United States Patent 7,365,185 (GENOMIC PLANT SEQUENCES AND USES THEREOF) - sequence listing, part 99

SEQ ID NO: 85926 - DNA, 5356 bp, Oryza sativa
tgttcatgcttgtttaagtgttgttttggtgattttgttcttttctctttagattccgacgttcccggagagtccgattttacaggggaagattttgaagagtttcaaggccagcaaggcaagtcacacagatcccaaacaaccctttgagcatgttgatcatgtttaaagctattgtttttattcaactactgcatttatttttgaatgtcattgggtggaaataacctattgttttgttatagccctttttgttcttgattaccctattctttgataccttgggttattataacttgactagttgagctttatacattggttcagctagatattagatataattgcacactagtgggataacttatgcttcactattatttaatgatggcttaatgatagctcatgatggttaatcatgattggttaagtaattaatttgccaactaaaacctgataatggtgggttgtgagcatatggttttgatggttgtgctcatgacaattaaggaccggttcacgattttcggttgtgaaacatttaccgtgccatccacaaaccagcgtgggcaacggctttactttctgtatagtatggttcatagtagagcaccagactgtgaagtggcggagataagcccaccggggtcgctggggagtccataccttgtttataagggggtgattatgatccgggaacggtgcactgctttgaattgtgttatgcaggaggtattgtcacaatctctattcgggtacttgttaagtatcgcgacgcatggttgacatgatgttgaggttgtgtcttgtgggtacagtggtacacctctggctagagtttaaactattcgaatagccgtacccgcggttatgggcgggtctaacaatgtctttcgtgattagtttcacacctctcaccgtaataaataatgttgtaattggtaataacttgtttagctcctggtttggaatggtatattcctggtttggagatagaactgtgcagccgggattggttgttcagaatggttgggcctatgcaacacgggtgtgttgtatagtgttgatttaatattgtttaattactcaactgttttattattttctcaattgcttattaaatgctgtttatgcaaatgagactatattatgccatcctttgttatcctgtgcacttgcatatttgctgcgtggcttgctgagtatgtcatatactcaccttgcaatcattcatcagaggaggagttctacagtgatgctaatggtgtggatgattaggtgtagccctggtcaagctacctgtgaagtggagtcgcctgcgctgtttattttattttccgctgcttagatctttattgattgagaggaactatctacctctgtaatgacattttatacgcttattaattagagtaataattgtactctattatcaatttgttattgtgtgcctcggctgattcctggacgagggttcacacacatgtaagcgtttggaattttggatagaaattccgggcgtgacacccggtgtgactggcaccaaaaccatttcaccatatatctctaaatatcagtatcaattatctctcgtgccaattgtttatcatgaaataataatcaaaacacactttgatttcacatatgccaatgtgtattaatgtttgtggaaagcaaattatcatttgctgcgttcagggagctcactttgggaacttttcccccacgcacatttaacggagcaactcatttgcacatgtttagctaagtatcagctaaaatggattttttaaaaactatgattttaagcaacttttcaagattttttttttcaaaaatatacaccttttagtagtttgggaaacgtgcgcatggaaactcacatgtacgaacacagcttaagtggtattaacactacaacaaaaacctcgtatagaggcacttttgtagaggagttttgcaaattgcttctaagatcataagttttatagtgtagagacacttcaaaaattatctagaaaacttttactctagagacaattttagctcagtttgttagatcttatcttatagaggcattctttcggcactataaaatgcgtttaatatgtaaaggcattttgttgagacattttaaactatgtagagatactttttagaatgataatgtgtaactaaagaaacaaacatacaagtaatgacatggaggtgagttggttagtgcattgaagattaaaatgatttaaccaagagatcaaggcttgacaaaagcaaggatattattatattctcttttttggactggttttatatggttgtggtacaatttaatgtctctagaaaatgcctctacaatcttatagacattttataaaatctctcttcgtttatagagagaattcaccataagacacttattattagacatgttttaaaatgcctctatattgttgtaaaggcatttgaaaagtgcctctattatactagaaaaatgtctcttacaaaacatttttcttgtagtactgtaacattaggtgctagtagcagtttcactgccgattatgcacccggagattctaaagcgggcagcaaatagagtgttgtcacactactacagattcgatttttccatgtagtcaaaaccgatttttccatgcggaggtagcgcccatctgcacctaggtgtttgcaaaaatcaacattatcgcgtgcgggcagcccaaccgcacaggatactctattatcccgtgcggccgggttacgtggactgcacgggataatcgattatcccgtgcgatcgagttaagaggacctcttgggataatagattatcccatgcgttatgttaagtggaccgtacaggatagtagattatcccgtgcagttcagttatgtcgaccgtacaggataatctattatcctagtcggctagcatgtgctaggccgaccgcacgggataatagattcgtgcagtcaccctagcaattgctaaccgtttgggaaaatgtacgtactcattattttttgtgtatttttgaatcgtaaagttacatataaattatacaagcacaattagaaacatcgatatatatatatatatattacatagcatatgtacatgtctagtgttcataatattaaaaatagatgttttttattctattgcatgttctctctcccactcccttaggtttttgaattgggggtccatagcaagttcgctgtaagggtcatagaactcccttggatggttgcggatgttgcaacgaatgaaccggcataagtccgcgcagatgttcagaagcgttttctggtcgaaccagtttgctgtatatgggatgctcggaagctatggaaaatagaagaaaaatgatatgtgttaaaagcgacttaaatgaactatttcctatatgtaaggagcatgatgacttatatctgtaaactcagttatgtatctcccacggaccctgagcatctcgcacacttaatatccccataggttggtactgttgggttgcttgtaacactgcgtaagaacagtagacacgtcagtaataagaacaaacaattgcatcatatacttaacgaatatatatatttgattacataccggccagcgtccctttacgagaagtcttgtcctcttttgatcctttacgaacccgccatgttttctgtaatagtcgtgttctctacaaagatgaaatatttgattgagctaactttatctttgatcctttgctttcttcctcttgattgccttcttctataccttcccgaacacgaccttaatcttcttggccatgtcgaagacttgtgcaccagttcatgcttcaggaggaagatcgttctctacggacttgtcaaataagttggccatcttacgccacttgtgcctctgtggtaagaaccgacggtgacgcatgtacactgtcttccttgaggaggtgaggtacctgtatgacgtgttgtcgatacatataagacatccgaacttcctcttaagctatcctgggagccaaaagttaaccggcaggtcgttgatggtaatgaatataatggcacgtagagtaaaatgctccctacagtactcgtcgtacactcgtatcccttctttccaacgcttcccaattgtcaaaccctcatcttgtactagctagaacctctggttcaacgtgccacaacatatcctccagatcaaaatcaatatatgtatcatctataccagagccaccacattttgggtgaagatgcacttaaaccccctagtgggttttggtgattaatgacaatgtggttaaaggggactaacgtgtttatcaagtttattcacaggagtttagtcccaaagcaagttgtgatgactaagaatgcaaggagaccccccaattcgaatgttcctaagtgcgaaaatcgctgtaggtgattagactaggtttttcactttcgaaattgagtttaggaaaaaccgtactattaagaggggtttcaagtgtggttctatggtatacaaagtgctcttagtcatatccatgagtcaaaagatttttggaatcatttttgaaaaatgattttctccccaggacagagagggctacccgaaggttctggccggaacttccgggcgccgtttaattgcaaaaattttcctaagtgctgcccagaagttcctagcacttgcccggaacctcatggcaggtttccagttcaaacatgtgagtaacggctagatgacatcacctagccgttataaatatggatttcatccccaggtcaccctttggccattccacttcagttctttcatgttcgagggttttctagccactcccaagcttcctttgctttctccactcaaatctagagcctatcttgtgagattgagagattagatgagagtgtaggagtgttttggagatggcttgaagattaggtttgattgagcactttggataccttgtgggctgtcacttgggcttattactcttggagatcttctcctagatggttaggtgtctcccgtgagcttccaaagatcttgtggatgtcgtaggaaagtttgtgaagtttttcctcacctccgcaaggaaacgaggtaagtgagtaaagattcttgtgctgagttttcagaggttgtcctaggtagagcaacttgcacttgtggtcttttctagaagaaattttgagttggatcttggtggtctctcaattctagaaaataacctagaagtgttgagttgaaggctgtggacctcttctgggatctttgcataagtgagccaaggggttaatcgagacccggctctttggagcacctcaacggagagtaggattcgtgtgatccgaacttcgggaa

SEQ ID NO: 85927 - DNA, 5209 bp, Oryza sativa
ttgcgttttgcctttgcgagaatgcttaatagaaagatatgatgactagagattgcgtgcagtccgctgaaacccagcgcgtagcaatgaggctgtcggttaatcatccataggatgagcctatggaacacctctgattaagctgcgcttttggtcatcatcttcaaaattatttgctcaccgagggttttgaggtttgtgtagatttaatgataactgtgatatgggtggctttgcttcgccgaaacctggtcacaatatattatcaccacatccatacgtggatcaggtatcataataaagcggatgacttttgcctcgtcggtgcccagtcatatataccggcctttattccagcttgccaatggctttgcccaccgcctcctctgttcccgctcgcagtgtgatgacgccggctgccacctccgctcgtagtcgagcgtggacgtcgacgaccgtcgtttcctcctctcccgtttgagtgcgacactagcaactgccatctcctccgccccttcttaatcttcctccccctccccctagcgcctccactctgcccatcccctcagccagatccagccaccgccgaggttggggcgccagatttggcaaggacgacaggccggcaacaggaggcctttcttggctcgatcgggggcttggcgacctctggtgcagtggtctggtgtgcggggacgtcaggaggtctcaccatcctcacagtacagcggatgcagtgactgtgtggtagggcgacaggaagggagacatctcagatggcagatgtcagtgaacatcttgtataggatctttcatttattttgcactcgaggcgttcgacgaaatgcccatggtataaacatgagaagttttatttctgtcgcgcccagtttttagtttctgatttctgttcagcagaaaaggaggcatgcagacaatccattgtggcacggctgatgatcctagagggacagtaactggagttctcttttgtctgtctagtctatctctggttttgagactttataacattatgtaatttgaaactatgtaatctcaggctacataatggatttggacttgtcttgttgtttagtcctctcgtagtgttctttagtcctggggaggttcataagtaccggggaggttctgccaatttttttattaaattttgacaacttttaacatatcgcattagttggcctgtttggtagagctctaactcctaaatttaacttcagaagttgggtctagagtggagttgaggtgctgcctaaaaccagctccacctctttagtttattttgtgagagagctccacacagttccgctctcattctaggtggagctgagctccagctctaggagaggtggagctagagctggacctgtgccaaacagaccatgtaagcgttaattaattaatgatctttgttacctacaaatacaccgataatcttattcatatgcaatactagtattaaattcctatgcagcacaggctccgtagcagtcggcccattagtcctatactcctattcgccaatccaccacttctcacaggtaaagcaccttttcttcctctcacattcgtcttcctcgatgcaccctctccttttcatttttacgcaatctttccttccgccatctcctttccattcactggcggccggctacaatcaatctccggcgagctcccactgcaggttctcctttcgcccccgtataaacctcccacttgatgcagcactccaacacactgtatgacccattttcatttctcttcatctggacctcccaaaagctcgactgcagccgcttggaaattgtgaccatggcgagaccgacagcggaccacaacaacgaaggaattttgaggtggcgcgacatggagagataagatgggggagcactggaagaaagcgtcgggacttggggagaaatatgcgggcttacggcggcaatgctttacccattctaatcttaccccttgcaaatggatggatgtgagtggtacctcgtggtacctggcacctcataataaaaactctcatttttttactctactttgctctatgttcaagtcagtgatctaagcataacgctgtaattaactatcctatataaaaactagatatatgttgattaattttgtttcactacccttgaaatcccatctccgtcctgtattcaatatttcgtatatatttaagttatgacatgaagtgaaattaagatcctaaagctctaacctcagtgtttcacgtcatcgtcagttctcagccgttggatcagtgacttgtatcgtttctcagccgttggatgaggaaaatgcatcactgtcagattgaagacagcccaaccatcatctcacacacagatagcacatgaggcccatgtaataacttggaccacgtgaggcccatgtaataacttggaccatgtgaggcccatctgtgtcgatctaggcccaatcaacagtgaaggagttagggtttgtttttttttttttttggctcagtgggggtttcctcatggagttagagtggtggcggtggcggcgcttctttccatcaacggtgctcgggaccgtagcgttagcttctcctattctaaaacatctttcgcttcaacttccctgttcgactcttcatctccttagcaacgaaactgacagccacctccttcgctaataaaagcatgcaccaccaacgattattcttagcgatgcaagcagagctgcgtagccaagcgcctgcttgcctagatcaactattgagctcaggtagtcaggtaattaatcagtttaagcatgtcaggttaatttctttagctccctctcactctctcaacattttcttttaatttcatggatcccaatttttccttttttatttcttcttattaatcacacaaccaattcaaattcgacaaatttaatgttgttaagtagttcttgttttcactgaaatctctgaagttgttggaagaaatcagtggaccgaccaagattattactgtccgcatcacatctgatagatagtttcagcaaattctcggtaaaatgctttagcagtgcagcatgagtggtaagaagaaccacatctttttcgaatcatgatatttatgtgtttctatatattgttatggtcttagagctgttggttgctccaagtataatttttatatgctccacaaattattgccttcattgacaatgttttaatatacagcttattactctgagggatgagtggtggtatgatatgctgtatattttatctgtgcagggcactttttttctctgaatggaccataatatctgttgagatattgcattcttactcacctgttcataagataaattattgcatggaaccatggactgaatcatatatcgtgtgctctatgcagtatggacatttgctaaaatcctactcaatttatggtgtaatgtatatgtagctcctgtaagttcttcctagatgaattctgaatattaatgtttgcttcaaatgtaatatagcgttgacagtcactccattcttaccttaagttataaatatctcaggctcttactttctctgttctgctaatacaacttcgaactagttatctatataaactaatttgttgtaatagccacagcttccatattcttaatttacctacctgctcttttatagaaaaacaattgggaaagcccctcttgtatattaattgtataaagtttattttaatttctctaccccttatggtttacatcttttgctaaccaaataggaatatatattaatgtacttcaactggctattttttttattattggaatagacatttctcattgatgtttatattattttatatatattacaattttatgactgaattgtatacccaaacatcccgcatcaacgcgtgaggtgtcaactagttatacatatgtcagggatctctacagtttactctgcggctcttcctttagtctcagatccgctgctcccgacatgagctgcgacccgctacatcgcaccactcgtacggtttccaccggcatccaccacacaccacaatatggtttgctgaccgaaagctgcaaacaatgtactcccatcagccagctttgtgcgcatgatgcctcaccatggccggcactcacaccgggtaaggatggtgctcagagtcagagatacttggcaactcacactctcgagtaaccacggcagctgccacagcgagacacattagaatgtcagcactactagtcactatggatgtaatgaaaaccttcgaattatttttcttgttcggtccacttcttttctgatgcttcctactcccatcacatcacaatgcaagacaacttgaagaaactagattctcttatatatctacctctcccattgtcttgttgattgttgctcgcctgctaattgctcctagttgcaacgacgagagcccatatgtattgtagtgaagaaagatgtatatatatacccaaatctggagggatgtatgaaagagttggacaagctagttattgaagatgatacaaactgttatgtcctggatggttggtaggcaatttttttctgtcgtctgcctccagaagtattttaaaatttaaatagcaattactatcaccttttgtttggaattagtatttaaatttggacatgtcaagacatatgccataatttattttgccttttgtcccatataactatgagatgaagatttccgagaaaacaaataggggcaccggcctagtactacgaaagtaactaaagggctcgatgcttgaaaaattaatagtatatattcatagttctataaaacaaaaaagagtgtaagtagataatatcaagattctatatgcatttctacgactgtctttgataaacaatgtggtcctaataacttatcgatgagacaactccattgatatgtacgtagtacaaataaaatatgttttccttagcatgtatgccacgtcatgtagctaggtagatggaaggagtactcaatatcctaaataattattgttcctcaagagtatggagtttctaaacagcccatcatgaccttctgtcactacaatcctataggtgccggttgggaactggctataagtgccagtttcccagctggcatctttgccttaatcttattggtgtctgctttaaaaccagcatctatactattaaaaa

SEQ ID NO: 85928 - DNA, 1785 bp, Oryza sativa
  unsure (1)..(1785): unsure at all n locations
ttagtagcttagcgccaatgcggttggtgttgagcccttgccatgtagacgaggggattggctcggctgccacattggcaagggagtcggcgctgatcagtgtaacctcagcgcaaaggcggttggcgttgagccgacggtctatttttggtaagtttttttgcacggtctagctttgaaataagtttttgaaaggacctatttataaaaaaaatagggttagattggtgtagttctcatgtagcttagctgaagtacaatttgtgaaatacaattttctgaaagccaacatgctaaaattaaattacaaatcctaatgtttttcacttaaaaaatacttccaaaccatagaaaatcccccatgccgagtgatgtttacaggccttagggaccattacacaaagttttgacatgtgcaataattcaaaaacatcatggatctgaatagcttcctttatttttttaaaaaaaaaagaatctaaagggggcatgcagtagtagtgggctagaggcaagatgtactgggacattatacaagataggtgacatgcaagtttccatgtagaaaaagtgaaagccattttcttggattttaataaaantgacacttacttggcnagtgcaccatcacttggaacatctgtgacacatcaacaatgtcattagctgttgttgcgattttcactatgtcagatccaactgcttgtattctagccacaagatctgcaagctcttcgcaggacggagtactttcataattgtgtgatgagacaataagtttacacttctctggcttactgccagaaataaagctgataaatttgtcagcaacctacaaaaaaaaggaaagttggttacaattgtgtgcatgtattccaaatcgtgaactcaaataaatgaggcatatgggtgtacatggcttgataattgaggaagagtaaattattttagagtgttttgctaaatgtttgtcttaatccagttataaacaggccttgtattgtgttccagaacatatgacataagacgtgatagaataacaactgaaaaaaaaatctgcctgcaagattattagttagagctaccttgtattattttcattttctgggctagtcttactgtctcagacagttaggcgttccttttttctgttgtgagacgttttatttgttagtttgctcctttgttaatacaaagatgcacaaatctttcgtgatttacctaaaacaactggaaaacatgaactgtgcaactttaactctatttaataaataccaaaaaaattacaatttcattccagagaagcttagaggaaatcacaggacactaaccacaaattgagcataagaaggatgtattgagcattcattatcaattataggacatttttcaattaaatttcctcatctggagttatcttttagtgtgatagccaaatggcagctaaacactgaagtatataaaagaatgattggcaaatggattccatctgaagttaatggtatgattaatctactggtgagcaataaaattgaatattaaaagcaatagagatactaacatagtatcatttagaatgaatgaacaagtgcccatataggcacctccacctgtgaagctataatgtgcttttccaaatttaccgagaactcattttcaaagttatgtgcagtacatacacaccacattttcatgctcaaatcatttgtattgtggagaacagaaaaatgggggaaatgattatgtatattgcacaatgtccagtgcatgcatttacaaaaacac

SEQ ID NO: 85929 - DNA, 4345 bp, Oryza sativa
caaaatttcttcaaaaaagaggggaggtcatgccaaaatttatagtgaatttacttcggtgattatatacaaatcggaggtgcctaaaaggttagcaacttcatcctccaatgttttttttgtcatattacatttggagctatgttttgcacacttttttatctctaaaattttgttgtaagttgatgagagagaaaatttgtgtgggaaaagaaagaatatatagaaattttgtttatttgctaaataaggttttataaaatatttgagtaggaaaatatagtgaaagttaatcttaaataaaagaaaacaaactaaattgaaaattaaaagaatttaaaacttaaaaaataataaataagaattatttggtggaatattttataatttttgtatgaataatgatatgtcattattgtatgactgttgaaagagtttgtgattattttatcattattgtatgactgtcattattgtacgaattattatttgtgtacgattttttttttcatttcatgtagatggatcggcaatggatgtacgctgaccggcggtccaaagagtttattgacggcgtgcattattttttgagagtggccgaagctaacaagtagaagggttttatttgttgtccatgcaataagtgtaagaatcagaaggagtattctgcatccaggactattcatttccacttgtttgagtcggggttcatgccaagctataattgttggacatcccacggagagcaaggggttgaaatggaagaagatgaagtggaagacgacaatattccagactttgctcagtacgctggatttgaaggaaatcaaacgggcgaggaggacagagaagctgattataacgatgttgcggatgatcttggtcaaatgttgcaggatgccaaggaggactgcgaaagtgaaaagggggcccataaattagacaagatattagaggaccacagaacgtcgttgtacccaggttgcgagcaggggcacaaaaagttggataccactctggagttcttgcaatggaaggcaaaaaatggtgttagtgacaaggcatttggcgatttattgaaactcgtcaagaacattcttccggagggaaacaaattgcccgagacaatgtacgaggctaaaaagatagtctgccctctaggactggaagttcagaagattcacgcatgtccgaatgattgtatcctttatcgcggtgaggagtacgagaacctagaagcatgccctgtttgtaaagcactacgatacaagattagacgagatgatccaggtgaggttgacgggcagctaacgaagaagagaattccagctaaggtgatgtggtatttccctataataccatggctaaggcgtttgtttaggaacaaggggagtgctagaatgatgcattggcacgctgaagaacgtcaacaggacgggatgctgagacaccccgcagatggttcgcagtggcgaaacatcgacagaaaatttaaagactttggaaaggacgcacgaaacatactgtttggtttaagtacagatggcatgaatccttttggagagatgagcagcggccatagcacttggcccgttacgatgtgtatctacaacctccccccttggctatgcatgaagaggaagtacataatgatgccgattattattcaaggccccaagcaacctggtaacaacatcgatgtgttcctaagaccactggtcgaagattttaaactgttgtggaagaaggaaggtgtccccgtgtgggacgaggacaaacaggaggagtttaacctacgagcgctgctgttcgtaaccatcaacgattggcctgcacttagcaacctatccgggcagtccaacaaggggtacaaggcttgcactcactgtatggatgaaacagaaagtatgtatcttaagcactgtaggaaggttgtgtacatgggtcatcgtcgattccttgcaacaaaccacccggtacggaagaaaggcaagcactttaaacatacggcggaccaccgtacgaagcctaaacatcgcagcgggaaaacagtgtttgatatggttaaagatcttaaagtagtgtttggaaaggggcttggcagccagcctatagagagcgaagatggtcacgcggcgatgtggaaaaaaaaactccatattttgggagttaccctattgggaattcttggacgtccgccacgcaatcgacgtgatgcacctcactaagaacctttgcgtaaaccttcttggcttcctaggtgtatatgaaaagtcaaaagatacactggaagcacgtaatgatctgaagcatatggaacaatgcggcgaccttcacccggaaccacaggagaaaggcagccattacttgagttcagccagctacactcttagcaaggcagagaaggaaagtatgtttcaatgcttggagagcatcaaggtaccgtctggatactccacgaatataaagcgaataataagcacgaaggagaagaagttcacaaacctaaagtctcatgactgtcacgtgttgatgacacagctgctaccagttataataaggggtatcctcccagacaatgtccgggcaacaataacaaagctatgttatttcatgaacgcaatttcgcagaaggtcatcgatccagataggttagaaacccttcagaatgatgtggtgcaacgtcttgtcagctttgagttgatatttccaccttcatttttcaatataatgacgcatctactttgtcacctagtgaaagagatcgatattctcgggcttgtgttcctacacaacatgtttcctttcgagaggtacatggacgttctgaagaagtatgttcgtaaccgtgctcgtccagaggcaagcatcgccaaggggtatggaacagaggaggtcattgaattatgcgtagaatttattgaagacattcacccaatcggggtacctgaatcacgccatgaagggagactacggggaaaggggactctcggaaggaaagcaataatgacggtagacaataatttattccgtaaagcccatttcacgattttacaacaatcttcattggtggctccttacatcgaggagcacttggctctagttcgcgccagaaatatcggtaagtccgatgcatggattacacggcatcacattgatactttccccgcatggctgtgacaacatctcatgggtaacgagacgattaaccagcaactggccttcctggcgaggggtccatctggctcgatcgcgacattccagggatatgagatcaatgggtacacattctacacaagagcccaagacatgaagagcacgaaccagaacagtgctgttcgtatcgatgcatgtgacacgatggtacaactggcacgtattacggtgccatcgaggagatatgggaacttgactatggacctctcaaggtccttctgttctggtgccaatgggttaggttgattggtggaggcgtaacgattgatgacagtaggatgacaacggttgaccttaacaaggttggatactcggacgaaccttttgtccttgccaatgatgtaacgcaagttttttacgtgaaggacatgtctagcaaaggaaagaaggacaaagggcctgacaatcgaagcgccacgtggttctcccaagcaaaagaaaaatcgtcggagtagaggacaagactgacgaggattacgatcagtttgatgggcaaccccctttcacggtgacggttgacactagcatcctcctatcaaacgaagacaccccttactcacgtagcgatcacaaggaaggaacaatagtgaggagaaagtacgtgcggacaaccgtcactgccgtaattgttgtaaactattttggatgtattgaatatgctagttatatttgattaattacaatttttaacaatttaatatcatgcatatactaattatatacgattattagaatttttaaaagttttaaatcatgcatgtgggatttacatatgttagttacaatttttaacaatttaatatcatgcatatgctaattatatacgattattagaatttttaaaagttttaaatcatgcatgtgagatttacatatgttagtgacaatttttaacaatttaatatcatgcatatgctaattatatatgattattagaatttttaaagttttaaatcatgcatgtgggatttacatatgttaattagaatttttaatgcattatttactattttagaaacacatatgcaacgaaattcaatattcagtgctattaactttagtcccggttcttaaccctaaccgggtttaaaaaagaatttagaaatagcgggaaaatatctttactccc

SEQ ID NO: 85930 - DNA, 3087 bp, Oryza sativa
tgtgaggaacatggcatcatacatgagaggacgcctccctattctcccgagtataatgggatgctgaaaaggaagaatcgcacgctgactgacttggtgaatgccatgttggacaccgcgggactgcctaaggcatggtggggggaggcattgatgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccagacatgcatgttggtacaattatggagtctcgtgattctatcttctttgagagctttttcccaatgaaggatacacatagtggttcgaaccaaccctttgaaataattcccagttcaatcacaccaccaaaacaaactgaacatacacatgaacttgtctctgaggaggatgtcagtgaagctcctcgaaggagtaagagacaaaggacggctaagtcttttggtgatgatttcactgtgttcctcgtggatgacactcctaagtcaatttcagaagcatatgcatctcctgatgcagactactggaaggaggctgtccgtagtgaaatggattccattatcgctaacggaacttgggaggtgatagagctaccctatgggtgtaaacctatggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataatgtgtgtactatcgccatggtgggggtgagggagttattttgtgcttgtatgttgacgacatactgatatttgggacaaaccttgaggtgataaatgaggttaaatcattcttgtctcaaaattttgatatgaaggatttgggagtagctgatgttatcttaaacattaagctaattagaggtgagaatgggattacactcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagaccattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgtatcgaaggagatgggtttgagacccatgtgagttatactatggtggtaacccagtctatgtgatcggagatcccgtgaattagatcctaggaagaacaaaccattaataaactagaggagagtaccaatatatataccctctccaagtgaagatgcatatactctcgtgagctgcaaggcaggttggctatgccttaatgagttctgttggctttaattagcaaagatgttgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagtcgcttgaagcatgtgtggtggagagaagaggggaaacacacgcgcgcgctcgctcgcctcgcctcgcctggcagggcagggcagggcagggcagggcaagcggcgcgcgtgcactacgtacccctcgaatggtccgaaaaattggctcctcacccttgcgcagatgcagccttcttttgca

SEQ ID NO: 85931 - DNA, 1940 bp, Oryza sativa
ttttatggtatgctctatcataccatctcactttctgcacacatttgttttcaaacgtgacatgtctaattagttgtcacatttcagctttgcatggtgcataagcttggttatggaaactgggatgaactgaaagctgccttccgcatgtcgcctttgttccgatttgattggtttgtcaagtccagaaccacccaggagttggctaggagatgtgatacccttatccgtctagttgagaaagagaatcaggaatatgatgagcaagaaaggcaggcaaggaaggacaaaaggatggctaaggtacctctgttcatttcaccttccaagatctttatttcattgtttgaggctttatgcactactttgtgtactgttttgtgtagtactttcttcgtttcacaatgtaagtcattttagcatttcccacattcatattgatgttaatgaatctagaatgtgggaaatactagaatgacttgcattgtgaaacggagggagtatttcttaagagttaggacatgctttggtggttgccatgcttttccacaatgttatgcctgaagtgtggcatatacaatttgtggccattaacaattattgaccacaattgtggtaacatttagcaaaacaatgtgacactggtgctaagaaagcatggcacgccacaagattggcaaggacaaaacgctagtctaatacatatagttgaaaaatggccacttcatgtgtggcaacttgtggcaccaagtcatcaccaacctaatttcctgcaaatggatatatggcttttatagggctggtgcaaagggacatttgatattatgccatccttatgatatgagtggcatacattttgtatcaatctatcttgctaatctcctaatgtatcttctgttgcagaacatgacaccgacaaagcgatctgcgttaagggtttcagaaggtgaaactactccatcgaattctttcaagaggcgacgccagtcccttatggatgactatgtgggctcggtaagctaagctatcatctagtatggtgtcgtgaaatgacaagtcatgcacgttttgcaggaattttacatggtactctgtacttaggaatgcagtgctaatcagctgtactaatattttacagggaaggcgtaagcgaggttgatcgggcgttgcctgctgctccctttcaagcttgtcggaagtctgggagagctttgaaatgtgcgcgctatgtgatgtttaaagcctctaggcgcacttaactcatcgctgaggcctaactcagtatgatagtgtagtggtatataatactatatgttttctctgcggggatttcatgaccgctctggctagcctatgcattaggaatcagatgtactatggattatccaactttggtagaggtgaactcatcgaagctacccttttaaatccctatgcttatgttacattggccaaaagtccgctcctaatccgagtattctatcttccgagtatatcgtataaatcgctatcagtatttttcttttctggcccttgaaaatatattaccctctgttttataatataggatattttttaatctagatttatagtggtagaatgtgttttatttggtactatgtttttatgttatggaaaggatgaagtaatggtactatgtttctatattatggaaaggatgaagtaataggtaggcttacatgcatgtgcataagcacacggttatcgcgaaaatcttgcggttaccgtaagatataccgtggttaaaaaactaagaaggccatgtagttaccgcgagatataactgtggttaaaaaaactgagtaccgtgggtatggaaactaagaaggtcatgtagttaccgtgagatataaccgtggttaaaaaaactgagtaggccgtacggttatgtaaacctatgctgtgactggtggatcata

SEQ ID NO: 85932 - DNA, 6226 bp, Oryza sativa
cccgtaccgagtggtgaaggccgtctttggaatatcctcttcccgaattctcaactggtggtagcctgatcgcaggtctatcttagaaaacactttagctcctttcagttgatcaaacaaatcatcgattcgcggcaaaggatatttgttcttgattgtgacctcgttgagtgcgcgataatcaacgcacatcctcttcgtcttatcctttttctccacaaaaatgaccggagcaccccaaggtgaagtacttggtcgaatgtaccctttctgcagctgctcatcaacctgcttcttgacctctgctagttcgttggccgccattctgtacggtctcttgtaaattggagcggttcccggtgccaagtcaatccggaattcaatctctctcttgggtggcatggtagtaaggtcttcggggaacacttctggatactcgcagactatgggtatatcttccaatttcctcaaattcttcttcacggtgtccactgggatttccgcctcaatctgattcaaagagaccccttgctttggtgagtctggtgatttgtacactgctgtttctcccttctcgttggtcaaggtgactgtgcgattcgcacaatcgatgactcccttaaacttggtcagccaatccatcccaagaatgacatctaggtctttggattcgagaagaatgaggttggctagaaatggtgatctttggatttctattagcactgaagggctaaaactgactgaggttgagctatttcccgaggtatgaaccctcattggtgtgctaagctcttctttccttaacccatgcatcccgacaaacttctttgaaatgaacgaatgtgttgcaccagaatcaaaaagtattgttgcagggattgagttaacaggaaacgtacccagtacgacctctggtgctgcttgtgcctcctccgcagatgcgtggttgacacgagcctggataaaccttggcccggcacgcctaggcttcgggcatttgtcagcgaagtggccaagctcgccacagttgaagcaggaccctggttttgctccagtctccctcttggcttgcgcggacgggcctgactgtgccggtgccgttggtgggcgtggagctgcaccgcggttgggctgacctccatggtggttctgactgccactggcgccctggggaaagttgctagggttgaacgggcggtactggcggacgatcatggtggtaggtccaccctgctgcccgggagcgaagcgcggcctctggtgacttccctgaggtgccctgaactgagcggccttcctcttcctgtccatcttgttgcgttgatcatcctgacggattgccttgtccaccagcctttcgaaatcggcgtaatctccagatatcaactggttggttagctcatcatccagacctgctaggaatttttcctgcttctcggcgtcagtgcggacatcctccggtgcatatcgcgcgaggtgattgaactcatggagatactccgtcacagttctgttgccctaatggagtgcccggaattccctcttcttttgtgccacgaccccatctgccacctgcgccttcctgaagctacgacagaactcttcccaagtgacttcagtgcctggcgggcgggtggccatgtgattgtcccaccaagctgacgcaggaccttgaagctggtgtgtggcgaaagcaaccttctcctgatcattgcactgcaggagattcagcttcttctctatggcatggagccagtcattcgcctccatagggttggtggtgctggagaaggtggtggcctgacacgtagaaactctagcaacttggactgagggggagggggaccaaactactgatgctgctgttcggcgtgctgcagcatccgctggtgcatctgctggtgttgctgctgcatctgctgcatcatggctgccatcatctaagtctgatgtgccatcacttgggctagcgtcggattctcgggaagtggtggcggaccattgccggaattgctgttgggatgcacaccctcagtgcgctcttcgccgttgctgccctcacctgttgcgcggctaccattcctggtgtagaccatctggaggaaaagcagacgggggaaaagaagaaaaatagaggctcaaaaactaagctttattatataggaatttaaactgtaattgttctgatctgaattaaaacacttaaaaagcaagcaaaaatccttattaagacagccatatcataggcacatgatatcgaccgtcgactgacccacaagcaagcaacctaaatacacaaactaacaaacaaatgctagacagacgataaactaatggaaaatgagcctaatgctcggaacggctcctacggtcggtggagtcgaaggcgtcgtcctgctcgtcaccaggtccctctgagcgactcctggagcctggcagataagtctcgccgctgcccagctctgagccactggatctactgctgctgagatcgcagctgccactgggagtagcagacaaccaacctccgttgccactggctggacccctagcggctgatgctggagcgaaggagagagcagacgcgggagctgacacgtgaacgggagctagagctggtactggagctgcaggaactaccggagctgcgagcggaactggaggtgctgcgggagctgctgatggaggtgggttcttgggcgcaagctggatgcgcacgggtgcagtcgtggtcttgtggggcgtagtgcggatccggactcctcctggcgcgggaagaccctttaactgagcattatccctcttcaggcgcgctatctcgtccttcagagcgacgatcctcatgagcttcccatcattcaaggccttggacgccttgtgcaagtctgagtgcatcctatccaatcccctcatcacagcacacatgtgaccaaaggtagtgtcgttctcgccggctgtcggacggaaagtactgacatcatcaccgctggctcgacgagggtgaaatcggtacgccgtgtcgtggaagatgtagttgtggcgctcccgtagtctggccatcatcaggtatgctgcctcctgacaggcgtgatctgctgtgcctccggatgcctcaaccaccatattagctaggcaggtacccacgtagccgtgaacctccaggcgaacacggtgaggaagctcgccactgagcggtggaacagtcgtgtactctggcgcgttggggtagcccaccaccagcgtcatacgtgccaactctgccacaaagtcaatcatgccttctccgcggtggttgggtgggtggccggccatctagagaagacaaaggagtaggatcaatgcatgctcaaatccaaatttaaataaagcaataaaagactcaaataagagaatcgaataagagcaaaattttatgcatagatcgttttgcatgagagcgaataaataagacagactcacataacgataaaatattggggaaattagatacatactaataataacagtaagagcataaataccttgcaacccatgttcctgagctaggacctaatgcatttcacccattaaatcccaactgactgacgaataaatctcaatagttttacaaaaaccctggactgacttgttttgacaaatctcacttaaacgagcgaccaagatttttccccttgaaccacaagaacagatcccaatttttccggaacaaatccaattgcaaagaacatatgcaatgaaaaggattcagagggctcttaggtttttccatttggcttgtcctacggtcaaggtcggctctgataccaacttgtcacgcccagaaattcccgaatagaattccaagcagaatgtgcattaaaatccccgtccaggaccggccggggtacacaaacgacaatgttgacattcagatccacgtcttacaaacatcataaaagtcttacataaatgcagcggaaggaaagaaagacaacaggagctaagccttgactagaactgcagcgggaacaccactccacaggcatcctcgacggcacggacgaagcctactcctcagagaaacctccatctgacacatactcgtactctggggttgggaaaaatagagcaaaactgagtactacccactgtactcagcaagtcataccggaataggggtatgatgtagagaattataaaagaagagctagagtggttcatttgcataaagcgagcatttataaacagaagttgacagatttaaacagttgtaataattaattaatattaactatccactgtccaacgctatcccacgttgcaacaggcccaaccatccacctaaactatccaaattcaaaagattacactagggtgagactaatcacggtgaatctggttgaccgcccataaccgcgggcacggctattcgaatagttttactctgatcagaggtgtacaactgtatccacaagacacagccccacgacacgtttccgtgcgccgacatgccaccacaacataccggaaagaggccgtgacaagacccttcgcataaccccctctaaccaagcacaccacacctcaggtttcacccccactcctcgcaaggcagcgggcagtcccctctcgtgcctaggtgaatccgcaagccgcataggccgtcgcaggtcccatccaaactccatcacgcccacccttgcctggatgcgtcggctagaggaaagctacgttacaagccaagccgttgcttacgctggcttgtggtaagtacgataagttcttccagggcatcccgcgaaccggtccttaactgccatgggtgcgaccagcaaaaccatgcacccacagcccaccatgtgatttattttaattaaccaacaccaaagcggtggcactaatccaacaataccattagaaccaacagtctaaacattaataagattttccccattgtgcactagttgaactaagcatggctaagcaatccctagtccaatctctagtcatgttataaccctaagctgacgaagggacatggtacaacaatagcatggctatgacaataggtaaacatcccatagtaacattataaaacaatgcaatatttgaaagaaaacaatagagcatttgcaatataggatcaacatgttcaagtgacaagcatgacttgccttgctctgctgctggaggaacctcggcgactatttcgaagtacaccggagcgtcggaggaaccggaatctagcgacatacaaagcaaacattgcaaacaggctataagactactgaaacagggaacaaaaccatttttaatggattctacacatttttcttgatttactgagacttgaatgggcttaaacggagctcggatgaattagttatgaattttagagattcactgtgtttattactataaaagaaaaatcttaaatcatttattgcgcaatatattccaggctgacgtcatcaaggcggggcgcggcgctggcaagcgggacccgcatggcagtgactcggagagggaggaagggcgccgacaagcgggccccaccggtcagcggctcggggagggcggtccacggcggatcgggtccacggaccgggaaggagcggcgcgccacgcggcggccgaaccgatggctggtgcgcgcgggcacggcgcaaaccggcccggcgaccatggcgcgcgacggcgcggcacacatgcggcagcggcgcaagacggcggccggcggcgactggccggcggcggagagtggcggcgtcgcggcgaagcggcagctacgtggctaagcggcggctaaacggtgcgggagagagagagaaagaggaggagaggcctcaccgacaacgatcgacgacggcgagcgacggaggacgatggcgacagcgggacgagctccggagcctcctaacgaacaaaaggagagggttagagggagagaggagggtgcgagagagcgagggcgccggccgaaggcggcggccatggcgtcactcaccagcgcacgacggggatggggctccggcggcgaatctctacggaggaggggtggacgaggtggacctcggccgcgcgaacccaacggcggcgacggcgcggtgcggcggcgagtgtagcggcggctagaggcgaccggagtagcgggagaggcagcggcggatgggcgcacggcgcgggagcgatggggagctcgggagagggaggtgaaatggggaaaaagcgagagggagcgacgggg

SEQ ID NO: 85933 - DNA, 12474 bp, Oryza sativa
atcccttatattttgggacggaggaagtaactagtagcctatcattattagcattatatgtagtttgggtcctaaactatattagttctatgggttggattacatatacatcttgcccttgtggatttggcatggtgtaatatgctaacagaatctaatatgctaacccatcatgactacttgactagaagcatagaaatgaaaaggcaaaagatgaagaatgaacctgttatgtgtatttggcagctatctcacgcatcaggctttcaggagctgcaaaagcagattatcagaaagatgaaggtgtattagctaagtaggtccacaaaaaacattcgacataataaggtatatgatatataagttaaaagagcacaataccttcaataccacctgtgaaatgctcaaactgacccatggcttgtctgacaaacatctctacaccgctgacaactttaatcccacattcttctgcttctcgtagaagccgggtaactttcggggcatataccgcatcaaatacaacatcatagaagcttaatgctttctgcgaaaacaatggaatttataacaaatattgaggcagcactgagcagacagctatatcaagataatctcaaatgtaacaagagagtatgctgaggttaattctaaaggtggtaatagagcttccaagtatgctgttctggaatataacatggtgcatgcatgagcaagatacctttgggataggggtgccgtccacattggggtacattcccaatgatgtcgcattagcaaggatcatcccttcttcaggcctgaaagtttcaagctcggctaatctcagggcatgaccacccactgcagcagcaagacttactgctttttctgaagaactcaagaaaattatcaattacatgatgtactgaaatacgatcaattttgagctttataaccagatgcctcatatccagtttgaaacaagaattgatggaacaaaaattacaaaaaagatatacatattttatttgctaacttaagaatagttgatgtgatcagcatagactgctactgttgattgcaagtgcagaaagagttgtccaaataactacacaaagaaatactagtatttttggggtggcttatgcaatgcactttgacatgactgttccatgaacagtagcagtctattcgagcatagttgacatttagtactagaatgataatgcaagtgtagtatattcagtaaacaaggtactctaccgttttcaaaatacagggcttatttaggacgagaatactaagaaatgtatgaaataaagagaaagaagataaaatgagcatactacccatacttaaattgattcgaaattcgtattcaagaagaaaaaaaatcaaaataagagagtacttagcgagagcattgttcaatctattcgacatagatgacatttagcagtagaatgataatgttagggagaaatgtgccaaatagggacacagaagatatatcatagtaaaatcacatgcaggctttatatttcgagagaaattttgtgaaaaatataggcaccatcttttcaaaatggagtaattacccatcttggataataaaaaatgcatgcgttagtaatacaagatcacaaaagttagacaatattctgcatccccgcaaaatatatatattgtgcatacatttggttgagatcacttgccagagtaacaaaacatgaatgcttatggccataactgaaagacccactatgtcggagacaatagtgctagcgtgctacaagcctctgggaatccagtagtaaatatgcttattcaaccagtgacattaatcattccactccaactttactcaaaattggatgtacaataagaaacaaatgaccaaattccagtgagttctactcctaccttagagaaagttaatgtcctaagtctaatgccaagaatgcctgatcagacgaatttttcttgtgtttttttctgttatggattgaatttacaaatttgatcttaacgtgaaaacagttgacaagaaaatatcctgaggcttatatacaggatgtcaacttaaggatcaataaagagggagttgatgtggaaaatagaatagttgtataggctactaccaggacacaagttctaaaatgaaagaaatgcaaagcatcctgagcagtaaccacccttttagatagagataggaaatagctaactagtcaatctaatccaatctctgactaaacagccatcgtgaacaacgatgcagttactgttgacctgcagtaccgcagaccctaggcaggcctattgctgctttggaccttaatgggctgcacatgacattcacccttcgcgtgggtactgttcacgtgtgcaatgctgctggcctagagtcattgaccagtgtttctatctggccctagtgggctccacatgactgataaaaacatggataataaaaatgagttaatatatcttcccagattgcatgcattaatcattggctgagggagtgaggagcatagttcagaactttatatcacaaaatgaattctttatgatttgcacatgatgatagaattaggtaggcacagaaattgcataattacagacaaagaatatttggctcagaaacacaatcttaccgtaggtacgatttgctactacaactcttgcacccttctcctttgccccataagcaattgccttaccagctccaccagcacctacaacaacaacaagcctgccagccaaaggtgagatggcagcatcctttgatcctgggcctgtgaaacataatttatcagatatttttccatgactcccaaaaaagagtaaaaaaattgctccagaattacgattataaaaacctcctatgccatcctcaatagcagaaattgctccaatgtagtcagtattgtagcccactagtttgccatctggtctcctaattatggtgtttatggcaccgattgactgcagattgaagaaaatatcaaaggtcaaagaaatctgaaaatggtaattaaatgaagcaattagatcaagtgtaccacatcaaggtaccttagcaactgggtcatgttcatggcaacactgtacagcgtccactttgaaaggaagagagcaactgcattacatttagtcatatagcatgaactcagatttgttcttgtgaaataccccctccagtcgggaaaacaaaacatgttattttgcatatgcatcaagtcaaatctctactccctccatcccaaatatagctacctttagcattcaaatgtcatcccaaaatatagctatttctccaccgacttcctcacctcaaccagtcacgaccaccatctcatttaatttcttcacctactttctcatctcaactaatcacaatcatccctcactttactttaattttctccttaatatccgtgtccaactataaaagtccttatattttgggacagagggagtaacgctttgtgcatttctatatatacataaatacatccatatatacatttaaatatgtattatattggaacatgggaatcatatttgtagatttgtctaaaaaagtgcttccattatattagaattttattgtaaacaatagaaatattgaaattgaaacgagtcgtcagagttgcatcttagagaccactgtatattccaaattgatatttttcatgccaggaggggagtatgctaacaaaagtctttccacgaaaatgatttgttgcattcagagtttcagacaactggcctcttgtttacccccaaactaaaatgtctattttgggctctctcccagattgtgcagagctatgcacagtaagtactctgtaaaagtttggatataaagagaagtgagaaaaaaaacacagtaacaaaccaatacagagggtcagatattgcatatcccaacagtgttgtacctttgtctctttggctgaagaccagagctcagatcctactaattgtggattgggtgggttgtttgtgtgaatttttcactttgatttctgggatttgaacatgtgacctgtgggttatctgccaatagatgactgttctaagcaactattcacctcccttgcgatcaaagaactgagaggaaaaatacagatagctaggttttcccattaaaactaacaaccattaggtgacgtttgtatgaataaggtaaagtgtctaaagaagaatccagattgggagtatccctcgtgtatgactcagaaaaatctagtccatccaaacgtttcaaattccaagcaatccaatagaatagctatgtaattttttctatcctctgaaattagtacctgaatcctgaaaaatccggagatgaatatgtgctgagaaatcgagcaaggtcatctgccaaaagtggaagataaacagcattgtatccaatagattgaagacatttattgtgcaaaattgggctcttgctctgttttactgggttggcaataagaccaagaacctttgtatcaggtcctatacgccttatattataaatgtccaacagttctttgacggttggctgcccaggtgctgatatctttgtagcatcaagagtcccaaaggttagatatcctccaaacttgggggataacacccttgacattaaacctttttcgcccatcactagtccaatcataggcacctgtcatttctactggtcagtcaaatggaagttaatacaacatggtacaaattaggaaaagaagagcataaaagtacaatttagacatactacaacattatccatactgttgtctacctcctactccctccggcacaaaacatagctacttatgcctttttttggagggattaaggttgaggtgggaaatggttgtggttggttgagatgagaaagtagttgaagaaatttaatgaggagtggttgtgattggttgagatggggaagtaggttgagatgagacaaatttgaatgatagaagtagccatattttgagaccgagggagtaataaataacaccaaacatgatgacataagaataagctaacaaacgagcacagctttgccaatgagcttagttttcttcttaaaattctcctaaacacataaagttttaaaagcttaattggtccgatatttcaatttgcatcctctctgcaagcgaccaattttatcactattcacatcctctgtgcaagcaaccaattttatcacaatggtaagtaatgattttctattaaaaattaatgatattatttgctttcactggtaaatagggagatttgaatatggaaagtacagtataacagaagggactgaaaaaaaagtttaatactacaggttagattggtgaaattctcatacagcttaactgaagtacaatatgtgaaatgcaatttcctaaaagccaatatgctaaaattaaattgcaagtcctaatgttttcattaaaaaaaatgacttccaaaccataggagctaggaagcatttcatacaaagtttgaggaatgtttactggcctgagctagggatcattagacagaacgatttccgtgtgaagtaatttaaaaacagcatgaatctaaaaggaatgcagtagtggtatcaagatgtacaggatgattatacaggataggtgacgcaagtttccagatggaagagtgaaaatgtatcttggattttatacaatgacacttacttggcagtgcaccatcacttggaacattcgtgacacatcagcaatgtcactagcagttgttgcgattttcactatgtcagatccaactgcttgtattctagccacaagatctgcaagctcctcgcaggacggagtactttcataattgtgtgatgagacaataagtttacacttctctggcttactgccagaaataaagctgataaatttgtcagcaacctacaaaaaaaaggaaagttggttacaattgtgtgcatgtattccaaatcgtgaactcaaataaatgaggcatatgggtgtacatggcttgataattgaggaagagtaaattattttagagtgttttgctaaatgtttgtcttaatccagttataaacaggccttgtattgtgttccagaacatatgacataagacgtgatagaataacaactgaaaaaaaaatctgcctgcaagattattagttagagctaccttgtattattttcattttctgggctagtcttactgtctcagacagttaggcgttccttttttctgttgtgagacgttttatttgttagtttgctcctttgttaatacaaagatgcacaaatctttcgtgatttacctaaaacaactggaaaacatgaactgtgcaactttaactctatttaataaataccaaaaaaattacaatttcattccagagaagcttagaggaaatcacaggacactaaccacaaattgagcataagaaggatgtattgagcattcattatcaattataggacatttttcaattaaatttcctcatctggagttatcttttagtgtgatagccaaatggcagctaaacactgaagtatataaaagaatgattggcaaatggattccatctgaagttaatggtatgattaatctactggtgagcaataaaattgaatattaaaagcaatagagatactaacatagtatcatttagaatgaatgaacaagtgcccatataggcacctccacctgtgaagctataatgtgcttttccaaatttaccgagaactcattttcaaagttatgtgcagtacatacacaccacattttcatgctcaaatcatttgtattgtggagaacagaaaaatgggggaaatgattatgtatattgcacaatgtccagtgcatgcatttacaaaaacacaaacaaaaaaaaataaagtagagcagcaaggtttaaatatgaaatttcttgtgtgtattacattacatgtattttcagaagttttttacacagtgtatcatgcactttcacaaatggtgggcactaatcaatttgaaacgctaaggatgcttacactattactgcatactaattgggaacagcgtaacagtttaacacatttatggaaacaaaccttcaattcaatatcaacatagtctacgcctaactccattgctaaacggagtgcttcaaatcttgtagcatcatcaccatcgtactggcctccttcccaattgggtctgcaaaaaaaacaatcagatacgtcatttatgcaaagcatagtgttgtaaactagtatacataagttagacaagtatgaccaactactacaaagtgggttgcaacattgtgaatataaaaaagtactcacgttggaaaaagctacaaaataaatcaactaaagctcacaaaatgaaaagataaatataaggatgggagaagcatataccttttatgtatattttttttacagatcctataatataaatattcatttctacaagtatagaaagctaattaatggccacagatacgctcaatcagtttaagtgtttaaccaaacgccggcttttacgaaaataagaaatgattgtgccacgtctcaatcagaagtgaacgaacagataaaaaaccttttaggttcttgggtttagttcttttcagattatttaccagattgttgaaatggattatttgctcaacacttcaaaaaatacattttctccaaaaaaatatactcctgatgtattgcttagaccacttgttttaagttatttgttaagtaaatttatcaaaatattttatttctccctatcatcaagtagattatccgcagcaacaatctgctcaataatctgtttcgaactgagccttggatggactcttttcttacgttatggtcatacttgaataaagtatttacaaatctacaaactgagtcagacaatatggcaaaagatgtgtctcaattttgggtacaatattatgcaggaatgaatttaggtttatacttttgctagttttaaccttccacaaaatttaaggatgtgttatcacaaattcataatagctccataatccaaaaaagaaacacatggatctaaactttctccaaatagttttctagatttagtagagttaacttttcaccaggttgttgcatgaggcaccagggtatcaatgcagtgtgaacccagcagcattccagcaatgacatgctaactgaaaaggtgggcagcattccattcaattccttgagatattgactagctcagcatgagattaagagatatgtgtgcttcactattatatgtttgctatgggatacgtccagtttgcccagtttacattcataaatatccagattggaccctctgctctaaaaccggttatttaaacccttaactttccgagtcatcaaagtattgagccatatgagtaagccaaatcatgccatgaatcaacaagttaactgaaatcaaaaggcatttctctgattctcgccctctcttttgtctcttttccttatctcctctctagtggatcatgcatcaatttgctggtttaatgcagatcaaaatgccatgtagcaagccaatatggaaaaacttgtggaattagcacctgtaagagaattccagaatatatagatttacatgtatagcgaattaacacgctctatacatgtactccctccattcttttttgagatgtccttttagcatgtacgtcttctcatctatgatcatgtgttcagtttgctgtccatgtattcaatgagccgtagtcaacccctttagctcgacatatctcaccttgaggacacctagggaccagcctagacatcgtggcgtcctggtgccccccatgtgccatgattgcatggcaaccatgtcattgacaactattggagtcatagatccatcaaaatggccaaggtctctgatacagtagttggaggactaaatagttgtctatagagcaaacaatagtgttgtgtttatgcaaaacccctgtaggtgggttggtctgtgatatacagtggttagcccatgcaatgcttttggattgctcagctaggttatggccttggttagtttgtatttggccctttactttgtggggaacctcaacaggctgatcatccccctttgtgcccctagtctgaccaaatgttaccatcaagcttgctacgaggatgatacttcttgatagttggtgtaacacttcaattggcaggtcataaacatcgttaaaaggaacatttttatataacaactcaacagatatgaagggaatatttaaagtcctaatgtcaaattaacccacttactatgaataaaataatatatctgcaaaaaaacatctaaagttgacaactaatgaactcagctggtgcacattatattgcaccagtattaaattctccacgagtttatcattatagtattgcttttacaatgtatagaaactaggatagtacacaaaggaaaaatatggaaaaaaaagaattggattatgataacacgataggcagtcattttcaaggttctaaaactcagcagctagtattcattcaatcacctcactgtggaatgcatatacaggaaccagccttgtacttggcattatactcaattttcaatttaaagtttgaatttatacatgatgtttatatggtatcagaacaaaaaaaaaatgttgcatcttttctatttatgtaggcttcaaaagctatccatagtaaaaaaacgcaagctgccaggtagaatgatcaaaagggggaatcacgacaataacgacatgaataataggagtcaatcatgtaattctaaatcagcgagtagaaataggactagtttgcatcaacagttcataacgacatgttaaatcagaatgtgtgatcagaaatcagcaagacagatcaaaacctgacaaaagttgattgcaagttttttgtgccacaaacttgttaactgacctggaacgcactaactacataaattaccgaacaaatggaccagttaaacctgttagcatactcgttttgcaatatactcctaaggaacaatcactcaatgaatcatccaaatctatcaacataccttttcaaaagaaaacatatcaattcgtgagttgaattaaaaaaaaaaaaactcgactggcgggggaatgacttccccatggcttttcattaagaagaagcctcaaccaaaccggtcgagaaaagccacgaaccctggccccccacacgcggactcaccccctatggatcagtccgtaacctgtgctttgaggcccctgctccctatacgagggcccgccataggtcaattcttaacacgtgtttttatgagaggccagtgagtgactttttttaactaggcctgaaattcgcttcatggggagtgaaacccaggacctacacgtgctacttgagcattattcattaggctacaggtccttccgtgagttgaataaaaaaaaactgtggaaggcatatgatgcaagtactcatttaatcaaaacattggatagctttctagaatattgatgttgtttctgtttattttatgtggtactgagaatttaatagttagtcaaagattaattgtgtcatgtgctctctttgggacagaataaatgcctccgctccagataacttgtttatatctagtcttgacatggctttaggtttcaaaccatggttatgctatgaatagcatgcgtacatggactccacttggagaacaaatattccatgttctaggcaacatatgctatgtggtcactcttttggatatgcaactgtcattagtgtgtgtattaaaattaacgtgaaatgtacagatttcaacttcaaattcactatcccctccgtcacataatataaggcatccaagaattcaaactttgtcccaaaatatctgcttcctccactcaaccacctctcacttaatttccacccaatctaacccccaaacaccttcctgctcccccccccccccaacagataccccctcatttaatgatgggcattatagtctttttcattcatccttaatctctccacaaaaaaaaaactagaatcccttatattatgggacagagggaatatatgttaagaccaaaagaataactgacaaatggcatgattgaagccatgacagacacagcagtcgtattcacagagaacatagcatctctatttattctaataaatttttaactgaagttgaaaaaattgacatgactgacatggctgcaatcatgcctgacatggtgcttgcgcagcggcctgcaagtttgctaacaattgcctgtgagccaacagtctccaaggacattaccctatcctcagcaccacaacctatcgtcaatatagttggtagtacatgaggatgaggtttgtatcttagagatggtgttaggtttgtaggtgagatttaaataagcaatgaataatcaatctatccctctaaggctgcgttcgttgcctctagttcccaacttccctttctcgttttccgcgcgcacgcttttcaaactgcttaacggtgcgttttttacaaaaaaatttctatatgaaagttgcttaaaaaatcatattaatccatttttgaaaaaaaaatagtaaatacttaattaatcacccggtaatcgctgctccgttctccgtgccagggattaattaagtctcccctgttcctccatgcaccatgtctcccctactacctcgacgaactaaaggtcgacgataatcaactgagattaaacattcacgagaatatacttgcaaatattaaggatcaacggcacaaagttgcaaatatccacctgccgaggggcatttctgcaatttttcacatcttccacggacttatctgtaattgttcacctccaccatttgtggatactcaattgttgttaatttttgttatgatcgggcggcctaaacggcgcggcgtcaaaaacaagctgattctaacggagaacacaaaatgcagttggctatgactagatgttgacccaaaatccatcccaaaaacgggggcgacgccacccaaaacaaagcaggaatcagctgaaaagcatcgaacattgcaagcgcacgagaacacacgtgaaagcatctgcgcacgcgctgcggatataccgggaaatggacgcagaatctggagcccgcctcctgagagaaggggtagagggcgagaggagagggggatctcaccggtaggtgacgagggcagggagagggcagccacggagcaggctcgggaggtgctcccgcgggcggaacccctcgatgaagtcgagccggatctcgacgaggtcggcgccggcggccgcggccgccgccgcgtcggcctgcatcgcctccaccgtgcgcgacaccagcggcacgcacaggagcgtcatctctcccctcgtccttcgccggcgagcgagcgagcgatcggcaagcagtgggggtgggttggtcaggctgggtctagcctggtggcgggcgggcgcaggtggaggggaggggtgggtggggg

SEQ ID NO: 85934 - DNA, 2163 bp, Oryza sativa
atcctatggcaccaggccattggagggttcatgacacactgtgggtggaactcagcaatagagggcatttgcgcgggcgtgcccatgatcacatggccacatttcgcagagcagtttttgaatgagaaatttgtggtgaatctgctgaaaattgggctggagattggagtgaaaggagtggcacaatggggaagtgaacataaagaggttagggtgacaaggaatgctgtggagacagcagtgtccacattgatgaatgatggagaagctgcacaggagatgaggatgagagcaaaagacttgggtgtaaaggcaaggagggctttggaagagggaggttcttcctatgataacataagcctattgattcaagaaatgggaaacaagcaaaatgcatctggttgatacagatgggaataagcattttttttaatcatgatgagcatgaagtggaggacctatcatacttatatcttcataaagtatggaagatgtccacatttggttattcaactatggatttggcctgaatttcatcccctctaactataaaggattgtgttttacaaatgaccagtatgttgtgtggtatgattctatggtttaaaataaacctggtctaaattgcatcagttgctcagtttctcagcagagttgatacattttagagaaggagtaaaaattaaataaaatagcgtttgtgcaacaccctaggccaaaatgctctcaaagtctaatctccaagtaatttgggtgtacgactggtacatcttacgagcatagaggactggtgtaaatttatgaaaacaatactttgccaattatatacttctttaacttttctgaaaatattgtatattatctagcaactgtggctgcttcataagatcatgcatcccttacaaacctccatatgttaaagcagataaacagaaatagactgtttttaagttctttaaagctttaccaagcaagtcaaatgcatgttttgggtcattacaatttcaaatagcagcctagcaaatggaatcaaatatatgaaagctgcagactggagaaaataaagcatacctggtttttctatgaatgaaacagtaaggctccatcagacatcctcctttgcttaatagcataacggcgcaccagattagctccagaccacaagataaatttaacattactgcaagaaattcttacatgaaaatctctgcaaagctggaaaagctccaagtgtaagatatcttggcaagtcgcatagtgaatcatgtacagcatgttagtaaaaggatttgttttaaaaataaataaattccatacatatcatatttcgatttttagctcataagaatctgaatgagaaaacctccttaacagaatagtctaaattaaggaacaacttattgagaaatcaggaaaaacttaatactctctaaccagaaaaaggaaaacagatttcagcatgacataaaagagaacatgtaaggttaccttcctttcaataagaactttgccagtacaaccatcagcgacagagaggtttacaccaagatattatagtgccttaaggagagcacaacatgtataggctaagctggattaagaatattctctcattattaacttcattccctggactaaaaatttgcagtcactgccacatttcaactgaaatgcttgttggtcatttgggttttcacttgcttacagatgttcagttgtccgtatgattcatatataatgtattaatgtgctaccacttaccaatagtctttgcatgaacaggatccatgtctaaaatgatggaagcgtgtcctatccctcacaatgacctctcttccatacaatttcgatatcaattttattgcgttgtggcagtccaaacacatcctcaagtttttcacaattcttatgataacattagattctgaagtgagtaaagcaaaagtgactgccaacttctcacttgtgccaagtaaaagaacccttttttgctttttcacttctttccggtgcacctttcaaaacaaagggacccccctttttccaaaaggtttttttttaaaaccctcaggcacatatccagcattcctcaaatcagttagcacattttccaactttgagtagatttctttattcataggatgagacctatcagcggctaca

SEQ ID NO: 85935 - DNA, 7110 bp, Oryza sativa
tcaacggcgtcaaacatttcgaaacggagggagtatatgacaagcgaaccatagcttgtcctatcaagttatccaatcaaataagaaattacatcaccacttttatataaaccaaacaaaaaattgaataatcccatccaacaaaagcatctatctcccatcgtatcttggcctccaatcaaatgaaaacaatcttgcccctccaaaggctccaaccaaatgagaaaagttattgactggaccatgaccagggttcatcgctttatgacataacaacatgtaaacactgaaaactaaagacaagtgtacttatttttcatctgatcattctgttttttaagatggtctcaggggcggatctatagtattagcatcggtgtcaggcaacaacgatgactttcgacaaaacttacggttaaactgcttatccatgtattattacattatagtctaggtataaatagcatgctatgacaccgatatacacattataacaccaacgaatcaattttctagattcgccactggatgatctcattatcttgtttgtacgccactcaagacagagatcggcaagtctgttattttggcgagcatgtcagttgaaactaggtccttataaattgccaccgctttacatcgaattgttagtgtcaaacaataatcttaaggcaattttaattttgaaacaatattgtttgaaaattctattgccaacgcacacccccacccacccccacacacaccatgtcgatgattgataatggcactgtcacccctctgcaacacgaatgtccagatgcaaggaggttgaagctgactttggtgcatatcgagtttttttttttgaaaacaaggaaattattataagaaacatagaacatgggttattttacaattgataggagagagtagacttctggcatgacagagtctagtagggtaagcaatatgagaaatatttggacagttaataacaggatttgaaaacagactggttctagcttctttagctaacttgtcagccaccttgttgattttccatggaatccatgccacctggaacaaattttcagctatgtctctttgaatttggctccataaaggtctgaggctccaatggcctggttcattgttgaagtctcttttcttgatcgtgtccgctattactgaattatcagttaaaaaactagtgcctgcaaagttgaagaatttggcaatctccatagctagttgcagtgccaccagttctgcctgcaaagaatattgagctacctcgcttttggctttaataaaagagatttgctgaagtatgtcaaacggtactaaatcattttcgatcgttggatctagctaggcagggtattagaccagagcaaatctcttaataaaaagagcattgtgtgtcatcggcatgtggaagaaaataccaatccctatgaaagtgttctcccaagctgcatctatataacatctattgccctccgaaatggtttccattcttcttttgttttcctcctcctgagattccacctgcaaattatgatttgtagagtatatgtatttatcatagcttctgccgcaaaacacaaaacacacttgggtcggctcctttaagatgccctgaaatttcagatcatttctggccttccaaagctaccacaagataatgaaaagatttatggatatcaattttattagtactattttttttagataaaggattataaattaacccggcctctacaccttttaggaggtgaccatttgaggaaatgtaagcaatgatgtgagccagagaaacattatcagggaaaatgtcagtagaaagatttgcttcagaaattctccacgttattctgctaaaggaacaacgaaagaaaagatggaaatatgtttcaggttgattgcacctacagcaattagctgaaatatcagaaattctgtgatttaacttttgcgctgaatgcagaactttctccgagcagtctccaagcaaaaactttaaccgtgggaggagtaagcttgtccttccagatgattttgatgatagaagtcaccaggggatttacctgttgaaagttatgaatctgatcacttttcataatctccttatatgcactcttagtattacaaattccattcttagaatgcttccaagttccaacaaagcaattcattatcattatgaatgatctggacctgcaaaattttgttcacagcttgattttcaaagattaaattaagtttctcaccatcccaggttttattatcagtccacaggtcagcaaccatggttgtgaatagggtcaagtttaatgaaatcatgaatatcagaatctagctcacaccatggttggctccaatgaatgcttctccgtggctggccagctgtatgggtgttagggtgtatggcacgaacaatacaaatcataaaaaaaaaaaagaggaaacaatattaagtcccagtggatgcccttccagtgcgtctgaattcatccgatgaaaccggtttgcagtgtgatcctcttctctttgctcattcatcgctgccttccggcttaaacttagtgtttttagtttgatttgacccaacaataaaccatgctgatgtgtcgatttttctaatatatagttaaatggacggaaacagtcaaaatcgacatctctccggaaatgattctcctttggttgagaaaattaatcatatttttcacttttattattcagtgctgacagcaataagatgctacaagaacatagaaaaatcaaattatatatatatatagaataataataataataataataaagaaaaatagtagctcttatacgaaaatgtcggttggtcattgaggaattttcatgattacctgcattcgtttggagaacaaagggagtttgtttatttcgttttccgcgtgcgtacttcccaaactactaaacggtgcgttttttgcaaacattttctatatgaaatttactttaaaaaatcatattaatccatttttaaagtttaaaatagttaatacttaattaatcatgcactaatggcttatctcgttttgcgtatcttcccaattttcttaatcccctctccctcaaacacagacaaaattttatgtagatcgtgcattctacaacttttatgtagttaagtagttagtacacactagagctcaacatgtaagaatgtcaaatcatcattccatactattttcatgatatttcaacatatatttatccatcatgtgtataatgtctaacgtaagttcatctatatatttcacacttgcatctagtttacatgaggtcaacaaccagaaccttgcgatgattgacatatatagtaataattgtataatgcttcttctgagaataacacttagtctctgcaattttcgctaaactatttgtggcagctggctttattggatatgcctatgccagtagttggttccagtattaaattgctataaaaatagtatattagcaaataattacatatatactacccggtagtcaacccttgtattcttcactactaaaaaaacattttttcatgcgatcaaaataggtttttccatgcggaggaattgcctgtctgcactagaagtatgggaaaatcaatattttcacgtgcgggcagctcaaccgcaggggaaaatcatcttccagtgcagtcaggttaagtggactgcatgggataccgcccacacgtaaaagaaaaacaaaataaaaaaaataaaaaatcctaaccctagaatcgcctgccgccgctcccggctgccatcatcgcgccgtcgccgcaccctgttgctgtcgtcgtgacgccgcagcgaccgtcgtctacgcccgagaccaccaccgtcgcgccggctgccaccgccattggatccgcacgcatccgggtgggggacggccgccgccgctggatacgggcaggggccagttgccgccgccgtctgtgcccacggtagagccacacggtgcctcgctgccatccgcgcccgcgcctgctggccgccactgccgctcgtcgtcgccgtgatcgcgccaccgccgctcccgattgagcccgccgctgctggcaacgccgcgaccaaccacctttgccgctagctcctgcgggctgcctcctactcctccttgtgcgatcggtggggaggagagggaaggagaggagaggaaagggaaaagtaggagaggaaagtggaaaagtaggtgcgtagacagagagagaggggtgagagtaattgagggatttaatataagggaaaaggaggagagaagttgaaaattttgaagtgagtaggagggaaaaggaggagaggtattttcgcgggcggttcagttaagaggcccgcacgtgaaaatcgattttcgcctgtgggccttttaagggtctgcatgtgaaaatacccttatattttcgtgatggttaagaggcccgcatgcgaaaatcgattttcgtgtgcgggcctcttaagggtccacatgcgaaaatgggacgccaatttatccgtgcgaacgcaaaaacagtccgtctacaatctaaatagctcctcgtacaggaaaaatccttttttagtagtgcttatgaatggcttgaatattagggttttatgaacttaaactgtatatttaggttgtagataaatacattttaaaatttactagaaggagcataaactgtaattcaagaaatggatggcttactgaatcgtttttccttctttattattagccctctatggctctatagtatagacttccaagattgtttaggtagtacgatggatcagtttctcagcgaaatctgtctatctcaggtactctcgagatcttctgcacaagctaaaaatttcacgtctacttgaattcttcaaatttgtataaattttgtttgaactactttcaaatcagttaacatgtgtctgaccaacgagatgagtctgtttagtcctttttcttttctagattatgatataaacgtaggattgaaacgcaagaactaagccaaccgaaggaggggggggtttgaatggttggcatacccaaaaacccaaactttatgcggaattaaaagttaccctcaaattcgacggatcgcggtctgaccgaagtagttgcgtcggtctggccgcctggaagctgtcggtctaaccaagattggaactctggtcggaccgccgagatcacctgccgcgcctgaagttgccgccggtctgacagccgctgaccccccagtatgaccgccgcgattccgccggtctgaccgctggtgtctcgccggttagaccgctgaacccgagaaaacacaaatcgaagaactcttaaagtagataacaactttattgtttctctctgtgtttacaagttgcaacaacagcacccctcacgaaaatctcgactaaacttgaaacactaactcaactctcaactcaatgctctcaaaaccgataccgggaagcctcacgctccctctctatttatacatgaggtaggcagcctaaaggcacgaacaaaactcctactagaagtcctaatccacctaggaaaccttctcgtacaagaaacaaactttacaaactccaatcataccaaatttggactccttccaaattcgactccgcatcccatacgcacacaataagtccatcgtatgccttatggaatattcaccaaccacgtgcattgaactctagcctaatgtagcgcccgttctgtcgtggcgcctagcgggaaaactatctcttaaaaatcctaattgcgaaatctgtttctttgcttgttgtctagtgtccgtgccatctcagatctcgaatccccgatctatcgtcaagttcaatcccgaatccaaatccttcccaaatcaaatccctccgcaaaagtctactttgcctccctcgggttcgatgggccgaattcctctcggcccatctctccctccctccccatctctctctctctctccccgctctgcccgtgagccgcgccaagccctcctccctctccgctctcgctgccgttcccgccgatgccgcccaaatcgccgcgccacccgggcgcgcgcgccgtggtggccgaccggccagtcgccgccgccgtcagcgcctgccgcgcctgccgcccgtgtcgttgctccgctccaaaccgcccccgccgtcatcgccgtcgtcatcgacccggcccccgccactccgcgcgttagcctccaagggacggaggcagagctcctcccccctctgtcgcgtcgcccccatcccctcctccttttccgaaagtggcaaggggcaagccccctttcttccttccttttcctttttcttcctccgccggcgtcattcccctcctccctgtcgccgatttggccgctagccggagcgccagctcactggcttgaccgtccaaagtcggttcccctctcccaaaccgacattgtcgcccatataaacccaagcttcaccccctttcctttcctctcccattcgcctccactccagtgtcgccgcctcccgtgctctattcgctattgccgttcgccgtcgtgcgtgccggaggagccggcacgagcgaggacacggaaggggactctgggcgctcgccttcttcctcttccccggcccgaggctggagagatcactcccgtgccgtcggcctctcgtcacagcgccccgcctcatctcggtagtgcattcccccgttctccctcctcgatccatctcttccccttagttttcggtagtagcatgtgtagccttcctgtagctagctggcgccgccccgaccgttgccgccgctagctgtgtgctcgccgccgtcgccgcccgtgctccatagcgcccgctcgtcgctggcctcgctcggcgtagctccgcccaatccgacgctagcaacggattcccatagccgcgtagatgctctcaccgccgggaatcggccccacgtgacctcgtcgccgtttccccttccctcgccgccggttgccgccgccgcaatccgccgccgttgagttccctccggcgaatccgagccgttggctcgtctcccctcgtcccatgcaaccccccggtgtgctcgctttcacctgtatcgccgtggttcgct

SEQ ID NO: 85936 - DNA, 6161 bp, Oryza sativa
cggtgtcaaacattttgaaacggagggagtatatatttctctcatcaaattataagcctctgagattttgttttatgtatgaggttttattccatctttaaagaggtatatacctattcataatttgagaggtaaaaattaaaccgattaaactgattagaaaacaagtttatgattatgcacctgcaacattattatgattgttgtgaggtatagagaggtatatataactcatattgttagtccggaggtgtatactcatttccaatcatccaacatgtaaaaataattttggtacctccttttatgtagggtaaaagtaaaggtatatcttaagtatgaagaggcatatacctcttcaagaatgggagaaaatctctttatgtatttaattgtaagatacaacctctattttttaatagatcatgtcaccgatttttaaataatgtttgaccattcatcttattagaaaaataatgtaaatatgctaaagtataagacatacttaaagtttatttttaataataaaacatgtcataacaaaataactgatatttgtataaatttcttgaatagtgtactgatactaaggtatatgcgagactacggtaaaagcaacggagacaaggtttttatataggctaagacaccctgctgataggtaatagcctactcttattgatcgaagccggtattaccattatatgtcaatatcttacaagtgcaatgacgtataggagaccataatctagtctatgtcagaatagtggcgtaaagctcgagcaggtgatcaacggttagctattgtcggctttcttgaacaggaacttggccagattggagtcgacttgtattgtcttgttggcttttgtggctcatgttggttttgtgatcgccttggtcaagatttgtaccctctattcctaggggtgttctatttatactcttagatgaccccttgtctaagcagaaccacataaacaagtgcagatactatctaagtaaatcttgtggtgtccgagtaggactctgtgtaggatcgaatcacaagaactaagccaaccaaaggaggggtgaatggttggtatacccaaaaactgaaaacttctagcagaaataaaagttaccctcaatttcgatgagatcggtctgaccggagtagattagccgatctgaccgaagcgtagtcgccggtctgaccggtgtagatcttccggttggacagccctggaatccctgccgcgcctgatgccgccaccggtctgaccgcaggtcacccgccggtctgaccaccgcgatgccgccggtctgaccactggtgtgccgccggttagaccgccgaaacccagtgaaacacaaatcgaagaattcttaaagtggatgacgactttattgattctctctgtgtttacaaagtgcaccaacagcactccttacaaaaatttcgactaaactcgaaaccctaactcaaaactcaactcaattgctctgaaaagcgatatcgggaagcctcacgctccccctctatttatacccgaggtaggcagcctaaagccacgaaccaaactcatactaagagtcctaaacaccttaggaaaccctctagtacaagaaagaaactttacataaccaatcgtaccaaatttggactccttccaaatttgactccacatcccatacgcacacaatacctccatcctatgccatatggaatctccatcaaccacgtgcatcaactctagccttagtatcccacatgatctctgaccaccacggacgtcgtcttatccccaagccgactcccggtccatcaccgcaaatactctcccgagacatcgagtcacctacacatgaaataaacaaagaaaccatattccgagaccaagctatctccaacttgactcattagtagcaaacaacagtattgcatacgtatagtatccatctagaagccataatcatgaaacaatcacggatatccaaacaaacaactcgaaaccgaaaccgacacagcgtcggccaatcagaccgtgggctggccggtccgaccgctcgatcaccgccggtctgaccggcatacacagcccggtctgaccggtcacataaaatgataaacctgcgatcacctatgaatccaatcatctccaaaaccacttcgtgaataaattctaaataacaaaaccaataatctccaatgccaattgttcatcatagaataataatcaaaaacacatttggttttacaatctcccctttgatgaacacattggcaaacctatcaaaaatgttttggtgtttggaaaaataaaaacaaaagtggtaaaaagcacacgtcgtacaaacgtacacatcgtgctcaaaaatccaaaagaaaacttctccccctttttaaaagaaagaaattcccaattgaacaaaaacatgctcttctcaacaactccgaaaattcaccttgcttctcccaaaaatccaaaaattttcacaatacttctcccccttttgacaatgatttcatccaacataggaattatgttcattaatgttcaagagcttagcatacatataatatatcaagtcatttgttgcaataaaaagaagataaacctatctataagataacaagcatgtattaaagtataaccataaaccaaagattttacaattaagcttgaatcaacaatcgaaattcatgatttcatacgatttataatgcaacatctgaacaagcacataggttgaagaataaacactaaacacatatacctattacatttatcactctttctcaaataacctttagcacaaaataaccaagagaattttttaactttttcttttcttgagccttttttctcatatttttctcttttattccgggtacgtccctgtcgtcaagactgtttctagggattcggcacccattattttgctcacatcgaatacgtccttgtcgtcaagactgtttccaaggattcggtattcatttttttcatattttttattctctttttcacaatgagcaattaaagctatttgaggaataacaattcaataaagcatatatatatagagcatttataaatcaaaccacatgctagcatcaacattgcatattttcttaattcaagtatagaatttaagtgtcatgcatcatctcccttaaaagcaaaatctaaatctcatgaaaagactagaatacatacaagctatgctagagacaaataaaccttcaaagtattgctagcatgcgcaagaaaataccatatgtataaacaaagttctcttttctcaattttttctcattgtcatattattgcttgataaaaccatgagatacaaactccccctcaaaccatgccaaaaggatgaattattcccaattcacaacgaagaaaagcaaagcgattatgatccaaaggtttatggaaaatatcagcaatttgcaacttggtatccaaaaactgcaattcaacatctctcttctcaacatgatccctcaaaaagtgaaaacgaatatcaatgtgctttgtacgtgagtgttgaacaggattcttagcaatattgatagcactagtattatcacaaaagagaggtactttctcaaaagtaagaccataatctttcaaagtagataaaagccaaagaatctgtgaacaacaactagcagcagcaacatattcagattcagtagttgattgagcaacactagattgtttcctagaagaccatgcaatcaatgatgtaccaagaaaatgacatattccactagtacttttcctatcaattctacaacctccaaaatcagcatctgaatatctacttaagcatatagaagatgaagtagaataccaaattccaaactcaagtgtatgattcaaatacctcattattcgcttgaccacttgacgatgtatgtctggcctagaagcttgaaagcgtgcacacaaacacacaacaaattgtatgtctggcctagaagcagttagaaacaacaaagatccaatcatacttctatactctttttgatcaacagcttcaccatcttcatcaggatccaacacagctgtagaaccaataggtgttgaaattggcttgcaattctccatcttgaaccttctcaaaagatcctttgtatacttcgtttgatgcacaaaagtaccttgagatgtttgcttatttgcaatcccaaaaagtacgatacctcacccatcatgctcatctcaaattccctgcgcatagtctcagtaaaatccacaaccaaagcgtgagttgaacaaccaaagatgatatcatccacataaatctgaacgaacagttgattatcaccatgcttaagaacaaaaagcgttttgtcaaccattcccattgtaaaaccttacgcaagcaaaaagttcttaagcctatcataccatgctctaggtgcttgtttcaaactatacaaagctttagacaatttaaaaacatggttgggaaaatcaggattttcaaaacctgatgattgtttgacataaacttcctcctgtataaaaccatttagaaaagcacttttcacattcatttgatacaatttaaaaccttttgaagcagcaaaagccaacaaaagtctaattgcctcaattctagcaacaggagcaaaagtttcatcaaaatccaaacccttcacctgggtaaaaccttgagcaacaagtctaactttatttctcacaatcaaaccatcctcattttgtttatttttgaaaacccacttgattccaataatattttgaccaggcacttggttccaataatattatgcccagaaggtggttcaactaaagtccaaactttgtttctctcaaaattttcatgttcttcatgcatggcgttaatccacgattcatcagttaatgcatgtgaaacatctttgtgttcaaaagaagcaacaaatgcagaatttgcacaaacatcatgagtcgttattttagaccttgtagtccgctcacctatattactaatgatttgtttcggcggatgtcgtcattgaatatgcaaaggaacagcgacttctgaagttgattcacgttctgtatcagcactggtcgaagttgtaatctctagaggaccatctcgatcagcatcaacagtacccgaacccgacaagcctggccggtctgaccgcaccccctgtggtggtttgaccggtggcatgccggcggtctgaccggcctggcgctcggtctgactggccgagctgacctcgtcgtcgtcgtcgctctcgtcttcaaaaatacgaccatcctccccctgaacctatgacaatatatctgaaatatcgggtctagtacctagactagcctcatcaaaagaaacttcgcaagtttcaacgattttgttagtctccaaaataagtacacaatagcaacgagaatgtgcagggtaaccaagaaacaatcgatcggtagaacgtgcctcaaacttatacaaatttctagatttcaagacaaagcatttgcaaccaaaaacacacaaatgtgaaactttgggttgacatccaaatcgaagctcataagaagtttttccaagttttgaccttaagaaaacccgatttgaaatatagcatgcagtgttaatcgcctcagcccgaaattttctacgagttttatactcatccaacatcattctagccatctcaaccaaaacacggtttttcctttcaacaacaccgttttggtgcggaacacgaggagaagcaaattcatgttcaagacctctttcattgcataaatgttcaaatgaagcatttttaaattcaccaccattatcacttcgaattcttttcaaagagccaggaaattcaagatccaatcgaagaaactaaccacgaaagtgttgaaaagactcgtccttagttgccatgaagaaaacccaagaatatcgagaaaaatcgtcaacaataaccaacacataccactttcctccaacatattgcactctagctggaccaacagtgtccatatgtaatagctgtcccggtgcatccgtcatcacagaaacaataggagcatgtgaagaagcaaccatcttagcatgacgacacggtgtacaaaccaaatcaagatctttcttaagtttaggcaaaccacaaacaagatccaaaccacttaactaggggctgcaggaat

SEQ ID NO: 85937 - DNA, 739 bp, Oryza sativa
catcgtgaggtgtgcaaaattaaggtgaaagattagtttttttaatcgatttggtatttatttatgtgttttggcttgcaccttaataatttttgtagcatcaaccttgtgtttgcattgtgttattcaacggattcgattatgtttttttttttaaaacaaaacaatggaaaactaattatggtaagtgtttatgtaagattggatgcttgggatttttgtccgtgtataataattataattaatgattgtttgaatggatttagattgatactttaattttgtgtcttgtaattcgtacataacgaaggctatcaccagggtcctgtttggatctcctggtaaaaattttcgccctgtcacatcgaatatttggatacatgcatgaagtattaaatataaacgaaaaaataactaattaggcatattgcatgtaaattgcgagacgaatcttttacgcctaattgctccatgatctgacaatgtggtgctacagtaaacatttgctaatgacggattaattaggcttaataaattcgtctcgcggtttacatgcggattctgtaatttgttttgttattagtctacatttaatactttaaatgtgtgtccatacatcagatgtgacacgccaaaactttacacagcctagatcggacggacgaaaagtggatgtgacagaaaaattactacaggcctgtttagattccctggcaaaattttacaccccatcacatcg

SEQ ID NO: 85938 - DNA, 656 bp, Oryza sativa
ttcaggtttttgactgctggtttgagagtggttccatgccatatgcctacattcattatccatttgagaaccgtgaattgtttgagaagaacttttctggcaactttgtggcagagggattggatcaaacacgcggatggtttgtttcacttcatgaaatttcacagctgttttatacttgtgtctggtactaataattttagggtgcattttcttcttttgcagttcatttatgaccttggatgatatttcatgattatgtaccatgtattcttgtaacatacctatacagatcatgaatgatgaaagtggaacaattagttacacttaccttgaattcatttttgcttgttcagaaggcatgtgatgttattcatgaattattatggttgaccatggattgtctgtagtagttttgatagcagttttttctttcttcaataatattttacactttttgggagaaaaaacagtatcctatgctattttatgttttatctgggttaactggtagcaatgatctggtgttgattaaaagaattctgtaatgcttgtgcttttatcacgtttactttatgagattttggtgggcaaaaactaaattcagttcctgctaatgatattagtggaatccttgtgtattgtgttctaaaatg

SEQ ID NO: 85939 - DNA, 1240 bp, Oryza sativa
tgcattctttaacccgaagggcattgttgtataacaataagttcctatgggggtaatgaacgcagtgttttcctcatcctccctagccatgcgaatctgatgataaccagagtatgcatctagaaaacacaaaaggtcacaccccgcggtggagtcgacaatctgatctatgcgaggcagggggtaagggtccttaggacatgccttgttaaggtcggtgtagtcgatgcacatccgaagcttgccgttcgccttgggaacgacgaccgggttcgccagccacttcggatggatgacctcacggatgaatccggcctccagaagtcgcgccacctcctcacggatgaaggcttgacgtttcggggcctgccgccgcactttctgccggaccggccttgcgcccggccgcacggcgagacggtgctcaatcacctccctggggaccccgggcatgtccgccggtctccaggcgaagacatcggcgtttgcccgcaggaaggagacgagcgcgtcttcctatttgtcgtctagaagaccaccgattcgtgtggtcttggacgggccgtcgcccagggcaacctccttgaccgggacctcgtcacacgtgatcatccgctgcctcggggcggcagggacggaggtgctgagcctctcgtcgccaccctcgggcttggacgccgcggcgaggtggtccgcgcgctgctccatacaagcgagcgcgactttgtggtcgccatggacggagatggggccaccgggacccggcatcttcatctggagataggcgtagtggaccgccgccatgaacttcaccaacgcgggcctccccaggaccgcgttgtagggcagactgaggtccgccacatcgaagttcacccgctccgtgcggaagttggcgggtccaccgaaggtgaccgggaggtcgatatgacctagcgcccaagtgtgccccggcgtcacaccaatgatcggctgggacggccggagcatcatccccggggccttgatggcgtcaaaggctgcgggggaaaggatgttgagggctgctcctccatcaatgaggacacgccccagcttcacgttgcaaacagtgggggaaaccaccattgcgatctgtcctccccgggcaacgcacggtgggtggtcggtctggtcgaaagtgagggcaacctccgaccaccgcgcctggcgcgtcgcctcatgagtaggggccgcggccagaagctctcgcttcatggcc

SEQ ID NO: 85940 - DNA, 680 bp, Oryza sativa
ctagtgtaaattttggtagctctaataccaggtattcgaaggtagtaaattttcaagtgaaaaatcttgatatctctaggtatttctcaaagatcataaaatttctttaataaaactatgaataattgcttcccatatattattgcaagtaaattcagataaaaaaaagctgcaggtgttcatcatcaccagttattcaccaaattgttgtggactgacatgcatctaaacaatactatcagagaaggaaattacttacctgtgcacataaatgttgtaatctctccctttaagatactcctctgtaatatagggatcctgcccattaggcacctctggggcgttagcagcaatgcttgatgagacggcataggccatttgtacggatccacctccaagatcaatcacgcctactgttttcgagtaatcttcacccagtctatcaagaagatagttaagagcaacccacatgtaagatccttcttgagatcccgtaagaacattgatccagtttggattgtactgaaatttgctcttggtgtggacaacatctctgacctgtactatgaatcaaattaagtaagtggtctgaaggcatttcatttatgtagtatatttttttcttaaagtatacgcaccgcttcaagaatctggtttgccttttcatctccaataagtat

SEQ ID NO: 85941 - DNA, 1989 bp, Oryza sativa
gtgggggagtggggaggaagagagaggggggattcaaattgaaccccgcccactctcgggcgcgcgtgggggcgggaggaacgggggaggggcggcgacgtgggcgcgaggtttgggcgcagagtggaggcaccacgtgggcgcggaaagagcggaggaggcaccggcgcggctgtttcggcggcagcggttggagctccggcttcaacggccggaggtgggagacgaccgacaggtggggcccacctgtcggcgtcccagagagaggagggaggggcgcatgggccggcccaacaagaagaagggcgagcgcgggcgggagaaaaagggggggtggactgggccgacggcccaagaagatggaaaaagaggaaaagaaaagggaaaaggggaaaaaggggaaaggatttttcctgggatttaaaaatattgcacttgctcaattttaattggttaaaattattttcaaggctctgaaaattccactaaaattcatcttaatgtattggagtatggggaactcaagaaaaattccaccacgccgaattcgattattaaatgcatttattaattagggatttagctctaggttaattaagataatttcttcgggcaatttatttaaccaatttttaaagcaagaaaagggggggaaacttcagggtgtgacattcatcccacccaagaatgtcctggacttccgatttacaacccagagctgcaatttcatgcgctaccctattacaacctcaagggcagtagcttacattgaaagacaggaaagcaaaatttacaaagttctttatctcacaaatgatcccgccaagagctgacgaagcaaaagtgttcttctccaaagccgacttcaacatcgttgaatcagtttcagccgtcaccctttgcatcccgcattcactggcggctcttataccagctgcacatgctagggcttcagcgtggaaagcattcatcagaatctgaactttacccgctcccgatttaacaaccttgcctgagtgatctctgatagcaaaaccccagcctcctgttctggtgaaaggatcaaaagctccatcagtgtttattttcatcaccccctggtctgtcctgctccacttttcatttctgctcggagctcttttgctatcttttttattcaacttcatatattcctcagccaaggcagctataatgaagcccagttcagacggggatcttcccctctccccctcctggaccctgttccgctctgaccaccattgccacaaagtaatcgatgctaacaaaatttcctttgctggccgattgaaaactgtttccatcacctctcttcccgatcttttttctgctagctcctgtctcaaaatctccaggttgttctcctgccaaaccttctttactttcttacatttgaaaaacaggtgcccagcatcctcattcattctattgcatattatacatctactgtccagatccatccctctttgttgcaaattaactctcagcgccaaaatgttatgactgaatctccaaatgaaatgcttaaccttccggggaagctgcatcttccatactttcttccagtacatctcccgttcagtgctcccatttgacaaacctgcacttcccctttttcttctctgtaactccccatctcgctgcaccttataggctgatttcactgagaacaaacccttttcatcatagtgccaggccaacatgtcatccatctcgatgtgcaccggaatagtacggatcatattaacatcttccggccagaaagtctgtgtaagcagctcaacatcccaactacctgtacttggatctattagttcctccactcttgtgacaagatttctccctcttggtgtgatcggccgtctcgtatgatcacttgggatccatgggtcagaccagatattaatggccgccccatttccaactctccatatcatgccatctctcagagtcaaaagcccccggcatata

SEQ ID NO: 85942 - DNA, 907 bp, Oryza sativa
agagagagaagaaatagtcgaggtggttcggtttcgcgcgtggtggtgcggttatgaatagtagcctagcctagctgggggttgtttcgagtggccatttgcgttttacacctgaaaaatattttagcactctttttgcatttacatctctattaagcgggtgtttagatccaccggcaaaagaaatttttctccgtcacattgaacgtttgaacatattaaatattgaaaaaaattaattatatagtttatgtataaattacgagacgaattttttaaacctaattgcgccatgatctgacaatatggtgatatagtaaatatttgctaatgatggattaattaggcttaataaatttgtctcgcagtttacatctggattatgtaatttgttttgtttaatactttaaatgtgtgtccatatatctgatgtgacctagtaaaatttttttactggtggaactaaacacagactaattcattagggcatgtttagattaatgcaatttcaaatcataccattttttgggtaaaattatcaaagatgtatatatatttagtttcttgccaaagtttggtaaatacataaaaaaatcatgccaaaattttagttatattgttaacttaaaaaaaattggtaaggtttattttgactacaatctgaacagctccttttttttctaattatacggatgacgcatacacatctgatgtacattcttgattacatgaaagacacgttcacactagtgtacattcttgattacacggaagatgcatacacatcactgtacatgcgcagcacactcgcacctgtttacacctcgtatcactaaacttttagatttggaaagtaaatatactcatgcatttgcataggtgttaagccattagcttctccagcgcg

SEQ ID NO: 85943 - DNA, 658 bp, Oryza sativa
tctattactgtaatactctcacttttttttttcatgaaaggcaatggcatcattgtcaagtgctcatgatgtgcttccacaaatctttcttatgactgatggatcagttgatgatgaacataatatatgccaaactgtgaaaacggagctcatcagcagaggatctaaatctcctcggatttctacttttggactaggtaatgttaaggagagcgtcaaatatacaattatctcattattcaaaactcttgacttatctcctggatcacatgaaaattctcctccctactttttgcaccaacgctcatgtatttctctatctccaaatattcttttttgtgtaagagaaaaatgcttacaccataagtcaacagaccagtcagtgtggtgatatatgctgccagcttgtgatgagacgaaccatattttaattactctgctgttttagttttgtactacttcgttactgattgcttacagtttacctgatatattctttttgctcttttcattttatcactggaataacaggtttgtattgcaaccactatttcttgcgcatgctggcatcaataggcagggggcattatgatgctgcatttgagacaggtaccaagcccctaaacccttttgttctcatcatagcaaacagtatgct

SEQ ID NO: 85944 - DNA, 11595 bp, Oryza sativa
catttatgactctatttatcagggtttaaattatgacacatataatggaaaaattgtaaaaaccatctcaaatgtcactataagtttgagtttccccctataagacgatttgtggtaaatacacccccctctcttagttcaccttgatttgagattcccctgattgccattgctcgtccattctcgtgacaaacccccccccacatgtgttcacatgaatactaatacgggaggagttgtggtcaccactcatgttgatcaagcctaatgacacgattgtgacattcttacacatgacacgccaacaccttgttgggcagtgtgatcacgagtctccgcacttgaacatcagggttgtcgaaagatgagctactgcgcttgcctcatggggtttcgggtggctagtttcttcgaggattcaaaaacgatgaaaatgagctcagtgtgacactgtgctgctaagaaagataatgtgttcagggtcatatacatcaagagatgagctaagtcgtataacacatgagaaaagagaaaaaaaatagtgtgagcaactggggaggaatatcaaactaaggtgaactaggaggtgagtattcacaaaagatcatcttatagcggaaatcttaaactcagtgtgacatttggagtgatcttctataaatttccctaaatataaaatgtacgatcggggtttaaaaaaaatgtacaatcataaatattgtttcacctctgtatgttgatcgtgctgataagagtagtcatgagcaggggcggagacaggagtagggcagcttgggcttgcaaccctattcctagtcctaaatattcattgaaattccattttaaaactttaaaaactagaagataaaggcaaaattatatatattcaactaattgagccctaagtttagaaaaattttggctccgccactagtcatgagggtgtgcatgcacatgtatctttcgtgttatcgggcaaaaaaaaaacaatggtttagaatgtactaccaccatcctagaaagatcgcagttttgtacagtatatgtataatatttggccgttcatcttatttaattttttttataattagtaattttattgttattagatgataagatataaatagtattttatgtatgactaattttttcaaaaagaaatatatataatttttttaaataagatggacggtcaaacattagacacgaaaactcacaactggatttaaaatgggacgtagcaacaaggcagaggctgtactggccgagagtagccattgtttagttcatagtgggtgagtaaataaaaaaatgtaagtcgcaactgcaagttttaagatcattaagtcataaattaatatacattgttttccctcattaagactgagacaggaaaaaatcgatatataaccacatgttggccaatttggatggactctgattggccgtactagcgaactcactagttcctttgtggggaaatacgttatttgtcaatatctttttttccacgtcttgcgaattgcgatgtaggttcatgcatggcactacccaaatgaaaggagtagctgaccaggatgaaatacactcccaatggccaatgggcgttcgagtcaattgaccactcgattctatcgatttgttttgtccgagtaacaggaacagaacagcttgatctatcttatcgcccccatcatcccataaatggcttgattcctcaaaaccaaataacccacaaatgtctctaaaccagcaccagaacgtttggactttggagaggtccaaacctgaaacctgatggctttttcatgggtaaattgtacaaccaacgaccgacctgatcacctgaccaagtgaccatccttgatcaagctgtacagtatggagatgcacgggcttttttttcttcttcgcaaactctatctatgtacactcgaatactctcctctctccccaaattacaaacacaaaaccagacggctacgagtcggaccctgaacacagctcggcgcagcactcgtagcagccgaggcaggcgaacgccgcgcagacctgcgtcatcacgatggcgcactggtcgttcatcttgttgcaggccttgatgcagcacatgcagcagaggcagtcggcgaggcggctgcagcagccggcggccttgttgaggatctcgaacgtctccagcggcttcacgtcgccgaaacccgtgacgaggttctccctggtggcggcccggtcgccgaacccgagcttgaggcattggagcgggatccgtcgaggttcgtcggggcccttgtgacctttcagtttctgcttgacctgttcgagtaaacaggcaagttagttgggagttctgagctagcgtggttgtcacaagatccatttctcgtaaaccagtttataagcagggaccattggtattattataaaaacagtgggacttaccttttgtgctgcatctaccttctccaatgtttgaagtaggaccatgctcgtgtactctgaaggaatgctattttgaatgcttagtttcaccaccttcaaaaatcaaacgaaatggagttactgaaacccatatactgctaactgaatggaactcaaactactaaagaaagtaacatatttcaggggcaactgcaattcacaagagaatgtgacctataaagatttcaaactagttcagggaataaatgaaatggaaagcgaacatcaaaataatattcagcaccaacaaccacactagggctgagtttagttccaaactttttcttcaaacttccaacttttccatcacatgaaaacattcctacacacacaaacttccaacttttccatcacatcaaaacattcctacacacacaaacttctaacttttccatcacatcattccaatttcaaccaaacttataattttggcgtgaactaaacacaccctaaggctgtgttcggatatggggagttgggaactaaactccccgcacggaaaacggatcggtccattagcgcgtgattaagtatttactttttttttttcaaaaatggatcaatatgcttttttaaagcaacttttgtacagaaactttttgcaaaaaaacacatcgtttagtagtttgaaaaacatgcgcgcagaaaaagagaggggtgagctgggaactctgtgttcggcacaccaagttcccatctcctctccatcgtgtttcgtgcgcacgtttttcaaaccgctaaacggtgtgtgttttgcaaaaagtttctatacgaaagttgcttaaaaaaatcatattgacccatttttgaaaaaaaaagctaatacttaattaatcacgtgctaatggatcgctccgttttacgtgcgtaggagattggttcccataaagcccaagcgaactcaagcatttttcaatgtattgcccattaaatgcttaaatgcttcagacaagcaatgtgagaactttcaaacattaccgattatcttcactatatctcatgactccaaaattcagtggaggtataaagcgaagaacatgtataatgcaacccttagccaaaagcctgaaacataaactcacctttctctccagttgcttgtcagaagaaagccatgccttcgctgtgagaaggccaatctgctgtgccgccaaaacctagaaatcataaataaaaaaaatgcatatattattagtatactcgagaaatctatggccccaagtatgatattgtgcaagtttctcaatggaaagaagagaaaccaaatgtacacaatagtgagcatcttactttgtcaaggggtatatcctttatatgctgcaccttaagttcaatcgagatctctctcatgtcagccaagtaacctttagctgtaaccatatctgggaacttgccttggtatttcccagatatacataaaggactttttgctgaaatgtctggaatgtattcagaatcgatctgaattggaggaaaggaacagtcagaagacaataaaactactgtttttttctagctactactagttacacctgcaaaaagcatacccacaaaccacccttccatacagcaaataattatttctatatacaggacaggctctttgctaggaagagcagtataagatggtatggcagcaatgaacacagcacacatacactaccagagaaaatgagttgggaaatcacaaatcaaatactgaaaaagagtcaatttcattatgaaacatgatcgcaatgcagccagaaccaccttgatggcattactcgtcttacatatccatctctacataaccaaatttacaatattgagtagttagtgatgaattaactcacttcaaattcatcaagatgtgctgtagcatcaatggagatgtttgcaactattgtactcgatgctttcctgaaccacctaagtacctgactctcaattgatcctgcaaaaacaattcaccaaaaaaaaaaggtttatgaagatgttacatggacttcataaaagtcatatttgtccaattaatgcatataatagaacagtattgcttagatatgaacttcaggaataaatccagatcaataacaataatgtattggtagaatgcccatgaaacttgagcagaggttgcaagatggagtgtcaacttaaacagcatgcagggatcataaagaaacagtgttacgtggaaaattgcaaaccaagagtacaactagctcttagattgcagagcaagaggatcccttcatagaaaacattattgccacctctaacaatatgaactgattgcagtttggtttttctattataatttggttgagataacagtatatatcgtgtgtctcaggaaaagctaagaaatccatggagaaagggtagactgtgtagatcattgttctaaccttcaagtttaaagaccaacataaaggtaagagcatactgtttgctatgatgagaacaaaagggtttaggggcttggtacctgtctcaaatgcagcatcataatgccccctgcctattgatgccagcatgcgcaagaaatagtggttgcaatacaaacctgttattccagtgataaaatgaaaagagcaaaaagaatatatcaggtaaactgtaagcaatcagtaacgaagtagtacaaaactaaaacagcagagtaattaaaatatggttcgtctcatcacaagctggcagcatatatcaccacactgactggtctgttgacttatggtgtaagcatttttctcttacacaagaaaggatatttggagatagagaaatacatgagcgttggtgcaaaaagtagggaggagaattttcatgtgatccaggagataagtcaagagttttgaataatgagataattgtatatttgacgctctccttaacattacctagtccaaaagtagaaatccgaggagatttagatcctctgctgatgagctccgttttcacagtttggcatatattatgttcatcatcaactgatccatcagtcataagaaagatttgtggaagcacatcatgagcacttgacaatgatgccattgcctttcatgaaaaaaaaaagtgagagtattaacagtaatagaataaaaaataatactacatatgcatctattcacaatcgagatttaatattcaataatacctcattcaaaggatgcataatatctgtaccaccaccagcaacaaagtttaagtttatccagtcaagtgcacttgctattgatttctcatttactttctccaaacacgatgagaatgagtgcagctcatcattaaatgttataatgttgaagtaatctccttctgtgagttctgacagagcagtagacatcgcattcttcacattctcaagcggatgtccttgcatgcttccacttgtatcaatgacaaacacaactgcttttctgaagacctattgaattgctcaggtgagatataggaacaaggagagagattttgtgaaacacagaagaaggaaaaagggaatgtacttctgtgtcaataaaccaaaagtgctatgaacaaggccacctcagtaacatccttatttactataactttaatgatttacaatcgcaaaatatcctgatagtatttgctaaaagaagtccagattgtagtttgcacatagctagtggaatttcactagaaaaagatcaccaaatggcagtttagaatggtgggtttgttgattggttctataaaaaagtagttctacattagcttcatcagaaaggtttctgctagaggccctcttctaaatataaaagttttgtcaactgcagatatctcactcaaggaagatatgcttaaataaataaaaataaaaactatgggacgaaaccccgcaaaagtaagagcaactaacctttctgttgccacctccaggtaaaagaaatatgcagaacctatctctatcatcataatcacgcaatgtcgatggttgaacaagcacaccaccagataagtcaccagaataaacctataggaatgaacataaatcagacaaatctgaacatatatttagctattgcagttttgaaacagtaaacagttctcgagccagatttcagttacatctgcaactaacatatgctcacaaaaaaagaaaaatttgagaagtcttggaaagtcagattatcacaggaactagtgagctcataactacttaaagaagtgactaccgattacagctaataaagagatcacaaaagggaaactcacactgtatgaaaaattgaaatctttgcttgaccaattctcaacagttgcttcatgccggaaagacaacttctcaccctgcctacctttttcctgaaatagtaagggaaactcttttgaagattaaatgttgtaaaagcactgatgccaattgcccggaaatcaaaagagttctagcaaaaaaaaatgattaccttcaatgggtggcttgttccctgcagtaaaacctctttactgaaaccactattcacagtcaactgaattttctcccttttcatgaatacttttggcaatgggttaacataatatggaaaacggaacggtatgtccactgagaatcgtccattgtcatagtgtagcttctgagaccatctgattgtggcagaaatatccgccccaccctcaatctttatcggcaagatggcaatgaatcttcaaagtaagactccaattccaaaagttcaaagaagagaacaaaagacagttctgcatttagcatgtacctgtgatattgtcaaataaaataattggggtttcaagagtccgccactatcagcttttggagcattctctgtagtgtgatcttctacttcaattacttgagtattatatgatcttcttccaacggtaacctcggctcctagaattgaaccctattagccaaaccgttcataggttgagaacaagacaaacatggaaattaatgcaactcatataacataattaaacataatatactagtagatgcctaatgttcatttaatggtgatgtttcctacggatggaaagtagaatcagatgtttcaaaatatcaaatattagtgtatgtgagttatttattacaaatttccaagttgttgttaatcaacttcgctaggcaagataacaaccacccaacaccaatgaataatatgctatagtcatccaagacaaataacttcaccaccgaattatctccattctgcaagccattatattctacaaccagacataaaaggagcaatggagcatcatgtgtacttctagatgctgaagtaaagaacaagctatacaatatgtttccaaatgacacgaagcaacatatttcagtacacatcaacatatttcttcttcctagctgcctcatttttgatacacaagccaggttaccactctgctaaaccagcacattccttcttgtgtttgatttccataggacaaagcaaggaattactttcacttgcttatgccactttttactgaaaattgctcttgtaatataaccaaaggcatccatttagtcagctggaattcataaactagttataaagaaagtacagaatttagtgcagagcacgccatgatttgcggtcaaccacctcaagacaactcaatcaaacgaaccatatgaacaaaaaaaaaaaagagaacatattccacttggacaaacactgggttaagcaaacacctgaataatgttgccaccaaccattccaacagcacagtcaacaataaggtacaaaaccaacaaagcatccatgtgaagaaaacaatagaactaacggctcaatggagaatcaaaactgcaaatcgagaggcacatatacatgccgcaaaaacaaatccaacaaattcatggttcccaactatgtaataacactagccaaacagccggaatcatacatagcacagcaccaatcatttcgaacctcaccaaaccaaatctacgaggcaggagaagggaacaacacagctacactagggggtaaaacaaaaaaaatcgccaaaatgtgatccgatcgagatttacctggtcgcccatgggcacgacgatgcggacgtcgcagtcgcggctgcgggtgatgcagtgcaaccaccaccgcgcgcggacggtgacagcggcctcgccgagcgcgcagtcgacggacaggtcgacctccttcatctggagcgggatcagcgcgggggggtcgaggcggccgtacacgtatggctggtagctgggcacgtcgggggtgtcgaccgcccccgggtcggtcaccaccgcgtacgccatcggcgccgaccgcagcagcagcgccgccacggaggcatcacccccacccccacccccaaccccaacgccgcggtccatccccgccagtggcctcggcggcggcagcccccccggcagcaccagcctcttcgacagcttcagcccgtcctccaccgccctagcgaacccctccatgacccagacgcgggatgcggcggcggcggcgtctgcctcaggtagggttccggctgcgccgacgagaggaggagattggtgtggtcgattgatctgggggggaggcgatcggcgcggcggcgtgggcaagggagcgagacgagtttatttgtggagatgaaaatgatgagatgagatgggatgggaggcggtgagattaacgggatgggggggaggtttgattcgatggatcgttgtcacggaagatttgattaatgtttttaactgattacacggaagattatggtggagttggtttggtatcttcgtttggttatgggtgtttcctttccattgtttatgctgtcgctttgtccgttgaaaaattgaaaactgtaaatttattagaaaagggggaaaaaacacgggacattaacatgagttcggagtgaattagcgcttccggggcaattaaaaaacttgcctaatccagttatagtatcagccatgttacattactcggaaagaaagaaacatgttacatcatgtattgccttctgatacgttcacacaaactgaactttgctttagcaccgccttagcgtcagactaaccattagctttattgtttaaccacaacctgctaaagagagtaataaagagacctttgctttttactaaatgatctgcatatagtttttttatagttttttttatttctaaatgatctacgtatttatattcattcattaggtctattcgttatttgtgtataggagtaaatggacatggatacacgcatccatacacacaagtatttatagctcacatgtaatatcttgatttgctgggatcggctagaaaatagtggggatggtgtatgtatcgagtttgttatatattatgagagagttattagttttcgttggttttagtgtacctatgaaatatttagatcaatttaaaatggagggaggatcatctttggagaagttgaggttagacgtggctcaatcacgacagccggccgtaataatctcatcgaagacaactcgccgacgagggaaacgacgttaaccataacgttgacgacgttgataccgtgaaaatgaaaataatattttaaagatctatttataaaaaaaaatttgaaaaaaactacaatgtgaaaaatactccgcgggcggtgagcggagtctcggacgacatcgcggcgcttccaaagaaaaggagcaacgtatacacgcggtcaaaacacagctgcggaaaaaggccctgggccccactttgtgggccccgctcccccgggccggccacgcgcgtcaagcacgcgccacgtggcctccaaagggacgacgacgcgcgggagatccgatcgtgacggctcgtttcggcttcgacggtcgggatctccgtctcgccgtcggcaacgcggcgtaacggctagttttgtgtcgttttctggggggaccgctccaggagccgtgcgtgtggtgtgaactccgcaagtccgttatacaggagtacgtacgtcgcgccatcaccagctgtgaccgcctggcgcccggtgaacggttttgaaacacgttctcgcttgttttttttaatggtgcgaagttctattgagcaggaaaaaattactccctccgtttcaaaatatttggcaccgttgaccttttagtacgtgtttgaccattcgtcttattaaaaaaaacaattatttattcatatcatttgatttaaagcctcatcgtttggcatattttctgaatatgtcaaatgacatattttgcaaacgaaaatcaatttgtgaataaaacttttatatatgtgttcttagcgatctaaaagcaaaggctgaaaaataaacttcgatgaaaaaaccccaaaattagcttcaaatttaacgttgaaaattcaaattttggctcataagcatatgaatatgccaaacgatgaggccctcattgttaaatatactttcatgtacacatatagttttacatatttcacaaaattttttaataagacgaacggttaaacatgtgctaaaaagttaacggtgtcaaacattttgaaacggagggagtacaagattacaaccctgaataccaccacccacacaccgatagcgccaacacacaatccggaagaaggctagcaccgaaccggccgccgctaagcgtgaccgaccgccgttagaccaacaaatgaacacatacaagatcgccccctagggatgccaaaacaacgtcttcaagaagagaagtgacagaaaaaccgttgctgccgtccgtcggggctcagaggagccaagacatggctttcacccggcaaccactcttgaggggtgagacagcatgacaacgccctcaggagggggaatgaaccgtcgttgtcggtccggctaaggccgggctaggttttcacccgccgctcaccatctgcgaatccacggctgacgcaccgatgctccaccaccactcaagctctgccgacatgtgagacccctgcaccggcgtccccagccggccagctttcgtgtgccgaagaccgcgccacacccgccggcagctcctcctcacaccgtccttaattgtcatgagcacgaccatcaaaaccatgtgctcacaacccaccattaccaggttttagttggcacattaattaattaactaatcacgattgaccatcgtgaactatca

SEQ ID NO: 85945 - DNA, 3542 bp, Oryza sativa
cctgtaaatgaattcatagataaaatgagttttggtttccaaacaaaaggatacgaagagtttaagggaacaaatttattaataagtatagaatttataggaagattgactaatagaagtgcctccaaatacaaaatcaatgtaaatgatgtgatagaaaaaatgcattctaaaggaataaaattcatgagccctttaataatagactctgaagaaagagcaggagaaaaatggccaattagtgaatttataaaaaataaaaccttgagtcagcctgaaaacttcataagttaccaagacagcaaagggaatgttagtattagatttacaaattataaaaccagagcttcggatgatttggatgcagaatcatctgacagagatattatagataacagaagacatattatatctgaattgatggaaaaattagaccatgaaagtgaaataaaatattatgaagataaattaagagatatagcagatgaatataataactctatgaaaagtgagtggcctaaaattagagacaaggaactttatttctatagagaactatccaggattaagaaacaaaaaaaagagaaaagcttggtcatagaaaccccgagaacccaggaaattaaaatagaacaaataaagtcagaagaaccaagagaagaaatccaaaagttagataaggtattaagtgaggaagagcaatgggaagtaaatgagaaattattactagagagttatgaagaagaaaacaacctgatagaggaaatagagaatatagaagaagaagataatgcagaacaatataatgattttatagactcattggatgaggaaggtttgcataatctagataatgcaatggaagctatggaagtagatttgggaataggaaaaaggaaaagatacggagagggttctgtaaaaaatgaaggagaaagagaaagaccagccagggcagcaggaagatggcctccagaaaaagaagaatattcatatcattatatcccaggacagtataggcacatgggcactaaaagaagagattttgagaaaccaataaaatttcaaaatcaaaaaagtgatggggctatactaaatctagcagcacatgatcccatagactggccaaatatcattagtatttggaaggggttaatagttcaaaaatacatacaaaatcagcataatatagggaataaggtgggggatatgataacttatttagaaacatttttgggtgaatctgctaaagtcctatgggaacaatgggttgaaaagaatcctaataactatgaagagctaaaaagagcaggaagtaatcctcacaactttgcaaatatagtatctaatattatcatagctgaagacccagaattaggatatacaaccctgcaaaatgaaagattaaaagaaatagaaaaatatatatgtatacatatatatatatacatatatacatatatatatatatatacatatatatatgtctatacatatatacatgtatatatgtatatgtatatatgtatatatacatgtatatatgtagatatatatgtatataggtatatatgtatatatatagatatatatgtatatatatacatatgtatatatatacatatatatgtatatatatacatgtatatatacatatatacatatatatatatatacatacatatatatgtatatatacatatatatatacatatatatgtatatatatatatatacatatatatgtatgtatatatatgtatatatatatacatatatatgtatgtatatatatgtatgtatatatatacatatatatgtatgtatatatatgtatgtatgtatatatatatatatgtatctcagaggtacgaaagcgtggtggagccagaatcaaacccaacaaccttgaagcactcaaccttgagtctgaagaaagaattaatgaatatgaacttagtgagaatatagacatctattatatatcaaattccaatatagagtgcataggattacaagcatttacaccaaattggtatagggatattaagtctaaaaaggatatagaaaaaattgttcaaagattagaggatatccaaattataggagaaattcctatgaaatattgggagaaaaatgctatcgagtgtaaaattaatataataaacccagaatatattattaagaccagcccaatagaagcaactccgaaagatatagaagaatttaagatgcatatagaagaactgctgaaactaggagcaataagagagagtagaagtccacataggtctgcagcatttatagtaagaaatcatgcggaagaagttagaggtaaatctaggatggtcataaattataaaaggctaaatgataatactatagaagatgcctataatatcccaaataagcaagaatggattaataggatacaaggtagcaaatatttctcgaaatttgacttaaaagctgggttttggcaagtaaaaatggcagaagagtctatagaatggactgcattcacctgtccccagggacactatgaatggctagtaatgccactaggattaaaaaatgcacctgccctatttcaaagaaaaatgcaaaacatttttaacgataatcaagaatttgtgttagtatatatagatgacttgttaatattttcaaaaacttataaggatcatattgctcacctagaattattttttagaaaggttgagcaaaatggtttaatcctatcaaaaaagaagatggagatatgcaaagaaaaagttaacttccttggacatgaaataggagaaggcaaaattcatttgcaagaacatattgctaagaaaattttacaatttcctgatgctatgaatgacaaaaagaaattacagcaattcctaggacttgtaaattatgctagaaatcacatcaacaatttagcaaagctagcaggacctttatacactaaattaagaaaaaatggtcagaaatattttaattctgaagacattaaattagtaagattaataaaagaaaaagtgaaagaactaaaacctctagaattaccattagaagaaagttactttatcattgaaaccgatgcatcacaacaaggttggggtgctatattaaagcaaagacctactaaattttccgctaaatcagaagaaaaaatatgtaggtatgcttctggaagttataaattaaaaactgtcaataatacagatagagagatcatggcaattatcaatgcaattaatgcctttaggttatacctagggtttaaagaattcacggttagaactgattgtgaagccatctgtagatattataaccagcttaatagcaagaaaagctcaactagaagatggattttatttgaagatattattacaggaaatggttatagagttatatttgaacatattaaggggaaagataatagtttacctgacatgctttctcgtttaaccatatttcaggtatgaaaagatcaatgaattacgccggagtcgagtgcttcacatttggagatgacaacaaactca

SEQ ID NO: 85946 - DNA, 2554 bp, Oryza sativa
ttcctgcagcccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcataaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgttttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtctatcgcgacattccagggatatgagatcaatgggtacacattctacacgagagcccaagacatgaagagcacgaaccaaaacagcgttgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacagtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgttagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtacatatgatgattacaatttttattaattttaaatcatgcagtatgtacattaatatctaattagagtttttaccaatataataatatcattcatatatatgctaagaatatatatatattggaatttttattaattataagtcatatatttgcttattacgatttatccacttaatttattatagacaaaaataatttttcgaagtaattgtcatcaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttgagaacaaccgggagtgaagatcttttctttactcccggttgttctcatcaaccgggagtaaagatcttttctttactcccg

SEQ ID NO: 85947 - DNA, 2466 bp, Oryza sativa
aacagtgagtgccgtgtgtgttttctgcattcctctaaattgacacaaatcttaattcatttgcagcttttaaatgatcgataattggttggtcgcatgcttttaatcacaaaaaaacaaatgcacagtttttgtttgttgaagactacagtatcaggtcctgtttggatcaccctgtcacatcggatgtttgacactaattagaaatattaaacgtagactaatgacaaaatccgttctataaccctggactaattcataatatgaatctattgaacctatttaatccatgattagcctatgtgatgctatagtaaacatgtgccaattatggattaattaggcttaaaaaatttgtttcgcgaattaactatcatttatgcaattagttttattattagtctccgtttaatacttctatttagtgtccaaacatacgatgtgatacggactaaaatttagtctctggatccaaacaccacctcagttctcaataagtacaattttcatttgaaactctccttctgatggcagatgtgaattgaagtccgttgtatagaaaatggctaacatttcgaaatgatttcatcaaaatattgtgcataacacagaaagaagttagtaatatatgtttatctatattgtagttattcacttggtaatgattaggatgttactttacataagcagtatgtttgttgttaactaacaagaacaatgttttcttcacgccatgacccatgatgtgctggggaatctttgatagtacaaaggatgagcatataactgacttttgatgtctgttgtactcatttcgtactatgaactcctcaaatactttgattagatttgaacatgcatcttcatttttttcttatggcgattcctatattaatttatgtttaacataaattgagaatacttaattagaaaaaacctgaagtgctgacaagcttgtgccaaatggaaacaaatgaatgaaactatcccagtcttaattctgaagaacggcctgcacaggctttacaaaattcagataaaaaattatagtaattgtagcagttaattagaaatagtaaatgtactcagtggcaaaaaaaagaacagcaaaacttatagtagtagtattttgaccaactaaaggtaggaatgtcatgtctccttaatcatggctgtaagttgctggttgttcaacatggaataaactttgcaggatgcacatggcaagatctgagatttttgtttctttattcgataatgatttgaccctcctccagaatttactctcttttatcgggaggtttctttcagatcgaagaagatctggacatgctgaaacaaagctgctctgaataattattaggtaatgttgagtcctgggtaatagaaaaattcagcgatgaattaacaagtgttttcaggcaggcagtagcaaccttgttctttgtgagttcacacataagtgagatgaatcaaccaagtccatggttcttgtatataataatcttgagagatttggctcctgatcatgcagttcattacttctcatgatctcctcacatggcagagaaaccattcagaaagaaagcaaaatggattaaactaggcacgcagattgaatcaaccatagattgattcagtcaaaggacaagcagctatatttttctgtattctagttttggtataaatcataagtaatcaattgcttgagtaacatattagtgctaacgaatcatggttgctgattgctgttgcacatcatgacacgctttttctggatataattttggataattgcaaaataaagtttgaggagaccacataaagaccccaaaacaagtaatcctaacttaatatatgtatacttgtttgcactaaaagtacaatgatggtacattgctcaattattcattaaaaaatgagttttcttatgaagaaacagcgttggaattgagtacaaagttgacgatttacaggcttttgaaattcttgcatcgacagacatgggttccaaccaatatattgactatgttaaagaatagtccctccgaatttttttttatagttgttaccaagcatttatttcattcatttttttaaaaaaatctaaattattaaaaaggtgtgtatggcatgttaaacataaacataagtattaaacttcagttcatcataatctattatttaaaaattattagttatcaaagttgccaccgtagtagttaacggcgataaatataaagaaatggagggagtactttgcaattacatatactactttcaaatctcaattcgtcttcttttttactctcagcaagtagcagcatggggagctactggaataacggatcctgaaatattcttaactttagttctaactaacttacaaagtactcaattgatcagctgacagcgatcgatttgtgagtaatttttctctaacagcagagtgatctcctaaaaggt

SEQ ID NO: 85948 - DNA, 2899 bp, Oryza sativa
  unsure (1)..(2899): unsure at all n locations
caatagtcaagaactccctctgttccaaaatataagcagttctagtattcaaaatttgtaccacaatataagcatttctggggcactgattcaaatgcacggaaatctatatacattttcagccaatgagatgcttgggaagagaatctaaacaattcaaattttgaccactgtgactaaaagagattttttttccatctaccttagtttttgctaaaaaaacgtacagatgtttatattttggagcggagggagtacatataaaatttgagtgagctgataattaagtaaaaataaaagtaaaatttagacttctttgttcttacaggtttagttccagggcaagtgaatccaagggagataaagtgccagatgttaatataatcgagcgcacacccaacttgagaaactcttccatagcaagccctgggttaaaacaccaccaactaagagtccttgataccttacctgcaatataagaaaatctagagaattaagtatataagtaaacaattactgactcaaatgttaacttttaaatatttcgggttacagggaattgtatcaggagtcgagttaagcgtatggaaatagagaagaacgaatacaaacaatggaagttaaagagcaattaactcttgctcatggattatacatataatattgatgcaagtatgcaactaaatgctgcaggcttggagacaaatcttaaaagcagatcttgtaaattccaccattaagagatagttgtacaatattgatgcaactaaatgaggtcagcttggacacaactcctgaaggcagatcttgcagcttctgccaccattaattggatacaaatctataaaaaaatatgcttacactacggatatgaaaaaaacaattgtcaggtgacagcatgagagcatttggatgaatattattagataagtatgaattattagtaccaaaagaagatatgggcatcagctacagagccatgcaaacattgaaccagatttaaataacgagtgaccataatacgagtgaacttacccaaaactttaagagcatctccagaattttgttggcattcattcacatgaaactggaatgaaaagaatgagtgcaattgtaaaagcataaaattccagcagagtatgcaagcttatacagtaaagtgtgaaaagaggtaggatgaaataggggtgcaagtgggtttacccgcgaacccgcttataggcaaaaatagtgtgtaacccgccggtttgactagcaggttaactatgaatttgacttataaatgggtttataaattgatccacttgtatatttagatgcggcaagccgggccgcgacgcgaaaacccataaattattatttatttaaactcgcgggtcggcccgcttgcacccctaggatgaaaaaactgaagccctacttggaacacaggaattttggaggtaacagttcaagaaattgagaaaatttcctgtcttctaaacagggacaatggaagtcaggaagagggggggggagagagagagagagatgtatatatcatatattattgtgcatggttgctgcaaacattaaatgacagaagaaagcagcagaacttatctaaggtagagaaacttacacgataatactttgcatggctttgaccaccacctctaaaaattatgtcaagaatgtccctgattgtttccaatctacagacagtagccttcgccttcatcccaggtccagtttcagcagaatttcctaagtgtgcaggaaaaatacagacactcaactgctttgcatgaaccggcaaacaattatcaatagttatcagaaattcaatatgttcaactaaggtaacacttagagctagaaaaataatgaaagcttaaagtaactattcagatcgagaaaatggaatagtacatttcagtggaaagaagaaacctggaaaaattgattaccttcctcaagtaatagagaagcaccatcaattgtgtcaattagctttttggatgtttcagaagtaatattcagttcagagaggaactcatatatgtaattgccaggttttgtatggcccagctccttggaatcaatcaccacctcactaattttcttttcaagtgccattaaaagggctggggaaaaagttcgattattagtctattacagtacgaaatctcacagtccgaatcattaacataggtaaacactttctaactaagaatatggatacaggtatgatttgctgctgtaagaagaaatatggttcacctttgagaatagcataattttcagggtcaaattgtttatcagcagaattttcaaaggtcctctttgctgaacacaattggatgcattcctgagcttccgcaatgcaagaagagaggttattgggaagcaagtcaaaagatgcagcatctgcacatatactctcctgcataaaagggtaatggtaaattcaaaacaaacagaactataaccagacatatattgaatgaaacttatgtatataatattgagattggttcatttaactcaagtcttaagcataaagagagttttaacactaaagcaaacagatattcagatagttgtagattgaacaaaggactggagcatgtatttccataccaagttgtgtgcttcatcaaatataagtactgcattatcccatggtattccatttaaagaacgtcgatttcctggatcaataagatagttgtatggagcaaaaagaatatcaaccgacttggaaagttcccgggagatgtaatatggacacctaaaatggaaaataaaacaattgtagtcagcaaaatctgtaggcgttctgttgtgtgcatgtggtgtgcaagttagggcagnnnnnnnnnnnnnnnnnnnnnnnnagtagcataatgngcccaca

SEQ ID NO: 85949 - DNA, 2544 bp, Oryza sativa
catcatgagatgtcaagaagctttttttattcaaaaggccgagattcagaaaaataatgacttgtagcttttctacccacatgatgtttgacatcaacaagccactggaggtaaccacgtgatccttaaaatcttatatgttaggttgatatagcacaaaagcgcaaagcgtatcttgagattttcaaagtgactttcttcttaagtgcttcgatgaaatacgatatggaatgcaaatacagagagattgactaagaaaggctaaatcagctcacatgtagaacagaagacataaatgttaaaagcattcattctgcagctagtccagttgaagcagaaaactaatgataatttgattccttgcttagaaggttatgattagttttgaacctttcatcacaataaataattgctccatagtcatggcgatgtctaatgacacgtccaacagcctgattgacagctcttgccgcttgttgtacataccattcctcccctgtcaaagcctacaaaaagatcacaaacttgtttctaaataattatcaggaattcaggatataaagcatatgaataggattgcactatgtgcatacagtatttttgtttctagttcctgatataactgcttgaagttaataagaacataactccgactaagaaatactttttctgtgcgcattaagctttgcactaaaaagtatatgatctgtcttaaggatgttagttaatgtattgagcctattgcttgcactcactaccaatacaatgttgagaggccgaaggcttcatgaactctgtataaaaccgaatgtcctccaaacagcttcagttcaatcttaaagttttactacaatctagagaggctttaagcttttgactccatctgtgtggctgcagcagttatttgttttataatgtaatttgtccaaacaaactgtcatttgatactttaccatcagagctatgatggtgcagaaaattgatgctccatgatacagcacggtaatttatcatgtcataatatttttggagttgcaccatgtaattagaggaaaattgatgtactttacttaatgagttatgataagttcgagcttaatataaagaatcattgaacaatgaagtatggaaaacaacttaacctttgagttcttgttagatgctgaacccagcttatccaaataatcacgcttgagccgaacctggaacaatcacataaaggaaattgcaaattttattgaaggaaaatggagcaaataattatgaggcttgatagttgttagtttgtactttgcgtcataaaacaatgaatattctagcattgtatcacacggtatttgagctttgtacgaatggagctgagcagctggaagtcacacaaggaggtcaaatttcataagcttataatgtgcacaggatagttgttactttgaatgtgcaaggaactcaaaagcttttttcccaaccaaataggtcccgttaactatattgggagaaaagggtgagcaagaaaatagggaagaccttaggatcagttggggtagcgaagggcattccagtaactattacagctcttccagcacggtcagcaaaatcaagaccctcactaacctgcataagtataaaatgcataagtagtagaactaatatttgaggttagtcaaaatgcaacaatctgaaaatgaaaagcctaccttgttaatactcaaggcatctatccttccaataatatgtgattattatgctttgtttgattatagcacttagtttttttttagcagaattatagcactatagttgaatggctactatgtttattagaattctatgttcagtcctgcttttagtagtgtgttccatcattcataagattgtagctgtacctattaacatcattattagcattacaatactctctttatagactcattgaatgttgtcgaacatgttttaacacaaaagaaaggactaaacatcagagcaaatgaattatatagatccaacaaccaaccagagtcatagaagaatataaactcaagagtatcgaagctttaacaaaaagaagaaagttaacattgaacttcaccagaagttaaaatagaaagtaaaaggagatatgagaatattagatggacaggaacaaactttgccccgacaaactgcaaaaaatattgccccggttgtagaagaatcacgtagcttggctgcataatcctgcaaatccaatgccatgcagttctatgagaaaatagagtttaaagttcaaaccgtgacttataaaatatcccacaacctcgattgcatttggaaagttcgatgactgcctaggctctataactggctgcttgtgcttgcagattcgttgccaaattgtgtgctcatcacttgaattttcatggttctgtaaaatccaatcctcatttcctcaaggccaaatacctcaataaattggaataactcattgaaattacacataccctatctttccagcagttgatacactgatctgatacgatgcgtgcatcaaaagcatcaaaatgccat

SEQ ID NO: 85950 - DNA, 5395 bp, Oryza sativa
ctatcccgttgggggcaacggtatcccgtcccctcgtattcctgtagatgtaaagatgcttaacgccattcacagttccgattgacaagtcacgttgacaattcaagtcagaaattcgagtcagaactcagaataatcttgcgtgatccaagttatccaactaatcagaaagcagccagattcccccccgagagtattggggaaatcttgatgggcgcacgcacgcacggccgcgcagccagttgaggctgacgagctggcgcactggtccacactattctccacccgcttccttcccctccgggccaaaggattggttcacgacccgcgccgcaagcatggtccagcctcgctggccgcacttcagccgctcgccttttgcttgggccgcgccccgccgcgccggatcggcaggttgacgccgccgtcgaccgaatccaatccaacccgttaattaaaacccccccttcctgtgctcagtaaaacgagcccgattggcagtttggcaccagcaccagcagcaggagcagagacaggtgagaggaggaggataaacggaggaggccgcgatgggaaccgtgctggactcccacttcctggcgctcacggccatcgtcactgtgagcaaatccctcgtcttttcctcttcctctctctcgccggtgcggtgctcatggatgtggttggaggttccaggagacgtgattggtgttcttgggattttttttttaatttcttgttccaatttttgtggtggtggtggtaggtgggatatcagctggtgttcttcatcatcaccgcgctcctgcggttcgataaagtcactgatttcgcaggtaattttggcaattgtttgtgtacaacttttcatgggaaactgcttatattattcttgaatataagttctcctcaacaaggaaattgccttttaaatttttggtaatttctgttactgcgttgttgtcttacaggaagtacgaatttcatcatacttgcaatcctcacgctagctttgaagggagcatggcatttccgtcaggtaaatagttgtctgaagtaaaacgtgcccaccttgttattttcttgttgtaaacatggtcccaatgtcttctcagtcacagcagaatgaaagcaagctgttcatttgagaattaattctcattctgccttcggattattcattctttggacttgccatgattttgttgtttgttcggtttaggatgacataacatcattaatatgttgatgaattaggttgggaatggatgtttctgttgacagatactgtagaatttgcagcaatgttacctgtttatttcttcattgtctattattgagtaatactgttcatgaaacgggataaaaatgcctcacttataacaaaagtgcaaacctgcaaatggtaacatgcctataaaagaaaggatgaaaagaaaatgggtagattagtacgaaaattagtggcatgcatgtgtttttctgataaaatctaatatttccaggttgtagaaaaaaatactgcaaattaacctgaaaaaattcctttcaagtgattttgtttcaagcgatgttgcatcaaagagttaaagataacctcgttccattttacatggaaatctaccgacggatagtagctttagccaactctacagtccatttgtttgtatattcttttataattgtaacaatacatgctttttttaatttgtggatttcttaactttcatccctttatcaggttgtattgactgtgctcgttgtgatttggggtcttcgcttaggactattcttattaatgaggtatattattataaaacagcaaagtttgttcaaatatgaaatgcattactaaactttctactatcttaaatgcttcatgccttcacgcatatattctgtgttgttggtctgatgtaggttattgttatcttttttatgagcaacaaaaggatcttatcagtcaaacctgataattaatattggttccattttggaatttcactatggtgctatctctgaaggctgttgctcagcccatcacataactcatttcacttatgaactggttaatgaatttgatcaataagcatgctcaatatgcaaccaccaaagcacagatgcagatggatactgtgaagagaaggcatttatcatcttcacaatatgcttatgcagatggatgcagatgcagatgcacaatatgcttcttactacttgagtccaggactgatgtggtgtcttgataattctagcagtttctcagttttcaggaaacaagcctggtttttcaaggaaatcaactttattttgacgttattattcatgactatgatgttgtagggctgttacatggcctatatatactttatgtaacttccttacttgctacattgcttatccttagcttgagccaaaacattcgatgttatccaaaatgacttactaatgcttatattgtctaaatttgtctaggattcttcaatggggagaggacaaacggtttgatgaaatgcgcgataacttgggaaaactagcagttttctggattttccaggtaaccttttgtaactttttttgcctgcttaatttgttagtggcttaagagagccttaccgggccttctgtcctgatttgggcaggctgtttgggtatggactgtcagcttgcctgttacaattgtgaacgcaagtgacagcgatccctcaattgaagcccgtgatattattggttggatcatgtggctgatcggggcaggtatggaagcaatagctgatcagcagaagcttacgttcaagaattctccgagcaatcgtggaaggtggtgtaatgtgggtctttggagttatactcgccatccaaattactttggcgaggttagtcagtttattttgcacgaacaagcttggttttcactaacctgtaagcgaaaagtatttgcctatgcagtttgaccttgaaaaataaagtaaaacataggtcaatagtttgctaaaaaaaactgttgaaaacttggaccttctcattctctgccattcatcttgcatagctatctgtttctaccaattgcagatattttgttgtgcactgctggttatatatattctgcacacactttatatgatataatctatttaattttacagtgttttgaacaaatactgacatttgtttgacaatttaattcgacacagatattcctttggtggggaatatttgtagcatctactccagttctctcaggagctgaatggctcgtgatcctcggacctgtattcctgacgctcttgcttctcttcgttagtggaatcccacttctggaggttaacaaccacaacttctctttgaaattatatactttgttacttgcaaaaatgctaacacatcacaccattttatgctcctgttttgaaggcttctgctgataagcgctttggacagaacgaagaataccgcacgtacaagaacactacaaggtaaggaagaactcctagacatgacacttttcatggggaaattttgggaaatacaatcgcagagatttctgagttgtaaagtaccatcctacatgagaatgacatatgggacttggacccgtatatcaatgacacatatgatagtattttctaactctgtgatttttgcgattgtattaagcaaattggcccgttttcatatccccactccaagggtccaagcatttctttgcagatttcaacagcaaagggtgactagcttatgcatttgtattttttatctgcagtcctcttatcccactaccaccagctgtgtatggagccctgcctggatggttcaagatgggcttcctcttcgagctcccgctctacaatcgtgtaccgcaacgtgatcctgtcagctgatgatatcagtgatctctagcgattgttgtgtacaatgtgtgtagtataagatacttcctccgtttcacaatggaagtcattttagcattttccacattcatattgatgttaatgaatttagatagatatatatgtctagatatattaacatcaatatgaatatgaaaaatgctagaatgacttatattgtaaaacggagggaggacattgttattgtcgataagtgatttcttttcgctttggttattagggcagtgaaattgtatccacgtgaaaacattacgttcccttcagctctgtttctaagctatccttttggtccctttttaaaatttccatgatataaacagccaacagccattgactatggttatttgtctgagcaaaacacctgatatgattgacaatggggtcagcactaaacgaagtttgtactcctacacattttgacaattatttgtacagagtagctactccctccgtttcaggttataagacattttgactttagtcaaaattaaattgttttgagtttgattaagtttgtagaaaaaagtaataacatttttaacccaagacaaatttattatgaaaatatattcaattattaatttgatgaaactaatttaatattataaatattactatatttatctatagacaattatttgtacagagtagctactagctactccctccgtttcaggttataagacattttgactttagtcaaagtcaaattgttttaagtttgattaagcttgtagaaaaaagtaataacatttttaacccaagacaaaattattatgaaaatatattcaattattaatttgatgaaactaatttaatattataaatattactatatttatctataaacttagtcaaacttaaaaaagtttaactttaaccaaagtcaaaatgtcttatgacatgaaacagagggagtatatttaaagcccgacgtgcattttaacattgaaaaaaaaacatcagaaagtatatgttaatctttgcagttttaactgaaaatggagcaaacaggccatcctgtcgctagattacgacggccaaatagctgtagagacaatagaacttaaactagggccaaaaatcaaaacattctctttcaaacaaaatatgaaatcgctgtgcaagttttaaaccctttcgagagattttcgctgcagggggttgtctccaggcagcagctacgtatacggagtctacacgtcgcgtcgatcacgctcacgccggcgcgatggacaccttgtcgacctccacgacgtactcgagcgtggccccgggcgggacctgcgcggcggcgtcgccgaagtcggcgccgtcgtcgccgaagccgagcgccggcgggacgaccacccgccgcttgccgccggccctcatggaccgcagcacgtactccaccccctcgcacattcccctcgtgtacggcctcgaccccatcaccagcgccagcggccgcttcccgtcgccgaacgtgtccacgaacgcct

SEQ ID NO: 85951 - DNA, 1008 bp, Oryza sativa
ccactaacaaattaagcaggcaaaaaaagttacaaaaggttacctggaaaatccagaaaactgctagttttcccaagttatcgcgcatttcatcaaaccgtttgtcctctccccattgaagaatcctagacaaatttagacaatataagcattagtaagtcattttggataacatcgaatgttttggctcaagctaaggataagcaatgtagcaagtaaggaagttacataaagtatatataggccatgtaacagccctacaacatcatagtcatgaataataacgtcaaaataaaagtgatttccttgaaaaaccaggcttgtttccttgaaactgagaaactgctagaattatcaagacaccacatcagtcctggactcaagtagtaagaagcatattgtgcatctgcatctgcatccatctgcataagcatattgtgaagatgataaatgccttctcttcacagtatccatctgcatctgtgctttggtggttgcatattgagcatgcttattgatcaaattcattaaccagttcataagtgaaatgagttatgtgatgggctgagcaacagccttcagagatagcaccatagtgaaattccaaaatggaaccaatattaattatcaggtttgactgataagatccttttgttgctcataaaaaagataacaataacctacatcagaccaacaacacagaatatatgcgtgaaggcatgaagcatttaagatagtagaaagtttagtaatgcatttcatatttgaacaaactttgctgttttataataatatacctcattaataagaatagtcctaagcgaagaccccaaatcacaacgagcacagtcaatacaacctgataaagggatgaaagttaagaaatccacaaattaaaaaaagcatgtattgttacaattataaaagaatatacaaacaaatggactgtagagttggctaaagctactatccgtcggtagatttccatgtaaaatggaacgaggttat

SEQ ID NO: 85952 - DNA, 2508 bp, Oryza sativa
attgtaaatgaatgaactattactacaaaacctgaaaactgggtattatgtatgtcacctaaaacttatgcaatttttcatttgtatcctaaccacctgtttatatcactgaccaagtttttacggatagaaactatctcatcaaggactcttaacgtagtatagtaacccactatgacaggttaaaacagagtaatagaacctgaaaactgggtattatatatgccacctaaaacagagtaatagaacctaacgaggatttttctggagatttttcctcgcttttttttaaaacagagtaacagaccgaattttaatttataataaactttatcaactcaaggacaattcaatagccagacgcaacggttgaaagtatagtaacccactatgacaagttaaaacagagtaacagaccgaattttaatttataataaactttatcaactcaaggacaattcaatagccagacgcaacggttgaaagtattaagagagaaacaatgatgataacacaaaccaataattggatggtcaaatttctcatcagctagaacacaatctgtggtatttaaaattcttgaaaatttcaacctttctacaattataaactaaatccacggtatttaaaatacttgaaaataccaacctttctacagttctaaatcctcattgtattgtggattctgatacacaagacaagcattcaagtataaaaaagcaagacctgcccttattttttttttcatatgggtatagaaaatttattaggataaactttggagaagcaagcacgagagtcgttatacagaaataatagtgcacacctgcatgccacatacaaaacaagccttcaaaactaccttgtatgttattcagacggttttagatagttcaggggttatttaggcagtttaacagttcaggaggtggaggtgacagatttctccgttttgaataccaagccaaacggtgtacaaaaacatatgaaagaagaaagaaaattagcacctctttggactcaaatattcaatgttgctagaccacataaaatctccacaatgaagatcagatacaatatatgccctctgcaaaaatgatagaagaacaaatctgaagcaatacgctactgtaaacaacaaacataacaaaatatgatatatatttaggcggtaaaataatgcactacatgggccatagtagagtttgcattgatcaccaacaataagaaaagatacataagtccagaactaaaccatcataaacatatcctaaattcatgacaatatagggcatagttttcagacatataataaaaaacgagtaatcatcataatgtttgtacctcgaagtactaatctagaattagatccttctgtttccaaaagttcccttgtaatactggaggatctttggcccattctgcagtagatgcttcagtgagttgcatagactgtgtcatttcgtcttggaggtctatcaggaactgagcctggcttaaatttggatgcttcatgccttgcaagttcaggtggcacaggactgttgctctgtataagcatctgtttcagatcaaagaaaatgtcagtgttctccagagttaaaaacgaagttgccaatcccttctttcctgcacgtccagttcttccaatacgatgtgtgtatgtatcgattgaactaggcatctcatagttgatgacatgagcaacatcgggaatatcaataccacgcccggcaacatcagttgccacaagaacagtgaaccgccggtttctaaatccatcaaggctcgtctctctctgctcctgtgacttcccaccatgtagtgttgtgacgcggaagcctgccttgtctagatccttcgcacgagcatctgctgatttctttgtgttgcagaacacaatggctggcttatccccaagatctgtgagtatcttctggagccttgacatcttctctgactccttcgtcatgatcacgttctgtgtgatgagatctgtggccttgccagctgtaccaattgtgacaacgactgggttccgcaggtacttcctagcaagccgctccacagcaggtggcatagtggcgctgaacatataggtagtcctatagatcgtttttgcatcaagctcctcatcctcattctcaggtttcaagttactcgatggcatagcatcaaggactccaacaacctgcggctcgaagcccatatcaatcatcctatcagcctcatccagaaccacatagttgcactggttgagcacagcatacctcctctccaagcaatcaagaagccgaccaggagttgcaataacaacctcacagccctgcctaatcttaaaaccctgctcttcaatggattgaccaccaacgatagacacaaccttaatgccaagataggtcgcaaatttcacagtctttttctcaatctgttgagcaagctcacgagtaggtgccataacaacagcataaggacccttagcctcattttccttacttatgggtggga

SEQ ID NO: 85953 - DNA, 7793 bp, Oryza sativa
  unsure (1)..(7793): unsure at all n locations
tcttcgattcccgtcgctccggtgagtctcgcgtcgattccttgcgcatgaaccaccctagggacctcactaataacatcagagcacatgcatgtttattagatcggtggatcaagccgtcgccgttcaccccggaggttcttgccgccgccgagcacgattccggcgacgagacggcgacggcgcgatggagaccgacccgccgccgccgccaacccgacccccgtccgtcgctgccgccaacccgacccccgtccgtcgccgccgccaatgcctatgtggcccctgctcctgtgaagacaaacgggggagaaagagatgagggagagagagggaggaggaagagctggccccgccgccgaccactccctcgaccgccgccgccctagtgtcgctgaaagggtcaattaggcctagaggagggggggtgaataggctaatttaaaactttatgcggaagctaaaactgagttagggtcggaaagtctgatccacagtcagactatccgaaaatatcagatagtctgatgttggatcagactgtctgatccactaaaggaacactacaagtagatctagtgcacaaacaagagtatggcacaaacagcgactagatctaaagcggcacaaaagcaaagctaaataataggagaagagatatcaccaacaatgaagttcaccgagttgttcccggagttcaaatccttgaggggattctactctacgttgaggagctcactaagagccgggtctttgctaaccctttcctcaagaggttgcactaagcactcctctttccactaaggggtatctctttccttgtggaggcgagatccggccttcacaaacttctcccggccaaccacacgtagatcggtggctcgggagtgacacctagccgtttaggagtcctcaacctccaagagtaacaaacaccacacaactcttggtcaaaccctagtgctcaagatcgagtgaaacacacactaggccctcaaacaccaaatccacaaccaccaagatctactacacaaagaacaaagagggatttgagagagggagagagagctcaaagatccaaaacactttagcaccaagctcaacccaaagtgaatgtgaatgaatgagttgggtaaccctagaaaagggttaggtggggggtatttatagaagcccccaaaatgtggccgttgggagagaatcttttcatcccacctcggaaagtccgaggtgacatcggatagtccgatgtttttgacccccaagcaggccagagacagagaacaaaattctagaggatttcggacaatccgatcgatcggaaagtccgatgtcatattggatattccattatttttgaaccaagaatttcatcctctcacagagactcaagttccattgaatttcggagtctctggatcatcggatactccgatcacatcggatagtctgatttaaaactcactcaaaaggaataaaaagcaattcaaaatagagagtgaagttctgagaaatttcagatagtccgacgtatcggatagtccgaccttatatcggatagtccgatattttttagccaacactcagaccgaagacagtgagcaaagttctgtgaaatttcggatagtctgagcatcggatagtctgatcaacatcggacagtccgacagacataaaacaggaacacttcaaataaatgattttgagcactagtgttctaccaattatatgcatgtggcatccctcttaatagtacggcatcctaatactcaagaacacaagatatacatggattagaagacaattaccacaaaagatgccgcaatacttattgtgttgacatccactcctttttcatccttgcatacatctcaacaaaaagcattagttaccctctaattgtgttgtcattaacaccaaaataaatgaggggtcctagatgcactttcattctccccctttttggtgattaatgacaacacacttagaagtaataaaagattaggattttggtggagctccccctaaatatatgctagaaatgaaataggagagctccccctcaatctatgcactagattagaaatgacaatataacctcatgcatatgccaatgacaagatatttcacacatttgagcatggataatagataattgcacataacaagacacaaaaacccaagggtcgactagccatcacgaaaggagatagattagagatttttgatgataggtggttctccccctttggcaacaaggcaccaaaagggaaaaaatagaggatcactcatccttatcagaatcctcgccctcctcacttgactcctcagcatagtcaccttcctcctcctcttcttcttcctccataggagccttgccatgatccgcacgagaggagcttgcctcagctgcaaaagggtcctcaatcacatcctccccactgtcctcaacctcagaaccatcgggagaacacggcaaatgggtgttgcgaaggagggtcttgatccgtcgagtgtccttcttccttgctctgcgttccttggcttgccgaactgagatggtcttgcataagttgaagatggacttgaagaacctcaaggacgagttggagtccggcttggtgacggtagcggagggaccggcacgagaagaagcacgagtggttcgtccagccggcacagcagcaaccttgatgggacggacttggtaatcggtatgtgccacctccttgtgaaacttcttcttggacacaatctcaatcatcttcataatgtaaggcccatagccaagtcctcgcttaggcatcatggagataagccggatttcttcaaagatgaagtcaaaggcgtcaaagagctgtgggtgagccttcatcttgtaaagcaaatttcttgtataggcaaggacgttgctagcatcaccttccttgggattgagagttttgcgcaagagcttgttgagataggcatagaagggaaggagacctttgatggtgcctaactcatagtccacatcttggtacaagaagtgaagagaatttgtgtccatgggcttctcatcatgaatcttgacacgattggtgcgagagcgagtcggaaaccccaaaatggcagcaaacttagcatatgtcacggagtatatgatgccatctgtcatccaatgaataatcttttctttgttgggctcaaaataaagtgtggcatagaattgtgcgaagatttctttgcaccatgggtattgcaagcccatgagttccttcaagttttgccgagcacaagcttcaatgacttcatcaataattgaatcatgcaactcctccatatacttccaatcaacccactgcataagaataggccccttcttaggtgcattcactgtctcatagtaatcctgctgaaaaaggttccaaaaccgaggatcagtggacaactgttgaaatttgtagagatctttcttacgctctttctccacttcagtccacttgcggttccaccttatgactctccgatgataattaggatctctagagggagcagtgataaagaaaggcccttcttcctgagcggcttgctgagcggcaatgtcctcttctaaatgaatctcttcctcaaaggatggtgcatgagaaccactaccttgacccggctcagaagaatccgtaggattgcctctccttacttttttagcaggtgcacttgatctttctccactgactcggctgcggcgaggaggaagaggagcaccatgctccacattagccacttgagctgcttggtcagaggcttgagcttgcgcgtcaatggcatctttgcgagattcggacatacgccgtatagcatgacgagccttggaagcgggagagcgacctcgagaactcattgtcccacggcgagagtaaacttgattcttgaactgacccgtgatcatgaggatacactgatttagaacagaggataatgattaagaagaagtggaagaagaatatttaaatgtgaagcaaggagaaatttggactgggccaaaaggaggtcggatagtctgatttgacgtcggactatccggtgtacatcggactatccgacagcatatcagacaatccgacggccttttgccctagaccaacaaatctcgattcacacaaacatatccaatggaatcaaaggatcttctaggtactagatctaggcactaaaacaagaagattcaccgaaggaaatcttgaaataatacaccatgagggagatcgagggaaaacaaggaaatacctcaagaaccactaagagaatcactggggaaccagtgatttggaaggagttgagggagggaaaccaccctaaagtgaaggaatagcaatcggagactccgaaacgaagatttttggtggcctagaactagggtttggagtggagaagaggggtggagagagaaacgactgagacaaatgactgaaggggtaagaaagagttacccccggggaggttaagtccccttgcccttggccccacgtcggatagtccgatttgaaatcggactgtccgattgtagtcggatagtctgacttgatgtcagacagtccgacatcctttgtggcagagacaataaaggatggctcaaggaagatttttttcaacaacattttgataggatgaactcgatggctagactattacttggacaaatgcagcaaaagaaagaaaactaggcaccctcgagagagggaatgtacgaatctatagcaaattgtgcaaggaccaagattcattagagaatgagatccccgtacacatagatttcaagttatccacatagattatgactagtgtttattcatgaattgaatgttcactttgtcatgatatggcaagcaaacctattctagtaaatgaaaaacacatgcatgcaaaagatcaagccacattccgagaatccaagatatttagctcacttctcaactcacaaaacctagcttcatctagaggcttggtgaagatatccgccaattgtttgtcggttctcacatgttggatgtctatgttgcctcttgtggaatggtctctcaagaaatggtggcgaatatctatatgcttggttcgggaatgttggatggggttattggctaacttaatggcgctctcattgtcacataagagtgggattttggacacatttaggccatagtctctcaaggtttgcttcatccaaagaagttgagcacaacaactccccgtcgaaacgtattccgcttcggcggtggatggggcgacggagttttgcttcttggaagaccaagaaacaagggacctacccaagaattggcaagtacccgatgtgcttttcctatccactttgcacccggcataatccgcatcggcataaccaatgagatcaaacctcgctcccttaggataccaaagaccaagattaggtgtgtgcactaaatatctaagaattctcttcacggccacaaggtgacactccttcggagcggcttgaaatcttgcacacatgcacacactaagcataatatcgggcttagatgcacaaaggtaaataagtgagccaatgatggaacggtataccttttggtcaacgtctttaccttgctcgttgaggtcgaggtggccatttgatggcatgggagtgtggattggcttcgcattctccattccaaacttcttgagcatgtccttcaaatactttgtttggcaaatgaaggttccttccttgagttgcttgatttgaaggccgaggaagaactttaattcacccatcatggacatctcaaaacgtttggtcatcatcctactaaactcttcactaaaagacttgttagtagaaccaaatataatgtcatcgacatatatttggcacacaaaaatatcattatcatgtcttttagtaaaaagagttgaatcggctttcccgatctcaaagccgtttttcacaagaaaattgtgaagacactcataccaagctctaggggcttgcttaagcccgtagagtgccttgtggagcttgtacacgtggttgggatacttcggatcctcgaagcccggtggttgctccacgtataccaactcgttgatgggcccgttgaggaaggcgcttttaacatccatttgatatagcttaaaattgaggttagtagcaaaagcaagcaatatgcgaattgactcaagtctagctattggcgcaaaagtttcaccaaaatctaatccttcgatttgggtaaacccttgcgccactaacctcgccttgttccttattacgaccccggcctcgtcttgcttattgcggaagatccactttgtgccaatcacattttgccaaggtcgctccaccaaagtccacacttcattctgggtgaaattgttcaactcctcttgcatcgccatcacccaatccggatcattaagagcttcttccacccttagaggttcaatagaagacacaaacgagtaatgctcacaaaaatttgcaatacgagaatgagtggatactcccttgttgatgtctcctaagatgttgtcggtggggtgatctcgttggatactttggtggattcttgggtgagctagatttatcggagagggtggcacttgctcgccttcttcaccttgatccaagcttgaagtggagggattgtcggcttgggttaatgtaggtggctctacttgtgttgaggaagaggccccttgttgtggctccctaggacgcacgtctccaagagccaatcttttgattgcttcgctagggtcctcctcttcacctaacacatgtgagtcgacttgctctacttgagagccgttagtttcgtcaaatgtcacatcacgcgcgatctcaacaataccggaggtgttgttgaaaacgcggtatgcgcattcatttgacccatgcccaagcaagaacccctcatcaactttaggagcaaactttgaggatctagccttcttattaagaatgtagcacttactaccgaaaacacgaaagtaagagacatttggtttgttaccggtaagaagctcatagggagtcttcttaagaaggcggtgaagatagaggcggttgatggcgtggcatgcggtgttgacggcttcggcccaaaaacagtccgatgtcttgtactcatccaacatggtcctcgccatctcgatgagagtcctattcttcctctcggctactccattttgttgaggtgaatatggagccaagaactcgtgcttgatgccttcttcatcaaggaaactctcgatgcacgtgttcttgaactccttgccgttgtcggttcgaatgttcttgatcttgaggtcgaactcgttttgggctcttcttgcaaacttcttgaagattgcttgtgtctcactcttgtcatgcaagaagaacacccacgtgaagtcatcaacaataacgagaccatatttgttacctccaatgcttagataagcaattggccctgtcggtgacatgggaccgggggtatcgtgactagaggcttgggtagccgcggtcgcccacgtggcctgaccccctcggggggggggggtcntntccaactgtaacatgtccacccatgctttatatgaacttgttggatttggctatatgtttatgctatattgaatgcactttggaatccacaaaatgagaagttatgctgtcaaaattttgtttaattcattttgtcaaaattctgacaactttttagtcaaatctgtcaaaatgaatcatttttctcaaatttatggcaaatctgtcataattgtgatacattttatttaatttattttcataa

SEQ ID NO: 85954 - DNA, 3074 bp, Oryza sativa
aaaagtcgctcgagaagcacattgcatttgaaaaaggcaagcgagtacgcgtggtcgaaaaggatgcggaagcggctcccaaggagtcggactcagcatatccagactctgacctccacgtttcacacatcttcggaggttccacaacgtactcctcaaagcgagaatacaagaaagtggaacgtgaagtctgttcgacatggcagggggctgcacccaagatgaagtggtctgaacagaagatagaattctcggaagaagaccaccccaagactgccgtcatcccaggacgatatccgatcgtggtcgaacccactattcggaacatcaaggtcacgcgggttctcatcgatggtggcagctcaatcaaccttcttttcgccggcactttggacgcgatgggaattccgcaaagcgaattgacaccaaccgattaaccctttcatggaattactccccagtcatcgtccaaaccattgggcaagattacgttgcctgtgactttcggccaagctaacaacttccgaatagagcagatcacctttgatgtcgctgaattcgatacagcttataacgccatcattgggagaactgcacttgcgaagtttatggccgcatctcactacgcgtatcaagtgctcaagatgccgggaccgaagggaataatcactatttaagggaatgcaaagctggcggtgcaatgcgacaaacggagcctcgacatggtcgagcaaacgcccagcccacccgccacgaccaagccacccaagaaagtgagcaagacaaacaagacgccgaaaccggacggcgcaatcaagatcgttccactctccagtgccaatcccgacaagaccgtcaagatcggggtgacactaagcgagaaataggaactcgcgctcatcaccttcctccgcgacaatgctgacgtgttcgcttggcagccgtccgacatgctgggggtccccagggaggtgattgagcacaaactcatcgtgcgacccgatgccaagccagtaaagcaaagactgcggagatttgcaccagaccgaaaacaagccatacgagaagagctcgacaaacttctcaagcctggcttcatcagagaagtactacatccagagtggctagccaatccagtcatggtgcgaaaggccaacgggaaatggagaatgtgcgtcgacttcaccgacctcaacaaggcatgtcccaaggatcacttccctcttcctcgaatagatcagctggtggactcaacagccggctgtgagctgttgagctttctcgacgcttactttggctaccaccaaatcagcatggcaaaagaagacaaagagaagacaacattcatcatgccattcggggtattttgctatgttaagatgccattcggactgataaccgcagggaatactttccagcgcacggttcagggcgcacttagcgaccagctcggcaacaatgtcgaggcatacgtcgacgacatcgttgtcaagaccaagacaagcgactcattgattgacgatctgcaggaaacgttcaacaacctccgacgatatcgcctcatgctcaatctagagaagtgcacgttcggagtaccatcgggcaagctgctcggattccttgtctccggcagaggaatagaagcaaatcccgagaagatcaaggcaatcgagaacatgaagtcgcccacaagactcaaggaaatacaaaagctaaccggatgcatggcagcactgaacaggttcgtcgctaggatgggagaacgagggcaacccttcttcgctctgctgaagaaacaagacaaatttgtatggacacaggaagccgaagaggcattcattgcactcaagcgctacctatcaaacccccctgtacttgttgctccccaacctaatgatgaattattcctctatattgccgccacgccatattccgttagcaccgtcattgttgtcgagagagagaaagtacaacgaccagtctattacgtcagcgaagctctccacgacgcaaagacaagatatccacagatccaaaagctgctttacgtggtcatcatgacatcaaggaagctacgccactactttcaagcccacagagtcacagttggctcctccttcccgctcggtgaagttgtgagaaacaaaaacgttgtcggccgcattgcgaaatgggtagtcgagctgagccagtttgatgtccactttataccacgaacagccatcaagtcccaggtactcgccgacttcgtagccgattggactatgcctgatgacaaatcagacaaccaagtcgacaacgaaacgtggacaatggcgttcaatggtgcactcaacagccaaggagcaggggcagggtttatcttgacgtctccttccggagatcaattcaagcacgcaatccacctcaacttcagggcgaccaataacacagccgaatacgagggattactcgccgggataagagctgcagccgcacttggggtcaaacgactaatcgtaaaaggagactccgagctagtcgtgaatcaggtgcacaaagattataaatgctctaaccccgagttatccaagtatctcgcagaagtcaggaaactagagaaaaggttcgatgggatcaaggttcgacacgtttaccgcaaggacaacatcgagccagatgacctagcatgacgtgcgcctagacgagaactgctcgagcccgacacttttctggacatcctgacgaagccatcagtaaaagaggttagcggcgaagttagcccggccgccccagacattggcgcggaggccacaaaggcagaacgcgccgttgccgatatcgagatcacagatgactggcacatcccacttatgaaattcatcaacagcgaggagttgcccgaggacgatacagaggccgagaaaataacccgtaaagcaaaaatctaaagtgtggtcagcaacgatctatacaaaaaagcgccaaacggggtacttctcaaatgcgtctcgtccgacgacggcagacacctcttccttgatatacatgaaggcatctatgggtcacatgccgccggtcggacattggtcggg

SEQ ID NO: 85955 - DNA, 7374 bp, Oryza sativa
aattataattacgtaaatttttttaataagacgaatggtcaaacatgtgaaaaaaagtcaacggcgttatctattaaaaaacgaaggtagtattaaatatagactacttacaaaactaattacataaatgaaaactaattcgtgagataaattttttaagcctaattaatctataattagagaatatttactgtagcatcacatatgctaatcatgtattaattaggctcaatagattcatttcgtgaattagttcaagattatggatgggttttattaatagtctacgtttaatatttataattagtgtccaaacattcgatgtgatagggattaaaaagttttagtcccatctaaacgggtgcttcgccctttttgccgccgaccgtagggatcacatcgctggtgagtctagaggataactcattttcttttttcgattacactgtagatgtacacatgcgcacaccactgtacaggaacatcacacaccccctcataaataagtcctttaacatatgctttaagagataaaaaccatcaatacaaccatgatctcattgaatttttattaaaaacccatttacttatgcctaatatttttaaatccacgacaacaacaccgcatcactattgttttccaataggataactcattagccacagtagcagcaagactgcaagagccgggaaaaggaccggacttgtccttcaccgcggcggcaaagccacaacggcgaggctgccgacagccgagctcgccgcggcctcgcctggctctctctcccggcggcacagagcgcgcgggtggggccgcccggccgcgtcgcggggcgcgcggcggtcgcgtacgggccacaggcgcgtcgcatggggcggatccggccacgtcgcccgcggaggtggagggtgtcgccgtcgggcgcgatctggcgctgtggctatccgtcgagtcgagctggtgtggctctcccctgtggggcccggacgaaggaaagcccctgcagctatgctcgacacgtcagctgtagtatcactgtgtgtggaatgtgtgttgattttcaccggccgtacgcacttgaggttgaggggatgtctgaacatcactgatttggtgagcgacttatgtgagcatttttgctaagaaagaatctcgtcgcttatcaccctgcaaatagttcagctatcaacttctaacggcgttttgttgatggatgattggtgatggataaaactgagtttaggcactacaaagttgatataaaaaggttctatactgatgaatattttttttttcaaaagtcatactatttaataggttaaaaagtgtctccataatatgccttacatttacgagtagaccgtgttaacgatatacgaacttgtcaagtggatgcaatttagtacacaaacttacgagagaagtacataaacggtctctaaacgtgtgtgggtgtgttacctaggcttctgaactcccaaaatgcatttttgggtctctcaatttgtcttgggtaccatatagttctaaatgggctccaacccactccgtgtgttgatgtagcatgccatgatggtgcatacgtgtcagtagaacccatatgtcagtcatatattgaaaaattaagaacataattttctcctctctttatttatttatttttcaaaattaaaaacataattttatcctctctctcctctctttataatttttatttttttctatgtgactaatatgtggattccgctgacacttaagcgtcaccatgacatgccacgctgtctcatggagcgggttggagcccatttgaacctatatgacacttatgacatgtttaaagagctaaaaatgtattttgagagtttatggacctagatgacatatccgtacaagtttagggaccgctcgtgcacttcactcaacttataaacattatgatgcataaacttttcttttgcgtgcgaacatttgtaaaacgatgtattatatagctagtctgattatagaatgttacacacatttgagagcatgagacatgtcgtatgtgcaaataattaacatttacactgtacttaatttgttcttatattatttcgtatccattacatatcccctttatatacatttttaatatgtataattaacatggcttgttatatgtttgatatgcatatctactaacatcatcttgaaattcgagcctacataacatccatctgcatccaacttagtgaaattagttacgacatgtttttgctttggtttatatggaccagacaagtttatacattaaaatgagtaatttacaaattccatatactaaatcacactcacctcgcaagttcacgtaccaacgatacaatttacgctagaattactcaaaagagtatactatgagatgtgcttctatgctcttcaaagaaaaaattgcacaatttttaaagaagatgagaggttcagattagaagtacttcaatagcctaaaccgttttaacaagggcatttttgtctttggagaaaattaccctgtatcaccgcccctttctcccgccgttcttctccacctccggcgccatcactcgaccattttgtcaaaatcaccatggcggcgctacccccgaacaaagttgtcgtaggcgccagtatctactctggtcctctcgatgaagcttcttgcccgtgattatgtcatcgtggttaggactgcactgcagcctgatcccaacactgagcagatccattatcatctctgatttggttgctttaatcaatagcatcacgattaagtaattcagctagttctctcaggtttgatgcagaggctacaaataaaaaaaacagatcggcttataacttttgatgctgtttcaagtgatgaacgatttgtgtttgtgatgcaatgcaaatgcaatggtgatcgcggttgttgtttagtggctttcagtttgtgacggcggcgagcagaacaagttgccggtgagctttggtgtggcttccgaacttttaggatcggagattaactccctctcaaggatgaaattgccctttctgaataatgtttatactatcctttcatcttctttaaaaattgtgcaattttttctttgaagagcatagaagcacatctcgtatactattatttagtagctgtgtcaattactcctagttaacacccactctagggatatgctgacgttgcatacggcatgctatctactttgcccatatcccatgcctcatgacttgctctatacgtgaggttaggatctaacaactggctttgttaggacccatgtgtcgatagcatatcaaagatctactgcttacctggcgtgccacatcatcagtccatcgctgatcaggaacagccacatcttccaaggccatcggctgaagttcatggatatagtatacgtgccttatgcatctcctcaagcccaaggagtcgaagcactcacactttgtgaacctagcttggcagtgtctcacgctccacacatatattttttttttcatgttagaataatatgtatatatatggtgtaacaaagtcacagttagttacattcaaatatatgtaggagagcaactctgtccacaataattattctcaccagccaattattctccacaaaaattattctcgcatgagaggacctttcatgcgcacatcgatcggtgtcagttttgcgaatttgtgttgtctgcgagcagatgccgaccttgtatgataggaacacccaagagagtcatgccattggcaattaatgaggaaattcgccctagtagataggtaattgttgcctttttcattaaaaaaagtaaaaataggtagcttattattatcaatttttataccagaccaagagagagagagagagagagagagagagagagagagagagagagagggagcacgcatggagcagagctttcttgctgattttcatgtgatttttcaataagaacaatactcctttacttttagaaagatctcagagttccttttggattaccaaagatatatggatctctgaattgtaccttaattagtaattccgaaaactacagccatattttctcctaaagttacaaattttcttttagctaaaaagttgtttataccacagcctccccccctcctcccctaataaaaaaaatataattgactagctaaatgtctgtgtgttgtaacgagattttaagaaaatcatcatacatggtagcaaaataaaaatattttctccaatctatggtcatcgttggtatcgttttttacacatatatcagcgacatagttgctccaactgataaacaactaatcgatataaattatttatatgcctagaaaactgtatttgatccaggtaaagtaatctgaggctcatcaaaacgttctcttaacctcccagtataccgaaaaggcaaatagctaaaaaaatgaaacgaaataggctgggagatagccctgctgccttgctagcagcaggttgtgggtgggaatcaggaatgggtaaaaattccccttcagttgttccatatgatcaatgaagtttctttgaattataacttaaaaatatatttttggaagaacaaagctgattaatcctttgtctagaacgtcaaataatgctatcagacgatatagctcatacccattttcacatttacaaataaatatgattgtcctgacagctatcccactttctcgttttgactctccttgtaagatgccatagtaccatttttggggtagaatggttatttaacttattcatcaatgtacagctgccatagtatgacttgttaggggacacatgcggatgagcgtgtgcgtatgcacatttcaaacaccaacaagtgcatatgcacatttcgagagatggtgaagactaacaaatctctattctcatttcctcgcaaaaaactctattctcattaaatctctattgaaaatgcacctatatataagtaatatggatcatctatatattgatatatctaaagctggctaatctccttgccagctgattggtccatcttttatccgtttatttactgccacgtgtctctccaccatttagacaacaggcgtagcataaactccgtgcttgcagcatgcatgcctctgctgccattcaggaataactgggagtaatggtgtgagcctctcgcgtaaaaataatgcactttctagacgtctcgcttgcccacattggttcgtgggcaattgcagtgctttcgcactatgccgaccgagccaaccatgcagtaagctcacatattgtcgcatgcatttgcataaactaaaccagtaacttgtacgaagaaaagcaataaacaaattaattatatataaaaattaaatttcaatatagacggttcaaatacaagaggtgaggatataaatatatattttttctatcgcatctgcaaatttaacttcttagaaagtaaatgagagatttcccgaaaaaaaaggagagattccaacaagttatcatgtatttcttaaaaaaagtaaaggttttacttttttaaaaaaaatagaaatcaagtatataataaaaactattttattctaatcacaacagcttagatgctaaactttacaaagtacaaaagcaatgtagaatattcaggaaatacgcctttctatatattaaaatatcatcttcaccactgataagttaaaacttaaaacaatattattctatagcatgatatatgttattcttgggtgttctacaaacttatctagaacacactaaaggatactttcgatgtaagatatttgcatatacttgatataaatctttacactaattgctataaataaatcccatattccaaataatatctaaatgaaatattagaggctaaattagcatgcgtgccaacatgcacgctcattttctagttaggatttaaacatagtagatagagtcatatacccacgatcactgccatggttcatctcagttaattcccaagaaggtcgccaagctcaaaattaccatgtatgtatcctaaagcgtagaagttggataaacttatggacatatatctaaataaaacatttgaatttatgttctggtaaaaattaaacaaccatcatgtatattctacccaatacatcacaatcaatcccgctgtttgatatagagtacgcttcaggcgtttttatcgacctactacaacattctcacaaaactgagatgaccagttgacaaggcaccattatccatgatttatgtacagcacgcgtgcggataggcatagcctactgtcttatacaaaatgatagttaaattaatttccattccatttggcatcagctcgatcaaacagacaaacactgttcagaaatactgtttcgaaagatacagatcaatcatggcatcctacgcttgtcgggctaccgcctgtgagaacaagtaccatgagcatttaagcacaagactcaggattatcacgtataattaaggccttctttagtttctaaaataaaaacttttcacccatcacatcgaatgtttggacacatacatagaatattaaatgtagacaaaaagaaaaaccaattacacggtttgcgtgtaaattgtgaaacgaatcttttaagcctaattgcgccatgatttgaaagcaaataaataaataaaattattatgttgtattacctctgttttttaatagataacaccattgaattttgggtatatacattagattatccatcttattaaaaaaaatcatgtgatcatttaaatcaaatgatctactcactctatcgaaaaaaaggcaaccttccagattcattgtcctaggtgatgtcaaatcaccacctatgttaccctttttaggagagggagtaaaaattaacaacgccatctattaaaaaacagatgtagtattcgagtggaggcaatgtgttatatgcattaccccttaattaataactactccataagattattggtgattatagctccgatatatgagtttttttcttttattcgctgatggatgagtcaccaacccaagaagatcacagagttgacaacacgaacctcctctcgtagtaatcctctctcgcctcgtgcccatcccctcgggtggcccccaccggaaatcccacggcgtgacagcccgcccaatggcattccgcccctccggattccgcgccccccgccagccaatcaccttccagataaccgtcctcccgggccccacctcctccccccgtcccgccacgtggcgcaaaagcgtgttcacgggccccacctccctgtcagccgacccgcactgtcgctgacgtgtgggcccgggggtcaggacccgagtccgcgattttataaaggaaacggctc

SEQ ID NO: 85956 - DNA, 916 bp, Oryza sativa
ctgcctataaatagcagcagcaccttacattcaagaatcacctctcaacacacaactaagaaacatagctaggtaaccagggaaggtagcatcagcagcaggaggcaatggagggaaagaggactaccacttcgatggtgatcatgtgcctggtcatcttgagcctcactgtcgactccgccaccgcggcacagtgcggctgctgcatatcctctcgggcaaaagcatgttgttttggttgtattgctgctggtggctccgactcaatctgcaagaacacttgttgtttcccatgtattctggccgattctggtaaattcactgaagtcactcttttaaatgcacttcttatatgtagatacagactttgtagcatatcgtggactaatacatatgtgtggccttccatgcattttcatcaatatagtttgttgacttcacttcccatctgacaacttcaggcatatatcttgcaacatgaagacaatttatgctctacttccactacaaaattaattaactaatgcgctaatgtgatttccatattttaatttcacagttgttgctaagatggacgaaatgggagttcttgctaagatggaaggacaagcctaaaacaacctactcgcattgctaccagtcttaatgcctttcataagaatatgttgttttgcttcaagttatggccaagttatgttaatgtttatctccaataaattgttgaccatatggagcgatctatagtcgatccatctgttggtcccaactatttgtatgtcgtgcatatgtgcgctcacaagcatatttaatttctcttgctacttttaataaggccatagcactatccaatgtgtcatctgttggtctctgaccttagcaatttaatgcaacatgattattattatttgtgtgtgca

SEQ ID NO: 85957 - DNA, 6591 bp, Oryza sativa
cgtttcgcccgccgaccgccggaacgccgccgtccccgtcgacccgtgccgcgccgccgccttcttccgctccggtcgccgttcccgtcgtcgtcgtcgacccggggtgagccgtggaccgcccatttcgtttcccccttccctcccctctctcggccgccgctccgccgtgcctatggccgccgccggcgaccataggggcgcgggcgcgtcgcctcccgtcggctgtgccggcgaggccgccttcgggcgcgccccgcggctgccatgtggggcccggccgtcagccgcccgcgccctcgggtgcggctgacgcgtgggacccacggcgccggccggcgtaagccgcgtgcacccggtccaccgtggaccgagaggctgccgcgtgggccccactcccgtggaaccggtccgcgcgctcctctctcccggctgacgcaataaatatgtttttaaattaaaatttaaatgaagaaattcgtaaatatccatttaaagagcatataaacttcaaatggccataacttggccatttgaactcggaattggaccgatcaagtctctaatttttccttaagaagccaagaacccatttttgtgctttgtttctgcttgttatatggagtttagtagagtaaaagccgtttcttttccgttgtcgtgtagacgctgcagcttcggaagatccgctcttcgtggaggttgaagccgacgtttgggaaagcgagcaaggcaagtcacatcatctttgaacatattgaatcccagtttgtaaaattatgttgatttaacttattgcattatcgctttatttaaattcccgcgtcatcactgttttacttagccatgcctatttacctttgttatgaccttattattattgttattgttattatttccttgttcaccctagaataaacaaaaccccaactagtggacactctactcatggtatcactagtatgattttaggtagatgcttcgcttttaattaggtaacattaggcggttttacaactctagactttgggaatattcatatcacctggacaccatggaatggtttggttattgtggaattggcttcacaccgctccttctattcaaaatccccaaaaatggttttaggctgggctcggggtgcatggttttgacagtagcacctcggccatataaggaccggtcttcgggcctctgttgcaaagcactaccgtacttccacatgtctagtgggtaaggcttagtttgtggctcagtctagtcataaacaaaagtacacggatggagatggaagaagtcgggggtcgatggacatctctaggacaaatgaaggctacacgagctgcggcccggtagttgagatgtcatggcacagggccggtgtcctgctgctaggggctcagtcctgcctgcctgtcccgggggttccggccgtaggtgggattgggtcggtactcttgtctatggctaggatgggttggaaactatgtcacgtctttcgtctgtataccgtgctggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggcgttgggttaaggcaggttcgtgtgggttcacggccttgataaaaaaatattgtatagtactagaatcgtgtttgcaaaatagccctaagcaactaatgtctttaaatgctgtctactgcaaccctaaccctttatagtataactcctttgtactcccttgcatttattctgcacttgtgggtgtgtcttgttgagtacggtggttgtactcagtcttgctcaatttttcccaaacccagaagaggagttcctggaggatgaaggctttggtgtctagctcgtgcctgccgtcaagtgcctgtggtcgtcgccctagtcttccgctgtttctcgtttgtctttgtgtgtgctgggccttcgctgcccatgtaataaattaactatttacgcttccgcttgttaaactctgaattgtatcaacttttggtgtaccttgcctcctgggacaaggattaatgcacgcacgtaaggtacgcccgttgggttatttccggtcgtgacattgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcagtcctgcctacctgtcccggaggtcccggccgtaggtggggttgggtcggtactcttgtctgtggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcataacaactaaaatgtggaatggttggcctgggttggcttgggacgagctgggacccagggtcgggtttccagttcggtctgaatcatcgtaggccttgggttaaggcaggttcgtgtgggttcacggccttatttaataatattgtatagctctaggagcgtatttacaaaatagctttcagcaactacgtgtcttttaatgctgtttactgcaaaccctaaccctttatattatgactcccttgtactcccttgcatttattctgcacttgtgggtgtgtcttgttgagtatggtggttgtactcagtcttgctcaatttttcccaaacccagaagaggagcccctgtatgatgaaggctttggtgtctagctcgtgcctgccgtcaagcgcctgtggtcgtcgccctagtcttccgctgttttccgttcgtctttgtgtgtgctgggccttcgccgcccatataataaattatctatttactcttccgcttgttaaactctgaactgtatcaacttttggtgtaccttgccttctgggacaaggaataatgcacgcacgtaaggaacgcccgttgggttatttccggtcgtgacattagggcacccacaatggttatctataggctctctacaagagatccatgtcagcatattttcctacttggaagagattaaatgaagagaaagagagcaaagctatctactaacctggaaatagtctatagagaaaaacgaggtaatggattagagagctatagatacccatgtagacataccattgaagtggtttactattaatctagtctattgctgagatgtacatgttttatagatagcatcttactttaccattgcgggtgctctaatagtaggaagtgggctatattattatccttgctctgagaatgtttttcaatcaacgtttgaccattcattttattcaaaattttccgttagctgcgccagcatccagcgcagaccggagaagccgacggcgagtatgagccttgctggcggcgaggtatccggcgccgtcctcctcacacaattgtgtagcgcagctgccatctgcgtggcgggatggttggtgccattgccggcagccggccaggtggcgaggtcgggaacatggaagcaatgctgctccatcgatttattcctcagatcagcagcatcgtcgcagcaaatgcgtcgacagatgagctgcaggttgatcagtgatcagcaaaagcagcaggaggaggaggacgtggtggtcgtcgatcgacgacaatctttgttgtcgctgcggccgcgaagacgtgatatcggctgaactgctgatgatcaagaacctgcagtgccggatggaggagaccatgctcggcatcatccgtcacgacaacatcgtcgtcctccggggttccatccagagtgacgacgacgacggcacggtccagttcgtgtacgaggacatggagaacggctgctgcctccacgaatggttgcacggcatccgccgatcccagctggaggccggctagagtcagcggcgtcggcgactgagatggcgggcgcggcggtccatcgccgtcgacgtggccagagcaatctgctacctgcaccacgattgcaaaagccccatcatccaccgtgacatcaagccgaccaacattttgctcgacggcaacctcaaagccaagatagctggtttcggtcttgcacggatcaatgttgctgggctcaaccaaccgttactcaacgtagaaattcctagcgaggcctttgggtatactgctccaggtgaggtgatctttaatgcacgatcaattccgatattttttaaaaaaaaacagaaatagattctactttatcataaacataattaaaggcaccatgattaaatcattatttaggtctggtacaactcaaaatccaaggtttcttatagctaaatattcatagctacataaatttgttgatttagtccatgcatgattacgttgataacattagataaatcgttttatttttattttagataaaatttgtaattttaaaccactataatttactatggatttgggatttgaagttgtgctaaacatgactttaccatttatttgtaattcactacatatatattgacatgtttttttccctacagagtatgcaaccgcgcaggtaaatgagaaggtggacgtgtacagctttggtgtggtgcttctgagctcgtcacgggaagattgggtaacgagccaggcgtaaataatgggcacttggctatgtgggcgcagagagggtacggtcgacatctcagcaaggacgtcgttgataaggagatcgtccctgatatggcacgatacttgaaggagatgaaggccatgttcaagctcggtgtggagtgcaccgctatggacccacgggagaggccgtccatgctgacggttcttcgtcgcctcaccaagcttggttccgtatatgtcagttgtttcaattcatgtgataattaactatagtggggatggcttgtatgtagtgcttccttcagtcattaatatataacattttttttctatttgtaagtactactcactttgcccaaaatataagaacctattatgatgagatattttctagtagatttatagtattagaaaatgtcttatatttattctatttttttatattataggatagagcgagtatatgactccgcacttcgtctaggttaattaaatagcgcgactcatagccctaccccgtttgccactgtgctagcgtaattatttcaccatcaagtacacaatgaagaacgatctcaaaatggccggcgtattaagttttcaagtctatctgtaatctgtcgatgaactttctcaatgcacgagtcatggaatgagtacggagcgccagtcggtcaatgaccgaattgttatacattctgtcattatgatattattatatttgtaagagctccaacggttagcctaataagtcaaagcaaaagttaaaatttaaaattttaaacttgattttgaagttggttttaaaatattttcaacgtaatttctttttagcgttaggtttttagtcgctacgaacaaatatacaaaagttttatctataaattaatttgtattctctaataagtcgttttagcttataagggagtatgtgccaccggtgaggctctaatattgtagtcttagtctttagacctatcttctatctttgtcggctctagctagtttctgcttgttctttacatttacgtttctttgggaagtttcattcatggatacaccaatatatgcttgggtattatcgatctacctaacgaacaaatcaaggtttgcaatctcgaagtttggtttttttcgcgtgggggtgggggggggaagaaatttcttagccgaaattatttgaaaatttgacgaatgttgaatgattttgaaggaactttaaccaaattcgaaaaaaaaatggataacaaccgaaaattttagacgagatttgtgcttgccgttgatcggtggagggcgaaatttcgtttcgaaattgcaaatcactggaacaaacacttggttcttgttcgtcggagtataaccctctggacgtgctttctagtctgttgtgtcagtatcagattgcaaatcgtaaaatgatatcattgaagagcatcagccagaagatcaatacaaactgatcaattatttaagtggaaatatctgtcaagctgtactgtccttgcgtagttgtgtattatcgaagaccttgaccaatatagcccctaaacacacggtaaagactagacaccaagcttcaagtctgcagtagcgtactgcatacgtacactgattaattagtgatcatcaactgagagattctcactcactctccaagtcacagcct

SEQ ID NO: 85958 - DNA, 1100 bp, Oryza sativa
cattttcggtagtggctttgctgctgcactgaaaccacatgcttttgatggttcaaactataagagatggaaagcacgtgcactattgtggtagacagcgatgcagtgcttctatgtttcacggggcaaacgaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcactcgaggccaagttcggagtctctgacgccggcagtgagctgtatgtcatggagcagttctatgactacaagatggtcgatgaccgttctgtagtagaacaagctcatgagattcagatgctggctaaggaacttgagaacaacaactgtgagttgccggacaagtttgtggcgggtggcattattgccaaactaccaccttcttggtcggactttgccacttctctaaagcacaagagacaagagttcagtgttcctgatctcattggctctttgggtgttgaggagaaggcgagggcaaaggacatccggggcaaaaaggttgaggaaggttctagtgccaatatggtacagaagaagaaccctcatgcatcccacaacaacaaaaaagtcaagcctgatgtcaaacccaaggctgcaaccaattttaagaagaaaggcaagggaaaggcaaaaggagactgctttgtgtgtggcaagtctgggcattgggccaaggactgtcctgagcgcaaagacaggaagtctgccaacatgatcattagcgagggcggaggaacatcggggtacggtaaaatattacctacagttctctctgtttttcattcacctgattggtgggtggatactggtgctaatattcatgtatgtgctgacatttctctgttttcttcttatcaggtcgggagaggttcctccttgttgatggaaacgggtcgcttgcggctgttcatggtgttggtacggtcgatctgaagtttacttcgggaaagaccgtgcagctgaagaacgtgcagcatgtcccttcaataaagaagaatct

SEQ ID NO: 85959 - DNA, 3452 bp, Oryza sativa
tatagtaagaatcctataaaaaatttgtttacgtcaaaaaggcttaatatgaaaattctatctttttttaaagtttggtaccatatcaaacttcttttttgtcgacgtttgatgtctcgactacggtatttggacagtatggggatcgtcggtgctagggcatacgcgagaccgaggtaaaagagatggagacagggatttttatacaggttcgggcccctgaattgtcaggtaataaccctacatcctgttggccggagccggagttgctttttattcaccataatcacaccagtacaatatgtggggtagcctatctaattgttgtcgacatggcggtctgaaggtctgactcgtagtcgacaacagggtagccttcctccttaaatccgtgtccggcgagatcagagatagcgctttcgtatctcctgacggtatccggagacaccgtaggggaatagccatgcctatccctgaagtcgatatccggcggcgtgtcttggcgtatgtaggcttgtgtgttgtggcttctggtggacgtgtgttgattgtcatgggtgtcttccatggtctcctcaccctctcctcctaggggggcttgtatttatacccataggtatccccttgtccaagtagaactaaggaaaccaatatggatacaatccgagtagtccttgtcgtttccatgtataactctggttgtctttccttatccggaactccctcgaggtcagtttccgtataagacatggtatgtggtggatcctgccgaaatttagtcaactactattaggtatgtgttatccataaccctgacaattttaaagagttagttttttttttcatatttagtggtggtcctatttttaagggtctgtttagatcctccaaaatggcaaaagctatgccgttttggagcactttttgccattttagatataaacactagtagcaaaagttggcaatttggcatttggcatttgctagtgtttacacccaaatttggcacctaggattaaaatagggaaattgccaaagtttggacgatctgccggttttcctctgagagggccggtctgaccgccgtatgtcggctggtcagaccgccgctagtgggccggtctgaccggtagagtccgagtcagactgttttcatcgagtctcgggtttccttgcttgggaagtcatgtttcgtgtttccatctgtttctagcccgagttgaacgtggaggagggcatgtaaagggcaagaccaacccctatataagggacaaggccggttcaattgtaagagatcaatcaactatcaatcaatcgaatcgttcttttacttttgcttctagttctagtttagtttgtccatctttgtcgatttgcgccggtccgccgccgctgtgagtgcgacacctctttgtaggtttgtcctgaaaaccttctgtttttcccacgagacgggtagttatctatcgttctatctagatcggctccgctagccggtttagtttatcaaaatccatcttagtttaacttttgctagattgaggtggttggcgactctaagattaccgcaaagcgttaggtgctgtgactgtgcttgtcaactttgtcaaaaaagttgccaacagctagtccatggtagcaaattttgccaaaaagtgctccgggaccacaccctctctctttctctctctctttagtgctaaaatggcaaaactttaagatgcatctaaacactaactagtacttttgcaatgtcaaatcttttgccaccaaaacttttgccatatatttgctattccaaatagatctaaacagaccctaaatgcatttttcttaagagatcatccatgaaaatcgatttttagatgatttcctttatgagaaccacagataaaaatcactggatctttaactgtaaaaatcatgatttttgtaagcctttccttaggaaagccacccgcaaaaacgaatttttgtggacctgccaaaaaaaaggtttttataggtggtcaatgactctgaggtgtaactattttcacatgcactatttcttttggactgcttgagaaaataaatagtgtagcgtcaaaaaaaaatgatgttttatagtgtatatatcggccggatgagaatagagatcagctggactgatatctctgcacgttaataaaaactgcagctaatctcgtccatccattttgatcactacgggttcagatccaagttgacagtacatatatgtaatatcaacaggcctctagttaattaagtaattagtataaaaatgaaaatatgaagatggttatctggccagtggccttccagtacacaactacacattagcaacagctagtggaaatactcaaataatactgctatgcccaggaaacactagtaattactacctccgtccctcatataaagtcatataaaggatattcactatttttaaaatactaatgtttgaccactcgtcttatttaaataatttgtgcaaatataaaaaagaaaagttgggcttaaaatactttagatgataataaagtaagtcataaataaaataaataataattttaaattttttttaataagacgattggtcaaacagtacaagtaaaatgttaaaatcccttatacgagttgacggagggagtaattaaatactgtcgccgttttcacgtcgctaccgttttaatttgtctgcaatataacgaattaatccggctatctgcgatatagccaatatatcatatctatgcgttatcttgttggaacgtacaggatatggccatccatgcgatatggccaaaaactctatgtacggttttgttacatcttaatcttctccgtcgtggccgatagagaccacacgtattacaagctaatcacaaatctagggatagctatattatatatttgtttatgacccatatttttcaccccaaattagtaagataagattcttttttacattgtaaatttaaaacttatacatatactacatattaaattacattatttacatattgttattttttttctaatatacgagtataaaatgttggaaatatagtcattaatcggcatattttaatccaagaaaaagaaacaatgatcatggcataagtagtgtagggtgatcttaacataaccagtagcatactatgcgcatcatgaatgtcgagaacaggaacataccagtaacgcgataacatgctagaggcatcatgtagaacaggaacaagcacatagtataggagaagattataccccgagaatggccctccgctggatggtgaggcagaattgcctccgttgttgtagtcgttcacggcacctcctcctggcgcaccagctccggatccagatccagctcctgtcggcggcggcgtaccaccttcgtcaacagagggcggagcaactccagacatggcgatgagcagtcgtgcgga

SEQ ID NO: 85960 - DNA, 10709 bp, Oryza sativa
gcagccccggccttttcgaccacggcctcggccttctcttcctcttccccttcctcattgccatcacgctctttgacgtcgtcctcgtcgtcggcgtcggaatcggaggtagcaggaacccttcgcttcctaggggcaagcttcacttgcccgcgcgtccgctttcgtgaaggccctacgtcgtcgtcgaccttgtgggggttcgcccagggaggcaatttgccgttataaacccggttcgcccggccgaccgcatatcgtgtcagcagttggctatactcgacgactgacacgtcgtcgatcatcttccgggcttcggcattggcctgattgagggtcaacactgcaaaaaatagagggtgcagccacattaagcgtcgaacgaagcaaaataacgaagcgcaggcatgcatagcgaaagtgcagtcttaccattcgtcccctcagggacaaccaatttcggcagaccatcaacctcttcgccttggtcaaccgtgacttgccatgactaggagaggggaaaatgcggaagcatgcagaactcctccaccaagtcacgacagctaaggcgggagcaaaccttacacagcagagcgaaccgcgcctccatagcgccgtccacggcgatcttgggtttccggttcggcgcgatcgccctgcgccggcaccggagggccttcgctgactcggaaccagcttcaaaggggatggtgtggtaaaaccacctcgccattgtcacgcccagaaattcccgaatagaattccaagcagaatgtgcattaaaatccccatccaggaccagccggggtacacaaacgacaatatcaacattcagatctacgtcttacaaacatcacaaaagtcttacataaatgcagcggaaagaaagaaagacaacaggagctaagccttgactagaactacagcgggaacaccactccacaggcatcctcgacggcacggacgaagcctactcctcagagaaacctccatctgacacaaactcatactctggggttgggaaaaatagagcaagactgagtactacccactgtactcagcaagtcataccggaataggggtatgatgcaggcaattatcaaagaagagctagagtggttcatttgcataaagcgagcatttataaacagaagttgaaagatttaaacagttgtaataattaattaatattaactatccactgtccaatgctattccacgttgcaacaggcccgaccaaccacctaaactatccaaattcaaaagattacactagggtgagactaatcacggtgaatctggttgaccgcccataaccgcgggctcggctattcgaacagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccaccctcgcctggatgcgtcggctagagaaaagctacactacaagcccagccgttgcccacgctggcttgtggtaagtatgataagttcttccagggcatcccgcgaaccggtccttaactgccatgggtgcgaccaacaaaaccatgcacccacagcccaccatgtgatttattttaattaaccaacaccgaagcggtgtcactactccaacattaccattagaacctacagtctaaacattaataggattttccccattgtgtactagttgaactaagcatgactaagcaattcctagtccaaagcgtattcatgttataacccaagctaacaaaggagcatggtatcaaaatagcatggctgtaacagtaggtaaacatcccatactaacattataaaacaatgcagtatttgaagaaaaacaatagagcatttgcaatataggatcaacatgttcaagtgacaggcatgacttgccttgctctgctgctggaggaacctcggcgactatttcgaagtacaccggagcgtcggaggaaccggaatctagcgacatacaaggcaaacattgcaaacaggctataagactactgaaacagggaacaaaaccatttttaatggattctacacatttttcttgatttactgagacttgaatgggcttaaacggagctcggatgaattagttatgaattttagaagattcattgtgtttattactataaaagaaaaaccttaaatcatttattgcgcaataaatcccagggctgacgtcatcaagggggcgcggcgccgacatgcggggcccaccggtcagcggctcgggagaggggggaaaagggcgccggcacgcggggcccaccggtcagcgactcaagggggagggcggttcaccgcggaccgggaccacgcgggtggtccaccgccggtccacgggaccgacggcccagatcgccctcggggtcgatcggacgggcggcgacgacccggctcggcttggctcaaggccggcctaccggccgcggcgatgacgacggcgtgcgcgcgcgaacgcgttgccggcgacggcatccggcggcggaggcgacggcgcaaaggcgacgcgaaggcggcggcactaagcggcggctaggaaggagagggaggggaatggatgggagaggaaacctcaccgagggtggccggcgcggaggaaaacgacggcgaacagcgacggcaagccacgggaggacgacggcaaccggcggacgggtttcggggtgtcctaaggaaggaagagagagagattagagagagggagatgaaccacggcgaccggcattcatggccgaaggcggcggtaggggttgaactcaccggagcgcgaggggatgcgaattccggcgacgaaactcgacggggaaggggcggccggggtggagcttagcctcgcgaacccgacggcggtgacggcgcggcgcggcggcgaccctagcggcggctagcggcggccggagtagcggaaacggcgccggcgggtggttgcacggcgcgggagcgatggggagcacgagggagttcggcgagatggggaaaaagcgagaggaggcgacggggaagcctaaataggggaggggagccccggacgtggccggtaggggcgggatttcgccggccaacgtggggagtgggggaggagagagaggtgggattcgaaaatcgaatcccggccatctcgggcccgggcgcgggcgggagggagaggggagtgggcgcgggagatgcggcgcacgcgcgggcgtggccgacatggcccggaggaggcggaggcatgggcgcggcggcggttgcgggcgcggcggcgccggctggaggaaggggacgggtccgacaggtggggcccacctgtcggcgtcccgaggagagagggaggggcggcttgggccggcccacaaggaggacggcgcgcgcggcggggtggactgggccgatggcccaagaagaggaaaaggaggggaaaggaaaaaaaagaaaaagaaaaggaagaaaagaattccctgggatttaaaatattgcaagctcgattttaaaaggttaaaattatttcgagagctctgaaaattccactaaaaatcctgttagtgaatttcgacatgtagaactcaagaaaaattccacaagccaattccgattattatttgcattgatttaatagggtttactcttgctttgcaccggtattttcttagggtctcttattaattcaattttaggcttaggaggagaacttcagggtgtgacaaacctaccccccttaaacggaatctcggccccgagattcggaggagctggcgaagaggtgcggatgggcggctttcaactcatcttccctttcccaggttgcttcctcttctgaatggtgactccactgaactcggcaaaacctggtgaccttgtttctggttcttctttcgctggtatcaagtatacgaaccggcttctccacatatgttaggtcctcctggatatcaatgtgttccgaatcagcctgttcttcaggtacccttaagcacttctttaattgggacacgtggaacacgtcatggatgccgatcatattggatggaagttctaactgataagcaacttctccccttcgttccaggattttgtagggtcccacgaagcgtggtgccaacttgcctttcgtctgaaaacggtgtactcaccggagcggagtgacacgaagatacacgtaatcccctgcctcaaaagtgagctcccttcggcggttatccgcgtagctcttctgtcgagactgggcaatcctcaacctttccctgatgattctgactttctcttcggcttccgctaatacctctgtcccgaacagttgacgctcgtctgtctgatcccaaaagagaggtgtgcggcacttccggccatataaagcttcaaacggtgccatctgtagactggcctggtagctgttgttgtacgagaattctgcatatggcaagtttttgtcctaagttccaccaaaatcaagagcgcatgctctcaacatatcttccgagatttgattgactcgctcggtctgaccatcaatttgcgagtgataggccgtgctgaaatttaaacgagtccccaattcttcctgcagcttctgccagaattttgaggtgaactgactccctcgatcagatacaatctttttgggtactccatgtaaacacatgattctcgagaggtagagctccgccaaccttttgcccgtatacgtggtatgtactggtatgaagtgagcaaccttagtgagtcgatccacgactacccagattgaatcgtgacccgatgatgtccggggtagtcctgttataaagtccattccaatctcctcccatttccattcctggatttgaagaggttggagtaaacctgctggtctttggtgctctgccttcactcgttgacaaacatcgcagagtacgacgaattcagctatttctctcctcatgctgacccaccaaaacttttctttgaggtcttgatacattttggtgctgcctggatgaatggagtactgggtctgatgagcctcggtgagtatcagatccttcagttccttgtcgtcaggtacacacaatctttctcccaaccagattgtgccgtgttcatcttcgtggaaatcccgggcttttccgactctcatgttctttttcagctctgctatttcagaatcatttacttgagctgctctgacttgatccacgagcgtaggccgtgcctccaaagcggctacgaacccgtgttcaacaattcccacgttgagatgctccaactcctgccgcaattcctcacacatgccctcgatgcatagagcagtgcagtaacttttcctgcttaatgcgtctgccaccacattggctttacccgggtggtagtgaatgctcatgtcatagtctttgattagttccaaccatcttcgttgtcggagatttaggtccggttgggtgaagatgtatttcagactcttatggtccgtatatacttcgcagcggttgccaatcagatagtgcctccagatcttcaaagcatgaaccactgctgccaattccaggtcatgagttggataattcccttcgtgtggacgcaactgccgcgaggcatatgcaaccactctgccctcttgcattaggacacatccaagtccgtgacgggatgcatcgcaatagacttggaagtctttcatctggtcgggcagaatcaaaactggtgcggatactaatttcttcttgagctcctcaaaactcttatcgcactcagctgtccatttaaacttctcatctttcttaagcaactgagtcatgggtcgggcgatcctggagaagttttcgatgaatcggcggtaataacctgcaagtccaagaaaacttcgaatctgcgacacggtcttcggtggggtccatttggtaactgactctacgttcgatggatcaactgccacaccctgagctgtaatgacatggcccagaaatttgacttccgtcaaccagaagtcacacttgctgaacttggcgtatagctggtgctccttcaacttctcgagtaccagacggagatgttgctcatgttcttcttcggactttgaatagataagtatgtcgtcgatgaataccacaacaaacttgtccagaaattccatgaacactttgttcatcagattcatgaagaatgcgggtgcgttggtaagtccgaaagacataaccgtgcactcatatagcccgtaccgagtggtgaaggccgtctttggaatatcctcttcccgaattctcaactggtggtagcctgatcccaggtctatcttagaaaacactttagctcctttcagttgatcaaacaaatcatcgattcgcggcaaaggatatttgttcttgattgtgacctcgttgagtgcgcggtaatcaacgcacatcctctttgtcttatcctttttctccacaaaaatgaccggagcaccccaaggtgaagtacttagtcgaatgtaccctttctgcagctgctcatcaacctgcttcttgacctctgctagttcgttggccgccattctgtacggtctcttgtaaattggagcggttcccggtgccaagtcaatccggaattcaatctctctcttgggtggcatggtagtaaggtcttcggggaacacttctggatactcgcagactatgggtatatcttccaatttcctcaaattcttctccacagtgtccactgggatttccgcctcaatctgattcaaagagaccccttgctttggtgagtctggtgatttgtacactactgtttctcccttctcgttggtcaaggtgactgtccgattcgcacaatcgatgactcccttaaacttggtcagccaatccatcccaagaatgacatccaggtctttggattcgagaagaataaggttggctagaaatggcgatctttggatttctattagcactgaagggctaaaactgactgaggttgaactatttcccggggtatgaaccctcattggtgtgctaagctcttctttccttaacccatgcatcccgacaaacttctttgaaatgaacgaatgcgttgcaccagaatcaaaaagtattgttgcagggattgagttaacaggaaacgtacccagtacgacctctggtgctgcttgtgcctcctccgcagatgcgtggttgacacgggcctggataaaccttggcccggcacgcctaggcttcgggcatttgtcagcgaagtggccaagctcgccacagttgaagcaggaccctggttttgctccagtctccttcttggcttgcgcggacgggcctgactgtgccggtgccattggtgggcgtggagctgcaccgcggttgggctgacctccatggtggttctgactgccactggcgccctggggaaagttgctagggttgaacgggcggtactggtggacgatcatggtggtaggtccaccctgctgcccgggagcgaagcgcggcctctggtgacttccctgaggtgccctgaactgagcggcctacctcttcctgtccatcttgttgcgttgatcctcctgacggattgccttgtccaccagtctttcgaaatcggcgtaatctccagatatcaactggttggttagctcatcatccagacctgctaggaatttttcctgcttctcggcgtcagtacggacatcctccggtgcatatcgcgcgaggcgattgaactcatggagatactccgtcacagtcctgttgccctgatggagtgcccgaattccctcttcttttgtgccacgaccccgtctggcacctgcgccttcttgaagctacggcagaactctgcccaagtgacttcagtacatggtgggcgggtggccatgtgattgtcccaccaagctgacgcaggaccttgaagctggtgtgtggcgaaagcaaccttctcctgatcattgcactgcaggagattcagtttcttctttatggcatggagccagtcattcgcctccatagggttggtggtgctggagaaggtgggtggcctgacaagtagaaactctggcaacttggactgagggggagggggaccaaactgctggtgctgctgttcggcgtgctgcagcatcctctggtgcatctgctggtgctgctgctgcatctgctgcatcatggctgccatcatctgagtctgatgtgccatcacttgggctagcgtcggattctcgggaagtggtggcggaccattgccggaattgctgttgggatgcacaccctcagtgcgctcttcaccgttgctgccctcgcctgttgcgcggctaccattcctggtgtagaccatctggaggaaaagcagacgggggaaaagaagaaaaatagaggctcaaggactaggctttattatataggaatttaaactgcaattgttctgatctgaattaaaacacttaaaaagcaagcaaaaatccttattaagacagccatatcataggcacatgatatcgaccgttgactgacccacaagcaagcaacctaaacacacaaactaacaaacaaatgctagacagtcgataaactaatggaaaacgagcctaatgctcggaacggctcctgcggtcggtggagtcgaaggcgtcctcctgctcgtcaccaggtccctctgagcgactcctggagcttggcagataagtctcgccgctgcccggctctgagccactggagctactgctgctgagatcgcggctgccactgggagtagcagacaaccaacctccgttgccactggctggacccctggcggctgatgctggagcgaaggagagagcggacgcgggagctgacacgtgaacgggagctggagctggtactggagctgcaggaactaccagagctgcgggcggaactggaggtgctgcgggagctgctgatggaggtgggttcctgggcgcaagctggatgcgcacgggtgcagtcgtcgtcttgcggggcgtagtgcggatccggactcctcctagagcgggaagaccctttaactgagcattctccctcttcaggcgcgctatctcgtccttcagagcgacgatcctcatgagcttcccatcattcaaggccttggacgccttgtgcaggtccgagtgcatcctatccaatcccctcatcacagcacacatgtgaccaaaggtggtgtcgttctcgccggctgtcggacggaaagtactgacatcagcaccgctggctcgacgagggtgaaatcggtacgccgtgtcgtggaagatgtagttgtggcgctcccgtagtctggccatcatcaggtatgctgcctcctgacaggcgagatctgctgtgcctccggatgcctcaaccaccatattagctaggcaggtacccacgtagccgtggacctccaggcgaacacggtgaggaagctcgccactgagcggtggaacagtcgtgtactctggcgcgttggggtagcctaccaccagcgtcatatgtgccaactctgccacaaagtcaatcatgccttctccgcggtggttgggtgggtggccggccatctagagaaaacaaaggagtaggatcaatgcatgctcaaatccaaatttaaataaagcaattaaagactcaaataagagaattgaataagagcgaaattttatgcatagatcgttttgcatgagagcgaataaataagacagactcacataacgataaaatattggggaaattagatacatactaataataacagtaagagcataaataccttgcaacccatgttcctgagctaggacctaatgcatttcacccatcaaatcccaactgactgacgaataaatctcaatagttttactaaaaccctggactgacttgttttgacaaatctcacttaaacgagcgaccaagatttttccccttgaaccacaagaacagatcccaattttcccggaacaaatccaattgcaaagaacatatgcaatgaaaaggatttagagggctcttaggtttttccatttggcttgtcctacggtcaaggtcggctctgataccaacttgtcacgcccagaaattcccgaatagaattccaagcagaatgtacattaaaatccccatccaggaccggccggggtacacaaacgacaatatcgacattcagatccacgtcttgcaaacatcacaaaagtcttacataaatgcagcggaaagaaagaaagacaacaggagctaagccttgactagaactgcagcgggaacaccactccacaggcatgctcgacggcacggacgaagcctactcctcagagaaacctccatctgacacaaactcatactctggggttgggaaaaatagagcaagactgagtactacccactgtactcagcaagtcataccggaataggggtatgatgcaggcaattatcaaagaagagctagagtggttcatttgcataaagcgagcatttataaacagaagttgaaagatttaaacagttgtaataattaattaatattaactatccactgtccaatgctattccacgttgcaacaggcccgaccaaccacctaaactatccaaattcaaaagattaca

SEQ ID NO: 85961 - DNA, 1302 bp, Oryza sativa
ttgacgatgctgtgcaagtattcgacatgatgccagcgcaggacgccatagcatggacagcactcatctctgggcatgagcagaatggggaggaggagatcgctctcgagctttttgaaaggatgacaggtgagggggtagtgccaaccccctttgccctcgtgtcatgtctgggtgcgtgcgccaaggttggtcttgtcgcccgagggaaggaagtgcatggcttcatcttgcgcaggagcatcggttcagaccctttcaacgttttcatccacaatgcccttattgacatgtattccaagtgtggcgacatggtagcggccatggcggtgtttgacaggatgcttgagagggacatcatctcttggaactccatggtgacagggttctcgcacaatggccagggaaagcagtcacttgcagtgtttgagaggatgcttaaagatgaagtacaaccaacctatgtcacttttctcgctgtcctcacagcttgcagccatgctggtctagtctctgatggccgccggattcttgaatcaatgcaggaccatggtgttgaaccaagagctgaacactacgccgctttcattgatgctcttggtcggaatcgccagctggaagaagcaagtgagttcatcaaaggcttgtcctccaagatcggtctgggtacaactgggtcatggggggccctccttggtgcatgtcatgttcatggcaatattgagatcgcggaagaagttgccgaggccctgttccagttggagcctgagaacagtggtcggtatgtcatgttgtcaaacatatactcagcagcaggacagtgggacgatgcccgccaggtcagggctctcatgaaggggaaaggattgaggaaggaccaagcttatagttggatagaggtgcagagagaaaaacacatgttcgtcgccgatgacacatctcaccatgaggcgaatgaaatatatgagatgctggacaagctttttcatcacgtgctcggggtaatgttgaggacaagcatggcaattttgttttgtgctgaaagatacatcctctggaatgaaacaattgctttagcattgcaagaacaaggccattggtctcaggcatgagggatgaagcccactgatttgccttcagcatccttggtatggcagattggtggtgtgtttcaaggatgctgcaaaggagcgtcagagtccaaaatgtggttattgtgtttctttgagattgcaatcacaaataaactcgtacgattttgattcgtttggaacttggcatcctgaaggatcaatttttcac

SEQ ID NO: 85962 - DNA, 4995 bp, Oryza sativa
  unsure (1)..(4995): unsure at all n locations
acattatagagtgctccatttgatctgtttatcattttctggcctcagtgcccatgacatgtattttggtgttacttaatccattgctttttccctgcatttgtttgctgtcttttttttttctgttattgggtttcattcgctaagcaaccccccaaaatcattaggctatttaccacgtgactacacatgctttcaaatgaatgcagagtcaatttttggtgcactagttcttgactcttggtttggcatatgaaacttctaaagcagacacttgcatcatgttactttatttagcaaacaattggttctgttactacttctgagtttcagtcatctgaatattggttgattactcaatcactgtgcagtaatacctatacattaaaaacacaaatactccagcagtatgtagattattttcgtgcactgaattctctggcatagtaggcaaagggaagagcaatagtcacttgtgttagtcatactgtttttaagtccttgtttaggtgttttagcatccgctcccctcctctcttttgctctattaacagaaagaaaggggaaaaagttccaggtctgaaattttcagtacatctctgtactatcccaactctcttatgcctttggacagagcattttcattactatggaacatggtggatatattttctccttcttgatcttgctaataatgttatgggttaggtatttccttttgaatggtaaaggtgaaaaaattgaggagcagactggcactatcaggacaaattgtgtcgattgcttagatcgcaccaatgtaactcaggtatatactgtcaagtatagtttttgttgcacgtcaaatttaattgtagatattgtgaacacttatggttactggataatttacctaccatgttgcactgtantacctaattcttgatagtttctcttccttcttttgagatctgtgtggaagacaatgtttttttaaataagtggcattgctctttttttagactattacaaacctagatgtgctgccagatagatctacaacctgagttaacttgtcattttgcagtgggttgtctcattggatttatctaaatcaaatccaaactgttggacttaatatatattgatgtacccttaaggactggcttgagttactttgatttgctggttgatgtattctagaacagaacctattgactgatgtagtaagatcacatgcctcaaagggaaaagccacttcagttactcctaagtatctaattgcagtcaagtagactaggttaacttcaaagtataatacttaatacttatccatcgtttatttatgtcttatttccccctcttccgtggagttttcactttaccagaattctgattatcaatatgatgactaaacagagcatgattggaggaaagatactagaaaaccaacttcagcgaataggggttctcggtgttaatgatacgataagcaaccatccagcttttgatgcaaaatacaaagtttgtgagttgttcatgttcactaaccctggttcttcttgtttgtattcctcatgcttgtttgtatctcctatgcttcttcttgatgcaaaatactcttgttcagtatgggccaaccatggagattcaataagcactcagtactctggaactccggcattgaagggcgattttgttcggtaattcctaaatagaaaaactgccttttcttcatttccaaagtgcagcacatttactggaacagtgttactggaagttcatggtgaacagtattactggaagttccttctttgttatcaagagaaagaactacttccagcttacatcagaaaaggaaaatcatagtgattgttatcaccttgagtctgttcacatctgagccacttatgttttgtgtggaacttggaagttttaagagtttcaatgggctatcatgaagttgatgtccttttactattcttgctgaaatgtctccatacttgtgggcaaccaaataccctatgggttgtaactgatttccagcatgctaataaccatcagtgaaaaaaggcctaagatagttccagatcccatgacgggctaacattactaagtagtatacatgctcttttggggcactcataagtttgtgctgctaaatttatgctcgtttttctttcatattctgatattgacaaataaaatgcggcagcataatttattacttgtttgtttgttcccatatttaacaattgtttttgttttattaggtatgggaagagaagtacccagggaattctgaatgatctgtggaattcacttgctagatactacttgaataactttgcagatggcactaaacaggtaaatgactgactttgcatgaaaatcaataaatcagaatgaccaaaacaatgaaccccattcaccgctaatatgccagcttattttcttgtgaatttctcacttaatcgtgatagaccattagtcatgcaaacatcctcaagcaatagtaagcattgcttttggatattggtagtgcattggaatgttttacgtggtcactcatttgccatttcaccagccctagaaaaatttaaaccaagctagagcattgccttattatttttctgttgttttttataggatgccatggatctacttcaaggacattacattatatctgttagccgcgacatggcaggtccaagcaaagcaggacttctagagaattatgcggtgggtacatttttgctgtagtgtataattgctcttttatactgacacatgaattgctactgggaaagccttctttgttaccctgtcaaacacttacgactaggcacatgtgcgtaggaacttactctatggtctgtatgtatgagaaactgttggatcagttatggactgtattttgtatctttctccaatgggataaagctcttaattgcacaattcttattttgcagtccttccgccttgcttttgcattggttatgggagctcttatgttcatgatgatgtcactaagacaaggtaagatttctgtgactgttgaagcagacacagtggagtatatttaacaattgttttcttaacagatatttttcttaggtttatttgcaccgtgtcaggcagcatttcctctgctctctgtgcatattacattacacaaagaactctctcttacaattcttggttcctttaggttcacccatctgcaaaataattttgctatatattgttgccagttttttagtatgcaaccttttcttcgctctgatgtcatgcccagtgcgatttgcaaggcatagttgtgcacgaaagatgggagactttgtccaggtcctgactcctgacaaggagtgacattgctggtaatcaagaagtaacagaaaaaaagcaagtacaaagagagatgcacttaggcagttaggaatggaggaggacaagtgacaaggatatacatatttcttccttaatttattgatggtcactgatccttgtttaggatcacacttccaagcccaaacatggatacctaacacaagtcccatttctggtcgtaactcacctaatatatcccactttcctatatctcaaaaactcaaactcagtaaacaagatagctagtcataaaattcaaatccaagttacttggatttctgctgatatgatgctatgctacgcttgtaaaactgaaaaaaagtaaagttgcataggctaatactgctgggtgctgactattttttcttcttttgcatgttgcaaaacatgagaggtaaggtggtttagaacgttggggcttatttacattggttttgatagcatgactgaaatttgaaccgctcttataattgaggatggcattggacatgtatcacagttgagtaaaataaatttgtttcaagttataaccatccgaatacatatgtactttctcaaagaagattttggagtcacattctatttttactatataatgggaatatatgtgcagctaattaactgcttcaatatctctgcagccaggaatgatgttcgccatttagtgttgtcacttctatgggctggtctttgcattggcatcacacattttgtcagagccaatggtcgggtgttcaccaacagacctcgtttttatcagtcgcgccattgaagcaaaacaaccactttacacggacactgagctgcctcataggttatcatttttcatcagacagtcagcaccttgtttcatatgaagatatattggtcgcattttttgctgggaatttgaccctcccctatattgtaatgagttttattttccatttttgtaacaagtttttttttccttttccttctcattgttttgatttccagccatcttttggggcatcacgttcacgattctgtttgacttagcagtatataattcaatacacctcctgtacactgtttcatcgacaacaactatatttgacatatttttcttgcaaggattaattatgttcaaattccagaatggattactgatcagtaaaaaatatgttggcacagtttttcaagatccagagattttgtggtatctgcacctgtgcccccctttttacataattcgctatgtatccagagctatcagtcagttccatttcaagcttatgtctggaatacttgtaaatacttcaagcttatgttccatcgttatctcatttgtgccttagctgtagatatctcatttgtaactgaggcatgctaatctgacttgaaactcaattccaacgaccatttgtgcactgcacaaccttcaatcaatgagccatttatttttttcattgccttgtgcctaacagctgaagcattgcatccttttcccttctttgtgacactaggcattgcaagattgtgtcagtactcacttagtaacttcattcttgcatgtgactaggtaggtatgtatatgttgtttttgcaccttttgcacacaaattttgacaatttgaccctttgcaaaaactatttttacaaatg

SEQ ID NO: 85963 - DNA, 2962 bp, Oryza sativa
tatggattgggagaaaaccatcactttcttacttgcgcacatgggggtgcttggcgaaagtcaatgtaccaataacgaagaagcgcaaacttggacctaagactgtggactgtgtctttctgggatatgctcaccacaacattgcctatagatttttaatagttaaatctgaggtacctgacatgcatgttggtacaattatgaagtctcgtgatgctaccttctttgagagatttttcccaatgaaggatacacatagtagttctagccaaccctctgaaataattcccaattcaatcacaccaccagaacaaactgaacatacacatgaacatgttactgaggaggatgacagtgaagctcctcgaaggagcaaaagacaaaggatggctaagtcttttggtgatgatttcactgtgtacctcgtggatgacactcctaagtcaatttcagaagcatacgcatctcctgatgcagactactggaaggaggctgtccgtagtgaaatggattccattatcgctaacgggacttgggagatgacagatcaaccatatgggtgtaaacctgtggggtgcaagtgggtgttcaagaagaagctcaggcctgacggtactattgaaaagtacaaggctcgacttattgctaagggctatactcagaaagaaggcgaagatttctttgacacttactcacctgttgctagattgaccacaattcgtgtgctactttccctagcagcctcacatgatcttctcgttcatcaaatggacgttaagacagcttttcttaatggagctggatgaggagatctatatggatcaacctgatgagtttgtagttgaaagtcaagaaggcaaagtgtgcaaattgttgaagtctttgtatggtctgaaacaagctcctaagcaatggcatgagaaatttgacaaaacattgacatctgtaggctttgcagtcaatgaggcagataaatgtgtgtactatcgccatggtgggggtgagggagttattctgtgcttgtatgttgatgacatactgatatttgggacaaaccttgaggtgataaatgaggttaaatcattcttgtctcaaaattttgatatgaaggatttgggagtagctgatgttatcttaaacattaagctaattagaggtgagaatgggattacactcttgcagtcccattatgtggagaagatcttgaatcgctttggctacattgatagtaagtcttctccaacaccttatgatcctagattgttgcttcgtaagaacaagagaattactaggaatcaactggaatactcccaaatcattggctcgctgatgtatctggctagtgcaactaggcctgatatctcatttgctgtaagcaagttgagctggtttacctctaatccgggagatgatcactggcgtgcgcttgagcgagtaatgcgctatctgaaaggtactatggaattggggcttcactattctgggtatcctgcggtactggagggatatagtgattctaactggatctctgatgtggatgagatcaaagccactagtggatatgtcttcatactgggtggtggtgctgtttcgtggaggtcttgtaaacagactattttgatgaggtcaaccatggaagcagaactgatggcactagatactgctactgttgaggtagaatggctgcgtgatctattaatggatctgcctattgttgaaaaaccggtgctggctatccttatgaactgtgacaatcaaacggtaattgtcaaagtgaatagttctaaggataatatgaaatcatctagacatgtgaaaagacgattgaagtctgtcaggaaattaagaaactccggagttataacgttggattacatccaaacagcgagaaacctggcagatcccttcatgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctccaagtgaagatgcatatactctcgtgagctgcaaggcaggttggctatgccttaatgagttctgttggctttaattagcaaagatgttgtcctgcagagcattcttgaaggaactcacctttgtgagcttgactgttggtcgcagtctatgaagattttgggtgaatctgctaggaagcttactaaagacctaggagtatgacttatacgctccacccgtggggtagtctacagacgatctagtaccagataagactctgagtgaaacttgcttgcacaagacttgcgattcaaggcgtagtccattgttcaagttgtgagtaagtgtagcttgaagttctaggtggatgtttaaccttgattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatacatgtggagtttagtaccaccttgcttattctaggagagggggacctccttaaaagggaggatgccctcctagccacttgaagcatgtgtggtggagagaagaggggaaacacacgcgcgcgctcgctcgcctcgcctcgcctggcagggcaggcggcgcgcgtgcacgatgtacgcgtcgaatggtccgaaaaattggcgcgcgtgcacgacgtacgcagatgcagcctccttttgcagttttgttttgctgcaaattcggattcgtttttgttttggaaacgttccgaaaaatccggtgtgtgcaaacggcgtggagtccggataagttacgcgcgacttatccgg

SEQ ID NO: 85964 - DNA, 2538 bp, Oryza sativa
ttcatatactaacattcatgatagtaaaatatttcattttttttatgacaggatgctctgaaagaactttggagattagcttatcccagccgacaacttcctcctctgaaatcagatctatggaaggagatgggctggcagaattctgatccagcaactgattttaggttcgtttcgctaatccctagtaatgattttaggatatatatataagctgtcatgcatttatcaacaccgcttgaacctcgacaactaatcttttgaagtatctaatgcttgcagagcaggggggttcatgtccttggaaaatttaatatattttgctagaaattacccagtatgtttctattaatcatgaacatttactccgcattagtctgctgttattgggtgatttgattaggtacaatgctcaatgtctgctttaacatgcaggattcctttcacagtttattacacaaggcggatggtaagagatctgaatgggaatatccctttgcagtagctggcgtgaacatatcttatatgttagtgcaaatgttggacctgcaatcaggtgaaatttgcagtaacaccttatctttgggccaatttacctcctttgctcttgacttcgaactctctttttttttcagctctatgcagagctacagcttatctctttcacttcttttgtaggaaaaatgggcacaaaagtcagttctcaatttgttcaactacttagagaagacgagatggcttttgataaccttttctgtatggcctttcagatgcttgacgctcagtggctcacaagacaagctagttatatggaattcaatgtgtgttctctgtagaacatctggtctcttctattggcttctcattctaccaccttattcagttgtcttcatttccatttttcaggaggttctaaagtccatgcgtattcagttagaacaagaacttactatcggaagcatttcttgtgttcaggagatgccatcatttaggttgctaaaaaggtagccatgtttgttgtttacagaaaggagtgtatcttacttgtcagtaggatcttgtgcatactaccgattctttcattggttgtacaacatgacacactgtaagattatttatcatagaataataaacccagtatatatctggtactttggtaagtgttcaatgttttctggggtaacaatttaagtatttctctaatgaaaattacctgcaacaggtttgcttcttaaaacatgtgacaaatgtaagtaaagtaaatatcttttattaacattgctgatgtttggaatatcaataaaagatgcagcatttatgcattcatgcctcaaccaagatgtatagtatagtttattctgaaagttagatagatttacatattgtgatttctgtataacatatgctccattaccttataaaactgtgaactacccagagttttcttgtgggaatacctatagtactactcaagcattcaagattctgagtaatcagaattaactagctcaatctagggtaagggagaaaattgtctccctagttaatcaatcagccttgggggtattacaagaaaaggaacacagacacttgtctcatgccaagttgaatgcctttgggtttctaggagactaggaccatagggagaagcatatgaatcttccccacctgaacagaacgcctacagaagctttgcttctttgtggcagtgccattggacagagaaatataccccaagataaaaacctgaaaacttccctgtatatctcaagattttcaacacccagaaacacacacacagagagaatcagttgcacacactgatcattttttgagggcaggagatattgtttgcttgaggagatattcgctccctatctgaaattgaaatgtccttatctaaaaaatctgaaatgtccttgtctaaaaaatctgaaatgtccttctccaacatattgcattcctcaaacaaattgtattctgtcacacctgagttatccatgctgttgccgccttcagttatactggagcacccttcaaataggtactccatgccgccttcgaaagcctcatcattgaaccattcactgaaattcatcgagttgctgaagtaagccccaggcattgtatccaattcataatccaagcaagggctccagaggctttcttcaatgccatcaacaattggaaggggttcattcatgcattcagcgctgtcatcggctgcaagtggctcattgttgtcacttgatgtatttgcttcactggaactgagctcttggactgcattctcacttcggtcatcatcttgaggctcttcatgtaatgctggcaccacctgtagctcttgttgcagttgtgccagtaactgtggttcctgttgcagctgtgccagtaactgtggctggtccaggtagcagctgatgtcgaagttggttaccgcattggcacctcggtattcaattgcagcaagatcataggccttggctgcctcctcttgagtatctgtaaaaagaggtacgtttgttgaaatgagaa

SEQ ID NO: 85965 - DNA, 2416 bp, Oryza sativa
ataaaggtaacactggtcacataagaaaatattgatttgcatagcctgatacatgtctttttttccacttacaagtaccttcaacttcgttctttgatgtagcaatggactgaaccttgttaggcattcgttcctgctgcactctagatttcctcctcttgtatagtttcatgcgccgaataaattgttcatgtgctttctgcagctccccaacaggctctgcaaggctattgaatacattgataaatggtaagtggtacctttaatttgcaaggtacttcgtattgatattaattttattgtgaggtttcacttgcaaactgcaatccaaggatttgttactccattggtttgcagtaggcggatctaagatacgtccattgacaattgaattgagtacatgaacttttttttatgtgtcattacatatcagatgtttcctttaggacatattagatgtagctgttgaactaaattttaagcaatgataaccgcaaaaatatggtaccagcaacaacaatggtggtaaaaatcttacttctgggttcccaagcggtacatgttctcagcatcctcaaacctcttgtgcttctcataatacagtgcataagccatataaaatgcggatctcttaaggcctattctgttcttttccatcttctttagcaatggctttgcatccttcacatagtccatctacaccattgaaaaaaaaaatggaaatatcacaataggacctttcagtccaagaaaatattcatatcaaaagatctctgttgtgcgtaacaaagcctagataataagctaagaaaatattcttatcaaaagatttatgttgtgagtaacatacaagttatagtatgagcaagcaaacaatagtacgaaatgaagacatcagattgaaatcgctatcgaactattgcagattcaattagcacagggcaaagctcgagccccaaacaaatcgattttggtgtggaactgcaaccaaatgaacctcaggctatctcaacagatccccaatgaaatgaaatccactatatatgacaacatcagtaaaaaggaaaggaagcatatggcggataggtggatgtagaagaaggtggctgaccagctggatccagacgcggaggtagcggggatcgtcgcggtagcgggcgtcgtcctggaactcctgggcgcacttctgcaggaacctgggcagcttcgcccgcagcgtcgccggcggcagcgccgcctccatcttcctcatgcccctagcaaacaacgaatcgatccatcaagcaacttgcatcgagaaggggaagcgatcgattgggagtggtagagagagagagagtaccggagccatgggcggagggggtcggagccggagtaggagcggatgtcgcccaccaccgccgacaggaggtctttctccttgtcgccgccgccgccgccgcagtgctgctcggtggccgccgccatgggaggggtggtggattggagcggcggcccgccggccggggtgagccaacacgagacgagagggggggtttttccgggtttgaaatgaaagggtggctagtttcgaatctccttcactcgtgcggatgacaggtgggcccactaccatccttgacatatgccccacctgtcagccagacaactcttgtcgccgcatctttgccaaaatccagtaatgataaattttaaaaggcagttcaagcatgggcattgcagatcacaaatttacaatcaaggtaagataaatgagcagccccatcgtttcgcttatgttaatacttataagtcaaaatttaaaatttaaaattaattttaaaattgattttgtgatttttttattatagtttattttatagcatttgcttttgaatcgctaagaatatgtgtataaaagttttacttataaattaaattttagttgctaataagccatacagataagcataaccataagcaaaaggatgacactgctcattggttccaacttccaaatttgttcaaaaaccttctgcgtacagtacaaaaatggatatgtctgctcaagatttatttaggtaatactgtgaccaaaagaaccccacaagtcacgactcacaatcaactctgcggttcgacctacaagacatagatttcaagccgttttgtggaagagatcctggagatcaagtatgtcagcaagaactccagctgcagtggtatcattgccagctccagcgccctgaatcaccagaggggcgctctcgtagcatctgctgtatatctccacctgcccaagaacaaagcagcgtcacttttacgtttcacatcactctctaccaacagtaaaaaatcacatatcaaacattctttaatcctctcaaaacagaaaaatggatttcatcagggtaccgagctcgaattcgccctatag

SEQ ID NO: 85966 - DNA, 1664 bp, Oryza sativa
taatacttataagtcagaatttaaaatttaaaattaattttaaaattgattttgtgatttttttattatagtttattttatagcatttgcttttgaatcgctaagaatatgtgtataaaagttttacttataaattaaattttagttgctaataagccatacagataagcataaccataagcaaaaggatgacactgctcattggttccaacttccaaatttgttcaaaaaccttctgcgtacagtacaaaaatggatatgtctgctcaagatttatttaggtaatactgtgaccaaaagaaccccacaagtcacgactcacaatcaactctgcggttcgacctacaagacatagatttcaagccgttttgtggaagagatcctggagatcaagtatgtcagcaagaactccagctgcagtggtatcattgccagctccagcgccctgaatcaccagaggggcgctctcgtagcatctgctgtatatctccacctgcccaagaacaaagcagcgtcacttttacgtttcacatcactctctaccaacagtaaaaaatcacatatcaaacattctttaatcctctcaaaacagaaaaatggatttcatcaatctacttctaacgtgttagaggccaatacaaacaatgtttttggtagttttagtgttccaacttccaagctcgtgtgaacaacgcaaagaagaaatggggaatggtgccaatacagaccctgctcacactcgtaggctcttttgttttcacctgaaaataaccagcccttgaggctaccaactgcacagtgccgcttgatgttgaataaaagagaaaaagagagaggaaaataaaaaggattagcataccacattgtcacttcctctcaaccttcccagtgcagagtttttcgggagttcttcaaggcccacttggcacctacaaaatggggatgttactctacactaccattgaaagaacctttacaaaatgcacagaaatgggcctacgtgtctctgacaatagtatgctagtattgaaacactaattagtgattcagagggcatagcacaataaaaggatacataccctgtgctttcaatcttacagacatagcgaagaacatttcctttcaaagatgctgcctttactctttcttcaatgcttttatcaagctgtactaaaccactttcaaggaagtcctttgtggacattgcatcaggtcctaattcactggggtataaactctcaacctgaagataattgcaaaaaattagcacacctgatcttttttctacgaacagggtgcctgctcaattacaagcggtcttctaactggaatgtacgacataacacatgcataaatatagtgtctatgcataattagaaaatttcggaataagtgatttaggggttaaaatctttcaaaatcaaagttctggtatcatagaaaacaactgaactagcagccactcaacaaagctaatggctacataaactaaataacaacttccaagatttggagggtattcatttcattttcagactataagatacataaggtgtataattcatcggaatccccaataatcctgaacacaagtctatggtgatatccagtgacctatattgtagaagagtgtcggtccttatccatagaatccatgtagccaa

SEQ ID NO: 85967 - DNA, 2498 bp, Oryza sativa
gtgtaatctgaattattactgaagataatgcgaattattgcagctggaggaatatgagaaggagaggtcggagatggagggtgtgtcgagggaggagtacctggcctccctccgccgccggagcagcggtttctccaggggtgtctccaagtacagaggcgttgccaggtaggactactgattaattaactctaattaatctctctctctctctctcttgacctgaatgatgagtcagcatagcattgctagctagggtggcattcatcagctggcaacgtcatttgccagccgtgtatgctctgcatgcatgctccatggtccatggcctcttctttcttgtgtcagtttcgtgcaatgtcatgcatgcatctaggaaaagtcagaactgcaaaagttttaagcttctctctttcttgatgaaatctgcttccaatatcagttactgtattgtggtgccagtgctaccaacttgctgtttccattttgttcagagctagcagctgtctgttagtaattcatttctgaactttttttttgtctggttttgttcaggcatcaccacaatgggcggtgggaggcacggatagggcgggtcctggggaacaagtacctctacctgggtactttcggtacgtattctttcatccaatctttcatgctctttgctcttctttcttggagcccacttaccttaatcaaatgttgattactagcattgacaagccgctcttgtttgttggagaatttgcctgctgtaagccggccacctaacttttaccaaaatttatgatggttgatcaacccatctgcgaaattaaatggcgtgtttttcttgtttcccttcgatgtagatttgaccccttgcttttcttgaggattgcttactaggtagtacttcctctgtctcaaaattgagacagttttagatttcaatataattttcgggatgctactttgaacaataatatttataaaaacaagttatcttaaatgaaagagttgcatattatgatactagtttgagtaaatttcataaaactgcagatattttgtacaatctatcacaaaactacagatttaagaacttgttttacaaaaatacagattcagtggcttcgtttatcacaaaactacaggtactttgggcaatatatcacaaaactaaagatttaagtacttgtttcacaaaactacagatttaatatcttcatttatcacaaaactacaagtttaatggcttcatcatcacaaaactacaagttttagcattgttaaaacttgtagttttgtgataatggagacactaaatctgtagttttgtgataaatgaagacactaaatgtatagttttgtgataaacgaatacactaaatctatagttttgtgaaacaagttcttaaatctgtagttttgtgatagattgtacaaactacctgtagttttgtgataaacggagacactaaatctgtagttttgtgagacaagcttttaaatatgtagttttgtaataaattgtgcaaaatacctgtagttttatgaaatttactctataatctggtaacattattcttacgtgattgctctttttaatttttcattattaatagttaaagttaaaaatgttgatttaggactattctaaaaatgcttatattttagaacagagatagtagtatatattattctccttgtatgtttttgaaccacaaactctccattttactataaattaagtgagctggtgatatcactgatatggaagcatagtgttgaaacttccttttcttttacttaaaaaaatcagaaaatattttcctgctgtcaagatcaaagaccatgagaccaagataccatcctgtatgcaatccccagaagactgcccaatttgccctagaaatagcataaaaacaagccccatgtcttgatcaccaccatgtcctaattactagacaaaatcctagtatagatacattatatggtacatgacttggaaatgcatgtgacaagcacgtgagtggtgctgcaatgccagtagtaaaaaccagatggtgcatagggatcttcaattgttcatcactgccggctctttccactagagctagctgagtgagtcagcagccagttgcaagtgctcacttcacgtgcatggagaatgccctactaggctattaccccccctgtgccaaactagatcaagattcaagatccagaaccacacagatggattcatcactactttcatcacaactaaagaaagaaaaaaagggaaagtgaacagtgttcaccgattactagtaaacagaaggttgccagcacagttctagttaccaacaatgtgggaaaagtcatgccagatctcagatggtgtccagcacatgtcaaactagaaagtgaaaaaaaatgtgaatatgggatgcaattcagcatctctcagtattaagatccaatgcattcattttctaaagtcttaaatctatacagcatgacctgatcaa

SEQ ID NO: 85968 - DNA, 4594 bp, Oryza sativa
agacctactaatcatggccatcatcgacaacaataaatttgtatcagcaatacaaactaaaagcttggtcctcttgtccatctacaatacaacaaaaaaaacacatggacaacatctactgtcaagcaattgataaaggaatttcacacattcttcaacaaaaacagatatgcacagatctgaaaacgaaatcctcatccaaggtttagggtatttttaccgtggatattgggaaccccgatatgcagttggtggctacgaacacttcgaatcgaaggtgatgaggtccaacgccgccgtgtcctgctcgcgcaccggctcgagctcccgagagtgccgccgtgcccctgctcgcgcgagcgccgctgcagccgcgcgcgcctccacagcccatgcccgcggtgccgctgcagccgcgcgccgcgctgcttcaccgcagcccgagccgcgccgcgccgcgccgcctcaccgcagcccctgctcgcgcgccggctcgagctcccgctagtgccgctgcagccgcgcgcgcctccgcaacccacacccgcgccgccgcagccgcgacccgccgccgccttgcccctgcgcgccggctcacccaggccaagcacgcaccgccgccacccttgcaaaccctaggaaggaatagacagagaagagataagaaggaagaggaaaaaaagaggtgaagcgcttctgctcttaccgcgcgtgagttgcgagtcacgggtgcgaggtgggatcatttcgtccgccccttttttccggatggggttgtcccgaatattgaaggaatattctcttttggaaccatcttatccctcatagtgcctcaaccaaacagccataaaaatgggatgatctcatcccatcccgggatatcctcccaaccaaacacatgctaaaagtgatcttctacttttattgtttagattaaatgagagagacaaatctgtagtcatgggttagattcctttgttgtaattttctttggactccttttttctttaattctttaataaagtctttttaacagcggggcttccatgttgtgttcttaaaaaaaagttaaataaaaataccatgtctcctcatatcttgtgtttcttttctcttttagttatgtgtaatacgttatcagcataacgttctaatggagattaaggtagaagaaggtaaggaaaaaaaattgacaaactgatttgtattttatatattgaaccacaaaaatgaaacacttgcaactttctcgtctcatttctgtgactctcataccaccaacaccttcttttgagtcaatggcgcaagccgattggggtagtccaggcaccaacctccataaccaacaaccctcactacatgcgcacgtgccagccacatcccgtatgacatacgccgctgtaatgcaccggatcgactgagatcgccatgccgcgcatagcggctgagctggccactgcaccggtcggccatgtgctgcagcgccaaccacactaagcaggtgcgcttaaccagccacgcccccgcatagtgccacgccacccaacggtcgtacccagcagacgccatgccagagcaggtccgacgaccatacctactcgacagcgcatcgtcatgtgcaaaccctaacagcgtgttgattgtgccatgaccgtcttacggtgtaagtagtaccgcttattttgacatgtaagtagattcgcgggttagccacttacacccttagagtcgcccatgtcacgagcaaacagcgccgccgtgctacagagtgctggaccatgccagcatgtcgatcgggtcaccgaattgccttatagataagtggtcgcatcgccgtgtactggccatgccattgtgagcgtcggccaaggaatgaggaaagaaggaaaggaagaagaaacatacaaaaggaatgaaaatggaaaaaaggaaaggaatcctgtggtttttgcagaatgggcctgagctttctggaacatatcagcacagctccctgtattgagatctttggtgcacacgtaaaaccttaaatttaggaaaacaccatttctaaccctctaccgcatagaatcttctaaagtggcccttgtatttttcaaaattcattgaaaatttgtattttagcgtcaaaattaatgattatgtattttggatttgaatttcgttttgcatttgaggtattttactactgttatttaagattttgaacttctcttatgttcataatatgataaacacaagattgtaaactccaaaattttgccaaaaacttgaaatctaatatttcagaaattttgtccaaattttggaggtttttgtcccaaggtatttttgtcatttggataaattgtacagtgctaacggaggttaactgaacgacaatagtaaatcataaaacttaagcaaaagtcgacggcatattgtagaacgtgataaattcagtggtaaatatggtttacgattccgagatagccttccgtttcgggctctgacggaatgacggttttcacgaaatacggtggaaagccgatagattccaaacaaatttcataaaccaatatttgaatacaaattctctgaatttgccgataagctcgcgaaaatcggtcggctttggcgaaattccgagtgaaatatcgaaatttcaatcggtaactagaaaaagattcctttttttattcgttattcttttctttcctactgtaaatttcagtaaatacacggaatacattaattttttcgtaaatttatatcccaacaggttctatgaatatcatactatttataagattttatttgatttttttcttttttatcaattcaaatttgactttgaatgaaactcaccaaaatctcagacggcttctgctttcgagtctcgtcgaaaactcgaaatttcgcagaattcaaccggttttcatcggaactgggaatcttagtggtaaatcgtagacctatgataaacttattggtatataatggattccctcccaagtcaatggctgtgtgtcagcaagtttggcactgtacactagctctagttggtggtgctcgctgctcaggaagcggccacgaacaacgtccatccaccgtccaaccaaccatacatgcacgctactcatggacgttgccaggttgctgtagcgctttcatatcagactagatttactatttttgatttgactccgaattattctatcaagctagcaactgcttttgactagcccgcaaaaaattgcacgggaaaatttctttgttgggacctgtttagattctaactttttctttaaattttaacttttccgtcagatcaaactttcctacacgtaaacttctaacttttccgttacatcgttctaattttttcaaactttcaattttagcgtggaactaaacacatcccaaaatcgtctccattttctgtcggaattaattcacgcccaggaaacgcattcaagtggatgctttcacctgccattgctttgtttattcacttccctccagcttaattacgagtagagtacagtacagtcatcgctgttactctgaattatactactgtagagcatcatatgacagtgaggttcagtcacaggagaggctctgatttactctgtttaattcgcttgagatgaaagcatggatgcattcatgcatacgcgcttaatttggctcgccacggatggcttctagcgtgaacgacaacgttgcaactacgctactccatccactgacgattaaacaacataaatcaggtgctaatcaatacccaaacgcagcagggaaagaaaaggacaacagctaactgcaaccgaaacgtccctgttcccggtttagcgtcgggaaatcatgagctaataagcagcaacctgttacacgtatatatctaacttgttttatatttttatcatgcatcacatgcctagcttttttatttgtcactataaaaaaaacgcacatcaaaataaacttgcacgaaataaataaacttgcacgatatattaaggttctttttggcacagctctaaatctgagatttcttgaagatgaatatttctaactccacaaattgatctagatctacggtcacatagataacatttgaataaatcaatttattcctattttaaatgaaatataaaattcactataactcaacgtataaacatcaaatctaccgtggatcagagatccatagctctaccaaacatggcttaagtttttaactatattgcaaaactcgttagccttacttttatatattcatttataagttcaccaatatattttttcactttttccttacgaatcactgaattatttgtagtctaaatttttcaccctaagaccaaaatgtaaatatgtgaattattggatgtcaatttggtgattcaaaggttatatttatatataagagaaagattgagcaccagtatttaaatcctggtgtacatagatattagcacacataggtgcactttaaatagaaatttaatgaggcaacaatttgatgtggttaagtggtttccatctcttttggcacatattaaaggacgcattcacatgtgtatgagtgtggtgtttgtgcatatat

SEQ ID NO: 85969 - DNA, 1765 bp, Oryza sativa
  unsure (1)..(1765): unsure at all n locations
aggtcaggggaataaatatcaaacaaataggctcttttcacatgattcctgtaagtaacgcaaaccattagtgtctgcgttttcatgtgtggacgcaaaatagttgcctacatggagcgccacgtcgtcggtcagccctggtcgaacaaggtttggacctgctgtgtttcatggacctaaacgcgcaattttcaagtttacagacctaagtgacaccactgctcaagtttaaggaccgaccatgcatttcactctaatcggaaacctgtaccctgactttttatatttacaaagttggatatgaagagatgatcatcctttgacactataatgctttcatcctttcacttcgattcttggatcaaaataatctatgcacaccttactccttttctatttcataggtattcagcaaggatcatcgttgatttctgaccttcaagggcaggaaacagtccttaagcagtgcattgagcaacttgaaagtgtcaacatggctagaataaccctaatcaataaactaagagaagccctcagcgaacaggtcttgagcactttttatatttttttccccaaatgttctaccttgaaggcatactattacattcataaagctttatgttttttctttttatataacaggaagcaaagtcagagcttcttcgcaatcagttgcatgtaaggattattcttttatgcattctcacttgttagtatccttgttattacttcatctttcactgcagaatcacatgttagatctttctatttcttatgccatgtctgtaactcaattgcaatggaacgttaaggtcaaaattatgctgatcattttcatggatccataagcttttgtttgcctagcggcctagcctaagatgccccatgagtccatggcatgtgagcacaaccagagttttgctttgtcaaggacattcattcatgaatttatatcacacatgttcaggatgagtagagctaggaaagacaaaagcaaacatgagaacacataagatgcacattgtatgctctgacacgaagagaagcctctaaactggatagttgctgaatctgctgtacgattcagctctatgatggaagtagtagactagccatggtctgcttgggcagcacagatgatctgtctcatctagtatcctgcttgaagcacaaacctgcctcttagttaccatggcaaccctgaggccttctctggataacaaggcgacatgttatttcctacttattagactgcttctcaattccaacttatgtttgcaactttgcatatatgacattcctctctttatctgtttcaagagaaataggtccagcacattgggaggtctgactatctctatagcataagctatacagttaaggtggcccttgcatgagctaatagaaagatgtgcctgcagtgatgtacccatgcatatgcgttgttattagttgtaacctaggttctatgtagctaacctgctaactccacggtacaaacatgtgtcattgcatcttagttggaaatttccaatcacatatttctgctcccgtatgtagcatccgtctccgctggcttttgttaacattgctatataccatctcagttaaaaccgcagcatctttcctgccactgaaggggtgttttagcagctactcaagaaattatttagattgatttttggctaaccctgatttaattgacagggggatcctctagagtcgacctgcaggcaggctaatatcagctatcaaatnggacacg

SEQ ID NO: 85970 - DNA, 2963 bp, Oryza sativa
cacgacaaccatatacatacccattatcttctaactccatcggggggatcatgcttctatttattagctcgttgaagtacccttccccaagctcaaataatcctatccccgttgcatgttcattctggataaaaccttcagctatccacttccatatcaaaagatttttctcgatcccatattcttcccgaaatagactcagatacagcatgcaagcctttagatgtgaaggaaggtcatagtaactaaaagacagtattcttcgagtattctctacaatgtcattgcctctttcaccaaaaccaatagaattgtacacattagaccagtcctcccctgatttacttgccaacaaactagctattgtgatgatagctaatggcacaccaccacattttttcaaaattttatcacatgcctcagttgaaagactgtctaggaatctgtcttcaccatcatttattctagaatataataatatttcagagtcatcacgagaaagggtttgcattttgtaaatatcaccgatatgcgtggcgacttcaaaaatacgagtagttaccactactctacctccacaattactatgttgcagagcacatctgatcaattcccatgatttcttatcccatatgtcatcaataacaaacaaaaacctatgcatccacatcacagtacaataacataagttagtaaccatgcctagtgggaagaatgtaaaaaacaagaataacaccaaggtggcaccgtggcaaccatttgaaagaacacacgaaaatgccactataaatcaacaatttgtagaaagtcgatctagtgtgaataaatcaaatattataaagttacaagttgtatacaactttttttaaacaatgttgatggaagaaactctttataatagccatactgtatatcagcttagaaagcatatgccgcatatcatccacgatctatcagataaaacgaactagaccttaatctataactataatagatatcaatcatattctcaatgttcttgtccaatcaacttgactgtgcctcagttacctttggatgcattttgctttatagcctaatatgtcatacccaaatgattttctcaaacaattgttcatgaccatgcgcattgacaacataaataatatgctataatgcaccagcccattaatattcttatttcagctcatctgctcatgtgtacattcaagtttaggctgtgcgtgacccaattattctattgtagtggtagtcctgcctcggtaaatttagatatgtttgtgctaccttacaatgctttatgatataattgtagcactttgggttaactttttctacacgaatcttggtcaaaagcaagcataagcatttgtgctttctgtatacaaacatgcccctacaaaaagggcgatgcaacattgaaggtgaggtcttatatgttcaggtactaaaacaaaattcacatgctgaactgctgatgaatacgtagatgttcatacctcttgttctggatgagtttccgtagttcgttgatgagctgcctttcatccaatatcatcacatttggattcatgtagtcaaaatcaataagaatatccctcaagactttcttcatgtcaggatcccgaccaaccggaacaaaagccccacagtcaaatgccagtttatgtttgtcatatactgctttggaaagagtggttttgccgagtcctccaaatccaacaatagagacaatcttcattttctcgtcggaggcatgaacatcatccccaagggataatatctttacgagcttttcactctgcttttcaatgccaacaagctctgtcgtctttttgtatagcgcctgaaggcgaggatcgatggtaacaggacctgtaaccttggcgataatgttgtccaccatgtacctgtcacgccttgcagccacctcctcgactttcttgttcacgtcttggatagctccagcgatcttatggtgatgcttgcacttgttgaagaaattagccatcttcttccggaagcgcctgagcatgtgtgtgtcaagaggctcaggaccatcgatgtgcaccaagaaagcgtcgacgacgtcctccatgtcgtaggacagctccctgacatcccctgcccagagcttgaccagctcgtcgagctggtctggaggcacctcaccgaccttgaggaggacagcattcatgctctccagctcctgtgagagatgcttgatcttcttcctcacgcctttgtgcaagtcgtactcctccttgagtacctcaaccagcttggggagaaggctccctatcgccccgtccccaactccatgctcgctggctcagtcagttggtggtcttgtttgtgcgcacagattgggcagctagtaggttgatggtatatcgactaaacataggagagcatgcaaaagtttaaaatgcacttcatcttcgatgacgaacactgaacaccaagcatcccaatgccgtgaagatacaaagtagcagtactaatcaagcgtcaaactttgcggccgtgcaacctgatcacatgtttacacgcactcttgacccccctgtcaggctgtcacgcgtgctgcacgcgagtttaccatattttgtccacgacgccctgcaagcaaaaattaccagtgaaataagggagaaaacttaatcaatctgtcctgttaacgaacaatttgcagatgaacacagatatgaaatatgcagtcattgctgaagtctgggatgatgagcttcccagtgagcaaacatatatcaggcaaaacgtgatgtcagcatcgggagcaagcaaaaggccgcggcgggggcgttgtccagtgcaggctggagcggcggaggcgcggagcacagggggctggatctcgacgacgaggggggcccgcctgccggcgccagcggcagcggcagcacctgcagccacaatgccgcatcacctcatcctacacatat

SEQ ID NO: 85971 - DNA, 2566 bp, Oryza sativa
gaggtccttcagtgccactcagtgcggcgatattaatgtggtaacatcatactttcgagttctacgcgttttaactttggaggattgtagtgttactggggaagcttgtggaaaacatagattagagcatgtagggaatttacgccacctgagatatctggggatttggaatacacgtattgatgagttccccaaggaagtaggagatctcaagtttctacaaacgctgaatttgtcaggtactggaatacaacagctcccggaggctgtgggccttttgaaacaactgttgtgcctacgtatcaatgacagtatagcagttccagctggtttgatcgggaatcttacttcattgcaagagctgaagatatggccggttgatgatgtctcaacaaggcagtttgtgaaggagctgggcaagctgagggagctaaggattctccggtgtaccattcatattagcgatgagggcatggagagagatttgctagaatcgctagcaaatctgcacaagatccgcactttgtgtattttgggctcagcattaccgagcggcatcacacgggaagcatgttttgtgacccctcagcgccttggacagctgtgcttggaatgcttcaagttctctggactaccagtatggatcaactcttcacttcttttgaacctcacccatctagatgtgtcagtgcatgtggtgcaagaacaggacatggaaacccttgggaggctaccagagctctgttatctcaaactgtgttcagattacaccaggctagtaagcataaggaatggtgatctgcaacgctacttatttcggaaattgagattctttgtttctccctttttatttgcccggtttgatgatttgcacggccgtgaaaacgacggcggcatatgcatagcagtagcaccttccatcatgatgccaagccttgaatcccttgtgttttgtgtctacgtacggttcctaaaagatatggtggaaatgcagcctggctttgacaatctgcatatgcagcttggctttgaaaaagttgctagcagttcgctccagagggtcactgcaacgatccaatgtgaggatgctactgctgctgcggaggtggaggaagcgaagacagcattggcgcatgcagctgacctccatcccaaccgtcccacccttacaactcaaatggtgaacaagcataagatgctctcatccgaccgagagctacgagtgtgaagcagaggagatgatggagaactggcggagagaatctaggagcaggagagcaaggataccagctctgctttcccctgatggttaccctgcaaaagcaagcatacatgttgcattgcttctgtatcaattctgtgagacaatttagttgattctctgaacagagtcagctaagtgccaaatgcccggttccagcctgtgtttgatcgattgacgattggttcggatatctccttcacttttcctgaactccatccacgattcaagatgtcaaatgcatataatcattaattagcagctagcattacgtggacaatgtgcttcaagatgcatttcgttttcgcgtttcttgtatatttttgtcagcgggctatctttgtcaaaacgttatgcagttactccaccggtctgtgttatgaacagcggtgtgactgtacttgttcatcccttcctgtttgtgtttctgtcaggatatcgaacaagttctgaatcacattggtactgaaagagactagacttaggcccccagctgaatagtagacaagaccatatatggttcgcatgtattaacttttaattacttcttctaatagaatgacgtacaatcgaattgccagtttgatgaaaaaaatatggtttagaagtgaggttgattgtccttgttaattaggtttactgatccactgtctatcggtagtccacttccaagtaactgaatcatattgtgtactcaggctaatggtcccaatctcgtccggagtctgaatatttcatgaaaatctcctgcaacattgacagtgaaacctgaaatcagttatgtatactgaacgtatgcctatgggcatgtctgtaaaccgtaaccgccacctgaagaaatcaaattcagaagacatacattattagtcattcgaattcagaaggcagattgatagtagtattatcggacaacaatggaggaggcggcgatcaaagatgtgttctgtagatggagttgataaacggggggatccaaatagatggagaagaaaactccgacccctaggatctccgtgagacgtccgattaaggatttgcggcacagattagatgggtaaatacattgggtgcacttctctttttgggcctcagaaatctcgatccggcttttgggcctgaatgtttaaacgggccaactttgcaaaacagttatgctggggacccgacccaacaagcgagcggcggcgtcgccttcgcttccaactccggcggccggggcaacgacggcggcggaaacagccggggcatcgggaggaggctgcggaggtgtacgcccatggatggattcaacggaatcgcaacacg

SEQ ID NO: 85972 - DNA, 1105 bp, Oryza sativa
caatgtcttagaggtaaaaattatttaaccactttgcataacttgacttatgcctaccaaacttctatttttttaattcaaaaggttcgccaaaggtgccgcaaacttgctgcaagattaggttacaggtcggttggattggacaacgtgtaccaaccgcgaagagtaccaccaccactacctcaatcggtgtgtccaagtactgctcgacactccatcaggatagaagagcgtgaacaagttggtggttcgtcgtcgtcacgcattccacaggaaaggggaaagggaaaggcacaggctccacctagcggcgacgacgaggagaaggaggagaaggagaatgagggctacatcgcaccagacgccgaggagataggcatgtcgcagtctccgatgcacctcatgcatcacagcccacccaatacaacttgtgatccactcggccagcgaaaaagaggtaaaatgagcttaccattctcaagtgttacttgatttccctcactttgttttttaaatgttttaaactttggtttttcaaatgtagatatactcagggcttgcaagctattcggcgccaacggaaaaagtgatttctatgaagttgatctatgtgtcatgtgttaacttgtttcacggacttttggatttgttggttgtatgaagtatgtgatggacttgtagtattgtttgatgtgtggaatgtgtgatggagttgtggacttttttcgtcaatctagttagcttgtggactatgcgatatgtgatttggtgtcaatatttgctgtggaacctgttttgtcgatatttgcattttttgcagactgtccaatgaaatttgttgttggcagggaggtagaggtcggcgccagctaccctgacgtcgtgctgggggggcaacaccagcaaatcggccgaggcagaaagcctcaggggtgggagggttgctggcaccgtgctatggggggcggcaccagccacccgctcgaggcagaaggtctacgggttgggggggacggcgccaagcacgcttgcgccgtgcttcggggggctgcaccagcaattcggccgaggcagaaggcctcgagggtgggaaggggggaggggc

SEQ ID NO: 85973 - DNA, 6385 bp, Oryza sativa
  unsure (1)..(6385): unsure at all n locations
atcgagaagaactcgagcgccattcacttggagatggaggcataccacttgatctaagacgttggttgtccccccattggatatcatgaggcacacgccaccggtcctcactggcacttgcccagcttgagactctaatgctgtggcgtggaacttgggtccatccgggtgcatccccagttggttcccaacctgcctcatacatctgcacgagtgttgaggatgatgaactttcccgttcattccttgtcatgttgcgtgtctccctgtatgctccacttgcacgagattcttctatgctctacaggggaatggttagttcatgtcagttatacaaatgataccctgcatttggcaacgggattttatttgtacaaccggggaaaaagtaaatcaaagatccatccactccatacttcagaatatgcccttgcactagataggtctcatccatacacggacgagcggctgagataaaagcaattttgttgctaacgacacctaccccttttgctatctgagtaatcagagaagtgcactcaacaggagcagagaactttatactttctaaccattgtcttatcatacatttcacaggagcaattttgatctttctaaccatggcaaacatgataatcaattcatcccccctaatggtctaagatcacctctaggaaacaaagtcatagcaatccatttgtgcatgagcctaagtgtaggattatggatatcattcatcataggtttcttgcaaattggagcaccagaaatatcttcccaaaacctatttttctcgaacccagaaattcctttctagagatcgattttacagcaatcgtgaaaaccaagaagtgtgcttaagcttttccatgtaagtgtaaactccttacggaaaaagcgaaaggaaaatccatcttctatttctttcaaagtgcatagaaattgcaaagtaagcaaacgagaaccaggctcatctaccacagcaaatctctgccaaccaacagctttccaaatagcacgaaattcaacatccatatctatctttttcagcagctccggagagtattctcgtgtatgagcatactcccggttgctcagcatgtagtaggcttttctctcccgatcacagacaaggtcgaggtcggtgtcgttcaggagtcgtcgcggagcttcggcgtcttccaacgagacatcagctgatgaatgagtactagactcatcatgatgacttgatgaagagccggaccccttggacagatgagacaatcggctcctcattctgcacaatggagcaagaacagactaacccgacgggggttagaatagcaagagtttcacccaccggttagttccaccaaagcaacttgtatatatgcaactagtgtttgaatttgaggaaaactataaaagcttgaatgaacttgagaacaaactttggagagggaatgaaaatgtattgaaatggggtggaattccctctcggccggctggtttttatagggtacccacaactgtcagaaaagacatgtgggacccaatagccgttgcccagccaaaaatggtaggtaactgttgcctggccggttcggtcgaacccctcgtgggcccaaccggcaccactttcggccgttggattccaacggttagtgcagtcgtggcacagtgaattttcgttgaaaattttattttggtttgctctgaaaaattcatttgaagattttcctcaaaactcaaagaatcctaaatggaaattttgaaattcaaacatgtgttgatgcataaattcaaattgttgaaagcaaaaatgcagatacataccaatttcctatggcgaaggtcgcgtcatttaaaatccgacgtgcaagactgtacctccttctgattcagttcgtggattttccacccgtctctggaggtgatggagcgggcgtgtttggcttttccctccacaccttccatggctttggtgcagaaggcggcttcttctcagccgactgctctgacttcttggccggtatagttggttttatcaacgtcctccaataacggttcctaggcatcgttgtttccttctctaggaaattctgcatgaacttcaccaggctatccgtcttgggtggctccacttcgaccacttgaatattctgcgggttcggcccgtactttatcctgaccatggagcattgttcgacccttggttgaaactcaaacttttcctccttcccgttaatatgaaaacggatacttcccgctcccacgtcaatgttggcttccgtagtgctaaggaatgggcgccccaggatgagcgacatctcttttcccgtgtccatgtctagcaccacaaagtcaaccgggatgaagaaatcccgtatcttgactggcacatccaccgccatccctgctgggtaacggactaacgagtcagctagttgtaggcgcatcagtgttggtgccaacaccgtgaagttgagcttgtcaaagacgtcttttggcatgacgctgacactggctccaagatcgcataaggcctggtcgaactgctgtaccccgatcgagcaggacaccccggatctttcttcttctttgggagcttgtggagtatcacgttgctgcattgctccgtcagcttaaccacctccgttgttgggagtggtctcttgttgttgagtatgtccttgagataacgggcatatgttagtacttgcatagcatccaacaacagcacgtttatgtggattttctggattacttcaacaaaacgagcgaattgctcgtctactaacggtttcctactccgttgaagaaacgacagcaaccgtgcgtcgtagtactcctgcggcatggtcttttcttgctaaacctctttgtcagctgagtcactagatagcgcttcttttgtaatcccgttagttcgtgcagggttaggatatggtggatcacgagtggacttacctcccatcgtcgtgatcgccttaacattttcaagggaggagtcgggttgccccggaatcctcccagtttcttttgcagggactaaagatgccaactgagctaggtgggtttctatcattttattaaagctcagttggttttgaaaagcggaagcaaaccatctagcttaacatttatattttcaaggatcttgtcattggcagcgagctttttgtttagcgcatcagtggttttagcttgtgcaatgacgagatccttcaaggagggttggttagaaaagttaccattgttgttacccccttgataatataggcgtggttggttccacccctggcctccttgtggacgatacccgttgttgttgttgttgcccatatacatcgcctcctcacgggtttcccggcagtcgttcctagagtgacccgtgttgccgcagacctcacatgtaacgtgtgagtccagagccttgacagtgtcttgaggccgtttgtcgtggtcgtctaagcgcttcatgaggaggtcaagcttggcagcaagtaattccgtctccttgactatgtgcatgttgggatacgcgtaggctaagatagcataaatcaaaaatttctatcgcgtaaaccaggaaccatgcaagtattagatcatagatcgttaccacttgatagattatataacttgtgattgactcctcaatcacctttgccatggccatgcacttccataatctataacattgagggacccagagatatctctccataggaggggcaaatcccatcttgattattcatatcccacaacatgtttcatagcatacccgaaaactacttttatagctacccatttacggagtagcgtttagcagtccctaagtaagctactacacatgttgagaagcatgataatctcaggtctaaggattcaacaccaacactaaatgagatcactgatgacacaacacatatggctcttgcagtgtctcatgttgggtctatccaacaacatgttcaccaacatgtgtccatattattaatttggtatctctataccatgatccatgagacatgatcatcaattaatatatgtgctgatcatataaacatatttgttccacatatgatatttgatcagggatcctttagaaatagtaacaaacaacataatgattctcatgaaagaatcacatattcattaaccaataaggagttatctatttcaaggaacaatgttggataaatatgtaaacaaagtatgtgatacaatcatctctataattgcctctagggcatatcactaacagtctctcacttgcactagagtcaatcatgaacgtatcatatacccattgccctagtgtgtgcctcatgcttaggctgagggagtggctttgtcaacggatctgcaacattcaaatccgtatgtattttgcatatcttcacatctcctctacccactatctcgcgaatgaggtgataccgccgtaaaatgtgtttggacttttgatgcgatctaggctccttggcttgcgcaatggcaccactattatcgcaatagaggtccattgggctagaagcactagtcaccacacctagtcgagaaatgaatttctttatccaaacagcctcctttgctgcttcagaagaggcaatgtattcggcttctgttgtataattagacactgtatcttgcttggaactcttccaactcacagcgcctccattcaggcagaacacaaatccagactgtgatctaaaatcatctttgtcagtttggaagcttgcgtcggtgtaaccatttacaacgagctcttcctgtcctccattgactaggaacatatccttagttcttctcaagtacttcaggatattctttacagctatccagtgactctcacatggatctgattggtatcggcttgttgcactaagtgaatatgaaacatctggacgtgtacatagcatagcatacatgatgaatctgattgccaaggcatatggaatcacactcatcttgtttcgctcatcagtcgtttgagcacactgattcttgccaagattaatgccatgtgacatcggtaagaaacctttcttagaatcttgcatgttgaacatcttcaacacctttcaatgtatgtactctggcttaatccaattagcctctttgatctatctctatagatccttatgcccagaatatatgttgcttcccctaagtccttcattgaaaaactatttttcaacgatgtcttaacggattcaagcataagaatatcgttcccaatcaataatatgtcatctacatataggattagaaacaccagtgcgctcccactaatcttcttgtatacacaagcctcttcttcgtttttgacaaagcccaacgccttgactactttgtcaagacgaatattccaactccgagatgcttgcttcaacccataaatggatttctgcaatttgcatatctttttagctgattgtggatcaacaaatcccttgggttgtgtcatgtacacatcctcatcgagatttccattgtggatagctattttgatatccatttgccatatctcataatcgaaataggcagcaatcgctaaaacaatccgaatagattttagcatggcgactggtgagaaagtttcatcataatcaacaccttgaatttgtctgaaacctttcgccaccaatcgtgccttgtagatgttaaaatttccatctacatctgtctttttcttaaagacccatttgcactcaatggcttttacaccattaggtggatcaaccaatagttccaaacttgattgacatgcatagattctatttcggatttcatggctccaagccatttctcagagtctggtcccaccattgcttcctcataggtagtaggttcatctttgtctaacaacannngccgctttgtcctgtagttaacaacgcatacctcgcaggtgtacgtcgtatcctatcggatcttcgtgaagccggtgcttccacaactggttcaacaacaacttgttcaacctgttgaacaacatcttgctcagcttgtggttgtgtggacgttgaagcgttttccggtgtttcttgaatttcttcaagttgcaccatgctcccactatcctgtcttgaaataaactctttttccaagaaaacaccgtgtcgggcgacaaacactttgccctcttcccgattataaaaataatatcctttcgtttccttaggatatcccacaaagaagcatttatctgatttaggtgtgagtttgtctgattgcaaacgttttacatagaccacacagccccaaatctttatgaaagacaaactgggacgctttccagtccatatctcatatggtgtcttatccactgattttgatggaaccctgtttagtgtgaacgcaactgtcttagagcgtaaccccaaaagct

SEQ ID NO: 85974 - DNA, 1793 bp, Oryza sativa
tttcatatccctaatggagttacaaggcttattactcgggaaactcaaaacttcatggtgctgttttgcttttattggtgctctgaaggcatccattatgtaattctcccttcgttccaaattgatctacatatatccattatgtaattctcccttcgttccaaattgatctacatatagttttttctgaaattattcctaaatgatatacatatttgtgttaatttattaagtctattcgttatttatgcattggagtaaatgtacgttgatgcatgcagctatgcacacaagtatttataacccacatgcaatatcttgatttgctattggctaggaaatagtaggaatggtgcctgcattgagtttgttgctagaataaatataggatgagagagttatttgcttttcttggttttggtgtacctatgaaatatatatgtagatcaatttggaatggagggagtagtttttagaaagctagctctggtaggatttttagcagaggttttgggttttattgtatcaggtttttagaattgattattgggaagagaaaaactaggaagtttatctaagaagtcttggtgacttgtagtttacattgaactcatttaatatttctacagaaggtttttatgattttttgtacggaaagtctttagaggtttatttgatttcaaatcctcttctatatagaaagtattatgatctcaaataaaatctatatattattgttaacttatgcacgccaacaattgtttgccttttggcctagggatgaaaatggtcacatgaatttccaactgaccgagcatcgtttacatataaattatatcattttcgattcttgacatatatatttttttaatctcttttagcatcgttattgacattatatatttaaattaataaatatgatcaattctctaccaacggggaattatttctgaagggatgttagtgttttcatccctattttagcgccaaccctagtaggcagtagtactataggatcaaaaacaaaaggaaagtttgcaaaaaaaccaaataaaaggatagttttcaagaggtttgatccctagcttattttcttatgaaatcgagccgtacacatgtttacactaacattttgttttctttcatgtgaactaaaatatgcagtatttagaaagtaccaatatcctccaaaaattaggtcccattttgttttgaaccaaaaacataggaattttatagaattgtaagtttataagatttttttttctatatggccttttggaataaagggttcaaaactattgaatcttatgaaattcctaagaaatgccttaatttatacaagttttgaaggatttttaatatgagatctagaaaatttcctatgagtctatctatctcatctagcatatgtttttcctgcggtccagtcaaagaattatttttgtatttttctgtgttttataatcctctagttagcatttaaatttctattaaaatcgtgtatatatatatatatatatatatatatatatatatatatataaaatccagagtttcgaagtagccctttttatctactcaatcctccattcaaaaggggtccttcgtgctctttttttacctggcgagaggtgtgcgtgtgggcgggaaaaaccaagacgaaggagtgcgggggaaaattgggttaatttgatccatgtctttgcaaatataccatattgaaaaaatattattactattagtgaaggggacatatccggtgaaaacaagctaagtgttggaaactcgtg

SEQ ID NO: 85975 - DNA, 2764 bp, Oryza sativa
gcccctccccccttcccaccctcgaggccttctgcctcggcggaattgctggcgcagccccccgaagcacggcgcaagcgtgcttggcgccgtcccccccaacccgtagaccttctgcctcgagcgggtggctggtgccgccccccatagcacggtgccagcaaccctcccacccctgaggctttctgcctcggccgatttgctggtgttgcccccccagcacgacgtcagggtagctggcgccgacctctacctccctgccaacaacaaatttcattggacagtctgcaaaaaatgcaaatatcgacaaaacaggttccacagcaaatattgacaccaaatcacatatcgcatagtccacaagctaactagattgacgaaaaaagtccacaactccatcacacattccacacatcaaacaatactacaagtccatcacatacttcatacaaccaacaaatccaaaagtctgtgaaacaagttaacacatgatacaaagatcaacttcgtagaaatcactttttccgttggcgccgaatagcttgcaagccctgagtatatctacatttgaaaaaccaaagtttagaacatttaaaaaacaaagtgagggaaatcaagtaacacttgagaatggtaagctcattttacctctttttcgctggccgagtggatcgtaagttgtattgggtaggctgtgacgcatgaggcgcatcgggaagttgcgacatgcctatctcctcgacgtctggtgtgatgtagccctcatcctcctcctcatcgtcgccgctaggtggagcctgtgccttcccctttccccttccctgtggaatgcgtgacgatgacaaaccaccaacttgttcacgctcttctatcctgatggagtgtcgagcggtacttggacgcacggattaaggtagtggtagtgatactctccgcagttggtacacgtcgtccaatccaacggacctgcaacctaatcttgcagcaagtttgcggcacctttggctaactttttgaattaaaaaaaaaagaagtttgttatgtataagtcaagtaatgcatagagttaaatcatttttacctctaagacattgcgaagtttgttctccgtatccttaccaccccttggagatcggagggcatgccccatttcattcacactcctaagaagctctctggactaacagcgtgagaagatgtatgttagggtttagggtgcaaataaaaatcactgtgacaaatgcaagaaaacttacgactctgtctctaagtggggcgtgctccatttgatatccaaccctagtccgaacgtcgtagggatgccgcccctcatcagagtcgtggtcttcctctatgtcggcttccgtccaagtagggcgtaggaacagtctatatgtcctatgcagccaacgaaggtactcagtaaaaagatgattttggtgtattgcctcgatgtacctatcattctcccgctgtcctccattcatcaatggatctattatgctctagcacccagtccttcaccttctttgttctcaccctgtcgtaccttcacaagtggaaggtgatgatatgtaaaatagggtcaaatggtgcaaaattgaacattgacaatgaaagcaagcaaagataaaaaatattacttgtgtagatcaactccagttgagatgtcctcaacaagacattcttgtctcttcccgaactatcgcatgacacggtgcggaaggtggtattcaactgcccaaaaacaaatcaattggcactagtacatgaagtaatcggagtctcgattgcataacgagttcagtgtaagacttgtagcctcagtggtgtggtatggtaaccactcaatctataaatgttgaatagttgtcgtaggttagtatctcaatcatagaagtaaatgacgaattagaagtgatagtaaagtacttatatgtgcaggcagtccatctcgttgatgtactgcttgtatgcgatatcccggtgagcatgtgcagtggctatactctcaaacaggtaggccactgtcttctctatatatggctcattgtagggccaaggggtaaagatttgcctccacttaggcctgccaaccggtagtcttagccacatccacatctgaatcaccagcacacaaccactaatgttggatgatggtgcctggcaacaacaggcctcgaagagctgtctataagtccatgccaacaccgttggagccccaactaaaacggcccagatcatcaaggttagtgaccaaagaaatccaaattgccgaagcaatgtcacccccagcatctagaaaaagaacccctcccaataagtgcaagatgtatacacgggcatagcactcaacacgccatggctcaacgtcgtcgtccaggtctgaaaagttctggctaagccaagagacgggtattccgttatgcttcttcttgctcccttatccctgctcaatgttgagtgcaatgccaaacaactgctccacttgtgcacgccatccaggattctctgtcttgcccgtcaccccatgtccctgtattgggagggccaagatcatagccacatcttgaagagtgatggtcatctcaccactcaccactggagaggtggaagctaaggtcacgagtgaaagaagttcttcacctaaacaagtctcctcattacattaagaataattttgtgacatattcttctcgtcgttaagggggtgcaagtaagactgagttggtacgagaagacttggatgggcaaggatagaaga

SEQ ID NO: 85976 - DNA, 6003 bp, Oryza sativa
cacaagaagctagccgatctcccatagtctggcgaagaacaaaaggcaaggctaaaatcggctatcaagaacgtcgctgatatgaccaagtccctaaaagtcatccctggaaccgatgctcaggatgcccaattcattgaagaagtagaacaaattgggcaaagagctatatcggctatccagcgctacttgtctcagtgatattttgtgtaatagactctaggaattttatgccgattcaatataactccatattttgctaaaaaatttgcaattttgcaatttctcatatatgtgccccctaattttataatgtccaaaacattgataaaattataatttgaactaagggcgatataacaatatcagccattgtacatcggcaaaccacaaccgattacaatatgaaaacaactaagggcgatataacaatatcggccatctcaaggcgctgcaaatgcatcggctatcatgtaccggcaacatcagccgatcatgcattaacctaaacacttgggtaatatttcttcaaatattttccatttagtgctcgtccataaacttctccatcgagtccttgcaacatgtaagctcccttagatacaaccttatagatttggaacggtccttcccaattcgttgaccacttgtccgaatttactatcccgagtcccaatcggcaaaattaacttccatacaagttcaccttccaaaataatcttgggtaccaccttcttgttgtaatgccaaacaactcgttccttatccttgggtaccaccttcttattgtcgggttcatcttcaagccatatttcctagttctctcaaaaaccttcctcaaatcggctatatggttctctatctctttagacttaacaaccacatcatcaatatagacttcaaccaaccagccgatcagatcatgatatatataattcatggctctttgatatgttgctccggcacttttcaagccaaaagtcattacaacccactcaaacaagccgattgcaccaggacacctaaaagccattttatggatatcctcttcggccatgaaaatctgattgtatcctgcatttccatccatgaaactcaatatcttgtgtcctgaagcagcatcaaccagctgatcggctactggcattggatactcatcctttggggtagctttgtttaaatctctgaaatcaatgcacaccctaacctcaccatttttcttgataacaggaactatactagaaacccactctgcatatcgacaaggacgaataaaaccagcatcatataaacgtttaatctcagccttgacgggttcaagcatatcggccttgtatcttctcggaggttgttaatgtggtctaacccctggtttgataggtagccgatgttcaacaatagatctgctgagtcctggcatctcataatactcccaagcaaaacaatctctgaattcccttaagagctctatcaacttggttctaaattatggagataagttcttactgataaatgtcggccttggtcagtcacccggacctatatcaatctcttccaaatcatcagccgacatgaaaccctgtccttgcttgtcatcgagatcatctactgtgtccttggtgtagacgtttgaacccttcacgatgccctcaaaataatagcttgggctctcgatcttcaattggctgtcggctggcatgatttcaatcttgtcgccttgccactgaatcaagcattgatgcatggttgaaggaatacaacaattggcatgaatccaatcccttccaagcaacaagctgtaggaacccttcccatcgatgacaaaaaatgttgtagggatagttttgttgccgactgctagctctacatttaaaactcctttggtttccgatggattgccaccaaaatttttgagcaccatatttgcatatgctcttatggcaccagtgtcgctcgctgcccactcaaatgcttcttttgttagtgtatcatctcggccaaccgtagtacatacacatagtagtggtcctcctgcagtcatcgtagacaattccatctgctctttaaagtttggcttatgattctgatgtgaccattcagattcttgcaggtaataggtggacagcttttgaaactacagacaagcaaaggatattaaccacatagcaatatttgcacttttttgcgaatctatgtagcaatatcgttatgctactacacaactcaaatagagatacttttctagtcgcaatgtactcgtcgttttagatatgcatttatactctatttagatttagacaacgcatttagacttactcgtcgttttatgtactcgtcgcaatctaaatatcttaaatttatattccatttagacaatgcatttaagtcataattgtaaatttgttccaaaaaaaataattactacatattttctttattttttctagaattgttatcattttagttgtttaataaatttttaaattatcaattagtggtcttactctctccatccacttacaaagtacatacatgtacttcaaacatttcaacttcatatactttggtcattaattatactaaccaaattatacacattttctgtagacaaattattctgatcgattagtattacctcagtcccaaaatatagttatttttagcacaataccttgtctcgaaatgatgctatttctccacctacctctactcaaccaatcacaacattctctttcacctactttatcttatattaactattcacacattttctccaatcattctcacctactttattaatacacatgccaatctaaaaaatatttgcattttaggacggaggtagtttaaattactttcatatgatgttggtggcttcactataacatatctaggcctttctgaccgattccctgtgatgactgagatatccgtcattaatctaagacgattaaggtccttagttctgcctcggctgattctagtgacagcttaaggtcttggtattggtaagaaaaaaaggtcacggcatcaaacagggtaataacaaatgctttgaaattcgtgttacaagttgggctggcacacagtgatgaacaattccgtcataaaacatggtaagcagggtcctcatgacgcggaccacatttagacagtaccattcatatgtatgagattctttgtaaacattggtcataaaggagccctaattcctataagagtcagagctgcacaacgatgatgaagtagtttcgcaatatatagcagtagctagcaatagttgctaattaagggtctcacgcatgtaagaatgagataacgtagaggaggagacagttttctaatgtttacatggattgtgtgcatatgtttaattagggtttgcttttcaaatcagcatgtgtacgtctcgcgtggtttgtctggtggctacatcctatagtctggcatagtggcctcttgtgaaaacgtgttgatcaaaccatgtagttccctctcctgatcaatagtgaatgtgaaagatacgcccatgctaagtagtcgagcaggcgccattgatgtgatgccccggaaaaaaatggaggtgaaaataaaaataaaacatgagagaaaagaggattgattgggctgctttgctccttgggtttgagatagcgtgtatcaagttgcgcgttagaccgcgttcgaatatctctttttcaatttactacttccttgtttttccgtggcatggtgagtacgaatgtactcaatcgttggttttccccctttccccaacacgagtgaagtgaagttgaaagttagctttttctttcctaattcaaagccgttgcttgtggattgttttctagatactctaaattctgctgctgcttccctgcttgccgattcggggttgttccgaaggtgtggtttactctcaactattattttttacaaatgcccctttttgtccggaaggtgttcatagatggagctatccactatgacgcccttcaattacatggtcatcacagaacaagatatgtgactaaatttcgtttattcttgatgaacatgctttatagttattgatcataatatattgtatcagaaatcaatgatcaaactctaattttgaagattgtgagaagaggaagaaacacatgcaataaaattgagctgatggcgtattactgttacatacctctttctttgtttgagcaacccgatagcggcctttcacccctacttgatcctcaaactctttgaagttgttcataatttcattgtacaacgttttcatatagtccggcaggaaagagatagcactctcatcccatctgcaccagttcgatttgtaaattcaatgaaaattaatcacggcaatggtggaaacaccctatattttctgcaacatataaaaaactacatgaaaaagttcttttaaaaaaacactccttaatttatgtgccttaaaatgtcagggcctgtctgtcccatgcacgaaccatgcatccggacactgcaactttttcatctcctgatctagtaccgctgatgtctgaaggtccaggaggccgaatgtcatgtatcacttccagttaataccacaaatgtccacgtatcgctgctggactaagccgccaaccgccattcatatagtgtatctgtgccggttcaggaaccgacagtgttcctctcgagctacactgtcgctgccctactgccagatcaaaagctggcactaatagctgttttgaaccaacatgatactaataccacatgatcatatacaatttcaagatttaaatcaattcaatttgatagaggcttttgaaaaaaaaactcaaacttcacattattttggttctacactattcattaatctatttttgaattacatattattcaaatgaaagttatctaactagatcttgaattgtgttacacatgcatgtttgtatcacacaaccttctcttcatgcatgtgatattttgttttgaacttttttacatcttctaaacatataatttctggtcttgttttaatcatgttaatgaattgctgggtttcacatgatatttactcctaattggatgtagtaaattttccttaaacctttgtatggcttcatgcaatttccgacattcctcgatgttggcatggcaatcatatgtgtcatccataatgacagctagtacaaataacttggcaaataccatccttatgaccgctaagtcttcctcatagaacaccatgttggaccaaacgtatgactccactgcatggtccctaatgtaacttagccccatgtttccataaagatctttccaccacctgaaaattacgtgattcagatgtgtgctcagtactctatttataatagattagttcctattgactattttaggactagtacatatgaacatatacacatacaaaaaacacatgttaaacaatgtacagaggggtcttaataatattgtctctgtagtgctgtagaggtatgtttaaaagctatgcatatatatgagccagtgaatgcctgctacaaccatagtgacattaattcaatactgttttgcatctagattagggacattatttgaataaatcttgtgtttttcccaaatctctatataattgttcattccacgaaagatattataagaatatattctttgtttcgaaggccttcatacaaattattccttataggattcaaatcctccaagattcttgtgtttttcattatcatattccctgttctgcaggccatatgaattttgaaccgctaatccctttctgaacacacatccatcagtgcttatctttattttccaatttccatcgagtcaaccccagtcactactaaaatacgatttttcatggcgttaccctataattttcactggcggccatacgcaaaaaccgccagcaaaaacataatgagagctggagagcaacggaccgccagtgaaaacagatttttgctggcggccacgttaagaggtccgcca

SEQ ID NO: 85977 - DNA, 9855 bp, Oryza sativa
cggaggaattgatttgggaaggatttggattcggaattgaactcgacgatagatcggggatttgagatcttgagatggcacggacactagacgacaagcgaagaaacaaatttcgcaattagggtttttaggagataatttttccgctaggcgccacgacggaacgggcgttacagaggcgtatggtgagcggtggcgccggcggccgagagcggcgtggcgcacggtgagcggcggtggaaggcgcgcggtggcgtcgggtgggagcggcgtggcgcgtggcgcgtggaggcggccgatagctgtgcgacgacgacgacgacctcgatgcggacaaccccgacgacgactgggcggcgacgacgactgggcgcccggatctggcgggcggaggcagcagagagcggcgcgacgacgacgacgaccccgacgacgagtgggtgcccggatccggtgggcgaaggcggccgagagcggcgtgacgacgaccccaacgacgatcccgacgacaacgacgattgggcagcgacggggcggtgacgcgggcctcgtccctcccggatccggcggcggcgggcctcatcccgtccagatccggcggtggcgggccttgtcccgctcggatccggcaagagcgggggtggccggcggtgggagcgggagcgggagcaggctgcggcgggaccggggcgatcggcggtgggagcgggggcaggtggcacgggagcggcaggcgagctcgggcggcggcatcgccgcctgcgggctaggttttttttttggaattttatttttttttggcgattttttctctttgcatgcggtcggcttaagcgcccgcatgcgaaaatgcgggtgccgtggccacatgcaaagttggcgattttcacagacaatttcccgcatgtggttgcgccaaccgcatgcgaaaatctctcctgcccgtgtgcaaagacctttttttagtagtgtctagtgttatgggttgggactgcccttatgctccataagaagttgctagaattaaatgggctaggctcaatttaatcctaggaaatttcatgagccataattaatgttaagagattaataccattttgaaaaccaacatgggggaccttgatttaaatagcttactaattgagagcacatgctgagcgtttgaggtggtcatgggactgccatgcctgcgcgcgccgagccaagctggccgtggcggggcgggggttgggctggctgctctcctccccttccgagcattgcattattgtgagtaaagatgatataactgatggggagccattacgactgtaacatatggagcaattaagcgtctcaagtactcctgaaaaaataactgatggacagtcattacggctctaatgtatggagcaattaagcgtctcaattactgccgaaacgtctctctgttaaccttccatcaccgggatatacagagataagaactcttttctttattcgtccttctcgtattcctctcctctcacggtacacatcccacccttttgttcctccatccatctaagaagctgcatgggtaagtaggcgatcaagattttggagagcggttctttgcgcgactcctctcggcactgcatcctctacaccgcggtcttcttcctctgcatcaacatatcgtccaacccaatcacaggcagtggaggaggagacagcattggcaacgcagaaacagagaacgtcatcaacggaggcaacaacaataatacatcatcatcatgtcgagcgttttctgggtatatgtgttcgacgatattttgtacattttttttatatatgaaagaaatgaagtgtgtcaaagtattaatttcgggaatggcgatataataacgaaattggtgattaattaccactaatagcacaacctggcgtacatggcgtatacgtatgaataatgtgagacacttgccgtcggctgctctagtatatacgtactcacgacattttgatatagggtgatcgatccaatttcatggttggctggtggaaggaaaaaggtgtgaatgttttcatgggaatggaagcatgtgccactgtagcactgtcattagaggaagttaatcatatgatttgccggccgttaatctctcacgtcatatgcatggaaaccacgtacagtacatgcttgcatggaaacctaggaaatcaaaagggcaagatagctttatatgaaagtttctttccatgagcagggcgtgagcgtatacgtatacaaggaaaattgatccatatcacgtcagattggaaacgaaacagataatagcagcaagcacctgagatttcacatggaaatactactctccgtatcaccatagagaagcttcaataatcatatcacaatacaacggaattatcataatcatgatatttgctaaatggaaatttggcttatagatggaagcggctggctggctgtgcagatactaatccatgtatgagctagcctgtgaaccgacttatcacccctataaaagattgtccatttcattttacagggagacaggacagacacagagacggaggaacacacacagacagaacacacacgcatacgaaagtgagagagagagagacacacaccatttttggccggagaatctcggcgtccagcgagaacacgttggccgcagtgcctcggcgtccggcgaggaggcgcgcggaggaggagacggtcgccggagcacgtacccagccattgccatgggtacagcttattagctttcttttatttttcctgctctttctgctcagatcgtcatgcatgcacaacacggcgacgaggcgagtttctggtgctgcccggcccgctggatatagcgtcctctccgcctgtcggacgcaccgccggccggagatcgcgtcatcggagacgtcggtcgccggtgacacaactacctgctgccgcgacgtccttgcctcgccggccgcaacctctatcccacgacgcctttacctggcgatgtgatgtcgccgagacgctggacgttgtcgccttgccggtcgcagcctcctcttcgcgacatcactgacgtccgctcgctctcgtcgacgttaccatcttcttcgaactcatcggctggttgctcgaggagaacgccgaccggagcgccactactcggtgcccgcaaggcgtctccagctccagctacgtcgcaagccatctcgtcggagttgccggggacgtcgtcgagccgcctgagtccgtagacgacgcaacgctgccaagcgatgctcgtcatcatccgctgcttgccggagaaggtttttgtcattttgcctcaccggagcacgccaaagggagttgaggcagccgccagggcactacgccgcagagccctcccatgtcgcggatgctgattgtcttgtgcatgctattgtatacggtgacaaaccaacaaaacaagacatgcatgcatgctactgtacacggtgacaagcaaaaatgagtttgcagattcatactcatttggggctgctccgtattaaacctccaagccatgaccaattcggctatcgcgttgatcattttacttttataatctaattccgatgcaattcctacctcgtcgggtcatccaagctacacaattccatacatgtcttcaacaacaatataaaccaacacatcgtccaaggccgatgaggctaaacagcagggcgggaggagtcgacatcaagacgacgtcaccaacaccggcgtgcggaccgacgaggccgcgaataccgccggcgcccactcacacacatctacaccatcatcaccatcatgcatggaggacgtgaagcgaagacggatgatgacgaccagcgtagcttaatcggaggtatctcacgggtttaactcgcgagagtaattaaccgggtgtcttccgagaccccgggaacaggagatcacaatcgccaagtcagatccaccttacctatgagccgtggaacgcatttgacaaaggattttgttttttttaattcttcaagaattataataaaatgcattttcctttgtccattttatttttgtgtacctagtacactggcacgcccgcgcatttttattttattttatttccctgggcggagggatgaaaatttaatttttctctccaaacaatatgattatcctcatttcggtgtaaaacatgtttttagatgctattgttcctattagcatattcatgtttatcactatcctagaatcactcttgtttagggcccctttgatttggaggaaaaacataagaattttggaggatttcaatcctataggaaaaattcatacagatggctttgaatcaatggattgaatcatatccaatcctttgaaattcttatggaatggacaatactatagagattttggagaaaaattagcaagagctcaaagctcttggaaaaatttctgagtctatctctctcatccatttcctgtgttttttttataatccaatcaaacggttattcctgtgttttgcaatcctctattttacacttcaaatcatgtgtttttcctattctttgttattttcattcctgtgattcaaatgggcccttattgtgttatattaatttctagattaaaatatgctgaattacgactatatttctatcaatccaaaaatttaatagatcttttttagtagttgatattgcccttttgatggtgggatattatttcccaatcccaattaccaaataaagtctcgatggttcaaaatataaggttgtacctctctgtgtatgtcattaccgtaatttttttttaatctttctgctgtataaccaggaaaaaagaatcattcggacacctcaaaattttgagccaaccaccgcagaacatgttaattttttttgtcaactgtacaaacaccaaggtatttaaggatttacaccgacaaaaaaagaccgtaaatgtaccgtgtgaactccaccctctcctgtgactctaaaataactgacacggcctcccgctagcttagctctccgccgttctccacgacgcgcccaccaccgtcggcgagccgacgttgtcctgggcgtgcgcggcggcgtcggcggcggcggcgctcatgcgcgcctcgtaggcgtgtccgaggttcctgaggcggttgagctccggcaggatgacggtggcgaggtccgggcggtccctccggcgcatttcggtgcacttgagggcgagcttggcgaagccgatggcgtcgtcgacgggccagtccttgacggtgacgtcgagcatctgggcgaaggtgccggcgtcgatggccttctcgacgtggtgggtgaggcccatgggcggccgcgcggtgagcacctgcagcagcagcacgccgagggagtagatgtcggacttgacgcccagcttccccgtctgctggtactccgggtcgatgtagcagaaggtccccgccgtcgccgtcagccggtactgcgtcacgctgtccgccaccgccggcggcacgaggcgcgccagcccgacgtcgctgatcttgctgacgtagttcggttcgaacaagaattgtggccgggctcaggtcgcggtgcaccagcggctccggcttggtttctggtggaaggaaccaagcaagcccgggttgggcaattctcccgcccaagatatccttgaacccgctgggtctcacacggggaatcgggcgggcgctgccccccgcggcggaacaggcggtcctcgaggctgccgttgtccatgtactcgtagacgaggcaaccgtagtccgggcaggcgccgaggagaggcaccatgtttgggtggcggatgcagttgagcacctccacctcctggtggaactgcttccggccctgctgcgcgtcggggcggagcaccttgatggccaccggggtgtggtcgagggaggcgcggtagacggggccgtagccgccctcgccgatcttgagctcgtcggagaagcgctcggtggcgagctcgatgtcgtcgatgttgtagcggcggtagcggaagtcgtggctggagatggcgtacagggcgcggaccttctcgtcggcctcgcggcgggcgcgcacctcggcgttgcgacgccgctgggcctccaggtcggccagtcgctgcgccgcctcggccgcctccatggccgcgcggcacttggtcttctccatctccgccatcgccagcgccgcctcctccgcgtgccgcgcctcctccagccgccgcgcctcctccagcttcagcagctgcagctccttggtccgctgcttcgcgttgatcgcctcccggcacgccgcgttgtacatgtccatcgtctgcttcagctccagcctcagccgccgcatctccacctccacctcgcgctgcggctgcacacacacccacgtcagcaatggcgtcgcagcaatggcgtcgcagtcgaagtggtccaagaacgcacggcggagagaggcgagctgctctcccgtgggctggcggagagcgacgacatgtcgaggctgtcgcagaagtccatggaggagaagcgcgagctctggccgaagtcgaggtcgcccacgaaggactcgttcgacacggaccgcctcgtggagcggtacgacccgtcgacgccgccgccgccgcagtcgggcgccgccctgctggacagcacgacgggcttggacgacgaggacgggagcgagcgctcgcggaacggcgaccgcgtggtgagctccggcagggtgcgactgtccaccgaccgcctcgacgagtccggcgacggcgtcgccggcggcagcttccccctcgagcacctcctcgtgtacaggctcctgatcgatgagtcgccctcgtagccaccgccaccgccgcaaccgccattgacgccgcacttggcgagcctcacgttcaccgacttgcccttcgccaccacgtagatgttgcagtagtccggcgcgcccttcatcaggctggacggcacgtcggcgttcttgaatttcctgaccatcaaacaatgcagcaccaccatcaccaccaagaacaacaccttaaaattggatcgaaatcggatcaaaatcaaaacgaaactaattattgatctttgattgatttacttggtgaatgcatttctgttggatgcgccgagcgcgatgctctggatcttgttcacggtgatgaactctattaaggcctttgacacgtctgcctcttccagtaccaactccgatacatgcacctgatcgatcaacaatggaaaacaaaatgcgttctcgtaattaagtatttttttttgttcatgtctttgatctgaaagaattaatttcttgtgttgatctgaaactaaatatttgattaccccattcctggtgcagaatcctctgaaggggacaaagatctccctcatctcggcctccaacgcgccatgcgtcgcctcggccatggcgaatccatctacgtcaccaaaaaaaaaaacaaaaaatgcacatcagttttacgatctcttgcagttgcagcagagagacgcatggcaatggctgatccggcgatcgacgtacggttggcggcaggggggtggacggcgatgtggaggaggatgatgttggaggcgccggtgaggaggtggtcgacgacccacttcacggcgagctggctgttccggtcacggtccacggcgacgacgatcgtcatcgccggctggtggtgcattatccccggcggcgaggtggcccggtgctcgtcggggctgagtggccctcctccttgcatcctgcccgcctgcacttttccggtgagatctcacccgccttcgtcgtcgccgccgccgacgccgaccgtaatgtgatggatggatggaggtgatatcgccggccggatcagtggatgatgcgacggtgagtaggacggtggtgcaaggaaggagaagaagagagagggagagagaggctgagagagagagagagaaagggttttccttttccctcccctcctgctcttccttctcctctgtctctcttccttgcctccaaccttcctctcaaactctgcaatggcctcctcctccctcccccctttttttgggacctaaatgccatggcaatggagcaaggatagcctcagactattcttgcaccatctcttttttttctctcctcttttccattttgttccttttctaaaatgtttgtggaacattttggccgagctatctaaaatagggtgtgtaatccggcatgtcgaaaaccggatagaggtaaaaatggaaaggggagagagatgataagacctaagaatggctataatgcaactcactacaagatccataatccatgggttttattcctcctacttgttgttccagcacacgcatcacgtattcacgtgttcccattctgcataatctattccatttgccaaattcatgcataaaattcttgcagtgttttgttgttctagcatgataagtaaccccccaacccccatatcctctggctctcactatgttatgtacaaactacaaaactgtacatttcctaatattcttgtagactgctgaaatggttttacaaggtcaggtaggtcttgatcatcgttgagccggtcggatcagagaggagatgtctgacaaggttcattcgcatttggttcggcgcaattgtgaacatgtagaatgcaaagagtatgagatccactgaagaaagcgtcgaaccaaggaatcctcgccacatcctgatagtaacaaagaacagtgatgaacactttgttgggtggcaatcttcaggtcatacataatggtatttgtaaatagactgaaaacagaggcaaatgcaatcaagagtagaattaccatttgggcaaccggaaaaaggtttcaaagaatgtctgaatgccttcgttattcagttggattatcaaagccagcccaaaaaggaagaatgatcgttgacgtttccgttcttggggccataatgttctccatgctgcaacaccgcatagcaattagtaccagaaaatgttcctgacatttccaaaattatactaaaatactgccctcatctgaagcaatgtactccaatttgtaatactggtgtgcttgtcaataaaattgaataaatatcagaagaatgcttaccaagcattgatggactggaactttgagaggttccaggcaaatattctccagggtagacacggtttctcaagatatcagatatcacagatgcatatcttggagcttcagacaatgatctaaccaccgagtatcctatgtttttgacagataaatattatattattgcctgtaaatacaagagaaattgaaagtacggattgaggatttgttagtaccggttgcaggatgcaccatacttgctgccgcaccaaatgcgagatttttctggtctgtatttggtaaggaccctccaacaggaatgtaggaccattcctgaaatcaagagttcagcatttaggttaagtttccacttcacctatgcaagagaaacaactagtgacaccaagccataacttgttacctcctcgtatacttttcgaatatgaactcccattgcatccaaccgagacatcaaccgctttttaaggaggtcaaagggcattgcttctttagaagctaggcatgtttcctgtcttgaaataattatcatcagcaacacaaaagcatgggaaaatactagtcggaggaataaattgtgataaagtttctcatatggacctcaaagaaaattcgtgtggatgacatgggcatggcatagaggaacgttggatttccttgctcaggatgtgagaatttgtctttgaagcaatctctgtagtccatgaaaaccattaagctgggatcatatggattgttttccacctgaaaattt

SEQ ID NO: 85978 - DNA, 3937 bp, Oryza sativa
accggcagggtttcttttggcctactgcagtgtccgatgccgacaaaattgtgcgcacgtgcgaaggttgccaatttttcgccagacaaattcatctaccagcccaagagttgcagaccatcccactgtcttggccgtttgcggtttgggggctcgacatggttggcccgtttaaaaaggcagtcggcggttacacgcacctctttgtggccattgacaaattctccaagtggattgaagctaaaccggttgtcacaatcacagcagataaagctcgagacttcttcatcaacattgtgcatagatttggagtgcccaatcggatcatcactgataatggcagacaattcactggcggagtttttaaagacttttgtgaagactttggaattaagatttgctatgcctcagtggcgcatcccatgagcaatggacaggtggagcgagccaatggcatgatacttcaagggattaaagcgcgtgtttttgaccggctaaaaccttatgccggcaaatgggtggaacagctgccatcagtactttggtctttgcgtactacacccagtcgggccacaggccagtcaccttttttccttgtctatgaggcagaagcaatgttgccgagtgaagtcgaattcgagtctttgcgctttcgtaatttccgcgaagaacgctatgaagaggaccgagtggatgacttgcaccgattggaagaagtccgcgaagcagctttgattcagtcggctcgatacttacaagggttgcggcgttatcataatcgcaatgttcgatcccgtgcctttctagtcggcgacctggttttgaggaaaattcaaactacacgagatcggcacaagttatctcctctatgggaagggccatttatcatctctgaagtcacccgaccaggttcctatcgactcaagcgcgaagacggcacactcgtcgacaactcttggaacattgaacatcttcgtcgtttctacgcttaagcttatcattgtacttccctatcttgactgtcaacatcaagtgttcttcttgaagttgtcagtcgggggctattatcataataatggagtgtgattttttatcaattcaatttgcttacttggtctatcattgccttgcttgatttttctacttagtctgcgaggactgaaagtttttaatagcttctttgggttttaggctcaacaaagcttgataaaagcttttaagaaatcaaagacttggctagaattatcaaacacagcataaatacactagtattgtacaagttgagcctccatttgttacattcatacttagtcagattcagttttttcatcatcagagttgttactactcggctgcaggtcggtattgcggaatctatctacaacgtcacttgcaattttgtcagccgcgttttgagcattgctgataagatcaagagcagcttcttcgcttgtcccgtcagcaaagccatcaatggcgtcaatttcaatccttgggtacaaggatttggtcatcgccaatgccatgctagctcccatgcttccagctttcttgatattcttgaaatatacatccggagcaactctcagcttgtcgaagatttcggttgcgtcgagtgcactcggaccactgttattgaggaacatagcttggacgagtggcgtagcgacactagcgacttcatctcttgctccttcaagcctcttgatcttgccaaccaggacgtcaaattgagcttgagatttgattttgcggtctacaaaacatatttatgataagaatttgctgcatttaaaagagagaagttcagattgttagctggcagtaccttcaatctccttcaaggccgagtccctttgtgcagccagttctaccttgtctcttttcaaggcttcaatttgtttctccatttgggccatcctggtggcttgcgctgtttgaaatccaaatggttgaggatacagttatgacagcgtaaattaatgggacagatctagaagattaccttttgatgaacctctcagctcgaagtttgaatcctggagctgagcaatttggtccctcaattccttctctgtcttcttggcaagctccttggcctcgtgtagctggtccctaactgcttcaagagttcccaaatgaggaaccagcttttctaaagttgcggtcttggcctcattacgaagatggattctctgcatgatggttcatggtttagttctgctaaagagaaaacaaagtcatcaaaggcagtcgcccggaagatttacattcacaatgcgagtggcttctccaagtgctttcttcagctggcacacttcctcatcttctttttgacgatttatgacgatgccggcagcttgtgagttctcgtcccaccatttgagtaagataggaggacgagagtcatcagccgcctttatgcggagaatttcttcttcatcgcctggtggttctgatgtatttccaagacattagacgaataagctggagttattcaaatcggcatcacttgagaagatgagttacctgaggatgttcctagctgaacgtaaggtgatccttgttctttattcggagacccaatcatcgagtcgttaccagcctctggtcctcgagaagttgtcgtctgcgcttcaacttcgggagtttcttgatctggacctacatccgactggtttccagtcgggggctcttgagttgttgtagtttcagttgctgccgactagtttccagtcggaggttggtcactcggatcggccttatcacctgaagtatgggcgccagtcggctggctttcggcagttggctcagaatccttggatgaatttggctctgtcacagccggatcaggatcttttccagttggatctatgtcggatggtttcctgcaaaatattctttcaatattcagtattattttcatgagagaagcatgccgaagtgaaatgataccgagaggtttatacctggaagatgttctaatctttggcattggacggctagccagtttttcctgggagtggtatgctttgggagtttattggtcaagcctttgttcccagatttgttgccgtcgtcgccttcgtcgtcgttaagcaccagttttctcttgcgagaacctgtctgcccagtcggattggaggtttgaggttgtgggtctgatctgattgtcggccctccacctccctgaacggtgtgctggcgaggagaccggcgctgagtgattggggggtcagacttcatcaatacatattcctgaatgagatgcctccacggttagataactcaacatgaagacaagattatgttttggtaacgggttgaggatttcagatacatacctgcggaggcggattgaatgcgttatatggcacaactggcagctgatgtgagtagctgacgacaatagcatttgagaagattttatacattctctccttcatgattttaaaatccagagagtctggttcttcacgattaggatcatgcttgccgtcaaactcaaaagctgtacgggatctttctttaattggtgccaatcggcatttgatgaagtgccgagtaatctgctctccttgtaagccttgttctttgagttttagcatgcgatccatcaattccaaggcttgggctgcttcatccccaatcggaagagagttccaggtatcttggtacaccggaggaagacaagaatactcaggaagagcaggctcaggattctgaatataaaaccagtttgcgtgccaccctttgtttgaagtcttgaagggcatagagaagtacttttggctcagagtccccctcagctgaaatccggcccctccgactacacatggcttactcttgttcggttggggcttgagaaagaagattcggggaaacagagcgaagtggggcttaatccccaagaaggcttcacaaacatggacgaaat

SEQ ID NO: 85979 - DNA, 7509 bp, Oryza sativa
agaggacgagccccgtgccgatgcgctgcaggtgggtgatccccatctccgtgcccgtggcgcgtcgcgcgaacgggatgatgatgtggtcgtagaccggggcgaggaggatgatgaaggtgaccgggaacaccggcagcgacgccggcggcaccttgagccccccgacgcgggtgtccatcgtcgccgcctgctccacggagaaagtggacagctgcgccaggcagctgttgagcatgatggtggagaagaagatcgggagcaccatgagcacgatcttgacgttctccacctcctgcaccgtgcacgacagcgccccgcaccgcggttgacgctgcaccgcccggttcaggaacaccagctcctgcgacggctcggtagccacctcggcggcgccgtcggagacgccgcagatgtcgccgggcttgcagtactccttcatgtccgtgctccccgtggggctgggcgcgcggtcgatgacagcgccgttgctggcgctttgcgcgcccgccgccgaaagcgagcccggcggcgaggaccaccttggcgatggtggtgagcgggctccccgtgggcaccttgttgcggtacagcctcgagccggcgacgaacaccgggatgaagagcaggatggcgatggtgaagatgccgaacccccactgccaccccttgttgtcctccacccagacggcgaacgtgacggcgatgagcgcgccgacggagaggcagaagacgaagtagttgaagaaggtggagcgccccttccgcccccgcggcgcgtgctcgtcgaactgctcggcgccgtgcgacgggagggagcccttgatgccgccgatgcccagcgccgtcacgtacagccccgcgaacagcattgcctttttcggcccagacattggctcgcacgccgcgccggcaaccttggcgcaccccggcggcatcagagacggcgtcctcgcctggatcgtcaggaccaccagcccctgcaacacattcgcgccatgcttgacatcaacaaaagttcaaaaaaaaaaaaaagagagagaatcatatgcaggcccatataaaatcctaaaatctgcagacgagaaaagcttccaggcccatgtactgtccaggcccaaatacatgcaactacgtacactactagcatcaattttctgctgcaattttccgttgcaaatttgcactgccatgttgcaacagagcataccaacccgatcagaactgtgacgccaatgtctagtggtttggttggggggaaagagatatcaggtgacagcgagaaaagtttcgtggggggaggcaagtggtcggcgtgctgcatgtgccgccgcggccgcgcgcccgtgcgcgacgtcgctttggccttcgccgtggtccgtgagccggttaaagcggaggaggaggacgagaccgacaggggcccgtcgatgggttcgtagtaacttttgtcagcgctgaccggcaaacgtaaatacagttgggctaaaaaaactcgaggcagctttttgaagctggtaagtcaaacgtacggcgatcgtttttgtggcgctcaggtgagatcaccaaggtcagcaagcgacttggaagtactccctgcagattaatactacctccttgcacaaatgtacgacgttggttagttcaattttaagctaaccaacgtcaaacaaaaaaaattagagggagtaatacttatcgttttagataaaaacatgatcataaaaagtaactttgatcattattttctattataatatataaaaagcatcaacaaatatatgattttattaaagtagtttttaagactaatctatatatctagtctccaattttctaagataaatatttaaaaaattattcatagttaaagattttaatatttgatctcaccattatccaaaatgataagtactatcagtctagagatcagtctggaggctgtgtttagtttcttaaattggagagaagtttagggaaaactggtagtttgaaaaaaaaagttgggagtttacgtgagtaggaaagttttggatgtgatgtgatgtgatagaaagttgagagtttggaaaaagtttggtgtgaactaaacatggcctaacttagtagaacggacagccaactagcagtactactgtacttgtcatatcttaattagcccatcaaatcgggtgtgcagaaaagatgtttacaagtggtggtggtgctcctgtacttggtacgatcggtgcgtacataggagtaacattattgagtaccattgtgtatttgtgtattcagtggctattctatcaggatccacgtggcgcaatgtgcaacactccgaaagggaaacgaaggaaaacaacaaatgctcctacggtctatcctatccattcgtttccgatttccacaccatattgcaacttgtttggtggcgtacctatactatactctctatcaaaaaagtgttaaacttattacttttatcatcagtatcagaaaaaaataactcattctgtatgtaacgaataccaaaagagatatatatatatatatatatgcagtggcgaagccagaatttagagatggggggtgccatttacgagacgtggtaacttacttaaggttcggtgaacagtgatattgtagcgttgatgtatgatcactaactcgacatcatacatgttatagcgattagctagaagagagaatgagaacccatagatcataatttgccaatttaaacagtttgttccatgattttaattggagtcttgtaatcatttttaaaatgataaatcagttaactaagtcatttcataagtcatatatagctaggcagttatcctatatagttagtctcatctgcaactaatgatgtaattaatggctagattataagggctaattatccttgggagaagagatgggaggggaggtcacataagggttaggggggtgttggccctccctggcccctacggtggcttcgccactgtatatatgtgcatgtaagtgtaactaatgaatattaaaatgatcgtttgtgtttcagacaatcatctaagttatctattcgcttaagtcttagataaattgagactatgaataatgactattttatttggaaacacgataatctttccagaattatggctggactgaatagcttgcttccccggcctataaaattttacgcgcgaataactcaggtgctcacaagtcaaacaagtgggtaagaagaaaaaaaaatacgagtaccaccaaaacgatgattaatattctccgggagggaatagcaaaagcaagctaagcacaggcacagccaaagaatgaaagaaaccctgcaggcaaatcccgaaaccaaataaactccccacttgatccacttgcaccgccccagcggcgcgctagctagcagccgcaggtttcgttacgccgaggaggcaggagtagggcaacgcgaattgacgcggcgcgcgcgcacgcacgcacgcacggtcgccttttctccagggctgcgcactcgcggctttagccgcccgtgaccgcgccgcgcgcgcgcgcggttgccccacccccacccacacccaccctgggaggctgcgacaacacgcgtcggtccgtacgtctctctcgacgtacgcgagaaaggccgcgcgccgcgcgggcggtggccaagattggttttgtgcgactctctcgtcgcgcgcgttgacaacgagtgtgtggtgtgatgtggtgtgtggcggtgtgcggtttgcacgtacgcacgctagtggacaccgtacgtcgtacgtgtgtgttggtggaatgggagaactggctggatcacagtgatgagttgtgtgattcgatctggggctaggggggtggggataagataagagatggtggtcggtctcggatcggatcggatcgcgggaggtggtgagagaaatgcctcgagaatgttccacagtggctcttgttcctgcacgttgataagatccgtgcctatccgtaattccgtgtcctacatggtactgtattcgacgatcactaatccatcgtaaatttgcagccgtctctcttaatcatcatagcccgtttttcgctttttctggtgatggaccaactcataataaattaaccaatcgacgacttatcgatcgatccatcaaccgatcgttcatgaaggggcgacccagaaaggtcaccgtgtaccagatcaaaaaagatcgatcccgaccggtcaggatatatccaggggtgcgcgcgtcgtaaacacgtacatttcgtgcgagcgactgcgcgagaggagtggtggtgacccgggcgagcgcgtgacggggcggccagggcgccgggctccgcgacggttttggccgcgcgcgccgatggaattggcggtggatatatgaatggattattattgccccatcccgaagggtactcacactcacacactgacactactcaggcggcggcgacggcgaccgtaatacggccctgtcccactcgtggtgtgaccgtatgagatgtagcatttggtatagctaaggtcgtgtctagtccatcctcaactaccccaaattttcaactttccattatatcatatcatattcaaaacttttctacacacataaactttcaactttttttttaactcccaacttttctcaaatttttaacttttttcatgaactaaacacagcctaagatgtaggctacctatgataggatgggcgctataccataccagaacgtacgctgcccatgcgcctgtcgacgacggtggcgacgtagtcatgtcaagtaactagctgattgatctgaatttgggttatcgtccgttccttccatatatgtctctgagcccgacgatatgagccctacagtacacgactgttgatgtgcacagtaactgtatttttttggtcaagaacaatcatgttcacctcgccggtatggcactcgacagatatatacggttactgcgcccacgtgatccaccgcaaccgcaccgcacacgtctttatacccttatacgccgtatacatccacttccatcctacgtacgtactcatcctacgactagctctagtgctctacgtacccacacaatcataaaaatacacgacatttttgggctaaaaatacagcgcacacataaaaaaaactcatactaaccactctaaatttgaatgtataatgttgctgatttctaagtgatgtttaaccatttgttttatgtaaaaatttagtgcaaatatgaaaataaatataagttacgctaaaatacttttaacaagtgaaaaaaataatatttacataattattttttctaaaaaatgagctaccaaacgttatgttcagaaatcaataatatttatatatctaaaaaatgaaggcagtatgaacaaagcagaacacttcaacgcgcaattggttgcaaacacatatttatccaaatatctcgtagaaatagaaagataaagtatttcaaagaaagtctaaaagctaaaagcttgttgttgttttctccccatcgctaaaagcgagcagtagccatctatgatccatcagtggaccatcacagttgcaatccaaccaagctagcctagccaggccaaacttgaggaccatgaatcgatcgatcgattgtcccaagcccatgcataaaagcatgcctttgtgatagatactcctacttagatagatatcctagcacctagctagtgcagtcacgatacataggggccgtgatcagtagttcagtacagggttccctttgacccaggctatctctgcttgcttctagcgaataaagtgatggttacaatttaatcattggcctaattaatctctagatgtgaatatgtatgtgatctcatgtaacccaaatcacagggaattgcgagctccgtttagccaattaattccaggcaattgtcagatggaacccgtggagaaaaagaggtttcagtgtagggccgggatcacaaaatctttggtcaaatagtggtggtcatctagcgggaactagagccgttcgatcctgcctcgagattagcatcctgtttggctaatctttgacaggtgtcattttttgaccttgtccacgaatcttgtggggtctgttctaattggacggtcaggatgccatcatgggagcggctctgattactgacaggtcactttacgacatgcagctaaattctagagaccggtcaacaaaacatgttatgatggtaatagccaacgggtccagaagatagaaaggaagtcaacgatgacgtggcagcctagctggacatgatcatcccggtatattccttccacgtcagcatggagatacgatgagcaccatgcatgcatatatatctcactaaaatatacactcctacatatgtgatatgtgtctatccggaaacatcttatcatcttattattatcggtatatctacgattgcgtaagctggcatatggtttccttttttcctaggcttatgacggcaaacaattataaaggaaattaagtgagtaactaacttgcagactaacttaagttggatcaattactctcaactaaaaacacacaaaaatggtagtagtactacaactacgaacaaatttagatgtgctgttacttaccaggaattccacaaaggcgctgatgaggtagatggcgtaggtggtgaagaaggcgtcggagaggaagccgccaaggagggcgaggaggaaggcggtgcccatgaagttggtcaccgtcgtcgccgactgcgacggcgagtagtgcatgaaattcatcaggtaggtcaccaggttgctcgcgttcgccaggaacgccaggttctcgagcacctccaccactgcacacacaacaaagccaatattctcaatccaaattcgatcttgaaaaaaaaacaaaatctctatcctaatcagtatatattaaattaagttatactgttctccattggtaggattttccattgaaattaagctatgaaattgagctaccgtgtgccactgaaaaacttcagatggagatgtaaagttgtattttaatcggaggcgtttgaaaaattggaagtactagcatgcatgtgcggtggtaactgatataaccgccccagcataatgtgtgcggttcccagtgcatgccggccaattttctttgttctccctgaccgtttcggccttgcgattcgtgcccgaattcaatgctcgcgtagcgacaattttggacagggtcaaattataatggcaaatttttctccccaaaatccatggctggttctttctctcacactcacaaccgtcagggcaaaaaaaaaaaggaaaaaaaaaagtccttcacacatgcaaggaagcaaaaggcagtcattttccaactgaacattcgggatcggatcaacgggagagatatcgaaaccgaagccggcatggtgcccaccagtcaaccaccaccaccatcagcagcagcagcgcaagattgcaagaagaggtcgccgtcgatcgagagcagggacaccgtctttt

SEQ ID NO: 85980 - DNA, 876 bp, Oryza sativa
cattcagcgggaaagtgccctagaaaccaacacttttagtttattttgtagataaatgtacctctgaaattcatggtggtatgagttataaaaccttagtggtggtgcattgggttttaaactctagcattctcacgagtacctttctttctccttattaaagaaaggatacgcagatctcctgcgtgttaaaaaaaaggaattacttgtgcaaatatgataaaccttgtagcctagtggttacaagagcctcagtagcacctgaggtcctgggttcaactccccatgggagcgaattttctaggatttaatggcgttgtgctttcagtggtaggtgccgtacctctcgacagcgagacgcctgtggtgacttcgtcaactgcaagtaggggaataagttcattatgactctctgattcgtatccctgaaccatgataccggatatttcgacccgccccccaaactattaaaccggtggaatttgactccctcgatggttttggaggtcggtttcactgatatggcgtctatttagtggtgttgactcggtcttcgttccatgtggagtcaacgtgatgcttagtgcattagaattaaaaaactgcgtcaactccatgtggaatgaagatcgagtcaacactgccactaggcgccacgtcagcgaacccgtcctccaaaaccacttaggatagttgataccggatatttcgacccaccccccaaactattaaaccggtggaatttgactccctcgatggttttggaggtcggtttcactgatatggcgtctatttagtggtgttgactcggtcttcgttccatgtggagtcaacgtgatgcttagtgcattagaattaaaaaactgggctgcagga

SEQ ID NO: 85981 - DNA, 2777 bp, Oryza sativa
cctccaattccggtacgccccgttgatccagatgctgattttctccatgtgtgtttggtcgttgcttggtccttcctgttactagtataccgtacagcgttgagaggtcgctatcttgcgctgctcacggtgatgagctttgcttggatcgattaggtgatgcagcacacggttgttacctcaatctagtctcgattagacatgctacatagcagcttaattattcagatgtcgtttttctccatgtttttgcggttgcttgatcattcctgaatcctgatacatactgataaactcaagaggctcatttaagtgcatctgtgtgtacccgtgcaggcattcaacatcagataggccaagatgaacatcgccacaggggcaatgaacaccctcctccccaagcttggggagctgctggttggcgaatacaagctgcaaaagggtgtcaagggagagatcgaagaacttgagaaagagttgaaaggtatgaacgcagcactccacaaggtggctgagacacctgtggatcaacttgaccagcaggtcaagatctgggccagcgaggtgagagagctatcttacgacatcgaggatgccatcgacaccttcatgttaaagtgcaaggggcatgaacctgccacgagcttcaagaaggtcaccaatttgttcaacaagttcaaaactaaccatcagatccacggtgtcatcaaagacatcatggaccaggtcaagaaggtcagcgagcgtcgtgataggtacatagtcgatgacaatgctgccaggccaactgttgtggatgttgattctcgcctagaagctatgtaccgaaaggcaacaaaactcattggcattagcaagccaaaaaatgagctaactaagcgactcttggaatatgacggctcatccagccaacaatcaaatataatttctattgttggattcggaggcttaggaaagacaactcttgccaattcattatttcaggagcttaaggcaaaatttgacagctattgttttgtttcggtgtccttgaatcctgatataaacaagattctcaagaacattcttctccaacttgatgagaaaatgtattcccacatagatgaaacatgggaaacgaagcagctcatcgacaaaattagagacttcctcaacaatagaaggtacatttctatgttatacctaccttttatcattatttgaagataccttttgttgtacaaataagagtcctggctcaagtttttattgtattctaatataaccgggaatcctagctcaagtttttatactattataatataactggcttgtaaataaagttttggttttccaatggaacacatagttattcagaaatctgccctatttacgcataattaagtatctttgtaactttgtgaatagaaattcacaaagctgcacttattgtgtcaaaattgttggaaaattacacatttaaagctgcacatcattttcgacattcaatgtgcaagatacatattcctatcttttttggacaggcttcacatgatttatatctaggttcaataacatgtgtatatgctaccatctttaggttcttgtgcgtgattgatgatgtatggaaaaaatcagcgtgggatactatcaaacttgctgtgcaagatgctaaacttggtagcaaaataattgtaaccacgcgaaacaaggtcattgcagaacatgcaggcggtggtgtttatgaaatgaaacccttatctgatgatgattccagacaattgttctgcaaacgaatatttgactctaacgatgactgtcctgctgatttgtgtggtgtcactgagaaaattttgaagaaatgtggtggtgtaccgctagcaatcatcactacagcatgcctacttgctagcaaaccaaggaattcagaggaatgggacaaggtcaataagtctatcagtttggggcttgagaacaaccttgatgtggacaacatgcggaagatattaagcctcagttacagcgatctaccttttcatttgaagacttgcttgttgtctctaagcaaatatactgaggatgagctaattagaaaagatgttttgatatggggttgggtagcagagggttttattacagatgaaacacgacctgcagggacaagcttgcaggagattggcgagagctacttcaacgagctcatcaatcgaagcttgatccagccaatgagtgagaacactctttgggatgaagatggtaaggtgcatgcatgcaaagtacatgacatggtgcttgagctaataaatcagctgtcagtagaagaagattttgttacaacgtatttatctgatggtcaacaaacaggtaaacatacatgtacagcacaaaagaagaagattcgccgattatctctccataacagcaataagtcctatgcctcgccagaagcaagagaacaattgtccaaagtaaggtcgattactatcttcggcaaggtcgactcgataccacccttgtcgagctttcatgtcctgcgtgtgttgcagcttgaggactgcagtggaatggacaagaaccatcttaatcatctcgataagctactcctcctaagatttctgcgtctagggcactatggtgccactgagctccctgaaagcattgggaaactggaatctctcgaaaccttggacataagaggtgcacgtaaaccaagttcttttaaatctcataaggtactgtttccaatgtctttttgccaaactaaggaaactgttgcggctatatgctggcagagtgaa

SEQ ID NO: 85982 - DNA, 3160 bp, Oryza sativa
ctctgatcggcccggaggggggaggccgccggcctcgtcggcatggccctcccatttgtagcagtaaagggcagcagggagaaggccggcggtgacggagctgcaccctacgatgattgtgtttttttatgggttaattggatccatgccattgtaaatttacccaattaaaaatttactaatagtattcatgaaatcgggtggatgccactgaaccttttaaaaattagaaacatgccactctgtcacgatttctgataaatcctccgttaaccctaaccgtgggcatcaaactgccctcaaaccgtggcatcaaattgcccccaaaccgtggcgttaaatcctctgacttcttcgttttccatctctcttcagggtctcctcctgtgatttgcagggacgacgcccgagggtggaggcgacggcgtcggcctggcagcgacgtgcggccgcctggcaaggcgctaccgatacgcgtgcgtgactgacggaatcaaggtcttaactgcaattaggattaccaggtgttatgagcaggatctaccgaagaggttgccattaaaaaagatggtgccttcctctgtcccactaaaaagttcgagcctccctttatgtcatcgtcgaactttatggtgccctccacaccattccgtcgctccgtcgctattctttttgggttaccgttgggcaactctgtcatgtgggcccggacaggaaaaatatcgctcttgccctttcattctctcttctccctcgattcccctctctccaccggctacacccagccgagtgtgccgagccgctggacgcccgcgccaccacgccggcctccccttccctcgtcaccgccgtctcgaccgagccgagcgaacagctcctccagcttcgccatgccgcggatccgcgaacccgtccacgttgcggtggcggctctgcatcggctgttgacacaccacgagcagtgaggaggacagtggcctcctgctgataacctccgctacagccttgatggggtggtggtcatcgtcgtcgttgcaacgctgccgcccaactacaagacgaagtcgaagcaacaaccctcgcgccgcatcaccggcgatggcgtcgccgtccccggcagcgtggccgcagcggacgcccgacgaggtggaggacatcatcacgcgcaagatcctcctcatcgaccgcctctccctctcggaccaacccgccggcaacccctccccctttgcctacctcgcctcctccttccgccacgccgccgacaaggcctgcaagatctccaccatccgcgacgccgccctccgcgcgcacctcgccgcctccatcgcgcacctccgcggcctcatcctttcctacgcccgcatcgtcgttgggaaccccgacaccttcccttcgccacacaacgcgccccaccctgccgccgaactgctcgtattcctcctacccgtggccgccgccgtcgttgtcgccacgccgccgtcttctccccagtgccggcagcggtggcgaactgcgcttcgccctgcaggagcccacgtcggccgcgtccgtccccaggcgctggctcgccttctcactcctttgctgctgttgcatttgaggggagagaggagagtgctaggatgcctaagggcaattaagttatttggctgcgccgttacccaccgttacaacaaaaacggatggaatggtgtggagggcgcgataaaattcgacgatggtatggagggaggctcgaactttttagtggcacagaggaaggcatcatcttttttaatggcacacagggaaaaacctctctaacgaactagtggaaaatcgcaagcacttgatgttctccctgccatcaagcattagaatcagacaatcaacatgctccttgttttcacagacgggagcatgaacaaaggattaagcaacggtcgacactagatacctcttgatgcttttttctatttttaggcgtggagtttctgaactttgctttgtttctgtttggaatctggtgatggcgctagcgcatatgtaccaagtggccgtcgctgaagcagtggacggatgaggcggtggcagtgcgggtggccgcagagggtgtggtttgcgcgatgaagctggccgcgccgcgcctatacctgtggtgcacgcgcctcggcggcaggagcttggcgccgtccaattatctaagggctggcagtctggcacttcgccggccgccgtgatgcagcgccccgggttgcgctgatggatgggttgacagactctactagaaaaactattttttacgggcggccaaaacatgttttcgcgggcggccaaaccatccgcacgtaaaaatcattaatttttccagacggaccaagcaccacccgcgaaaatcattttcacatgcagaaattcaattttcccacgcaacagcagccccgcctgtgaaaatagtttcagcgctaaaaaataattttcgccgccaaaccagcccgccctcgggtttcacccacaaataaaaaattcttattcattcaacaaaagacaatcacaaacatccattcatcaacacaatctatacatgaacacaaatgcatcggattcaaatccacaacaccgacttgcattgcagcatcaatcaaaataaaaacaaataaaaaaagggttaattagatccatgccatcacaaatatgtcgattcagaaaaataccactacaattcgtctattcgtagccgtgtcattcaaattttataaaattggaacagtgccactgccgtcacgttttccatccatctcttcttcttcctgttttcttcttcttcgtcccgtctttgtcttcttcctctttccttttctttcttccctttttcccgggtgctgttcatcgtcaccatggccgccaccgcgctcaccaaggtgaggcggctccttgtggtgggcgtcaacgacggtgaggaagaaaccaagcaggaaggaaccaaacaaaactcaggaccaagcaaagaaaaatatatatgtgatttttatttgttgcttccacggattcgatcctggaatccaagaacatggtctccaatcttttcaggcaaaaaaagtagggatggatggatgaatgcgtaaggatctggtgggctgaggggattggatccaaacatacagtatgagagaagaga

SEQ ID NO: 85983 - DNA, 2153 bp, Oryza sativa
ccccccacccctccgattttcttcgctggcagttttatctctgtcccgccacgaaaaagatttctcaaacgtcatgaaaaaccgtttttctaatagtgtcccgcccctacccctgctcaccgtcctcctcgcctcatccctctctgcacttgcttcggccgccgctcgcggcgaagccggtcgatccgccttgcccgtagcccactccagccgccactcgccccactccgccgaccgtgtgcccacctgggtcgttgctcgcttcggccacaagaaggggagagatataagatagagagaagaggggagagagagaggagagagataagatccagtgtgtatgatacgtgggacctgcttgtaagtatgactagttatttcaaaagccacagcccatattccacaactgtttttcgaaaagccacggctcactgctattttttaaaagccacaactcaaacaaacacactgttgatagaggtgagtgtgctgttgttagtacttgcttttggactgtgtttataataaaaaaactatacctacttttaatgtttaagttttgtctcaatgtttaaatattatcttaaaatgttggcatatgtattttgccatcgcatagacggattcggccagcgaaagttttccaagtcgatcccatcggcccgcgtattttgttttttgcgtgaatattgttgtgctaattaattagtgagtattatggattgtgaatggattgtatttcgttcatatgtattctgtatatgtgaataattctgtattctgtgctgataatgcaattgtaacagatatattgcactgatatatattccctccgtattttaatgcatgacgccgttgatttttcgaccaacgtttgaccattcgttttattcaaaatttttatgcaaatataaaaatatttatgtcatgcttaaagaacattttgatgacgaatcaagtcataataaaataaatgataattacataaattttttgaataagacgaatagtcaaacgttggacaaaaagttaacggcgtcatacattaaaatatggaggtaatatctaacttgtgtagctaaaaaaactatagtcctatatatttgtaacagttatactccatctatctacttttgatagtcatattttcaaatctgaaaattctatttttgataggcatatttcaattcatcaacctatcatcttaataactttctcggatttaatgtttgactctccattcttccacacaagattggctacttgagcatcgtgaaatgtaaatattaatgaatcgcttttttacgaggaatgaccagtagcatgtttaaatagatgataagtagaattacttatcattagtctgtgtgccaagataaatatgactatcaaaagtagatagagggagtctatattgctattaaataaataaaattataagtaaacaaattcaaagtaccaattcatattatttaactgtataagtacaatactaatattatgaattaacagtaattatattggggaggcactacccgtcgagcgcccgattcgggcttaaaaaattcgtgctctgacgttagcgtgatgcatgcatacaaaaccactttaaactactttttctctcaaaatatttatccaaatcatgatccgattgcaccattaaattcgttacaattaaatctttaaaacaagaccacacatgtatatattccgatgaattttttaagcttattattgaattattttgaaatgttgtacgttgttccatcacgtatatcaggattgtttcactaaatagatcgatgttccaatcgtttacatcgggcgctgtttcaccttgtatgaaaacaaagtttcagcaaaatagcgaaagaatgtttcaactcactgtaacatttgatccatacatagtgatacattataagtacactatgtgaaatattatttgtggcgttgtttcaccttatataaaaacaatgtttcagcaaatagcgaaaaacgaaagaatgtttaaattcactgcaatatttgatccatacatagtaaaacattataagtacactagataaaatatttttgtggaacaaaaaataaaacaaattcacttaatatagggtttccataatatgtggctgatttgttataaaaga

SEQ ID NO: 85984 - DNA, 1236 bp, Oryza sativa
gctttgtttggatggaaattattttttatttttatcatattaaatggtgatgaattttatagtataaagtaaatatttgatctggtacccacttttatccacactagtctctatactgaattaaatttgataatgttaaaacttgtaaagattttaacacataggtaaaaatttggcaccaaatcaaacagatccttggaccgtctgatgagagcaactaggtcatatgatttgataggtactgatagctctcgctttggtggaaacttgagagacatgatccggtttccgattgacacaatctgaatcctgcaatcgcaacaccacgtctactcaggttatcaaccaggcaaccgtctcctcatgttataaaccgtgcgctgcccggttaatctcaccaagaaggttaatccctgcatgcgaatcgatgaacacaataaaaaacaaggtagacaacaactgaattagcatattatgattaagcattcgaagttggggttgcacaaactgaactagcgacgaaactacgatgacagaaataactaagcaaaacccaactctaaacgataatgactactgaataaatatgattagggacgctatagggttagacttaaggcgtctatctcttggatttagtccacgacctgatcattacaagacccaatgcctaaatcagagtcgggctggatgaaatatgtggcctgttttacagagtcccgactaccgaggaagaattttagcgtgggaccaaaaacatataaaatcagaccctataatctttctagcaagtacacatggactgtagcgcccgttccgtcgtggcgcctagcgggaaaattaattcctaaaaaccctaattgcgaaatttgtttcttcgcttgtcgtctagtgtccgtgccatctcaagatctcaaatccccgatctatcgtcgagttcaattccgaatccaaatccttccaaatcaaattcctccgtaaaagtctattttgactcccccggggtcgatgggccgaatttcgctcggcccaccttctcccctcccccggcgcgctcccgctctccctctccctctctcgccctctcccctcccccggggcactccccctccgctgccgccgcgccgagcgccccccttactttcccctcgctccgcccgcgcgtgcgcgagcgccgcgccgagcgcccccccttcctcactctacttcttcccatccctggcaagccctcccccc

SEQ ID NO: 85985 - DNA, 3282 bp, Oryza sativa
tgtaactcgcatgacataagaaaggtatgatctaatgcagaattgcagatgacagtttaaaaagaagaagaaaaatatgacacagccccagattgaatttaacatacatccttgaaataaaattaaagttagtacgcatatgcatttcagagagatgtcatggattagcctatctccttggagattaatattcacagctaaaaacaaacaaattgcttctgaattacagaaaccatcacgaggttcagctctttagcccttcctgtgatggccgctgtcaaaaggaaatgacagcgaatcatcataacacaatctatcaggagtttacagcctcctggatgctaaccacaaaccatgaaaacaatcatcagaactatggtacagctactagcaatctgaaaaccatgctgccttttttcttttccataatctgtacaacaataacaacaacaattattctgtacaccagccaatgctacaatgatcccaatctgtggtcgtcatcgatgccgtcctcctcctcggcgacgagcttgtcgatcaacagctccattgtcctgatgtacttgggcatgtaatgctcccttatcatggatctcgccaagcgaatcttgctgtaaagatgtcgaggtgtctcatacaaggcaacgacctcctcaccttgttcacttgtactgtttggctctgatgatgatggcaatccaaccatgtgcattattcttcctggagggtagagctgggggggatcttgactttggctcgacgatgacggctcgtgtgggttgtcggtcaaggtttctagaagctccacggcctgatcttcgtctgtttcattgagagctggctcattctcccctctgtcggtatcatcgtcattatctgattcttgaaggtcaagttcttccatggaaattgagactagttgtgccgtttcgatgtcagttttctcagctttgacattgacatcagtttgatttgtgatgtcatgagttccatgttttgcagagtcaatggaatgcttatgtgcagcaacacatgaccagcaagctattgcatggcgtttcttcaccacagcatctgaatttgacgaaggcttcacctgatcagcctgccaaataatcatgaatcaactatttaggtgacaagtatgattagcttgttcgaagaactggtgtttgcaacaatctagctgccatacctcagagctgttgggcaccagcatgtcaacatctacaaccttggatcttggatcagagacgaatggcacgtgcgatcggatgaagctcacagagcgattgacaaagcccaagaatctggtctgctgaatttgctcacgaaggtcatgtacccaggatgatgccatgacctgtcatcaatgaccgcgacggtaaatatgttgcaatgattatcttttactagcttccaagaactgtttgcagggaagaattttataaatgatatgctctaaagaactgcatctgcgatacagttcttggttcccgttttgatcgtcatacttaggaatctgctcatgaattcaggtagctgagaggtacctctgtacggagcttggcagcagaaactttgccaaaagatggaactaggtcatttctgttgacaatggttgtgatgaagtctttacccgactcagccaagtcccatgtcatgcaagcagctgaacagaaatagtaggacagggagcattactatctcacatcaagtatttctacatcataattttgtagaatcaaaagaagaacatggagttattctacttattctacagatgtatatgtacatcgcgatcgattggacatgtaatctttgtccaaaaaaaattgaatatgtaaaaatcataagatccttcaaacatttgttcattgctgaatagttaaagctagaatttttttataacaattaattaatagcttttaaattgtaggcgtgcaaatgccattccatgagactatattggtgtgtaaggtgctaatatggccttttagtgaaatatattttcttatgttaagaatgcaattccaaggtccgtgaacaatggtaaactagttgcttgtgctccatgatgcatacctggtccaaatgcaagacatgtggatgatgataacttctcattctcacgcagaatgtatgctaatattgcagcgatgccagcacccattgaatgcccaatgatctaaaatatataacaacagaaatgctgtgatttgagtaagcaaacaaaaatgatcagatgtagtgcacagtgttcatcatcttgtaccacgagaaaacttgattacaatgaatgcaactacattgagattgttaaaaaaaggctacataggtttgtgtagactgcacactttctctaaataaagtataatggtcgtttggataataaataaatacacgatgtatgccaataagcaaaatacgcaataacagttttactagtttgtgaaacaaaattcgtagttattagtctaaattgttgagcttctaagtgctgtttccactttgtccctttgtgctagactactaggcacaacttttagcttacttttggactaactatgctcgcttctgaattgtctttctcagcactagagaatcctaggaagtccataaaatatgcatagtaagagtacttgaaagtctttctcactttgacttcaaggtaaggaataatatcttgtttctaattggttaaaactccatgtttcccatccacttgctttcttgcacatgttttggaaaattttggcgtaacttggataggaaaacatctcccttgaaccatgtttcaagataagcctagaagattactgctaaactatgatttggttttggtggcatatccctgtctaaatgagagtaagaagagaaatgttctataaactgcatcataaaagaatggtccaacttgacaactagtgggtaggctctaattgcaattaacttaaaattgcatctgtaaaggtctgggaaataaattaccttcactccataatctgggaattgcgcaaccgcttcattgaggcaaggaatggcttgatttgcaatccagcgagctgccactaccattccacaatgagcatgtcccagcaccaatttggagacatgaccatcttgtgtcacaacatgatgaaatggaacctctgctccggttgccgccgtcaaccgatccttaacgctgatcgccccccgaataaaaaggaggaagcatttcgcacttctatcgcggacaactgtgaaagaaggcttcataagctgcacaacaataac

SEQ ID NO: 85986 - DNA, 1087 bp, Oryza sativa
aaggactgattacatacttcaaatgcgccagtgaaactccacctcagttggtttgttttcagacgaggaatgacaacagatagaacaggcatggtgggcctgtacttggcaattagtctgcagacattacagataccagatgaaatatgaaattagttttgattaaactacaccattatcctgtttatattcacatctttctaccttgcagcgcgtccagatgatgtgaagcaaataatgacagaagccttcactttgatagcagctcgcacctgcaaaataggcaagaaacaatttcagactaagaaacccttgtttcatataaagactttgtgaagcaaaaaacaatggaatagtcaaaaatattttatatgtgcacaataaacgttaagaaattttgggaacaagagaagaaacacaccgcagaagaagcgatagactccaagtgggtcatgggctccccaacatatttcacagtccgcttgaagtataaatcttggttgaataccttctctgcctgtgaaacaatggacaaacaaatatgactaaatcatgttactaacagactgatatagacagaaaaacaagaagtgaattttcattgtacttgttgaaaattgtaaagaaaaaacataaaagtagaaagaaaattcacctcagcgcaaattttgcccacaattgagatagtctcaactgggtacagaccacggagagtctcagcaccaaggagaatggcatcactccctgaacaaaaaatatatggttcagatttttcagaaggcaattaacatcatcaacaactcaaacaactcaccgtcaagtacagcatttgccacatcagtagcctccgcacgagtaggcctgaggttgtcagtcatactgtccacaacacgagtaacaacagcaggctttccagccatgttgcacttgtgcagagcagacttttgaaacaaaaacacctacagtaccagaagttaaagatcagtaagcaaattacatatcaaattgaaaacagagcaattcttgctaaagaacttgaggactctgccactaaaagcttcatagccaaataaaaagaagcagagta

SEQ ID NO: 85987 - DNA, 5645 bp, Oryza sativa
cccagatgaaaaagtacggccaaaagatttttctatgttatgttaataataaataaagaagtatttattggtaaaacttgttaatattgttataaaaatgtattgaagttggttgttgcgcaatttcatatgttaagtgaggtattatttgtaccttattcgacgtattagtactcggataatttatataggcctatcgcagtctgggtcgtagaaacattatatggacttaaacaaggagaattatgtaacatgaagaaatagtagtacaatttgaacatgatacaactatttgcattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgtttagtaaccctgtattgctttggtagttcaagctgcacaacacggctaggtggagttagaacccttctgatgtctatccattctctgtattgacatctccttggtggttcctgggaggaaagaatagatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaacgaagaacctgacaacgatcaccacacctgcatcttggatgggcttcccatggagggagtgccgtagttagcacccgccagtcgctctgttgttcacgacattgtcgttcataagccgcttttctctgtaagtattgctcagtactttcggatgcgaaataccagcgaccttcttgtaaacaagtggttaggtcgagaacgggattttctgtatcgacccactcgatgtatgcacaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgctacgccagtttggatcctcaacacctcggcgtctagccattgacgaaagccggtcggatttgtaatgaagcaagtggggaagagagtactgaatgtgactgagttctgaaagattgtgaggcctcactcgttaaggcgacttatataggcgcaaaaaatcgagtgatacccctgacatgtgaacgtggtggggtatggtgggtacgcctgattggcgccgaaagatacatgcatgatcggcgccgaaagttacattggtcgtatgcgccaaatggcgggcaaatactcgtatcacacgtgaataaaggaggctgcatcggtgcggcagaaagtagtcgtgcatgcgccgaaaggtatcgtgcacatataacaacaacgtagtcattacacaagcatacagtactggaaagtgaagcaagtaaacaaagagaagactgctctactggccctgccccgcgccacgaccacgcttggtcctccgggcctgtgctcgcacgtggttctgggagtaggtgaaacgatccggtggcacagcacgggtagcacgagtgtcccgcggaggagtggcctgcgcctggtcctgcgtctgcaccggcagtgtgcctcccagctgtgaggggtcgatgacgtcctctgtcgagcctgaagcgacgtcgaagtcagtgatgccgaagaggaaggtggaaggcaacaagtggtccgacgaggtcccagcatggtccagtggtggaccctgactcgacgtgccggctgcctgtgacgaagtcccggtgtactgccagaactgcgctgagtgcgaggtcgacacagctgcctgagacgctaaccctgcagcctgggagaagtgggcggcctgcgtcatagcgaactgggcgaaacctacacatcgacaacgggacccttgtaagctaagacataaaatgtatgtaaattgattgtcgaagtaatgttgtttttttaagtacctgtggggggcacaacagaaggcctagccgaggaaggcggggtgctgaacggtgcacgaaaccctgaagcaatcggcaagtgaaacggctcacttatatgtgcgaggcatgtacagaaatagtaataaaaatacttacctccgtgcggagggggagtcggcctaggaacgtgcgcagctggacggggaccagtcggtacggggggccgatgtacagctgcgtctgcccgagcaacgtcgtctgcacgacaggtgagaactcggagaatcgagcgcatcgactccaccatccgcgtgtacgtcgtcaggtgctcctctacgggtaccggaatccccgcgcctaaacgttggatcgtcgttgaaccgtcaacgacgacccggttgatgtcgtcgacctgcatggttaatttgttcgtaaatattcgtaaaatttgacgaagagaaagacatgaaaacataaaggaatggtgcgatgcagggtactcacagcacgagcgaagtcctggttgcagtgtctggcatagaggtctctagtgctcgcaacgtggggctgttgctccaagggagcgaaggtgaccctagtacgggtgcgtggctggtaccagcgtaggtaggccttgtacgactcctcagtgtgtggctctccctcgtggtccacgacctcctcggttgcgagcaaccagtcctcaacaaaagtcgccaacttggcgggccagtcgccagctgactgctgacccttgcgcgagtacctgcgaattaatgtgtaatattagtgtgaaacgacagatgttacaaattattgtgaacaggcagattttaatgcaacaacggaaggcgtagtgcaagatcttaccggtgaacagcagctgggacggtggtcggaaacggtactggaaagggcagacggaagccgaactgccgcatcacgcggaaaggggcgtgaggctcaacgcagatgtcgaagaccatcggaaccgtggtcatccagtacgcctggtccctggtgcagagtgtggacagacccaacggcgcacgagcctgggtagccgtggcactgtagggctcccacacgacgtcagtcggcagaaggcggtcgaactccataacaaactcaggatacgaccgcctaacctggacgtgagcccatcggcgctgcaatacgagacgatcgatgtgatgtacaatgaacttagcaattaacttaacaatacgataagatcgatgcaacgtacctgacgtcggcaccacagagtacccatcgtagggtagtcgacctctggtcgctcctcatacagtgactcctcgtacgcgtgctggtccacctcagggcggccgatcgcaatcctatcagctgcccagatagaaagaaagagagggcacccaccaaaggtcgcgctgggatccgtcttcgtgcaagactcacaaagtgcacggtacagagccgccaacaacgcggaaccccagctccactgaggcacctcgcctaccgtggcgtcggcgatgctcctggcgtagtgcacgagtcccttgtcgaccgcgtgcccgtgaccgcaacagaacatcacccagccaaaaagccagagcaagtacgcctccaaacatcggctgtaggagtactcgtcggcctccgcctgtagctgctcaacctgcaagccgtcgataaaatgttaggcaccttaatgcggactaaatatgtaatacgattgtcatttcggtacaaaaacactcacggtgaactgaagcagccacctcttcgtaggtccggtgttgcggtggtgtgccaacagctcgagcgggaggtgcggtgcgccctgtactagtgcgaaacgtgccgtcagatcgtcctgccagtccacagccgtggtcactggcccaacggcgtctcccgcgagcggtagccccaacaagtacgatacgtcctgtagggtaggggctacctcaccgcacggcaagtgaaaagtgtgcgtctctggcctcgatcgatcgaccaaagctgctaggagggacctgtccatagtccatcgtctggccgggtctgcgtcgccggccgcagcctccaccagccgacacatcggtaggaggccggcctcacgtagcctgcaataacaaattaatatgtcattataaaaaatattacagtgcaactaacttatagtaaaacactgttcgtacctctcgacaaaggagtcgtgaaccgtgagtagctcaccgcacgtccgtgcccagaacgtcccaagctgagccccctgcaccacagtaaggtgagaccggtgtcggtgatctatcgccgggtccaacaactgaggtgtatcctgacgtgccatctctgaaaaatatagtgtttcgtgttagaacaattcaaaaaatagtactgtaaaacaaaagataacttgcaaaattatgaaatagtaataaaatcatgagattaattatgtacaacaagagtacaggctatttaaatatagcaaacgttactaatggtacataacgatgacgtgcaatttaacatatatgtagagttcaataatataacataacattacgtgtcgaagtccgacatacatcagcatacctaaagacgttaggcgccttagtccgacgttacatcacgagacctaaagacatgacatgccgaagtctgacattacacgacgaaacataaacacatcgataagttcgaaacgaattacaagcaaatccacatgccgacatagaacataagaactacaccacgtagccagacgtggcacgacgacgcctaggacatggtcgagtggaggtagtgccttcacccgtagggcgagctccatctgctgctgatcctgatagtcctgcctccgccgcacttggtttctccttgtctttaggacaatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttactgaagtactgtgacacatatactgcatctggtatgccacactccgctgcggcagcaatgacatgggtgcatggcctgtggagcagcttcggctttgcacaagagcaatgacatgtgccgtcggctttgagaacacactcctgcttcactctcttgcggtagatacccctgcctgccttattttgacatagtatctcaaacctgtgctgttgggtaccttgcactagagctcgatgtttcatggcctttttacgcaactcctctagctttttctgcatgaaagctccaaacaaaatgctgttgttcggcatagagggaagaactgcttggaaccgatccctaaaatacctgcatgtcccatgtaaaatgaact

SEQ ID NO: 85988 - DNA, 1614 bp, Oryza sativa
taagcttttaaaatcatttctaataattccttttaaacaacaatttataatttaaggattttaaacaagaaaagcacttaacaattataattagatcattattgatcaaataattactgaactgttctctgtatcatttacatttaggaattgagctccgaaaaatccgagaaaattccagagagtataattaaccatggagaatttaataaaaattaaatccacccatgctttatatttaggaaattttatttcccacatttaacttcacttgtaaattaatgaacatttcatataaattctattaataatttattaaataatttataaatcctaacacgaaaatcagggtgtgacagttgacgagggaatggcagacgaacggcgggtaacggctgccgctcgccgcgccctccgcctcgacgacacggagccgggggtagcagcgccagaggccttggtggcggaggaccgcccaccggcgcctaggcgctgctgcgccgtcatgaccaagtcggccacgtcatccagccaacatcgggctggagtctctggatcggggacaacgggcgggtgacgcaagagcgcgcccgcagcttggagcgcgccctggggcgtgctgccatcgccgtagacgaggaggcgacgctccccgtctcgccgtccttctccatcgctcgtgggcggcgaagttgcggatctttcgaccccctcgagcgcctcctcccgcctaagacttcggcgagaggggggcggtggagtacgagctcgacgacgcgggttctgctcactgtcgtcaccgctagcgctcggagagaggttgtgcgccactgcccgttcggccattgggctgagcgggagaagcttggcgcacacgaaagaggacgagggcttagaaaaacacacgcgccccctacctggcgcgccagatgacggagcgtggggctcctcaccgggagaccgcgcgggccaccctttgccggttcggccgggggcgctgggtgaggttctaagcccttgatctgtggaatggttcgcgagagagcaaatgcgcaagacacgggcgatgtagacaggttcgggccgctgagaagcgtagtaccctactcctgtgttctggtggatctgtgtatgaaggagttacaaagagctggagagcaagagagttcaaactctagagaccctctcactcctcttttctccagtcccccctcttggtaggcatggtcctccttttatatctcaaggggataccacatacaccatttctacctacccttcttttgggtggggacccatcctactttgaccaaaacttggctcgtaccttcgcctgacaccgggataaccctgtcctccctcattaatgggcggagatttgcaatggctgctgtccgaatgaccctccgatgggatgggtcataccaacctccactccgccggaagcaagtgcaacgtggaagcacggttgtttgctgatgacgtgaccggcatcagaccagtcacaaaccggtcattcttgtctaccacgtgtcagtttagcatgccacacgtcagcccttcttcataaaatgacttccttataatggttgcgatgaagcctggtatgaatct

SEQ ID NO: 85989 - DNA, 2118 bp, Oryza sativa
cctagaaggagaggggacagaacaacacacagatcgacatacaagtcagaatagacaccaacacatgccgccaaacatcgacatcagagataagcctagacaaatccaatatggtgcctacggaggccgacaagagggatctagcgccatctctaatcacgatgagttcgtactcgagaaggaagactaccctgtcgtcgactacgtgttggttatctatgccgccaagtcggcgacagctaggtatgttatcccaaatattgtacttgtgtgattctaatgaatatagagcaacaccggctttggccaataggagtagggctattacctgtcagataagggtcccgaacctgtataaaatccttgtctccatctcttttacctcaatctcgcatatacccaggtaccgacgatctccatatcatgcaataaccgtagtcgagacctcaaacgtcgacacatgtgatactccaatttctaactactactcttcttgtactgaaacatactaatttttagcgtttaaaatttactaactttccaatctcatatatatatctcgtatactccctccgtttgtaattatattataagttgttttatttttttcatttatatctcatattctcaactaaattaaatttaagtttgactaagtttatagaaaagtatagtagtatttctaaatgaactaattatgctagatttaataaaattaatttgatattttagatcgttcgaaaaaaaggtcatcaacggtctgatcgttcgaaaaaaaaaagtaggtgttgagatgaaaagagtagtgaaagagaaaggtttctctaattttcttatacactaatcctgcatttcgaataaaatcatagtgctaattaaataccaacaaaattaaaattcagcattttttaattttatattcccacctaatgctgctaacctaggagtccagatatgaatgggatatatcggatatgattgctgacacaacatacataggggtacgtgtcatacataggggtgtctaggtaaagccgtgtaaagttttagagtgtcacatcgaatattatatagggtattgtatggagtgtttagacactaataaaaaaaactaattacagaatccatcagtaaaaccacgagacaaattttttaagcctaattaatccgttattggcacatatttattgtagcaccacattgtcaaattatggggcaattaggcctaaaacattcgtctcacaaattagtcgcaatctatataattagttctctttagcctatatttaatattttatacagttgttcgaacgttcgatgtgacagattgtaaaatttagggtgagatgtaaacaggcccatacttcgagagccactactagtgcaagcacatgcagatagaaagggccacatcataatagcctccattctgtaattgccacttgcgcaactcaagtttaaatattaattactcctccagtggcctaacacaacataatacttcctccattttctttgatgatagctcaaaattaaggtccctttcggattaaaggattgacaaatcagagaaatagaaaaaaaataaaattctgactgtaaaacgtaggaaaaatacataaatgattgtttgattgaaccacaggaaaaacataggaattaggtaagagagatagactcataggaaactttccatgaggttagacctcatgttaaaaatcctctaaaacttatatggatttgggcattccttaggaatttcataggattcaatatttttcaatcctttgtttcaaagggctatataggaaaaaaaatcctataggattagaatcttacaaaattcctatgcttttccttcgaatcaaagggtgccctaaactaaccaacgtcaagaaaaggtaacatgtcgaatgaagtactagattgctactccctctgtttcacaatgtaaatcattctagcatttcttacattcatattaatgttaatgaatctagacattgttggaattaatagatgggctaaggcccattcgaagattaattctttggaaaatcacaaaagcccacctcatgggatggcatgcatgtggagtttagtaccaccttgcttatt

SEQ ID NO: 85990 - DNA, 6952 bp, Oryza sativa
ccgtgcgccaccgatgctcgcgcgcctgccgagccgcctccgccgcccgcgctcctcccgttttcgaccgcctctgctgacacaaacaccaccgtcggccgctgcgttcaatggcagatgggggaggacagagaacaggaggaagatgggggaacgggaggaagatggggaggaaggggtagttcaatggcattttggtgtaaatactctaaaataattaagggtagtgggtcttttgaggtggagtggagttgtagagcagcaaaaacccagctcaatccccgtagtacaaatttgtggagcagctctgccaactccgctccaaaatattgagaatctataccgtttggcacagctccagctctaggtaagttggagtagggagctggatctatgccaaacggggagtaactcaatacaagatatttactccttttgtcccaaaaatataggtagctgtattgagggatcactacaattaactccctgcatagtaaaatatgttccatctagtttgaaggtttaccactcaattttaacgttcagaaacacaagaaaagacaagccaagaattttagcgcatgggaagatctttgattgtgaaaacaatatggtagtatgtataaatttcctatagtaaattcaagtttggatatctggggcattggttttggttcctttctgggttatgtctctagagtctaaaccagacatgatttcattggtttgactaatgaaacagtgcttatgattggacttgaaccaaaaacaggcagagtatcattcttttttgtgaattcaatggttgagtgaccctgaaaagctagaactgaatcatacaaaaaaaaaacaatattccaggttcacgatgctgttccaaattgatttcctaaaatgctataaaacctcagttgacaaatttcagctagcgggaagatacaaatatatacctcgtacatggattcagtcaataaactttctaatattgaccttaaacctcgagctccagtgttcttcgctattgctcttttggaaataagccgtaaagccttctcagtaaaatgcaacttgacctataatacaatgatgtgatatgaaaacaactaattaaatggttatacttcagaatattctgactctaaacaaagttccagaatttgtaagaaatactcgcttacatcattcatttcaaacaactttgtatactgcctgcctagggcattctttggttttgtaagaacctgcagtgaataaatgtgttaagaaagatcaattaattcatgtacgtaggacctagaatgcttaacaaagtataaggaaataaacttgaatgttgccaagtaaacttgaacctgcagtgaataaatgtattaagaaagtacaattaatttatgtacgtaggacctattatatatcgcacttcacagacagataatgcctaatggagtatatagccagtgtttttcaaaatcaagctgtatggacaatgtgcaaaacttttgcggtcacaaggcaaaaatacagtgattgtattttggtaaaaccataaaacaaagtcaactaactggccagtaactgaagtatgtctcatcaactgaaaattatggcagcatgcgaaccaatttttgtttgtggcagatgatggcacatcttacccgaaaattatggtagagttgataaaaaaaatatgcatgacaccaagaaccaatctgaacatactactaaaatacttcttggataaatgcttaaaaggtacgcagaaaccttgaagaaagcaggatagccaataaaaattggcagtctgtgattggaacaataataaataataaattgaagcaacatgtgccctttgacagaaagaacaattaaagagacacagcacatgcatgcatcgcaagttacctcaacaagttggtcttcactaagggaagatagactaacaagaatgggaaatctaccaacaaattctgggatcaatccatatgcaatgagatcaccactttcaacctgcatatatttcgacaaagtaagaaccctaaatatttcaaaggattctaagcatgacaagtcacaaaaccaagtatatgcattcttctacttgatcactcactgattcgagtaacgaggatgtgatctcagcatttatcacacccccagtccgcatatttgaacgaattggtgcttggaaaccaatggaagaatcatgtctcctattaaagattcgggtgaaacatataataagaaaactcgaaagactttcagcgtaaaacataaatgatgcaggatattgaaacctttccgaaatagtcttctccaaatcaacaaaagcaccaccacaaatgaagagaatgttttttgtatcaatctgcattgcaaaacaaaacagcataaaaccatattaaatagtttaacaagaacatatgaaggttctagttgtgcaaaagccaactggttgacactattttaggtatgtaaataaatattttcgtttacatgacatagttaaaaggggcaatgagaatttccattattatattgcactgcattaaacatggagggcaaaagtgttgctcgaaaagatgttcatagtagtaaagtgaagaaaactaataaaaacaaagcatcttttctacagattgcagagcaagcacacaaggtatcaaaaaacaaatggtctatttccagacaacagataattcaactcagggaattcactatcttctactagatgcaaggaataaaacagaggttctctgatgtcagacaaatatgaaatagatagcaatatggcaaaattggttcataggatacctggatattgtcaccccttgggtgccttctagcccctttctcaggaacactaacgacctatcttgacagcataaaagcaattgtaagaagatcagtaattaaaaaccttatgcgtcatcagtttttaaaaatactaaaataatcaagggtgctatcccataaataactaacatggtaacacttagattttcaaagagattaatctatgcctatcagcaaaattgaaggaaagagcagctttacgaactctatgacagatacaatgaggaggccaagaacagtttattgaccagtaagtatgctgatctttgtggcttaatccatgttgaactacggaattgtatggtcaacattttcataaactagcaaaataacttagctagagtaagtgataacgataaaaattttaaaaagaagcgcaagaaaaccccttaaatagacttctggttactccatttaaattaaatatattgatactggcgctcgcaatagattttacatgatcagaggcaaataagttattgcctcaatggtttggattggacaatttaatgtgttttgcaggttccacccatgcatacatggctggagaatcaaaaggcagaaggttatcaataaaaacatgcagtacatagttcaagataacaaaacattatgaagccaccaacaaattttagcagctagacagggcatattaactactccctcagtttccatttacatgtcactttggtcactttaaggtttcaaaatacttgtcactacacacttaccaatgtagttatttccattttgccctttgtgagtctaaaatgataattagttggcatatatatttagaagcttctagattatacatcccactcaagtaggagcccttttgtcatgttaccttgaacaagttgatttacatttggtttgtatgcatggtcacaagtgacaaataaataaaaacggaggtagtaaaatgtaagcctggaccaactcatgtactactagcaaagcgtagcaacaaacaattttgcacacagggttaagtaaaaatatgccattcatattctatgttagcaatccatctgaaataagatttggcatcagcaagctatcaatcaaacatcctaactggactgttccttgagtataaattggagcataacaacaaataacgacaagctcaccgttccctcaagcatttttagcagtgcttgttgaacaccttcacctgaaacatctctactaaggttgatgctttcagcctgcaagacactgcaacttcaaaaatccaaacaataaatatatgatgaattgaccctagctaaaatatcagtaccttctttgttattttatcaacttcgtcaatatagacaatcccttgctgagcagcagctacatcaaaatcagcagcctggggattcaaaagggaacaggaaaagtgctatcaatgaagagggtatagagtgctagcatcagcactggtagaaaggaatttcaaactcactgtcctagtttctgtaacaagcttaatgaaccacttaattcatctcctagaaagagcagttacgattaatctaagcttcctctatatagacatcatttagcaaatagccaattagaatcatctgtccttattaaagaagtcttgaacccaggtccaacacgaaagcccgaatagatagtagctagatgcttagatctcttaaacccaaaaaaaaaaaaacatcttcactctagatcataaagccaaaatgaattcatgtaataaattctatgcaaaggttattttatgatgtgctggagttaagaccacaatcttgatagttgcagttgtgaacatacacgcaggtatgcctagagttgggagcatgtggaacaatgaccacattaacatagaaacagtctgttagctaagtcacaacacacatgaaatctttcttagagaactaaaaggacataaatatcttatctgagtacatccagttctatggtcaataaaacacaaaatttagaattttcaggcaacggtgtcattacaacttttcttaattaccataactgccaacattaaaaaaatagtcatatccaaatttctatcttacaatttgcatttccccccagggtcagggcgaccttgtttaactcatttcaccctttttgtaccataagagcttgtgacttggaggcaaattcgaatgtcgaatatgggttgtctccactttgaaatatcatattgttatagtggctttcaagattttttatagttttgtttcaattcttcacatatttaggcactcagtagagaataagagggataaattatatgtcttaacagtttaacacttgcgctaatggtagaagaaaaatcataaggttctctaagcaactattgcaatacatgcaagtgaaaaggaaagactatataggccacaatgtcagtacacagaaattaaccataccgctaggagcttatacaggatagattcaacatcctcgccaacatatccagcctacaattggaaaaacatggttaaagaaaaggtgaactcctgagcaccagcatgagcacttattaaatcaagctgctatacgacgctctcaaacaaaagcattgcattttccagactacgattaagtactctattggtctatttaaaatatgccacctaagaacacagcacccataataaaaagtaatgttacagcaaaaagaatctttagaacacatgtatggctatgagtatactaagcactttatgcccaagaaagtaatgaaaacgtgtacaatacaataattacataaaagagtataaagcacatatcatatatacatggatccaactggtaccataattttgggaaatcttatgatattgctcccccttacagtaaagccaggaatggataaaaattggatgctatatcaggagaagaggaaaaatgcaaaagttaatgaattgataaattaagataattcatctaacctgagtgagggttgttgcatcagctataacaaatggcacattcacaaaccttgcaagggtttttgccagcaatgttttccctgactttgggaaaagattttagaatcatataagtaaaacattcatttgataagaaataaataatatctaccatcatcttattcgttgaatagaaaatggtctacatgagagagataaagtacagatgtaatactattgcatggtctgtaaaagaaagaagtgatgattcaaatgaaaaaccaaccatcaactagtgctatattaagaagtttccaaatgcggtctcatgtgctggcacctggcaatttggtgtgatcggaagtgtttctacaatatattaaagtttataccatatcattattaataatatgcatgcctactattgatcataaaaaatactagtattcatttagacaagaatatttttatagtgcacacgagttctccattgagacaatttttcattatgtgttacaaatattgcagcatacagcactaatagattgaatgattggagcatgtacccgagcctgtcggacccatcacaaggatgttgcttttctcaagctccactccatcagtatcactcgcgcaagaatcagtctcgctacaatctccagcagacctacagtttgaatccaatttaccacctgaaactacccatacgcaggacgcagcaagtctggcaaaactggtatttacacaacaccaacctgctggagagtaactcgcagtgtatccttttatagtggttataaactgctacagacagtacctgccaaaagacaaaaacaagtttattgtttcgatttaccggacaaaagcacataagagtcactacaatcgcataagtgtaaggctataagcagcgacgacgtaaacctctagcctacaaaactagaataagaaatcccattaggcacaaactacacccacccatacactatcaacactgttttgcagtaccaagtgaggctgaatccctaatccaaattaagacaactccactcagagtggaacgcacagagaaacagcataaatagttcaccttcttggcgcgctcctggccgatgacgaacttatcgagcccacggcaaatctccttgggcgtggggaaccgtcgccccaggttggagccgccc

SEQ ID NO: 85991 - DNA, 704 bp, Oryza sativa
ttcgcaaattggactgacttcaaacttttcaaccggattaatagtcaacgactttgatagcctttccttacaaggtttttaatccatcgccccattatatttttcttaagtttaattacacttaaaaacttaatgaaaaattagaaacgacttataattaaaacacagaaggggtaccctatatagactaagtcaaaatataagcttccatctataaatggccaaatggaccgccctgcacggcccagcctgagcatgaccaaggtacggcccgtgatcagtcaggccagcaccggcacggcccgaccaacacgccatgtcatgccgtgccccgcccacgggttgcatctaagcatggcccacaataagactcgggtcatgtcgtgtcggcccgaaggcaagatcagcctaccatactcgtccttttaataagtctattttggctccctcatctctttagtccggccaccgacgggctacggcctgcaagagccaggaatgttgggccgcggttgtgccgattgttggaccatgccgtgctgggctggcatgtcgtgtcaagtaagagacccagaaacggcccgacggtcgggtcgggtcgggccagcacaggcctaacaacagtcgagccgtgtcgtgtctgggctgggccaaatcttcataccatgggtcgggccgtcggactgcgggcctattggccaact

SEQ ID NO: 85992 - DNA, 6386 bp, Oryza sativa
aaggaatccacaagagaaaaataaagagaactttgacaataaatggcccttcttatttaacgatgtcatagatagcttaaatttgagagagattaagctttcagggcataagttcacctgggcaaactctttaccaaacccaatctatgagaagttcgatagcgtgttagttagtgcggagtgggaggagaaaaatccattggtgtctgttcatgcccttacccgagatccctcggatcacacccccctgctgctagacacagggaaagggtctcttaagaacaaccaacccctgtttaaattcgaacttgggtggttgctgagagagaactttcatcaattggtggtcaatagttggtccaaacaagttagagggaggacattgagagatggcaaaataaaattcagagactgcgtgttgatgaaaaacacgaggcctgggagatctgcttaactctagtgcaggtccaaaactcgcctttgggtatgcaagtgtgccagttgatataatcctacaatcaacaagaaacgaagataaagaaaccgcggttaaacctataaatgatagccgatcggcaaggtgccgatgacatatcatttatctttgagccgatgtcatgtacgtatcaatcaacagttataaatagataataaaggataaaatctactcgatcggatgtacatattaacaatatataatttctatgtcaatatatacttaagtcaagtgattgggatagattggtcgtcatgccgagacagtataaatcacatagatcgaagtatatactaacaatgaaactatatatgttcatagcatagcctatcagatagatctagcatgtatcggttaatactccaatactactctacactaagatattaaagcaagtaaaatatatcaaacaaaagcctaatatacttgaatgcaacaagatcttgatataaagggcagatttaacatatcaataaagcagatggaacaaatatagttaaatcaggtaagatcggctaaaactccgatactacccaaatcagcaaccaagaagcaggctagagattgagattctaatcacgactcataagatcaaactcaactgatgcagctataagtatgaaaagaaggacaatatctagacaatcaagccgttggaagtttcatagagtggttgacaccttatataatctaagtcaacatcgatatctaacctaatcggctgccctctaccaatagatgttagccgactgtagattagatagcgatattgccagagattatgtaagatatatcataactcgatgaattacgtaaacaagatcagagtatcacaaagatggaagcactaatcccgagaacgcaagctgtcataacaagttttacctcttgttgaacatcgaaaccgatgcagctcaacccgaaagcaagaactcgtcgaaataaaacgaaagtaaaaagagtggggatgcgccgagattgtattgaacgtgtgtttatttaattacatgaggttcggggtctatttatacccgagaattacaaactatgtccatatcggacacgactcttatctctaacaaactctaagataccataagtctttatggcagacttttgcccaaacatatctctaaggaaattacataaaatatcctagttaatagatacaattgccttctcaggactctatccatgtgtggcaaccatcttgaagcatatcaactcaacccgatgtcgtacagcaagtcgtattgtcggaatcggctatatcacctaacccagtctgactcgaacttagccgatcccgatcgtagccgattcgaactccagccgattcttactttgtttccgcgacgatcctcatctttgattccgcttcgatctaatcttcttctccgataccgatattaccaaatttggtcgttaacacatgctccccaagtccggaatatttggtaatgtttcggattttccatatatcgactccgagcaagattcgcactctgtcgtttcctgaccgttattccagtgctttaaatactaaccgttgctcccgaaaaatcttcactccgtcacttccgttttcactgccaaagcaaactttgtcctctctctctccgacgattcctccaacgcataaggcgatccccaggcgattccatctccgaccagatcttcgcccgcgacgatgtcatcctccgctagctagtctaccgcgccgtcagccgagtatgctgaggtaaggtctcatcggctagatctcttttctcggatcagattggtttttctattcctcatcctgctttccccttcttgattctcttgaatttgtagcacctctccaatctagttgcaattccaagcctctcgcatgaaaattacaaatttctcagcccggttggcaaccctgatcctaccgaatttatcatcggtgaaacaaatagggttcctttcagattagccaacccaaatctaggtcattggaagaacaccttcatatcttggctatctcttgagaaaaccccacccgagaagagctggaccacgtggttcaagcgcatgtcagctagtaaaagagttcattgggacgaaattagaatcggccaagcactcgaccttaccatagccaattcagccaaggacgaacccctaatggcagccgcctcctatttctggtccaacaccatcaatgccttcttgttcaaccaagggccgatgaccccaactctagtagacatcactatgatcaccggtctagatgtcacctcattggctaaccccatgagtttgaacacgaagaatcagtatgacttcatgaccaagagcataggcggttggtcaggttatgtagcaacatacatgggtcaaggctctatcacccctcgagagcgtgtagcctttctactgatgtggctagagaaatctcttttgtggatcaagctgtggccctacaaccaattggcagtttatagccgaagccttggaaacaaagaagcaatttcctttaggaaaaatccttctcggctacttatatcaaatgctaaacaatgcatcagccaaaatagtcgtccgctcagtagtcggagcaggtggaccatggtggttgttacaatcttggctgaatctagtagtcatgaaatttgtcaatcggccgtccgtaacagaagcagatttcccgagactggagccgattatagatgatgatggagaggaacacacccatcgtaggtgtacatcatatggagaatatacctccacaccaaccgatgcatgagcaaagctatcgaccgagctgctcaaagactggttttgcagcttttatgatggctttctcaaagaagctcgaatttggttcctctacgaagattcatcgcttctagagaatctatcagactttagatttgaagacatcaaccatgaaagataccaaaagtctagagaagtccttttagctgcaatcagcccatgcatccttcctgtcggcattcatcaaggaagaaatatcaaggtttcttatgagttctattacccaattagctcagctagacaattgggaatgggtcaactcccaatcagcttattctttgctgataagatccagtgccgaggagaaatctcatcaaccctgatgatgtatcggctgctaaatctccaaggacctcctctaggaagcattgaaaacatagagctggaaaccttcaggagcaaaacatttgacagatggtgaggcgagtggaaactgcatctattccatcaatcggcttccatgacagatctctttccagacgttatccctcaggtatgtcttgattaattttttgaataattgctcagccgattcataacttgactaattttcttttgaaatgcagacgacagaattttctcctcctcaccagagcaatagtaacagaaatatcaaatatgctccaggtctaattcctaatggaggcggaccatctccccctatcattggctttcatgcccccaggacttcaactcttcttcaagggctcatcagagaaccagccgatgccagcaaaaagaaaagaaccagatcatcggctgtggatgcatcagctcctgctccaaagaagaaggccaaactaaagaagcctatgccaaccgatgatctgcctgccctagatccatccattgaacaagctctagatgaagaagaaatcggcgaggatgttgatcaagccgcagataaagtaagcgataccgaaagaactccatcggcttctcctaagcacactcgtccaactccttctgctccagcccatttttcaagggtaagcaacttcctctgattctttttgcaacttcttcacttatagctgattcctcacagactttatagttccagaagaagaaaaccgctgtaaagaagaaatcggcagcaacgattttcaaaccagctccaccagtaagacattctttatttttttactagttgatctcagccgattttgtctaacatttgcctcttttatagcctcctcctcctccttcttcccctgtacaacaatcattgagtgatcaaactccatcggctgtagagaggcaccatattgaagaagaagaacaaccagctattcctactatcccagtaagtcttgtctatacaaatcttgaatcggccaaataactcatgttgatactcaactgtttttaaattccttcttgcaggccttagccgatctgttctctttcgaaattaaagactatcttgatgaagaaacagaagaagacaccaccagcaagtctttggctcccttgtctgatgatgtgaagaaaacccttgaagacatctctcatcggctagaagcatcatcactagacaacttggtggtaaactgtgggccgattaggactcggttacacgagatccatgctctaatcccagatgagctagccgatgtccttactctagctatatatcttgagcagcaccaattcaagctggaaaaaagccaaactaagattagccgaatgtcgggagcgcaaacatatatcgaagctacaatccaagccaatcgacagcttgttcatgaagagaaggccaaacttgatcagctatctgagggcccgattaaatctattattgatcggcacaacttgaagaatgcaacgctgagctggatatggaacataaaatgctagccgatctcccaaagtctgtcgaggagcaaaaggcaagattaaaatcggctatcaagattgttgctgatctcaccaagtctttaaaagtcattcctggaaccgtgctcaagatgcccaagccatggaagaagtagaacaaatcaggcaaaggctattttggctatccagcaatatttgtctcggtgactttctgtgtattagaccttagaaatttttgtaatcggctaagatactctggtactttattgtcttgacaatcctttgtgccgattaatataacttctaaatttgctaaaatattttcatttttcgtatatatgtgcctccttaattttacaatgtcaaaagcattgataaaattataaaaacaactaagggcgatataacaatatcggccattgtacatcggcaaaccacaaccgatttacaatatgaaaaacagctaagggcgatataaccatatcggccatctcaaggcgatgcaaacacatcggctatcatgtatcggcaagcatcagccaatcatgcgttaacccaaacacttgggtaatatttcttcaagtacttgccatttagtgctcttccataaacttccccatcgagtccttgcaacatgtaagctcccttagacacaactttatagatttgcaacggtccttcccagttcggtgaccacttgccgaatttgctatcccgagtcccaatcggcaaaatcaacttccatacaagttcaccttccgaaaaatctttgggcaccactttcttgttgtaatgccgagcaactcgttccttatccttggtaacctttgcaagggctcacaaccgtgattgaaccagatcttctctctcatcggccataaggttataatactcatcgtctgttaaattattttgcaactccgttttccttgagccgattctaacttcccatggcaaaacagcctcatgtccatatacaagcttgtaaggaaggacttggatcgatccatgacaagccatccgataagaccacaatgcttcggctaatctagtatgccattgccgaggataatcaaaaatctttctcttaatcaatttgatcaagctcttgttagatgcttcggcctgcccattagcttgtgcataatatggtgaagagttcaacaatttaatacccatgctatcggcaaactgaacaaactcatcggacacgaaaattgaaccttgatcggttgtaatggtt

SEQ ID NO: 85993 - DNA, 1503 bp, Oryza sativa
cctaggacgtggtcgagtggaggtagtgccttcacccgtagggcgagctccatctgctgctgatcctgatagtcctgcctccgccgcacttggtttctccttgtctttaggacaatgcttgtaggtgtgcccatgttcattgtatttgctgcaacgcttcaccctgccagcctccgactcgtacatattgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttactgaagtactgtgacacatatactgcatctggtatgccacactccgctgcggcagcaatgacatgggtgcatggcctgtggagcagcttcggctttgcacaagagcaatgacatgtgccgtcggcttttgagaacacactcatgcttcactctcttgcggtagatacccctgcctgccttatcttgacatagtatctcaaacctgtgcttgtgggtaccttgcactagagctcgatgtttcatagccttttacgcaactcctctagctttttctgcatgaaagctccaaacaaaatgctgttgttcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttccgaatctccattccagttcttctaaccaatgttggactatccgttgggagagattcaagagcttgaggagggtcagcaacggcggtcgatggagccgctgcacgctgatcactgcatttagctgtcaactcatctaatctcttccaaagctcattgaattttttctcctggttctgattgcacagcctcttgaacatgttcatgagctccttgttcttgaattgcttgaagaaattagctcccatatgacgcatgcaccacctactctgtacatcttcccaaacaccggggtatcctcgttccatactcccaaactgcaactctcctatcgctcgcagaatgccagcgtgcctatcatgtatcaggcatacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgcaagaatgtcccatcaatgcagagaacaggacgacagttcacgaatgccatcttgcatgcatgtagagctaagaacgccctttacagcacactcttgcca

SEQ ID NO: 85994 - DNA, 2966 bp, Oryza sativa
  unsure (1)..(2966): unsure at all n locations
aagtttataatatcattcttcattttgctactaaattgaatcttgaatttgctgatctttgcttgctgaagatgttaattcgtatccaccatacagaaatatctgcagttaggaacactgattatattgcattacacatgatgttatcgacaatggtggccaacactcccattgacattcttcatcactgcatgtttcccacatctaaggttaaagctaaagctatacagttgcttttgggagcaaatcctatgcacatgcgcctttttggaaaattgctcacggatattctgaaaaaagacacttctgttatgcaagtcgtgggttccgattctaatgcttcatggactcatgaggatagttttatacttttgttgcctgctgccttatcatacatagagcatcatagtgggggcaatagacagtgtgttgacttccttgagccagttccagtcttctatcgtgaaattcttttgagtgataatggctttccatgttggaaaagttttgttactagaagtatttttgaggaagattttagtgactttagacacacatcagttgaagatataatgaattatttcggtgacactctcttggggaagtcaataactatgctatgctattatttctattcgaaagagatacctcggaagcaacgattaaagataattgcttcaatttgcccacaatcatctgagctcttagattctgacatcagttttgttactcctgtttcatgcaacggtattatgaagcttactaatgagttatttgcaaagatatcactgattaggatgttgttatctcctcctagaggatcgttgaacaatgaaatagccccagagaaggagtccaagcgagtcaacaatgcaaagctgagttttataagcatattggtcagaacgttggataaaatattcaggaatttccctcatagtgatggcatcttactttcctctcctgaggaacaaaatgtcgtcagttgtttggagtatgcaatcctcaagaacattgttgagttgtcttcggaggttcagtcacatctgaaccagttgaagccaatacctttcctcaaccaattgatcagatcatccctcttacatagattcagtgatcctgttgtaataaaagcaatccgatgcataattgttgtattatctgaagggaagtttcctgctgatgaaattcttgaactcatactgggtcactcccattttgtgtcgacaataacctgcagtggagtttccgagtgcccatctgcttgtaatcccactgggggcctgcttcagccagcaccaagtattttaaaatcaggtgattctgcttttgcaaaagaaaacaagttccaagactgcattccagaaaagaagaaagtagaaatcatcaggttactcagggtactgtatgatattaagagtaggcaacataacagtagcctattggatgaatcaagggagcttggtttcttgcttttatctgtttatggtgcaactcttagtgaaacagatctagagatactttaccttatgaatgagatagagtcatctgaatgcaaagccattactgatgtggatcatctttggggaaaggcagctgtgaaatttagaaaaactgaagctaaattttcagcatttttttgggaaaattaacccggccctanctaaaaaaatagtggaaaaaagaatagncngngnaananaatattaaaaggtgataggcgaaggtcgctattccgcgagaacatacccattgattctaagctctgtgtcatgactgtcttacaattttgctataggagatcttcaagagcttctattttttcactggaacagcttcagcaagataattttggcgatattttcaaggtaatttgtgtcaattgaagttttgactccatttttgttctagattttttttttctttcagaataacactcctttatcttcctggtatatttgtctcccttgtgctcttaaaccacacttgtattggttgacaggcaacatctcaaagcatggatgcggttcggatttatgatcctgtgtttatcttgcacttctcaatccatactcttctgatgggctatattgaacctgttgaattttcccgactagggctacttgcaataacattagttagcatatcatctcccgatgaagacttaaggaagctgggttatgaatctctaggaacattcaaaaaatcattggaggtactgaacagctgctatttattgaatattgatatgatattttgtcatactggtttattgaattcaaatgccactggttattgcctactctggcagtggcagccctactttgatttcttgttgttgtgttatattgctacactgccagctaaacatgtctttgtaatgctaacacattgaatgttctcttaactttctaggcacatatgtaatgtcatgggctcatggttttgatatttatttgtctcaaaccactgtgaaaagataatttgtattgacattctgggagcagtttgatttctggtagatgtgggactaaaattctgtagaaatagactgataatgatggtttgaaggaaaaactggagggtggtgagtagagtcgagaggaaccagactagagagaggaacttgaggggctaattcatttcttccttaactcaaaagagatgaggagttgaggaccctccttaactgatccaactaatacatatgataagcctgacaaataacttaacaagcctgaaaagggataacaaggaaatctgggttaactctttagtcatatcccatgcagaatgaataaagaatggtttcattacagtagatctgagtacagagtggttatcttctatagtagtcactaggtgtaagtgtgtaaagcttgtatgaataaagaatgttttcattacaataatctgtaattttcttgaagaatcactgcttctatataatacaggcttctcagaaa

SEQ ID NO: 85995 - DNA, 2467 bp, Oryza sativa
agctggtgtcgttcttggcgcataacgacggaaatgatgaacagtcgaatggaagatggctcctaccgctatcacttggaaaacttgagattaaacatgttgattccctaaaaacgctgcagctctgctttccaggaaacctcacccgcctgaaaacactagtagtgttgggaaaccaaagtttaacatctctgcagctccattcctgcacagcactccaagagttgataattcaaagatgtgaatcacttaattctctggaaggtttgcaattgctcggcaatctcagggggctgctggcacacagatgcctcagcggccatggagaagatggaaggtgtatccttccgcaatcacttgagaaactttacatctgggagtactctcaagagaggctgcagctctgctttccaggaaacctcacccgccagaaaatactaggagtgttgggaagccaaagtttaacatctctgcagctccattcctgcacagcactccaagagttgatgattcgaagctgtgaatcgcttaattctctggaaggcttgcaatggctcggcaacctcagggtgctgcgggcacacagatgcctcagtggttatggagaatatggaaggtgtacccttccgcaatcacttgaggaactttacatccatgagtattctcaagaaactctgcagccctgcttttcagggaacctcactctcctgagaaaattacaagtaaaggggaactcaaatttagtgtctctgcagctccattcttgcacatcactccaagagttgataattgaaagctgtaagtcaattaattcgctggaaggcttgcaatcgcttggcaacctcaggttgttgcgggcattcagatgcctcagtggttatggagaatatggaaggtgtatccttccgcaatcacttgaggaacttttcatcagtgagtattctctagaaactctgcagccctgcttcctgacgaatctcacctgcttaaaacaattagaggtatcaggcaccacaagtttaaaatctctagaactgcaatcatgcactgcactcgaacatttgaagattcaaggttgtgcgtcgcttgctacattggaggggttgcaattcctccacgccctcaggcatatggaagtattcagatgccctggcttgcctccatatttggggagttcgtcagagcagggctatgagctatgcccacgactggaaaggctcgacatcgatgacccctctatccttaccacgtcgttctgcaagcacctcacctccctccaacgcctagagcttaactatcgcggaagtgaagtggcaagactaacggatgagcaagagagagcgcttcagctcctattgtccctgcaagagctccggtttaagtcttgctacgatctcgtagatcttcctgcggggctccacagccttccctccctcaagaggttggagatctggtggtgcaggagcatcgcgaggctgccagagatgggcctcccaccttcgttggaagaactggttatcgtagattgcagtgacgagctagctcatcagtgcagaactctagcaagcaagctgaatgtcaaaattaatggggaatatgtgaactgattactcggtggcttgttaggcgcacctttttccacctgcccaactggcgtgggctcgttcaggcgttcaagctgctgtaaattccattgccgcaatgacgaccttcagaaccgttacacaatacaaaggacatatgatggctagatcaactgtcgcagagctagctttggttcacctgaaaacataaggccaaacgcgtggttcttttaatcagaagtatcaaaaattggttttggtttttaacgaaaagatgttagaaatggttttaatgtgccagattctgtaccagaattctgtattttgctccgtaattctgtgctacgactgatgttgtatttaactgatagcaatcgaccggcaaaaccaatccgctccaatgcattgtcacatacaaattctataattctatctactgaaaaggatgattgctgttcattttcgtgattacagaaggaactgtgtatatcgtgctatttttgcattcacattgtgtcccaggttgtgctcggatcagccaatttcggtggttaattcactttgctgtgtcctctgtgcactcaagaattgttcgcacatgcaattcagttgagcatcgcactacgcaagttttttttttgttaacaaaggagtggttgacagcattgcaggttgctaaaacagtgtcaaaaatttgctaacaaaagaattctcttcagaaatagtatgaaaataaatgccacataagtaatctgagtaaaacagacataatcactagagaagactaacgacaaactcttctttttctatttctgtggtgaaaaactcagcatataatctcatgtatgcattggaggtgcataccatttcgatcatgtatgcat

SEQ ID NO: 85996 - DNA, 1876 bp, Oryza sativa
catcatcgccggcctttgccttcgccttcgctgccgccttctcctcctcctttctcctgaactgcctgcaatacacaatgcaaagatttttttttcccaagtcaaaaccagatcaatgtaagctaattgaatattacgcatacgcatttagactttcaacgatattttagtgagattagatgatatcgctagttttcatcttttcaagcgtatgtttaaaagacgcatttatgggtgtgtgagtgtgacattgtgatcactcacatgcagagaggggtgttgcagtggccgtcggggaggtcgcagagggcggcgtggaggcggagcagctgccacatgcgctggcagcgcgggcagctggtgcggtggcaccgggagaagtggcggatcagcagctgcagtccccggcacgccgtcgcgtacgccgggcacggcgccgccgccggcgcacgccccaccggcccgacctccgtgcacccctccgtgcagatgtggctcaggcagtccatcgcctcgctcagctccacgtagaccccttgctccgccctcttcctcctccacttcctccgccgctgcaccattcaatcacaccggagaaaaaaaaaatcaaccaccatgaattctagtagtagtaaaaaaaatactaaaacaaaaatcatgcgattttatcagtctatttcagagattattggtcaattaagggcctgttcactttaatgcaaaagaaaaaaacattaccaaaattttggcatagttgtcaaaattttggtaattggcaggatttcttatatagttatcaaaatttgacagcaaactaaatgtagccacaattttgacaactttaccaaaatttggtaagattgaaaatgacatcaaagtaaacaggtcctaattaggttcttgtcaaaatcaaaatcattcgaccataacaaaaacgtttaggatcgggaaacttcgagacggtaagccgttcgaagtccattcaacgtggttggacagaccaaccggaccgacctagcctcccccagatacaagaaatttctcattcaatccaccaaccaaccacaaaacgcaaagcacgtctcgacataaaatgtgtgcacgagtgcgacacggtggcccccggctattccagggacttaaggctcgaaagatcccagtaaaacacgctcaaaatcatgttcccctagtgcacgacccactgtgcaaatcctcccatgcatttcggtgtcaatggaaccgtgtgtcacagagccatttacaaaagcgcccaacatggataccccacaccacatcgagtgcacaattcaaagtttgaattttttttgtgtgaaattcctgtaaaattctaccatgttgatgaacagcgataatgatgtataccaggtcggcgtcgtggaggcgctggaggatgtcgagctcgagccaggggtcgttctcctggaggaatcgccacgcctcggtcttctccacggccttgaactccttggcgagcagcctggtgcagcgcaggtgcaactgcagcgcgtcgcacagcgccgccagctgcatcgtgtccaccaccgactccgccgtgagccgcgacccgatcgccccctcgcaccgccgcttcagccacggcacccggtacgcgtgcgccagcaccagcatctgcgccgcgctcttctcgtcaatctcctcctcatcaccactgcacaattagttaacaaaatttacacagtattagcacgtctaatatgcaaatgtttttttctcaaatatttctactacacgttttgtggtccaagttacagaaaatcacatacactttgacacttggcacttgagtacatatattttggatgtgtagtttcacaaaactacattatcgatgtat

SEQ ID NO: 85997 - DNA, 1349 bp, Oryza sativa
gcgcgaatcacgaagtgagtttttgccacgaacgcacccagtaacactccaatatgtccaaaaatcatgttttggcgttttttgaactttttgattccggtcaaaaacaacgctccttcgtgtgccaatattggcattaattgacaaaagttcgccgcgcgaatcacgaagtgagtttttgctatgaacgcacccgatacactccaatatgtccaaaaattatgttttggcgctttttgaactttttcattccggtcaaaaacatcgcccccgtttgggccaaaatatgccaatattggcattaattgataaaagttcgccgtgtaaatcacgaattgagtttttgccattaacgcacccaatacactccaatatgtccaaaaatcatgttttggcgttttttgaactttttgattccggtcaaaaacatcgcacccccgtgtgccaacattggcattaattgacaaatgttcgccacgcgaatcacgaagtgagtttttgccacgaacgcacccagtacactccaatatgtccaaaaatcatgttttggcgttttttgaactttttgattccggtcaaaaacaacgctccttcgtgtgccaatattggcattaattgacaaaagttcgccgcgcgaatcacgaagtgagtttttgctatgaacgcacccgatacactccaatatgtccaaaaattatgttttggcgctttttgaactttttcattccggtcaaaaacatcgcccccgtttgggccaaaatatgccaatattggcattaattgataaaagttcgccgtgtaaatcacgaattgagtttttgccattaacgcacccaatacactccaatatgtccaaaaatcatgttttggcgttttttgaactttttgattccggtcaaaaacatcgcaccctagtgtgccaacattggcattaattgacaaaagttcgccgcgcgaatcacgaagtgagttgttgccacgaacgcacccaatacactccaatatgtccaaaaatcatgttttggcgttttttgaactttttgattccggtcaaaagcaacgctccttcgtgtgccaatattggcattaattgacaaaagttcgccgcgcgaatcacgaagtgagtttttgctatgaacgcacccaatacactccaatatgtccaaaaatcatgttttagcgctttttgaacattttcattccggtcaaaaacatcgcccctatttgggccaaaatgtgccaatattggcattaattgataaaagttcgccgtgtaaatcatgaattcagttattgccattaacgcacccaatacactccaatatgtccaaaaaacatgttttggcgtt

SEQ ID NO: 85998 - DNA, 2286 bp, Oryza sativa
tagacagtgaaacgcttaccgaggtgggggcatagtaagcaccggagcagttaccaacctctacttcaatcgctggaaactatgctcacattggtccgtccattgaaacttacacatccttatgtgcgacatcgtcattggtttagcgataattgagaaatccttcacgaagcgtcgttagtaccctgccatacccaaaaagctcctcacatccttaacattagtcggcctttcctacccgacaacacttgaaactttgctagtatcaactgatataccctgctgatcgattacatgccctatgaaagtcacttcacgaagtcaaaattcacacttctttaatttagcatagaacttgttttcctgtaaactccctacaccatcctcaaatgacactcatgctcctctacatctttcgagtaaatcagaatatcatcaataaacaccaccacaaacttatctagaaagctatgcaacatgctattcatcgcctccataaaataggccagagcattggtcaccccaaaagacataactctacactcataatgcccatacctcgtggaaaatgcggtcttctcaatatcctcttctcgcactcgaatttggttataaccagattgcaagtcaattttagaaaacaccttttactccctttaacttatcaaacaaatcttcaatatgaggcaatgggtacttgttcttgattgtcgcagcatttaaggcccgattgtccacacacatacgacaactcccatccttcttctcagtaaaaataacaggtgcaccccatggcgacacactccgtcggattaacttcttggataatagatcatctaactgttttttttcaactcttcttggaaaggacgagctaaccggtacggggctctagagatcggtcgtgtaccaggaacaagatcaatacagaactctacatcacgctcaggtggcatccctggaaattctacgggaaaaatattgggataaacttcgttcggactccgattattataaactcatagtctatttttcactactcagcgagttctacgcatccacggttcctgatcgcctattcgaacaatggtttaaaaattaaacttttgcacgtttgtgctaatattccccgaaatatactattttgaaactcggggcattacagatacacctctcagagggttgttgatcttgccggtgcagatcaaccctattcctacaagcaaatcgaagaaacaagtaagaacaagataaaagcaatatgatattgcaaataggaatgaatacacacgataagttggggttttgaatacaagcagacggacggtctagctgacacgcacgctgtaaggaagtagcaatggctaaactttcatctaaacaaaacccaagaaaccctaaaggggtacctagctatttataggggtgggaagatgaccaacggggccgtagggtcgttctccaccaagttggggtgcaccccacatgggccccacttgggccgggatcccaaataaagttacaagcccataggcccattataggtgacgcaatgccttgtgcgtgtgagtccggacacacgagatggaattcggagatgaggctggatccgttggaaagagggctccgagagctttccatcaagtactcacggtccaaaacggaggtcgtatgcagattcggcggccgtttgaagtcagcagtgtagcaggtggccgaatcggattccggcacttggaggactcgaacttgatatcttgttgttcatccatgatgtgagcaacggatgtatccgtagtagccatggtcacatcatcgtccccttcttcacagaaaaccgtcctcggtttttccatatggtgttcttcacatagtccattcaaaataacctgtttcatccaatcaaaactagagaaactcgaagtagtgtgattggcaataacatgtttctctaaatctaaacaaatgaaaactctatgcaccaaatatattcctctatcattatatttgccaaagatatgaaaaatagcagtagttggacatggaaaatcagacttagcaaataatttctccttcaaattatcgagctcacaaaaatcatcaaactgaacatagccaaagtatttaaagaagatagcaatttacgttcctcaacttcattagcaatgtgaacagcatgcttaatatcaacacacaaacaaacactagaaatagcatgttcattcactagttgtggcatgaatataagtgaagcattatcacacaactcttctttatcacaaggaa

SEQ ID NO: 85999 - DNA, 3937 bp, Oryza sativa
tacagatacaaccattgctcacatcatgaaagaacaagatgatatcaagatcgaatcctccaagtgatggaatcagattcggccacctgctacactgctgacttcaaacggcagcagaatctgcatacgtcttccgttttcggcccatgagtacttgatggaaagccctcggagtcctctttccaacggatccagcctcatcgccaaacttcgtctgggaccccggcccaagtggggcccatgtggggtgcgccccaaccaggtggatcatgaccctagggtccctttggtcatcctcccacctccttaaatagctagctaccccttcagggtttctcgggttttgttagattaaagtttagccattactacttgcttgcagcacgcgtgtcggctagaccgtccgtctgcttgttcttcggaaccccaacttatcatttgtattaaattcctatttgcaatatcagattgtttttatcttgttcttgcttgtttcttcgatttgcttgcaggaatagtgttgatttgcaccggcaagatcaacaacccatggagaggtgtatcgatcgctaaggcgtaacacaacaacgtcttatacgtttgtagtcgggtcgtcaatgtttctcccaaatcgtagttgtctcaactcactgaaagatcgggccaaacaacaaccttgagtgtcgagtggaactcagggttcatcaggtggtatcagagctttcgttgctcggtgagtttttatctagctataacctgaaaattttcctacaaaaaaaattgcatcctgtacctagccatctttgtgccattgtattgttcttttcagtttttgcgttgttgaattttgtgttgcatcgtcacgtcgtgttgctggtcttagcgtctagttcgtttagagtttcgaattctagtcacgttttgtaccactgtcgtcgcagccgctgtgtcttggttgtcatcgggacctacgaaattggaatcgtctttccgccagagttccatatttgtagttttcagaagtttctgtcggttagttttgaagttgcgtctagggtatgctgtttagacgggcttgtgtttgtgccgtggttatgttttgccgtgaggaagaaaaaatgggaaaggaatatagcatatctgtttggattcggttcggtggaaggaaaggaaaataataatacattggatcggcaaatcagtttctgatttatctcattcatttaatctggccggccgatccatccacccactgtacccgcacctccccaccatctacagttgtttcccccaataccgtgagtagctcaacaccatggtgaaaatttttcaagtgtcggattggaaatccgtttgaaacaacggaacctatgagggacgagagcattccatttttgtatagttctaattttgggattgaacttttacacttgagtccctgtaatttttagattcgcatttgagtccctgtaatcttgcattgaggtccttgagtttgtttttttaaaaaaaataaaaaaaaggcagaaaggtgcataaaaaaagcaaagaaaagcagcaccaaaaaagaaaagaaaagaaaaagaaaagaaagaaaaaaaagaaagaagaaagaaagaaaagagaaaatattgttatctttgagctgaacttcatatatcagagtgtgcttgagttgtttctagtgctatcctgtggtatcgtttgtgtttaggctcgcgtctctagtacgttctagcctaggaccagcacggtacttgactttgaacgattattcaactttgcattctctgatttgagcatttgctattcctttgctacatatttaagcctacccagagctccacagatttgattacagccgtacaacaagtgtttgccaaggcattcatacatccaaacttcgttgtggtgcttggttgagtcggtgtacatcaccattccgcttgctttggtaagaacttgtaagagcttggttaaaagcttgagtgtgtgtgatatttgagctaccactacctagtagttgataggaacgtgcatattcttgtgtgtgtttcttgtttgctactaaccatggcaggattgcgcaagggaatacgagaacatcaacttctacaccttcgatgagatatgacgacttctccacgtgatgcatatgaggtacatgactataattttgcacaagttgcatcaaagttaccattctatgatgggaagtatgattttgttgcatatattgattaggagctagcagtagacaatgaatttgatatatatgatttttctgatgctcaaatgattaaggctgctagtaataagtttacctcttctgcattattttggtggagttatgtttgtaacaaacctgaaactttggatgaattcaaaaccataatgagaaaatgctttgtgagttcttattacaaatgtactcttcgggagaaattagaacatctgaaataaggcgatagaactgttaaggactacattcatgaatttaaggtctgtatcatctacagtgatctcaaagagtgcaatgaaaatacaatgcgtagatttttcaatgggcttaattctaaaattcaggttttgtttgataatgtgacatataatcatattgggcacctattcatgcttgctcgtagcattgagagttagatcatatcaaatgcgaggaagcatgaacaatgtgatttatctcccatttctgaatctcctatatccttatgcaatgatgatgtgcaaacattggaggagcaatcttttgtctctcctgttactaacgttttgcagggagttcagaacattcaacaaaaggaggagaatggtgtacttgataagaaagaggatgaagcacctgcggtttcggaagaaagtttgcaaggtaaattaaattgtgctgagataaatgaatgtgagtattctcaagctgagctacacgtgtccacttttcatgctatagtagagcaaccattggtggaaccaattgttgagatgcctttgtcacaagttgatttacttgttgttccttgtgataaagaagagttgtgtgataatgcttcacttatatccatgccacaactagtgaatgaacatgctatttctagtgtttctttgtgtgctgattttaagcatgttgttcacattgcaaatgaagtagaggaacatgaatttctatcttatttaaatactttgggctatgtttggtttgatgatttttgtgagctcgaaaatttgaaggagaaattatttgctaaatttgatttgccatgtccaactaatgctatttctcatatctttggcgaatataatgatagaggaatatatttggtgcatagagtttacatatgttcggatttagaaccttctgtacatgtggataaaacatgcaagctagagagaaatgttattgctaacaaaattatctcgagtttgtcttgttttgattggaagaaacaggttgttttaaatagactacgcgaggagcaccatatggaaaaaccgatgacgattttccatgaagaaggggaggatgatgtgaccatggctactacagatacaaccattgctcacatcatgaaagaacaagatgatatcaaagatcaagtcctccaagtgctggaatcagattcggcttacatgtgtgtgaaccctcgtccaggaatcagccgaggcacacaataaaaaattgataatagagtacaattattactctaattaataagcgaataaaatgtcattacagaggtagatagttactctcaatcaataaagatataagcagcggaaaaaaaataagataaacgggcagacgactccactccacaggcagcttgaccagggctacacctaatcctccacaccatcagcatcactgtagaactcctcctctgatgaatgattgcaaggtgagtatatgacatactcaggaagccac

SEQ ID NO: 86000 - DNA, 3159 bp, Oryza sativa
cgcgcggcgaacttttgtgaattaatggcaacattggcacacgagggtgcgatgtttttgaccggaatcagaaagttcaaaaaacgccaaaacatgatttttggacatattggagtgtattgggtgcgtacgtggcaaaaactcactatgtgattcgcgcggtaaacttttgtcaattaatgccaatattggcacacaagggtgcgatgtttttgaccggaatcaaaaagttcaaaaaatgccaaaacatgatttttggacatattggagtgtattgggtgcgttcgtggcaaaaactcagttcgtgattcgcgcggcgaacttttgtcaattaatggcaacattggcacacgagggtgcgatgttttttgaccggaatgaaaaagttcaaaaaacgccaaaacatgatttttggacatattggagtgtattgggtgcattcttggcaaaaactcacttcgtcattcgcgcggcgaacttttttcaattaatgccaatgttggcacacgagggtgcgatgtttttgaccggtatcaaaacgttcaaaaaaagccaaaacaaagtttttggacatattgaagtgtgttgcgtgcgttcgtggcaaaaactcacttcgtgatttgcgcggctatcttttgaaaagttcaaaaagcgccaaaacatgatttttggacatattggagtgtattgggagcgttcttggcaaaaattcacttcgtgattcgcgcggcgaacttttgtcaattaatgccaatgttggcacacgagggtgcgatgtttttgaccggaatgaaaaagttcaaaaagcaccaaaacaagatttttggaaatattggagtgtaatgggtccgttcgtggcaaaaactcacttcttgattcgcgcggtgaacttttgtcaattaatggcaacattggctcacgagggtgtgatgtttttgaccggaatcaaaaagttcaaaaaacgcctatacatgatttttggacatattgtagttattgggtgcgttcgtggcaaaaactcacttcgtgattcgcacggcaaacttttgtcaattaatgccaatgttggcacacgagagtgcgatgtttttgaccggcgcaaagttcgggatatcggcgtggacactcatctcgtgaacgatattcggcgtgtcgggcccgcccgtgagccgcgcgcgcacggggtgagtcgcgatgcacacttttgacaaatatgcaggcgtaagcacatggccgagccggcccaagagggagagggagggaaaggggactttttagagtttttctttttataaaatcattttaactttgtttatttcttaataattattatttgtgttctgaaaattccactaaaatttatttacgcattttaggcttttaggaaatatacaaaaatcctccaagccttatttgacttttaactttgcacattttaattgttggaggctttcacacggattttaattattctaggcataatttagaggatgtattttagagtcgttttgggacgtgacaccgtcctcctcctcccgtcaacggcaccgcgctcctttccctagtcggcgccctcacctggtcggcggcgcgtcctcccctcgtcggcactgtccaccccccttaagaggcgccgtcctccaccccttctcgccgcccacctccgcgcgctcgttgcccgccggccacgagcacggcccccatctggctcagccatccccggcgctcctctctcccttcctctctctccacgattgcgggtattttggtcttaaaactcctcaaagtggcaaagtatactgatgataatctatttagtggcattttatcctttgtattctaatggatggcatttttgcactcttgtggagtggcatattgtccgttttctccaatttgcccctgttctgttagatcggtttgacggtgttaattctgggataaaaagacatatataccctttgcatattgttgcagtttgtctgtacttctgtaaaaaaaaaagtcgtgcttttgcgatgtgtactcctactgtcctacatgcggcgatggctagaaacgtatcgagcatgtttgatgctccgttggtgttggtgccctgacacaagcgatcctccaaacagatcaatttaattcccggctttcatgaacaaaaacgttgcatacatcaggaagggaaaaggaaccgagaacacaagcaaaaattattccccaaatccatgaatctatcacaacctaaaaatgaattttcccagctgcttgcaaattgattcgatcaatagaacgaactgtgaaaacctactgctttgcacgatgtcaggatgtggcgtggctgcatcgccagcttcatgcggatggtggatacagcgaagtgaagcaacagataaaggccgggaatcggaggggagcttcccggcgccgacgttggtggacgacgcggactgcagcgtgtcgaggccactgggagtcagcgccgtcgccgtgctacacctccccctgctacacgtttgccgtgccgcgtcccgtacggccgtacctcacctcttccagctgaaactcaaccctgccgcccctccacatgcgcgcctagccgtggagctacgtcgactcacccctcccatggcttaccgtgtcgcctccctgatcgcgcaccgcttgcctgagcagcagtgctgcctccgccgtctgctcctccctagccagggcgttgggtttaaggggataagggatttttggtcgggagtagaacgattattttgcattttgtaaatcatttttcttttctttctacttttaattgattgaatcggagcacacctaacagccattcaaaataggggcaaaatgcaggttcagtctaaaaaagtaagggcacaaaccctaaaaataagaggtaaaattataattgcatagctaacagagaaaatgtgaaaatcgaaccaattgcattttaggatcgaataccatcctcaatctaatggcaaaaccaagaaggttaacctatgcttggagctctatttgcgttgctttgttcatgctatgccaactaagtggaattcatggttgtagcataattctgattcaatatctcatatcactcagttttgcttaagtctcctttcgaagatctttatgggtatccatctagtcagggtgtgt

SEQ ID NO: 86001 - DNA, 1232 bp, Oryza sativa
agcctagaagaagcagagatcgcaaacagatcgataattacatgcatttctcgctacatgcatttcctcgcttaattactgcaacgctgcaataagtgagcgtatatatgtattttttaagttcaatttagtgatgaaataagtgagcgtacgtgtatataactaacctagcctccaccggcaaaaaaaaaaaaaaaaaccgggtcacatcatatacagacacacatttgaagtaataacaaaacaaattacataatcagcatagaaaccgtgagacgaatttattaagcctaattaatccatcatcaacaaatgtttactgtagcaccacattgtcaaatcatggcacaattaggtctaaaagattcgtctcgcaatttacacgcaaactatgtaattgttttttttcaatatttaatatttcgtacatgtgttcaaacgttcgatgtgatggagaaaaaatttgccggcggaactatttattgctccttccgtcctaaaatataagtatttctagtacagtgacaagttaaacatttttagctttaactattagtagcaaaataaaaaaaatcaatcatgtaaaattgaagtttactagatttattattaaacaaactatcatagtatgcaactctttttatttaaaacatcttacttttataaatattgttggtcaaaatagcatctcgatgaccgtgtcagggttaaaaatatttatattttgggacggtgaagtattaaaaaacataggtagtattagataggcatcacgaactagacagaggaagatatagtcgattgacgtgtgaccactaagtttcgaccggtatggagatttaatatgacagccataatgtcaaagcaatctggagaatgccatgtaagaacaaattgcttaggttgtttcgtcaaatattttttttgaaaaaaatagtaatggatcgaatcagattgcgagctgcatcatcttgaatttatcgtcgtaagcttttcgatgcatggttagacacatctggttgaagtcatcgaaaaagagaagaaaaagaccaacatgatcatctgctcacagctcactgccttatcggccatagccaaaatattaattttaaaaccgttttatcatagtctattattttaaacattgatttttaatctacttataatacatacttcataaatcgttttgattttttctaagataaacttatataagcaagtttatggagaaa

SEQ ID NO: 86002 - DNA, 8324 bp, Oryza sativa
ttaacgtgccatttgagtcccaatttttctatggttggtttttgtgtgtccctaagcgtgaaaaaaatatcaaacaaataaaacaaaaataaaaaatttcggggggggggggcgccagccactctggcgcactccctagccacctcagcatcgccccgccacatcggcaaggggacggcgccagagaggctggcgccatcctgttggacgacggcgccagccactctggcgtcccaaaaaggaccatttttgggataagtttttctaggggtctatttgcgaaataagtttttcaaaaggaccaaaatgtgaaaaatccacagtgtagtaccaagatggttttcagttttcacctgaggggtgatccatgtgacagacgtacagtagttgtagtacctttgcaggtgttctgaaccagtattctccattatagtgccataattgacaatcggtacatgataatcggtaatgccgtgcagagtgttttttttttctgaaccagtattctctatgtcctaccatgtgtactcctaatttgtccaatacaactatactgcatttttactgctacatatctgcaatctgttagcaatccaaagtcccagagcttcagagagaggggggagttggaaggaaacctgatgcaggatagcagtagcaccaatggtcagaataagagcagacaagctttatatcatcctaacccaaggaccactattgatctaaccgtaaagacaaaacaatgacaaaatgacaagagaaaaattagagctttgtggtagagaccatgtgcttgagttccccagatgagcaggtttcaacactggctgggttcttgcgtcgtttgtgtagtactccctccatttcacaatgtaaatcattctagcatttcctatatttatattgatgttaatgaatctagacatatatatttatctagattcattgacatcaatatgaatgtgagaaatgctagagtgacttatattgtgaaacggaggaagtactataatagtggaaaatgctagaataacttacattgtaaaacggaggaagcactataatactggtaactttgtaaaccttgatttcagagggaacccactctattacaagtgcgtaccactactagtctacacatcgaaaattccaagttgcaaaaaggaaaaaaaagaaaagaacttgcgtccagactcacactcctaatttttaagttaaatctacagtacgaaagggcccagcccattgctctgtcgggctctcggcccatgatactcctaatttctctctgggtccccgcttcgataaggcccatataaagccttgaatagaagaatcgagcccatggacacacggctccggctcgtccacgcccaatcgcattcgcatcgtgattattctctctcttcctggtcacactcacgccaccgccacgggctaagattccaccggcatctttgcccttgataacaccgaaagttttcccggtttccgcagagccgagccgagccgcgccgtgggcgtttccgccgccgaagctttggtcatgcagcgcgaggagattggcggcaaaaccgcatccaaccgtccatgtccccggggacggagctcctctaacgtaaagtgaaagagccccacttttctctaagggtctgtttggtacagttccaactcctaaatataattttaagagttaaatttagagtggagttgtggagctgcctaaacccagctccacaactctagtacattttgtgagagagcttcacccagctccactcccagttttagtggagctgaaactatttggctgagctctagctctaggagaggtgaagctggagctgtgctaaacaggccctaactttatgtcagagaagcctcttccatccccggggcggggcgtcgtttcagggaatgggggacattgctatatttataacgacacaaaatcagcttacaatattattgtttaatgtttttttaatattactgtttaatgttagaggatatgatttccgttttataatgtaagcaaaatttagtcaaagattgacaaattcagtgtcgctcaagagctcaactaactacaactgcaaaccctataaaagaaaaactgaaaactgcagaccagtagtagcagtacacggaacgcagcagctcagcaactgtggttcattgtgttttgtttatactccgtagtaaagcgtaacgaaccgttgggcgtaaacggcggcggatcacacgctcagtggtacgtaggagtagcggattccacgaatacactagtgtagccgtactcgtgcggagcaaataatgaatagtagtgttagagtagataatagcaggctataagccagctataaacatattttaaagaagtaaagaaagagagagaaaagtagcgggctatagatctatagctagttgcagtacggactttaagacgtaatgtgtgtatgacaggtaggaccaggtattaatagtatagtaagcaactattgtacgaattggctattacattggctatagatgatttgaagctagtagttggatatactattaaacttgcacttagaagaactagtactactgtactaggctttcttctccaccgaaagagatggtcccatcgaaaccacgtgggcgacacgcacgcatgtccttcggttggtccattttgttaacgtgttccatgcatgttttgttttccttggcaagataagcaatgccccgtcccctgcaggaataacttactctctaagtgcaagcacaataaattgcatattagtagtactaagagcacccgcaatggtaaagtaaggtattatctataaaaacatgtacatctcagcaatatactagattaatagtaaaccacttcaatagtatgtctacatgggtatctatagctctctaatccattgcctcgtttttctctatagactatctccaggttagtagatagctttgctctctctcttcatttaatctcttccaagtaggaaaatatgctgacatatatctctcgtagagagcctatatataaccattgtaggtgtcctaagtactactgtcagcgagtcacctgagcagtttagcatcgtaatgtggcctttcagtatagtatatatttggcactctccattattcttctctggtcacaactctttctccattattccaaccttcgatgtggcctttcagactttgagtacaaactctttctctagccacaactctttcctgggcaggtagtagtagcctacagtatttgcctcgtggtgctccgttgtgcaacgcaacgcgactccgagattcgtggggcttgatgaaactggtagatacatatttcctccgtctcaaaaaaaaaaagacaaaccctgaattttcgtgtccaactttaactattcgtcttatatgagattttttataattcgtatttttattgttgttagatgataaaacatgattaatactttgtgcgtgacttgtctttttaatttttttcattgatttttcaaataagacggacggtcaaacgttggacacggaaaccagggtttgtcttttttttttgggacggagggagtacacactccacccacccgacacatcgggttctcttgccccatacccacacccacgatgtctaaatactcccacttaaatacccacacccgtcgcgggtacaaaactgtcctcatacccatacccatgcgggtaacgggtatccaacgggtacccatacccatataattgacttgtaatatttatagttttgtactataattagccatattagagctgtaaactatcaatattttctctagcaacaatgctattaatattagtgttcaaaggcgagtaaaaaaattatacaaccatattacataatcaagaaatcaaataataatttcatataactagactaagcaatgctttaagatgtgaaaggagttttatgctatgatttagtagtcgttgagagttataatactaatagttttagattcaatcaacgggttttttctaccaacgggttggtgggtacgggtgggtaaaaaacagacccatacccacccgttagtagacccatgggtataagagttagaacatgattggctcctaatagagtaaaaacccgtcgggtctcgggttatgggtacattgccatctataggcgggaagacacggaacacctggcagcctagcctgcctggccgagactctcccgtacacgcgtcccctgtgttgacctgaccccatccatcgcaccgttacaagaatcacacgcacgcgcacgcgcattcgtcgacctcgacccagtctgcacagcacaccacagcacagcagcagcgcgtagccgatggagccctacgcgtacgcgtgcgcgtgcgcgagcccaaggcggcgagcgagacggacatgtgggttgctgcggtttgctccccccgcgaaaaaaaacccaccgccaccgccactccgtgccgtcgcgcggcgcgcgggggtttgtttgggcttgggccggcggccgtccaaccaaaaggctgcagcgagtggcccactgctctgacgtggggatggaggtggcagtggcggtggcacggggggtgacgtcaggttggttgggttcacggcgtgagctgaccagtagtagggagtaggagtagctgctagcggtcagtcaacctagaaaaggcccaaatttgacaaccggcagcagtaataactcctcgccataagagcaagttcaatagtatagcccactaccagctccaattcatctatagccaatctaatagctcatttatacaatagttacatactacactattaatatatggtcccacctatcatacacacactgcgtcttggagttcgtgctacagctggctacaaatctgtagcccactacccttctctctcctcagttatctccttaaaatatatttgcagctggcttatagcctgttattgtacctgctctaatcggcctcctcccactttttcatgcagtggttcgtttccctgtaaaaagatcaatttatacagcactgtactaccactcctaattactcctatctaacaccatatttagacactaaactattactgcaacgaatataaattcattacactcgatattgtttaattgtattagtatattttaaaatggatgaagtataataatatagtactgaaatatactgtactggtattccagcatttttgcatctggttttgccttgatcaatggtcactatttcgttttcttttttcttttggtcaaagcagagtactagcattgctttgcttctcggatagttggatgtcatgtttgacagactgcttctacagatcttttttaaccttaggcgtccattactgtgtgttgagcagaagatgcacgaagtcaaaccgcatgaaaaaaaaaactaaccaagtccatgtatatatgcaaagatattcacggtggtattaatcctaattatcgtactactaatagtacattttgcatccccgcaaaaaaaaataatagtacattttgcagttggaatatactacaagtataattgaacttgtttgctgttcggcaaacggtggtccctcgtacaaactggaccaactaaaattggatgatattaacgtcctctgatcctaaccaactcgatcatgatttattcctctccaaatatacgaaattaaatgccgcatttatgcgagaatggacattgaaattgttatgaaatgaattagctccactaaaataatacatgtgctctctcacctgttattttctttttcagtagattccttttcacaaattagagacaaataatctagtattgaaatgttggcgggaaccaatagcatatgtaacttattgtgtagaaaaggatttgtcttgaatgtttagacgccatttgatcacacaccacaagttcttttttctctttaaaaagacttactagattttatctgaaaggtgatgagaaatcatcgtagtatacgatcactactccataaaaacggtaagtaagataaatcaatcaaacacacctgacatctcatacttaattatcatcaatattgatcggtaactctccgagagcaataattcctagctaatttggtgtacgaacaacaactaattagctgatatatagcaaatttcaacaagtggtaaaaggcacatcaatttttttatatctcaaaaaggtgttatcacactacaatcactactccataaaaaaggcaagataaatcaatcgagcgcttcatacttatcatcaatgactatctctgataaataactcactgagtacgtgaatttctaatttgctacggagacaacaactagccaagtaatagccgatatgtagcaaattccgataagtggtaaagttgtgcactaagaagaaagtagcaaatatattctatttatgtaactacatcgtttcttctcgattttatctcaaacaggtaatgagaaattaccatagtacaatcactaatcacgaaaaagacaagtatgagaaaccaatcaaacacatccagcgtcttatacttatcatcaatgactatcttcgaccgttaactctctttcaacaaaaattcctaatttgcaacacagacagcaactagccaaaacaatacccgatatgtagcggattccgacaagtggtaaagttacgcactaacgagaaagtaaagcaaatatattccatttacatagctacattgttccttctcaatctctccctctctcccctacagttcccctcacttccaccagtggtttccccacaacacaagcagttcaaactccaataatccgtgtgtgcccatagcaatttcgtttgtaggctaagctcaagttagagcaatgggccttggcggcgcgagaagtctcagcgattggcttaatttcaagttagtctaaaccaaaagatctatcttgtgcgtgtgtagcttatttcttttgtacagttattctttctatattcaatgaaattagcggctcaccgattcgcttaaaaaaaatagctagagcaagtaagaaaaacacattcccataccggcacggtaaattgctacggccacacgggaggtgatacagctgatcggctggagcaaagcaggatgagattgcggctcgtaatctgcgagcaatcgcaagttcgcaaccaccaccaccacaatctctctctctcggttggcaatttggcgtgtcccctctttctctttctctctcctctacctctcggcgtggtggtggtgagcgagagggattgggatagataggcacgcacagggtaggggggacgacgagacgagggatcaatcagaatttagtcacgcacccaggaacaccaagaaaaagaaaaggaaaaaccttttctttctttcttcactttggttgcgttgcgtctccaatccagcgtgcgttgagtagatagatggtaatgccgcccacgaatccgtggcgagttcttgcgtcgcagagtggcaatctgtaggagtttctctgggggtttgttttttttttttttaacggaagaacagaatcaaatcgaatcgaatcgaaagagaacgtaaattaatctgtggtttcttggcggcggatcgatcggcggcgatcggccggcgatggcgccgccgtcgatggattactggctcggcttcttccgcggcgccggggacagcatcttcgacgccatcgacgcggccatcgccgtcgcggcgtccgaccaccccgccgcgctccggtcgaggcgggacgccatcgccgagcgcctctacacggcgcacctggtccccggcgcgccgccggcggggccccccgcgggcggaggcgccgccgccgccgacgcgccgacggcccagctcctcctccaccccgagggcgccgccagcgtccctagcctctgtagctccgaccgcgccgaggtcatcaccgacgacggcgccgtccctcgccgcgacgacgaccccgtcgccgccgagaccgagcgcatcaaggccatcctcctcaacgaccaagaaaaggtcctcctcctcctcctctctctctcaccatcctccacttctcgtactgaatctgttctgccatgttgatgcagtcggaggcgacgttgctcgagctgctccggcgactgcagcagctggagctcacggtggacaccttgacggtgagaccgccgccgccgccgccgcagccatgccaaaccaagctcatgtgttgactagtgtgttcatgcggattcgtctttgcaggttaccgagattgggaaggcggtgagcagctaccggaagcacaa

SEQ ID NO: 86003 - DNA, 3508 bp, Oryza sativa
agatagccatgcactcttgaaattttcaaagagaaataaatggaagaggatgtatacaaaaggagttattgattcattttttttccacccacaaatttaccatacacatacacatacacatgcacattcttgaccagaaagtatgttttgtatttccgtggatccattatttgactttgcaatatatgtgatgcaagtaatgctctactcttttccataccctgagctccacaaaagccttattagatggtaggaaaagaaaaggcacaatcatatgccttgtgaggaatcatacactttgagcgatcgaaagaatcaatggaggagcaaagcatagttataattttgtgttacctcaaaaaccacaagttgttcttcatgaaaaattagggtgacttaatgtcaagattgttccatttctcaattgctcaagatcgcatggtagacactataaagatcgacaagtacaggtatggctttgaataatttgtttgcatgatgattagttaggaagtcataactctgttgtagagtccatagccttcactcgggatgagcaaaggttaagtgtgggggtgttgttgacggtccttaaatcataatatctgaccatcaatacctgcaaataatgaaataaaacacggtatccaacttagtggtaggtgttattactaatcatttccactagtgttggtgaaatatgtgtatgcaggtaatttgaggagaaaacacatccgtcatgtgacaaaatgcacctccgcacattcaggatgcgtttacacggattagaggcccaataagtcaataaaaactatttagaattggaccaaaacatcgcccaggttgttgggggcccattaaccaacctcccgaccaaaggagaggccaggaggagagtttttgggttcggccgaaccaatcctggtgcttcccgccaactactttcacctggacgtctcggatttctccccttaggcagttgcagggtgttttggtcatttcccatacccctaactgtcatttggagcctatataaggaggtcttcatctcacttcaagcacacacaactttgagctgaattacaagaggctctattgtatcttttgtacattagaaataggtagaaagcgaggggaagctctgaaggagtgcccggaagtttggcgctcatccgacttctgcctcgacgagtgtagcttcctaggaggaattctgaaggagtactggagtatcggtgagtactggagtactggccgagtagcttcctagatggctacgaaatcagtcttggctttatagccatggttcgagagaaaaccttctctggtagtatcggtgaaaatccatacctccatcttcaggactttgagctagtgtgttcgtgcctatctatcgtcggcatgacacatgatactcttaagtggaaattgtttcctttttctcgtagagatgaagctaagcaatggtacactctatctgtcaagaaattccactgtgaatgggaggagcttaagtgcaatttctgccttactttctttccattaacccgtgtaatcaatctttgagtagacatcctttcttttcgacagaatgagaaggaatatctcggtgcagcctaggccagtttctcactgttaactcaatctggcccagacttgtcgttacccgaccacgtgttgttgcaacattttcggtacgggttagacaaggagtttgccgaaaatctcaatatttctgcccgaggatcgttcgcacacaagacaaccgccgaaggaagagaactcttagatttgatcttagagaacgattctttcggccgaagcgaatccgtcccgaaggtcgagattattcatgaggaacctctgcacgtggagttggaacccgactcaactgtcgaatcctcatcccggtcgcaggagccggaggaagaagaaattcatcctccggaaatttcattccaattcgaggaggatcttttcgaagattattagaacaccttgaattattcctgagagaagagaccaccgaccaaggtcaattctaatgaacctcttgataaatctatgcttaaagagacggtgaagaggttgaccatcatcatgagtaacaaatggttaagagaaggagagctcttatctgaatcgattcagatccgatgcccctcctcaaccattatgtgtcacattggaggtaattcggtccgtgctctgtataatccctctgttggtgccaatattatgtccgcaacctttgcattcgattgcttaggggacagatcgttggaaccaaccgtcagaaccttccgaatttccacaaactctactaccgaaggtttagggattatctctggagtgcccacacggcacaacagtgttgaggtcatattagattttcatgtgtttgaaatatatgatttcgacatactcatagggcatcccatagaaaaactcttagatgtgcccgaaaccggtgtccttaacctgaaaataggaagaattgccacctccgtccctatgttgcaatcaaccaattctttgatggagtctcttcctgttcctgagccaattgagggagtgatggctatttctccattcgagaccctagagtctattttcgatgaatccatcgaagaattcaatgaaggggaggatgaaactggagaaacgatggatctgccaaaaacggatctgccgtcacgagccccaattgagctaaagcccttaccgtcaagcctaagttatgcctttctgaacagcgatgcggagtctctagtcattataagtgacaaactcctgagagggagatggcccgacttatcgccattttagaaaagcatagtgctgcttttggctattccctccaagacttaaaaggcatcagtccgaccctttgcactcatcgcattctcttagaaccgtctagcacaccatctagggaacctcagaggaggctaaataatgcgatgagagaggtcataaaaaaggaagtcttgaaactcctacataccgggattatctatcccgtaccatatagcgagtgggtcagccctgtccaagtagtgcctaagaagggaggcatgacggtcgttgaaaactcgaacaacgagttgatcccgcaacgaaccgtcacgggatggagaatgtgcattgactataggaaactcaacaaggctacgaagaaggatcacttttcgctgcctttcattgatgaaatgcttgagcggttggctaaccattccttcttttgtttccttgatgggtattctagttatcaccaaatccccatctatcccgatgatcaaagtaaaaccacattcacgtgcccatacggaacgtatgcatatcgaagaatgtcgttcgggtagtgcaatgcacccgcgtcatttcaaagatgcatgatgtctattttctctgacatgatcgaggatatcatggaagtcttcatggacgatttttcagtctatggtaaaacattcaatcattgtttggagaatttagataaggtctt

SEQ ID NO: 86004 - DNA, 1378 bp, Oryza sativa
cggaggcagagcttccccccctctgccgcatcgccctctctccctcctccttttcccccaaagtggcaagggggcaaccccctttctctcccccccttttcccttttccctcccgccggcgtcatcctccccccccggtcgccgtttgggccgcgaccgccgagcgctggctcgctcccttgaccgcccaaggtcggtttccaaaccgacattgccgtcctataaacccaggcgccctcccttccttttttcccctcccaatcttccccgtttttcacccacgccattgccgtccctctcgccgaccgccgccgtcgcgtgtgccggaggagccagtgcgcgctaggacgcggaaggggactccgggcgctcgtcttcttcctcttccccggcctgaggccggagagatcactcccgtgccgtcggcctctcgtcactgcgccccatcacccccgcacggtagtgcctccctccgttctccctcctcgttccatctcctccccttagactcgggtagtagcacgagtagcctccccgtagctagctagcgccgccccgaccgttgctgccgctcgccgtgtgctcgccgccgtcgccgcccgtgctccgtagcacccgttcgtcgccggcctcgctcggcgtagctccgccatatccgacgctagcaacagactcccggagtcgcgtagatgctctagctcgcccgaatcggtctcccgtcgcgccgtcgccgtttcccccttctctcgccgccggttgccgctaccacaatccgccgccgtcgagcatcccccggcaaatccgagccgttggctcgtctcccctcatcccgtgcaaccttccggtgtgctcgctttcgcctgtatcgccgtggttcgccccgccgttcgcagccaccgtccgccgtccgttccggccggcgtcttcttcaacctcccgccggtccgcgtggcaaccacataggcaagccacctttgaacatcttgagcctatatttgaacttaagtatgttgcttgaaaaatattatgcattgataggattgcacttaatctacatgtcccgtctgcaaggcagattggcggacctacctaacttgttgcagttgacccctccattgtaattattataccatgttcccttgtaaccacctagttacgcctcggtaatcgtgcactctgcacgaatatcgacggtcgccttcaaacttaaaatctgataaacatcttgggtaaaacttaggttttacaaaacacttggaaaacccgacacctgggtcggtgcttgcgaacctaaatgaatttccaaattcgcagaccggggaacgtaccgggtgtacggttccccgctcttgcacttaaggaccgtttccttagaatt

SEQ ID NO: 86005 - DNA, 1507 bp, Oryza sativa
aaggacatggggaaggcgctcctccacttcccggcgtccctccgatcccggcgtcggacatgccgcacaacgtgctcgactgcgcggacgtgatcggtgcttcgctggtctatcactaccgccgcatgccggagccggggcatgctgatcaacacctacgaatggctggaggcgaaggccgtgacggcgctcggggacggcgcgtgcgtgcccgaccgccccacgccgccggtgtactgcatcgggccactgatcgtgaagggcgaggacgcggcgaaaggagagcgccacgcatgcctcgcgtggcttgacgcgcagccggagcggagcgtcgtgttcgtcagcttcggcagcatgggcgccgtctcggcggagcagctgaaggagattgctcgtgggctagagaattccggccaccgtttcctctgggtggtacggagcccaccaccggaggacccggccaagttctccctgccgcgttctgaaccagactgggtgctctgctcccggaggggttcttggagaggacgcgggacaggggaatggtggtgatgtcgtgggcgccgcaggtggaggtgctccggcacgccgcgaccgccgcgttcgtgacgcactgcgggtggaactccgtcctggaggcggcgtcggccggagtgccgatgctgtgctggccgcagtacgccgagcagaggatgaacaaggtgctcttggtggatggcatgcagctcggagtggtgatggacggctacgatgaggagctggtcaaggccgaggaggtggagaagaaggtgaggttggtcatggagttcgaggaagggaaaaaactcagggatagactgacaatggcgaaggaaatggccgcgaaggcgctggcagacggcgggtcgtcgtcgttggcgttcaccgaatttctgaaggatttgaactttggaaacactacaaaggaaaaagcgtagaagacgaacattgagcagtgcaaacgatcaagcacaaaagatgaacattgagttggaatgatttatattgctgctggaatgtgacaaaatcacatatctgcattatttacccgctgtgaactgtgctatttttctgtatttctgatgtgagcagaaggtgtgagagtttcttcaggctgattagctgcttcagcagtcagcacttgtagattacactctggagccgtgcttacatgatggaatagtattatgctctatcacaatatgcaagatcaatgttcctcttctactttcggtttgttaatatctggcaattaagctgagcgtgtagagaataccacatggtgcaaaagctctgtctcagtaggctggagacttccacacttcagtagactcgtgtgtacaacggaaactattttcaccctcgaggggatatctactcgttgtttacatgtcactcaaatggttataaaaaaattaagaagatgtattaacatgtgatatatcactctacaaatatgcaagttcaaattcaacttctacaactcgta

SEQ ID NO: 86006 - DNA, 8144 bp, Oryza sativa
ccgccatcgctgtcgttgtctaccaccagctgcgccatcgttgttgtccaccatcagccacccgtcgtcgtcctcaccaccagtgctgaaagaagatttggggaagaagggttggatcggatgtggaggagctcacatgcaaatatgttgccactctggatggccacataagctagtcaacccggtcagagatcctttagacctcaatgagtcacttaaacaagaccgtggatcctaatgtcgatttttcaagatcatggacctaagtgacacctcgctccaactttaaggaccgaccgtgtactttactctaggtaaaagttgataaaagaattgccaaacttacaagattgtcaatgaagacaactgtgaaagggcatttggaatcgagcctgtcaagttgttgtttgatagatccctgcaagatatggagcaagattttccaaattttaactcagattacgcaaacaagttaatacatccgacatcatgaactcataacatacaaatattggagggccttgagattcccaaaagaggacgatatctcaccactcaaaccaatttttgacaggtttctgcaaagagaatatgatcagcccaatttcattgcacagttaattagctcccattagatttaatttcctcttgctatttatgcatgtgctgatttggcattctgagggtgctaataataataataaaaaagatcaggctggtgattgatggtggtatcgaccaccatagattgtattaaaatttcatatcaaataaaaaattctattggaaataacatggggtcttaattaatttttactgccatgcatggcctctttagtttcattagtatcctaaaacttaataatttctaaattcacaagcaacaagtatatcatctcttttattaatttaattttgaactttaaattaataattagcaagttataattgatgggttctctttaattattttaatctaagccattaactatgcattgtgtatacaattaaaattttcatatttacaatagtttaacaatagccatacacgtttgcactctttttatttgggatggaggtaatagttttgttttttcatcacaatagtcatgttgtttttggctaatggaatgaattattacttacaagctcgtgattcttgcagggttagaaatggcatagctgcaggtcaaattatcccacgcaagatttctagggaggcacgggtcacccatccaattctttttcacctggtacttcgccttgatcgtcatgattgctgatactgtcaatcaccaaaaaatttcatcaatgcacatgacatgcttgaccatcagctagctcatgtatgtgcatatttcagtttttctcaaattttttatgaatttagtcaaattctgttaaattgtgtcaaaatttcagaaaatttcggtccaaaaatttctgaaattttcaaaattttaaaaattttaattctaccgaaatggctgaaattttagatgaaatcgaaattgaaaaccctgagcacataccatcttgtgagtcggtgccaatgttagcggtggagatgacagagtacacctcgacggcgttgatgagcggcggcatcgtcgagttggcggtggcgttaatggtgatgttgtactgcgggtgtcgcacaaagggtttggagctgtaggaggcctcggcgtagagaaacgatggtgtgaaaccatcgtcgaacaatatgccgttgatgttgatatagaattgccgtgtggcgttgttggggaggttctcaagctcggagaagtgaaagatggcgatgtaccctggcgctgggtcgttgggctgcggctgtgagttccagaagaagtcgatgttgttggaggcgttgattggcgtgaccgctgtctgcatcaccgccgtcggcgcctcgaacaggtcgttgtctatgttctgaaccctgtttgtcgttgatatctcgttccacttggccgcatcaaaccaaggaaaccatactctgtcgtgcggatcatccggatacctggccattgaatcgatcagttgcatttcctacagataagggtaattttaccatccttaaaaaaaatattagaagatatcatattttctaatttaaaaattggtactttctcaaaaaccgtaaaatttatctacagagaattagagcaagtttaatagtatagccaactattagctccaatttatctatagccaatctaatagctcattcatacaatagttacatactacactattagtacctggacccacatgtcatacacactgtgtattggagtccatgctacagctggctataaatctgtagcccgcttcccttctctctcctcatctatttccttaaaatatgtttgcagctggcttatagcctgctattgtacctgctcttagctaaatatctggctcttatcgggaaaagtgatttcatcctttaagagatatcccctcattttgcatgttggtaatcagaaaaaatatatgaaagtatctgtaaatacgaatctaatattacgctatttatatcactaaacctatatattgtggaaaattttatgatatttgataaagtgcctaaagataccaagattttacaccaataattttgatacctcaaaatatttagtaccgggaggtaccaaattttacactaaaaaatatgatacctttcgataacttcttaagaatagtaaaattaccctatattgtgagactaacttttagttaaaatttatcgagtttgaattatcaccagtaatactgatgatagtataaataaatgatatgataataaatataaacagtctatacgcgtaggaaactttaacttagctcacctgatggaggtttcgtcagatgggccgaagttgagcctggcgagttggagtaggccctgagtggcgttcacctgcgggtagagcttgttcataagaggcctgaggtccaacccggagatgaacggtgtcccggcgccggtgttcaccaggcagacttgcacggagtcgtcgggcacgacgacgatggcctcccggttcaccggctggatcgggtccgtgatgttcaccaccgtccagaagttgacgccgatgtggaggtcaaacgacacgggcagcttgttgaggccgtcgtagttgccgtacatgaaggtggcgcggatgagatacttgaggccggccacgagcgaccggagcgtgtagcagttgcgcgcgccgtcggggaagctgcgcacgttgtagtagcgcgccgtgaccgccggcttgatgtactccggcgagacgttgtagtgcttgccgccgtcggtgaatccgtcgtccgaggcgtaggatatcttggtcttgtcgtcaatgtagctcgtcttccccgggagcccgcagtctacgctgatgaaacctgcaaaagcatgaaaaacatatgctcttttagttcattgaacattgatgtctttttgatttgtgaagcattgcgcgcattactatgaggtaggatactaggattgtactacgtacctttgctgtcaggctgggcacgagcttggagtacgccggcggtggcggtggcgaggcagagaagaaacaacgacgaccgtgccgccattgttgccggtgatgaacgacgctccattgcacatgcagccatgcatgcaggtagcaaagctgctactctctagggacgtgctccatctatttgtaatccagcattccagctagtaaacaagtgaccaagctaataatctcactgtcacaagctaataataactagccaattgatcatcacaaaactcaatcttgattaatttaaccacgtcactacgtcagcgcatctatccagattccagtaacaaagagcgcctcgctttgtgggtcatatagatattcttccactgacgagtggggctattcagaatttacactggccacctctttgtgggcccggcatgtcaatgaccctgagggaagaggcgagtgtatcacatgggccgggagttgacttgtagcccgctggtcaactgctttgctgggcgaaggacttggaggcccgagatcggtggccacggcccgtcgacttgaccttattttccgcgccggaaactatgagcaacaagattattatgcacttgcccactacgtaaaagaatttgttctctctgtcagagaatgcatctgaatctgatctggcagttttgcacaagagacaggcagcgcaagaagatatattttgcctctgacggactgcggctaattagtactaaacataattaggtacctaaaagttttagtaggagtatctacacgactctttggattaaatgatttggtgttttctaaatctccaattaaaacttgcatgcaggtactctagaacaacacaattcagttttaggctcagctgtaacggcgttaaaagaaccaggacaatattcatctcgcataccggaaactggaaacaccggttatgcaagtattcgtcaatcatgcatgagatttagtaataggattgctatgtaagtaatatcttttcaaccaatagggctccaaagaaacatttcaagatcttcatcctgctgtgcctttggtgtctctggcttcacagacacgacgtggtgttccgcaatgctcaaccatcactgctttcagccctgtcaaaatgccaataggaagttaacctctgggcggttcgctttggtccgaaagaccgtgatattattctggcttggaaaaatgtaatttcatcctctgttcatgctctaaattagttgtaatctggactgtaatccatcttgtactcaagtgctattgcttattgacagtttgaatgaaattcaggtggggaatctctcccctccagtgacttggtaaaaaaaaatattttcaaccaatggcaattgtttcttgatttgttcttatctaatgtgcagccaagtcttggcggagctggcggcacaagaaaggagcacatccaaggctacggaagtcattaagggtgtgtttggtttctcgtatgtccccagcctggccgtatccctcatccaggatgccctcagcctggctagggtaatgcaattggttgtgtttggttacttgcatgggtttatcctggatgatatgagatgttgtttgggaggagctgcgggagggaaggtgaggcaaacgagcacacccgctcagcaacgagcactcccgccggctacgagagttcgcagcagagggagcacccacgacggtgcacaggagccccaaaccctagcttcttctcctggggagtgaaatgaggaggggatgtggccgtgcggggaggtaaccctcgcctgcaacgaggggttgtgtgggtgcagttgcgctgcaccggatcagcctggatgcgcagcgatgctcccccctcgcgtttctgctcaacttggcccagacggcgattttgaatccgcctagcctgactcgcgggccggtccagccaaccaaacaagttggattttgctggcttgatgcgatgcaggtgcggtgcacccattcaaatacgccctaattgatgaaggtggaggcgcggggaaggagcaactacaagtggtcactagcggaggcggccatgtggtcgccggcagagatggctgagtagggatggagcaacccctcacggggaggaagcaacggcaagcagctggagtctgtggacagcagaaaaagtaaatagtagaaaatccttttatcaggaatttttgtctaacaaaacgaccttagaaactctaactaggaatgaggctactgagtagcagtaatgagcaaaatattaacctcttccgtgttatgcttgctcctgaattcttgaagtcatttatggcttcttggagtgcgtgatgagtcggcagcaaattattcgcgggcttgatctctctcctctcacccccatcgtcatcggctcacatcattttattacacttactcttatgagtgaatacaatggatgtgacccttgttcatgttacatgatttccattgcttgctagtccactaagtgacatggattccatttgatatctcatcttacattatcaagcaaagtacatttattgtgggaaatcataaaatttggattctaaattcttgataactatattccaagataaaaaaaattattaggtgtatattgacttttctcttcttgaagaatagtatggaagagttataaatatcaaagaatagataagtgtattgattacaaattccacacggtaaaagctctagatcttgattgtttgaaactttatgcgcttgcatttactttggtaaattaaagcaacaatattgtttcagttctgcatgtatctattttaggactagcagtctcggatcagattggcaaaggcctttatcgtgcaactggccctgtagccatggttggcactctttcaaaattatgctccatcgtgttgttttgactcacatcagtggactggtccgtgttgtacatgttataacttgagttgggatcattgttgttgccggcatagaagttgttatatgtatcttccatgccacatcgcctatcctcgagctctaggcactcctgcagctgagctaccacatcggtcatagtgggtcgttgtgtcgatgtctgtgcggtgcatttaagggcaatgtctgcggccttccacacaccattcacatcatggtcaccatgcatgtgtgcatccaccacaccttcgatgttacctcgtgccaaacgttgccgtgcccactggatgatgctaatgggccctggttcacgtagaatagacggcttccctgtgatcaactccaataagacaacaccaaagctatagacgtcgctcttggtggttggttgcattgttgcttggtacctacatgttcatccagttccacaagcttcacttaacatttgtaatagaaaacactgaacaacggtttcgagaaatatagatgagatttacatactctggatccacatatccaggtgtgccaacaagcgtgttcgtagatacatgggtgtcattaacgtgattgaatgtcttggataggccaaagtcagcaatcttcgcctcaagccttgtgttcaataggatgttggtcgccttcacatccctatgaataagtggtgggttgcacgccttgtgtaggtattctagccctaaccattatcagttatccaaataattaaactagtgatgatcaacttctagggaaaagtgtaaaaaagcatacctccaaacactttactagaattcaagtagttaccttgtgcagattctagtgctattcgaagcctctctctccaggttaaatatatcctgttgttgtttttacctataaataggtatagaatgagaattgaagatcatgagagtcatgtgaaatgatacgttagatgaagtattacaatgtatcctacaagttgatcataaacatcctatgcatacctgcaatgtgttcttgtagtgttccttctgacatgtactcatatacaagtgccatgtattccccatccttacagtaaccaatcatagagacaagattcttgtgatgaatccgggttaaaatttgagcctaacaagtgaaattaaccaattatatcccactagcaacaacttggtgtaagtataggcaaagcaaaatatcaactgcagctgaagaaattttacctccgcgaggaactccttagcaccttgattggaagattcagaccgcaatttcactgccacttgagtgccatcctccaagaagccgtcgtaaacgtacccaaaccctccacggccaagcacccgctggaagttgttcgttatcttctcaagttcattgtacgtaaatcgacgattcttaagttgtagtgatgaactatgcccgtatccgccatttgacgacacattgctcactgtctcattttgtggcttcacagaattgctcattgctgctaaaatatgtgaataagcatcactagtgttaaaaggatgaacaagtagatggacaattactgtgtttataacaaacctcaccttgctttttccgtctcaacaggcaacaaagtagtactgccactgatattatcaccacaaccagaactataactattggaataactatgtagatagctagcttgctcttcttttttgctgg

SEQ ID NO: 86007 - DNA, 4315 bp, Oryza sativa
gtcttcaacacctcgaaattctgaaaaacaattctatattgacatttgccaacatgtcaatttaaggtttacacaaacacatgattttctacgtaaagtggcacacggattaaataaataaccaggaaaattcatagtagtttggagtatgtttcctagaatgatttacaataaaaatcggttgacaacttatttttcttaaaacccatccaacaacgggttagagaaccttcatgcaccagaattttggcattatcatcaccaactttaaatacagaagcaacttgtcacgtagactcttgacaagttcacttgagtcggcatcaattttgggtcatgttttaggatcaattctgaacatcagatcagaggtgtactttccagttgaaattctacagtaacagaagttgtctgcactacactggaaacaccattgctactgctgtagtgatttactacaattaactgtagcacaagactcatttcagtattgatgcacctctgcagtaaggatcagtttccgttgacactgcttcctctttttttccctcaaaaacgcatgagagcattgctcccatttttatcaaggtaataagctgcatatggtgtcacttcagctaacaagaccaacctttgcagatcaaccagtccaattaatcaggaaatgggccatgctaacattgaggtccaaaaaaatctcatatgactgcctgctacatcatctcaatggctaatgatcatattgttctgctaacactacagatataaattaagtgaaaagattcaggactgaattttacagctgcagaggggcacttgtatgtcttaccagccagggtcagatgcctcccagctgccatcccatggataactgctagaaaataaaatgtacaactctgattccttatccgtttgtgctacaaatagatgtcaagtcaaaggagtaaaattataaacacataaccatggaaaaatcaggggaaaacacagcagtccaacaggaaaaaaaaaatgagtttaactacagccctcagaacaaacaatggcacaagatatgatggaaatatagaggcaacacatggtcttcaggagaagttaagtgcagttcaacccagggtataaatgatccacatatttctcataatataaaaactaaacaggaataacatagctcctgaagaaaacgatttcagaatttcaggctatctgaacagtataggatatagtaaaatctcatagatcaccaaaaaatccaaataaagcaatagcagatgttctcatggatagtggtaatcttggacaaaattgaagatcattacagcatgactccaagcatatatacacaaagagacatgcacagaacacagaagatccaggatattatattctaactcagaacacacatagtttgtctaactaaagaaagcatcaacggattagatagacacactagtgggaggtttctgatgtcaaagggtggttcactgaactttacaatctgcaatcaactgtagaacgaaattgctagaattaatctcttctacatttgaacatacctggcatcaagtgtgacatgtgcagtagtatagcccttcatggaatccaaatagaaaaacactaaaaaggggaagagcttagacatagtcaatcaagaggacaaggccattggattgtgaatgtgattcatccatgcaaacaagatttgctatggtcagtactcagtaaacactaaacaatatggaaataatgtaggctaagcaagttgttaacattgtgaagacgtgtgacatccaaaacctgaaaaatcatgatggatttaaggcaacaggaatatatgctgtacagataatctgacagcatgctttatgaacattcgaaatacaacatcaccagtggcggattcactgttggggctggttggtgtgccagccccacctctaatccctgctcttaattagttattaacaaatctaattagtcattagtgaagaaatttcccgaatagcacaggctaccttagttcttctactgcccaaactgataaaacagaacatcctccaagtataaataacaatatattcacatatatttgtgaatattttaatatagccacaaatcaaaatagagagtttttttttatcatatgcacatttggttttcattggaaaatactttagttgatatacctttatttgttttaatcatactccctccatccctaaatatttatgccgttgacttttttaaatatatttgaccgttcgtcttattaaaaattttaagtaattattaattcttttcctatcatttgattcattgttaaatatacttttatgtatacatatagttttatatgtttcacaaaagttttcaataagatgaacggtcaaacatgtttaaaaaagtcaacggcgtcaaatatttagggacggagggagtataatattttttacactagcacctcctcaatttacaccctggattcgccactgaacatcactgaaactatagtcttatgttatgtccaaagcattttgtggattcaacaaacatcacatttgtgaggcatctagtcaaatattttttaaaacttcaaaatcatgtgcatagaaaatatgagttttcagatactgacagttgctgaaaggagaagcactctaatcaagaataaatttaacaatcagtctagcgctggcaaggggacaaagaaaacggaatccatgcgaggatagtaatgggactgggttcgcccagggagatggctagagagtaggcagaattttctgggagcaaagtcattaaaaagactttgttaaacgcattaaattgatggacttctgatcaaatcacgaatggccatgatgtcctgtatcatctagcaatcatatatcagaaaattttaaattgatgcctttaaagcacaaattatttgttttggggagacttggaggtaaggatccaacttcaaatatgaggtgtttgatcaaatcaagcgctagctaggactacttgtatcaacgctccatgtatagccaaactgatgctggtgctgttataataaagtatagatacacatctaaattttggtcaaaaaattggaatatccatgatggcatgatgttcatgttgctaatatccttttctaactttgcacaacgatagaagaaatgaaaggttttaagccatgataaataatcaaagctgtagaagcttctgttcaatgaagcatccatgtaactcaaaattatttatcatggagctaattagatagatgcatagaaggacagtaaacaagacttaagaaatgatgacatgtcattgcccaatgccctagacaggtctatgcaccttgttagcattttactaaacacatgcttgtattcatatgggtactataagtataagtatatacattcatatgggtactataagatgtaatttaaggcatatatgtacattttgataatatatttaagaactccaaggcaagcattccatcaagcaggtcacaagcagtggcgacgtaaagccagttcccgtgtgttggccgggatgataatctattattctattgttcatcatgcctaaagcacaagggatgaagcaagcacaaaaggctaacattgtgctaagtactttacttatgttggtaattgcaagagatgagtagctatttaatgtgtagccatcctcaattagtgcacagattactcatgatgcaccaaaagttcagaaattcagagattactcatgatgcaccacaaattcaaagattactcatggtgcactaaaaattcagaaatggtcgtgtgtttgagtgcatttgtgcataccgggtcagtaagccagtgcatccggggcacgaagcccaccatggcagagagcgcactctgccacacggcgaaggcaaaccgcagcgtggagcacggcacgatgaggtcgtcgtcaacggagaagacggcgtcggtggtgagcccctggatgggcctgaacctgttgttgaggctgtcctccgcgttgatcgcgaaccgcacccgtgagcaattggtggagggagcaagggggggcgggcgctcaccgtggcgaggcggcggagaggtcagggcggtggagggtgagggcgagggcgaagatggtggtgatggcggcgacggcgagcaggcaggcggtgaatctgccggggggcgacgtgtggtgggtggcggagggggaggtacccgcagcggccggagccgtaccacctcctgtcagcaagttccagccgcggcgtcccccgcgtctcccgtcggctgtctcccccgccaaacgccgccgt

SEQ ID NO: 86008 - DNA, 5292 bp, Oryza sativa
agaagaacaataacaatcctaatcaggatgagaggacttgctttgtgtgtggccaacctggtcatctggctaggaagtgtccacaacgcaaggggatgaaggcacctgtagggcagacttctaagtctgctaatgtgaccattggcaacactggagatggaagcgggtatggtaatttacctactattttttcagttaattagtctactaattggtgggtttatactggggccaatgtacatgtttgtgctgacatctcattgttttcttcttatcaggtcgcacgaggttccaccgtcctaatggggaatgggtcatatgcttctgttcatggtattggcacggtagatctgaagtttacttcaggaaagatcgtctagctgaagaacatgcagcatgtctcttctatagataggaatcttgttagtggctcccgtctaactagagacggatttaagttggtttttgagtctaataaagtagtcgtgtctaaacatggatattttattggtaaaggttatgagtgcggaggcctgttccgcttttccctttctgatttctgcaataagtctgtaaaccatatttgtggcagtgtggatgatgaggctaatgtttggcactcacgtttatgtcatattaattttggcttgatgtctcggctttccagcatgtgtttaattcctaagttttccattgtcaaaggttctaagtgccatagttgtgtgcaattgaagcaacctcgcaagcctcataaggctgccgaggagagaaacttggcaccactagaactcctacattcagatctttgtgaaatgaatggggtgttgacgaagggtggaaaacgatatttcatgacgttgattgatgatgctactagattttgctatgtgtacttgttgaaaacgaaagacaaggctctagactattttaaaatttataaggcagaagttgaaaattaacttgatagaaagataaaaacacttaggtctgatcatggtggagagtatttctcaaacgagtttgacttattctatgaggaacatggcattatacatgagaggacgcctccatattctcccgagtctaatgggattgctgaaaggaagaaccgcacactgactgacttggtgaatgccatgttggacatcgcggagctacctaaggcatggtggggggaggcattgttgacctcgaatcatgtgttaaacagagttcctaatagaaataaggacaaaacaccatatgagatatggattgggagaaaaccatcactttcttatttgcgcacatgggggtgcttggcgaaagtcaatgtaccaataacgaagaagcgcaaactgggacctgagattatggactgtgtctttctgggatatgctcatcacagcattgcctatagatttttaatagttaaatctgatgtacctgacatgcatgttggtacaattatgtagtctcgtgatgctaccttctttgagagctttttcccaatgaaggatacacatagtagttcgagccaaccctctgaaataattcccagttcgatcacaccaccagaacaaactaaacatacacacgaacatgtcactaaggaggatgtcagtgaagctcctcgaaggagtaagagacaaaggacggctaagtcctttggtgatgatttcactgtgtaccacgtggatgacactcttaagtcaatttcagaagcatatgcatctcctgatgtagactactggaaggaggctgtccgtagtgaaatggattccattatcgctaacgggacttgggaggtgacagagtggccctatgggtgtaaacctgtagggtgcaagtgggtgttcaaaaagaagctcaggcctgcggtactattgaaaagtataaggctcggcttgttgctaagggctatactcagaaagaaggcgaagatttctttgacacttactcatctgttgctagattgaccacaattcgtgtgctaccttccctagcagcctcacatggtcttctcgttcatcaaatggacgttaagacagattttcttaatggagagctggatgaggagatctatatggatcaacctgatgggtttgtagttgaaggtcaagaaggcaaagtgtacaaattattgaagtctttgtatggtctgaaacaagctccaaagcaatggcatgagaaatttgacaaaacattgacatctgcaggctttgcagtcaatgaggcagataaatgtgtgtaccatcaccatggtgggggtgagggagttattctgtgcttgtatgttgattacatactgatatttgggacaaaccttgaggtgataaatgaggttaaatcattcttgtctcaaaattttgatatgaaggatttggaagtagctgatgttatcttaaacattaagctaattagaggtgagaatgggattacactcttgtagtcccattatgtggagaagatcttgaatcgctttggctacattgatagtaagccttctccaacaccttatgatcctagcttgttgcttcgcaagaacaaaagaattgctaggaattaactggaatactcccaaatcattggctcgctgatgtacctggctagtgcaactaggcctgatatctcctttgctgtgagcaagttgagccggtttacctctaatccgggagatgatcactagcgtgcgcttgagcgagtaatgtgctatctgaaaggtactatagaattggggcttcactatactgggtatcctgcggtactggagggttatagtgattctaactggatctctgatgtggatgagatcaaagccactagtggatatgtcttcacactgggtggtggtgctgtttcgtggaggtcttgcaaacagatcattttgacgaggtcaaccatgaaagcagaactgacggcactggatactgctactgttgaggcagaatggctgcgtgatctactaatggatctgcctattgttgaaaaaccggtgccggctatccttatgaactatgacaatcaaacggtaattgtaaaagtgaatagttctaatgataatatgaaatcgtctagacatgtgaaaagacgattgaagtctgttaggaaattgagaaactccggggttataatgttagattacatccaaactgctagaaacctggcagatcccttcacgaagggactatcacgaaatgtgatagacaatgcatcgaaggagatgggtttgagacccatgtgagttatacaatggtggtaacccagtctatgtgatcggagatcccgtgaattagaacctgggaagaacaaaccattagtaaactagaggagagtaccaatctataccctctctaagtgaagatgcatgtactctcgtgagctgcaaggtaggttggttatggcttaatgagttctgttggctttaattagcgaagatgttatcctgcagagcattcttgaaagaactcacctttgtaagcttgactattgatcgcagtctatggagattttgggtgaatcttctaggaagcttactaaagacctaggagtatgacttatacgctccacccgaggggtagtctacagacggtatagtactagataagactctgagtgaaacttgcttgcacgagacttgcaattcaaggcgtagtccattgttcaagttgtgagtaagtgtagtttggagttctaggtggatgttcaaccttaatcggtctccatcgaaccgctggtatataaacagtacatttgaaaaggcaaatctcagtgggattttgagatttggtgggggattgttggaattaatagatgggctaagacccattcgaagattaattatttggaaaatcacaaaagcccacctcatgggatggcatgcatgtggagtttaggaccaccttgcttattctaggagaggaggacctccttaaaagggaggatgccctcctagccacttgaagcatgtgtggtggagagaagagggggaacacacgcgctcgcctcgcctcgcctggcagggaagggcaggcgcgtcgtgctcctcatccttgcgcagatgcagcctccttttgcagttttgttttgctgcggaaaattcggatttgtttttgttttggaaacattccgaaaaatccggtgcgtgaaaacggcgtgaagtccggataagttacgcgcgacttatccggttcggttacacggagtagagatcgtgcgggcgccctgatcaagcgacctatctctatataaaccgagccgtcgccttcacgcaacatacgcaaaatcaatctagggtttgcctcctactctgtgctgcgccgtcgctcgtagacaactccatcccgctcgccggcgtgcaccggcgatcaggagagcaggtctccggaacctctaccttcatgtcctgcacggcgagaaggcggcaataaggtttttgggaagcgcttcgcgcgactgctccctgttcgttcgctacggctcgccttcctctctgctcgcgtgctgcgcgccttcgtcaacgcccgcaaccgcgagtagtacctgccgagcaaccggtttttccgccacctcggtacgtgttcgacatgttgtgcatatttgatccgttcatgttttactgcttagtttacatgtgtagatctaatgatgtgttcatgctagtttacatctgcaatgtcatgatttatttatggaataaattaaatcattatgtgcttataatttctacaatccaaaaaccttattataggcgctgtgattttactatggctggttttgccgatgcactgaggccggataaattcaccggtgtgcactttaagagatggcagatcagggtcactctgtggttgacagctatgaaatgcttctgggtgagtactggcaaacctgaaggagttcttactgctgatcagcagaagcaattcgaggaagccactactctctttgtgggatgcattcttagcgttcttggcgatcgtctggtcgaggtgtatatgcatttgactgacgctaaggagttgtgggatgcactgaatactaaattcggtgctactgatgctggcaatgatctgtatatcatggagcagtttcaagactacaagatggctgacaaccgttctgtagtcgaacaggctcatgagatacaaaccatggctaaggaactcgaactccttaagtgtgtcttacccgacaaatttgtggccaggtgcattattgcgaaactacctccatcttggagaagtttcggtactgcactcaatcacaagagacaggaatactccgttgaggggttgatagcgtctcttgatg

SEQ ID NO: 86009 - DNA, 1853 bp, Oryza sativa
ttacgcctatagttagttctgcacaggttgcataagtttcctctcctgctccactgcacaataacaccggcttcagttcatgtataaatctcaaataaacttctgttcatgtataaatctcaaataaactatcatttgaacatggatgtaagtaatcatgcacagaaaaataattgaacgacctaggaatatgatgtgcagctttactgtctcttcattggatagcatgttgatttctctagccctgaatttgtatgcaacttaaagagaaatgttgaacaatatgatgtatgagctgcgaccaaatttgcacaagaatttgacataccactggtgcatgcttttcaatctacggccttgtcagcaaatgaagatacaaattttacctcagtttccgttagcacgcttttcaaactactaaacggtgtattacatgcaaaaactttctatatagaagttgctcttatctacaatattagattaattaattttctaagtttaaaataattaaaactcaattagttatgtgctaatggttttctcgttttgcgtgcccgtacttaatcttcatgttcatcacttgtgaacactagtggtcacattctggtttaaacttcaagtttatttccaccaagttttatcgtatgcatgattccttagtcgcaaattcatacatgactatctaagctagggaccatagtacattaaaccactgatcgaaacaagggcatacagttctcagttgcaagaacagaggcaacaatgctaaggagaagaacaactccaagttattggtgttcataatgcaaagtgatcaattcatatcatgttaccttgacatcaaggaaacacatgaatttacttagtaaagaaagctatttgaattttaccttgcatggatttctcaaagttctccagctgagacatgaatccctcattaggagccacttgaggtcgtttgcttctaactagcgacaacgcgttctcaaggctcatttgatgcttcttcatcagatatgcaacaataatcgtgacactagacattcagagaagttagttagtaggacaaaagaaaaaaagcaccacacatctgctcttaatgaattcaaatattctttacaaaatatctatatattaagaaacacgtaattaatcaagggtgatctcacctagtggaatgaaattgagaatttatacacattatgaaaaccatcataaaacagtcaaagctaacatctattagagtattttccttacgagaaaattctttatttgtccttaaaagttgatcgcttccatcgtttgccctcgtaaaattggctccttctagtgctccgcattcttaacttttatcctttatttgccctttccgttagttctccgtcaacctactgttaggtgggtgaaaagatagttttgcccttatctttttatgcacagcagctatttttatactttatttttgttgccaggagcaatttttatactaaactgatggttcatatatctctaatgaacctaaatgttattttagtaagaataaaatacatcagtgcttacaagttggaccatggtatcatctacgtccttaaacatgtataatgaacatctgcttccctaatcttggtttaatgtatcacttgagatccaaactatagatgacggagctcaggcgctgacgtggccatccatggtggcgagaattttgcatttagaccccttcactacaccatgcccgtgagaaggaaggcaaagaaacagaaattatgcgggctgggattgttggcgataggtccccatggccgatataggataaagtgatcctggctgcgtgattgttaccattaaggcag

SEQ ID NO: 86010 - DNA, 1489 bp, Oryza sativa
agtagttctccttcatcagcatcaaaatcttctgcctttgatctctctgacctttctcttttcctggtagcgctggctataataacattttttatctcatccgaaacagctcttacttggttttcatcaaggagtcgaccagagagctgctcaattaaaaagaatagtgagcgataaaaaaacccaggcctttcaaaattgaggaacggccaagtatattatcgcagtgtagaaagttgaataaatagattataaaccatcagtgaatatcactcagctatactgcattgatttatcaattcagcaatctttttggtgtaatagtgtcaatgaaaaatgcattcaatgtgcaaaaggtgccagtgtcaacttccaagcaaaatcattctggctttggtataagtccactaacatagcccaatcaatgatgaaaattagtaatctttttgcacagtaatgactgcaataaactttcaacactaatagcaaataagtccaccatgacctttggaaagtgatttgttggatctaactctaatgtggtcttagtttcttccatgtcatatatgaaggtactgcgattatccaactgttcctcgacagaagctaactcttgaaaccactatctattgatggcaattttggaccaaacaatattccaaccaaacaaaattcatggtgaacaaactggtcatacatggttcatccaactgaagatatttcagcttcatccaatagataactaaaaactcaacaagaaaagacaccaggtatacgtttctacagctgaatgatctctctaagatgcataggcagacaacaaacataacccagttagctgtatacaccagtgcactgcctcaatatgctccagaagcattacaatttcatagaaaaataccatcccattcaaataaaaatatgaaaaggagaacaaacctgcatgcactcatttaatgaatcaagcatggatgaacacatctcagtttctggttcctgtatagtaattcaaaagaaaacagctgttagcgttgaatagaaaaaccatccacatgtatagagaagattttgcatagaccttgtgcagcgcttcaacaagagctggaattatgtagtcagataattgtttaacataagattcatcgcgtccttgagccagccccttctcaacagccaattttgcagaacgtagtagttcaggcatagctgcattgttgttggaactatacttttaaaatgcaaatccataaggcaaaagataaaatcatactaaaacatcaaatacctgcaacagcagctctcctcacttcctcatgaaagtaaaatttaaggagtggaaccaatgtaggagcaacctacgtggaatttgaccaccaacatatgacactgagtggcaattgagaaattagacatttaacatgctggtatgatatcaaacctgatcaatccatgggaagaacccctccttgagttcatcagcataacagca

SEQ ID NO: 86011 - DNA, 3881 bp, Oryza sativa
cactgcgataatatacttggccgttcctcaatttgtgaaaggcctgggtttttttatcgctcactattttttttaattgagcagctctctggtcgactccttgatgaaaaccaagtaagagctgtttcggatgagataaaaaatgttattatagccagcgctaccaggaaaagagaaaggtcagagagatcaaaggcagaagattttgatgctgatgaaggagaactactcaaagaagagaatgagcaggaggaggaagtgtttgatcaggttcgtgtatctcgtgactcccagcggctgggagtcatgtaacattaaaagacttaacttttgttagatgaatatttatattggacaaaaggggactgtatgaataacttcttttttactggatggaatattagtcttctaaaagttgattctgttaacactagtttttaaaataatttacaggttggagagtgccttggtactttaattaagaccttcaaagcttcttttctgccattctttgatgaactgtctgtatacatcacacctatgttggtaagtcagtggaatcctgcatttaattgtgtgtttggatttgatttatttttacacatacaagttccttgttagatctcactctagtatttttttttagttctaccactacattagttaccactactttaatttcttgatttgtgcctgttagcatgatatttcatccaactcttttcttctatcctgaaagttcctgattgttttagtggtttacattatatcacaacgcttcattttgaaagattttccatatgcccgacagcctctcaatattcattttgactgtttatcatcagtttattgtgaaacaaccaaggaagacaatgacatgcatatcttgatttgaactgttttattcatgaaaactcaaaatggatatgccaaataaaatagtatgtaagaattgtttccttggatatggctatcaaattatcagtgactgcgtggacatttttcttctcacgtgttaacgaaaagattaatggttattatcacttgtgtttaccagtattatcacttgcatgttttctagtcttagttctattgagctgtgttgattatttcttgttttgttgtttactgctcattcatttcttgtgtcattttaatttggcagggaaaagataagactgctgaagagagaaggatagctatctgtatatttgatgatattgcagagcaatgtcgtgaatctgctctcaagtatgttcctcaaagctatttggttggatgcagggcttgtatttgtaactgaattatgtattttcctatctgattaggtattatgatacatacctaccttttctgctggaggcatccaatgatgagaactcagatgttcggcaggtataaatatttatgttttcctgtcccttcatccatgtcctattgttatatttggccactaatgttgtgttgaactgccaacttattctttttaggctgctgtctatggtgtgggtgtatgtgctgaatttggcggtcatgttttccgcccacttgttggaggtagtcgggtcatgcttacatcactttgtagtttgtagtactttaccatgcattttcaaaaccaacccactaatttggtgctttcaaaatcagaggcgctgtcaaagttgaacaatgttatcacacatcctgaagcaaagcatgcagacaatataatggcatatgacaatgctgtttcagcgcttggtaaaatatgccaattccatcgtgatggtatcgatgcagctcaggtaagcatatctcacatagtcacattcagtcagttaaaacaactgtcattgttttgttatatatattctgtcttctgttttctatccaaccatattaacatgtgggctaccaagtgaatggaaagggggaaaactactttcctttattgagggaggatgaaatcctgctagaaaatctgtgcaaacttagtaggaaaaatgaattgaaatattcttgacagatattttctgtttgtggagcaaactttacaaacttaaatgattacggagtaggtcctaaaatttgtatatgcttttcaagattcaaaaaaggtccaaatcttgtttgcttgtatggatgaactgacaccttaatagatctaaactgttctttcatgccgttcatcaagtgaaatcaagcctttggatatagaaggaagatttatgtctttcgtcagaatgtactacccttcaatatttcctagcaaacacacagtcaagcttttagttatatgcaatcaatattccttggtccttgccatcaattactaatagctaagttggttttggatctgattttgcattcatacaacttggcatccttaaaactgcaaaacaaatccaaagttctactgaaaatatgctttgcgtaaactgttgaagaacttggcactttattgtgtctgaatgtttttcaaaatgaaactgctctgttcctgctagtgttgtgtgtcctaatggagttatggttgtttagtaaaaaaagtagtagtgattttccaaaggaatagttgagaaacctgctgcagagtatggagttcaagctgaaactgaaccaattaaataaccagtgtaaaaccagtagttgtgcttgtccctagatttagtctgaaccttgttttcagctcccgtaagaccatatattgctaaaaagatacatgttgtattatcctcatccaatgtattcatgctctttaggtcattcctgcctggcttggttgcttgcctataaaagatgacaagattgaagcaaaagttgtacacgatcagctctcctcaatggttgaaaggtatctgctctctatggatgacatgccaacaatcataactttttgttgcagtttataatgaccttgtctgtgtgcagatcggatgcagatattcttggtcctcatagccaatatcttccaaaaattgtttcaatttttgcggaggtaatttctgacttgtttcctatattatggtgtggggcccttttcccaaaggaaaacagagacatcaagacggattcctgtgttcctggtttagtttggttctctgtgataatttgtcttggaccttttgtgtactattagcatggcaatttcaggctgttactgctatagcagcaacatagctgatcctaggatcaaaactactatttattactatgtgcattttgtttttcatttctttgactcagatgctgtaaaattcataaatgaatgctgtcttgggatttctactgcaggttttatgcaacggaacagagcttgctacagatgaaacaaccaagcggatggcaatctcttgaggcgtttccagcagacattgccaccagattttcttgcctcaacattttccagcttgcaaccacagcagcagcttctgctgcagtccattttgtcgacataggttttttttttttgttgctgcaagttcaaatcttgctccttttttgatatatttcatcattgttaccgtcaaccaattctttgtgttgaatcatttgtgggtgagttcatttgtgaatgcgcattgctggcttcaaggaattggaggttgccatttcatatggttttgatgtagagtgtgtatattatcttgtactcagatatggttttgggatgtgctgcatcagaggttgtaagtgaaatggtgatattgttgtcagtttgagctgaacagatgctgcgccagttttggtaatgaagttatcatatttttgtggatgcttccctgcagtttttaataattattgctctctatttgtgctgagcatgtttcttcgctgatgaataccgtgccaaatattttacaccacagggtggcatttttttcgctttgtcttcatac

SEQ ID NO: 86012 - DNA, 8842 bp, Oryza sativa
ttataaattttaaaatagtctagagcctcgtctttcgttttcaacaagtacacatagcaaaatatagtagcatcatcaatcaacgtcatgaaatatcgttttccacccttcgtcaacaccccattcatttcacaaagatctgaatgtaggagttctagtggtgccaagtttctctcctcggcagccttgtgaggcttgtgaggttgcttcgattgcacacaactatgacacttagaacctttgacagtggaaaacttaggaattaaacacatgctggaaagccgagacatcaagccaaaattaatatgacataaacgtgagtgctaaacattagcctcatcatccacgccgccacaaatatggttcacagacttattgcagaaatcagaaagggaaaagcggaacaggcctccgcactcataacctttaccaataaaatatccttgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctatcgtgccaacaccatgaacagaagcatgtgacccattccccattaggacggtggaaccccgtgtgacctgataagaagaaaacaatgagatgtcagcacaaacatgtacattggccccagtatcaacccaccaattagtagactgattaactgaaaaaacagtaggtaaattatcatacccgcttccatctccagtgttgccaatggtcacattagcagacttaaaagtctgccctgcaggtgccttcatccccttgcgctgtggacacttcctagccacacacaaagcaagtcctctcatcctgattaggattgttattgttcttcatctgcttcttgaagtcggtggtctgttgagctttgtatttccccttgctcttgttctgggccttgtgcacaacattggcactggactgcccaccatcgcccttagacgcagcgtccttttcccgagctttctcctcaacatcaagagacgctatcaacccctcaacggagtattcctgtctcttgtgtttgagtgcagtaccgatctccaagatggaggtagtttcgcaataatgcacccggccacaaatttgtcgggtaagacacatttaaggagttcgagttccttagccatggtttgtatctcttgagcctgttcgactacagaacggttgtcagccatcctgtagtcatgaaactgctccatgatgtacagatcattgctagcatcagtagcaccgaatttagtattcagtgcatcccacaagtccttagcgtcggtcatgtgcatattcacctcgaccagacgatcgccaagaacgctaagaatgtatcccacaaagagagtagtggcttcctcgaattgcttctgctgatcagcagtaagaattccttcaggtttgccagtactgacccagaagcatttcatagctgtcagccacagtgaccctaatatgtcatctcttaaagtgcacaccggtgaatttatccggccttagtgcatcggcaaaaccagccatagtaaaatcacagcgcctataataaggtttttggattgttgaaattataagcacgtaatgatttaatttattccataaataaatcatgacattgcagatgtaaactagcatgaacgcatcattagatctacacatgtaaactaagcagtaaaacatgaacagatcaaatatgcgtaacatatcgaacacgtaccgaggtggcggaaagacaggttgctcggtaggaactactcgcggttgcaggcgtcgacgaaggcgcgcagcacacgagcggagaggaaggcgagccgtcgcggacgaacagggagcggtcgcgcgaagcgcttcccaaaaaccttattgccgccttctccgacgtggacaatgctagaaagtctaataatatgaaacgaaggaagtagcaattatcattgccaattgaaacaatagaccaggaatgacaacacggtgtctcaaatttgattttttttgtttgtgaaaataatcttgaaagcataattctattttttcacgcgcatgtatcctccctagacatatctcttcacctttatcctccttatcttctcatctttatagtaatcttgactacttttcttttgactctccctgtaagaaacttccattaatgcttagggtgtgtttagttcacgccaaaattggaagtttgattgaaattggaatgatgtgacggaaaagttggaagtttgtgtgtgtaggaaagttttgatgtgatgaaaaagttggatatttgaagaaaaagttgggaactaaactaggccttatttgagcatctagattacttgaaatataaaaagttgtcaaaggcataaagtttgtctccatcgtatgtttcatgaaaccataaagtgggaactaaaccaggccgacggagagggagaggagggagaccggccggatctgtaccccgtcacctatggggaggccgccgccacctcccttgggcactaccgccgctgcatgtcgccaccaccaacccaccaccccgagcaccttctccccagatctggctaactccggtgaggccgacggagagggagagcaagacgaaaaggggaccggatttgcacctccccgtcgctcgtggggagggcgccggtcacatgtgccactgctcgccgtctggaagagggggacggagggggagggaagcagccagccggcccgctgggacaggggagcgaagggaggtggcagccagcaggtgcaggagggagaaggggaggaaagggcagcggagttggaaggtgtgagacgaacgagtcaaggcgtccgcgtctcgcatcgcgcggataaggaaaaggctgacgcgcggcacggataaagctgaggccggctgggctcgcctggtttggctcggttttgtatgggtgctagttttttaattaaccggtacctataatataatataggtgtaggttcttcctaaaaaccggcacctataatatattataggtgtaggttcttcctaaaaacctgtacctatagtattggcaccggtttttcctaataaactgacacctatagttcttaaaggtgccggttggtgccggttgtatatttttttcaacgtgtggaggtaggaaaatgctccacacgttgaactataaggccggttttatagtagtgttatgaactgggtatatcgtaaaatattttcatcatctaaacagtctgaaatgaaaagtcatcatctagaatgttgtaaatcttttcgagatttacaaaattgatataatgttggtcttatctgacttcatatgtaaaagttatctatgttttaaaaaagtaaaataaccatatgataacatcactgctggttatttctgtacgaacctgcaaccggccatgttgaaaacaggccaaaaactgaaagattagattgagaaccaaattgatatgcttaaatttgctcgcagcaacaatttcaatattatgattcatcgatcttcgattttcaattacaacttttaatcttctgtttacttgcgcactcatggcattattccctgagtactgatgggcaatgctagaaagtcttacaatatgaaacggagggagtattcattatattacgtgatctctgcagctttacgtcagattatgattttgttaaattcattatttaccttgaactccaatatcagacttgagatgacaatatttcataattttctttttttttttggacatgtacataataatcaactttgttgctgtgaacctccacagatcctgagacaggggatgaatacacaaaaggtttgagaacagcacaaatttgcagccgtgagaaaataacagcaggataggtcggtgacaatggctacctagctagcaggatgggtggtaagagcaggatggttcgtcacctctaccatacctccatctccatggcatcacccttcagttcaacatcgaggaggcttcaggcacattgtacgtgatcttcgatcttggcatggtggtttacacagacagagggatgaaaacggtcataaagatatcagcttttattatttttatgaaagcggtatcgatacatgtgggaatttttgaaattgatgaatttaactatttagcgacgacttcgatactgcacatatggaaattttttagaacacctccttctgtactatatattttggcaccagatattgtgtaaactgttcttcttcatgagaagctgagcaccacttgtccaaaacatcacatacaggaggcggaagctttgttcccaactcctctatatagagatgctgttttaaaaacacatattaattcatttttaacttaattttaattaatacataattatcatacgctattgagctgctccgatatatcagagggaaagttcccaaccgacacaaaggaacacaaccataatcatgagcacagcacaacacgttaattcactcctttggcattcaattaacctttttaattttgttcttttgtgagagctacactacattactttttctgcctgtacactttccattttggccagacaatgataatcttccacctcttccctcacgtgctggtggtaatgtccatgtccctttgcttttcttagaaaaaaaaattcacatccctagctctactctggagatttgtcgtcgtcactaacacaccttttcatttgaagcggagggagtatgaagcacaggcttctaaaggactatgtttaaaatagagtgaaaaactaaaatattgattagattgacaaaggaattttatcgacattagatttttcattcatcattcctggcgtcctgcttttattcatctttgttatagtgtcacactaactcgtagggtaatactatgagggtccctacgatagatttatctacgttcttataataggatacatggtatcgtagtattaccgttatgtggttgactgcaccaggacctggttcatgtacttgcgtcatctcaattgtgtcaaaactaaaatttaacaatatgaaaaagggtagcgcacaaaaaagaaagtagatagtggataggttatgagacaagggttcagacaggtatgccttctcgatgagaccttctcgatgagaagtaataccctatagtttagggattgtattcgctgattgttgtattgatctgaccatctgagttgtggttatatcctcaaggggtatcctgcccttcttatatagtcgaaggagacatgttacaagatagagatataaccccttacggtttaaatcactataactagttcacaatcttaccgaacaaagataacaatccatttccttgataggcaggtaaacgtaatacctgagtcttaattctttacatattctatttacatgatatatcccctataaccagttagatagtccagccgtgtggttatatggtacccataatctccacagtagcccctgagacattcatagtcgacaataaaatcttctctcaaaccaaaaatttccatagccaagtgcttcaattttctctgccttagtcttccaagtattttctcctattcagtaggatgtgaagggctgaaaaataaaaaaaatataaaatatacctaattaggtgtagccccccaactatgtatttgaacaaactaagcatatagtaaaggttaaaaagtttataataaccatccgagtggttttttaaaataatatgcacagcctaagcttaattacataaagaataatacagctagcacgtcactttactactaaagcttactgcataatgaacaactggtactggcgtcatactatgcacatattgccaaagcaaaatatgttaaaacacataatcgtcaaagttgcggacgcgtagggactcaaactccatctcactcggcaacatagcttcagccccatatactaaaacggaaggtgactgacctgtcacacgactgggtgtagtgcatagtgacgacaaaactgaaggcaactcctccacaaagcggccgatttacgacacaaatcgacaaagatggatgaactagactagaaatagattgaaatattgaaaaaaacgattcaatcactggtggagaaaccatttgtagtcccggttggtaacctccctttagtcccggttgtccaaccgggactacgaatccgggactaaagatagctatctttagtcctgggtgaaataaccgagactaaagatcgagctgacctttttttttttttgcatggccctgtttgctgcatggttgattatatatatatatacatacatatgttacaatacatatatatgcataatatatagtcatatatatatatatgtgtgtgtgtatgtataaatcatatattatatacacacacatatgtataattaaagctacttaacattttatgtgcatatatatatgttaccaaaatatatattaacacacaagtaaatgtgtacatatataaatatatatatatatacatgcatatatagtacaattcatttgctcggtagttatatctacgacttcgacttcgacgccggcgttatgtcagaagaggaaggaccgacgttataaattgttgatccgtcgtagtagaattcaccgtcgggattaagtacttcctcgttgatgaatcccatcagttgttcttgaacagccgtgataaaatccttgtgtgagagattatccctcatgtgaatacgctatcattcgaaaaataataacgtatcaatatatgaaattaataaacaacttaacaaatcgatacgcaatgaacctttgaatggtttatgtatacgtacatcgagctctcgtgttgtgcatatttagtttgataggcagtgggcatactcgcatacgtagtagccgcataagttagttccctggtcctgctttgcacactacatgagaaacgatgagagatttaatatactctttatattaactgtaattagatattcaattcaatataattttggatcaagcatgtactcactggaaaatgaaacctccgtccaagtttttctttccaagtcccgcagaccaattgacggaaccgatcccaagccctacatatgcagttgcaagctatgattaattaattattacctgagatcaacataatagcaatagattccccgcgactttggaatagatggcattatattacctgtctatcagtttgaagaccttgtcaaaaatcttctcctctttattcattgagtcgtacacagtgactctgcatgcatccaagtcgaagaataacaagacccagtggaatctggaatatgcgtgagatgagatatatatgatcgaaaatgtacatgctatatgtatgggaatgaaatttgttcgaacgacaataaaaactcactctgtgttgtacggcagtaatatgtacgtcttgaaatgttgctgcgttaggagatgcacgagattgtcctctgtatgtttctcgtacttgtcgatcatttcggtgttgattttccgagggtcgatgaacccagtatcgtagactctccgccgtcgggccctttgaatctccattctacaacgatgaaaggaaagtattattgcttacatatatgccaggagctaattattgaacgaaacaaatcgaactcaaagatactcacaaaatccatgcgctcagaagagagacatcgagggcgtccaactggtacagatcgaagagttccttgaaatggatccagagaacatcgtctccttgcaagaagtcggggtttctgatcctcgctccgaacatctctctacccttggcgctcatttccatgtaccgttcatggaatttgtacatctgtgtcggtagggactccagctgttcaggtttgacaagcggtttaccgagttcaaacttgtatgccaattccgccttcgggattggtgcgccttgaaccaattgatccacagatagaccggtgtctgcaatgaaatccgttatgccaaaatcttcaccggtcaccaaaggctcgacctcttggtttggttgttctccaagctgagggactggtttggacttcttgtgataggctctctgaagtgttcggtcatagtccgatatctgtaaggcctccttgtttgttttggacattcccttgaagaagttcttcacgctcgggtcaataggtatcttcttttcaggacttcgaggcttgagttgcctcttcacctctcctgccacataagcatcaagctcctcttgactgcaatcgtatggtggctccttgtttttggtggcgtcaactttcgccttcttcattgcccttgtgcgggcaggcggtggagcttggcgagaccttgtcttgggaggtgcaggcggacacagtggaggcggaggaggcggaggagccgaggagatggtgcaagaggacgtggcggaggaacctgaggagatggtgcacgaaatgccgcttgtcgcccaggaaggatgatgtaccgcttgcgccatagtatgatggcgtggcttgtgtcacgtagatgcgtctaaccgtcccctcctgggtagtccaactcgaggtcctcgtacgcagctttcaccagctcaacttcgaccctcgagtatcctgctgaaatcggcctgaagtggtaagtcccggaagggtcccgttgggatggccattcccaacgccaccttcacgtgatgagaggttatctattagtaatcaacctaagcagcaacttgcggaatgtacaagtcaaaaatataaaactacgagcataccttgattgataagt

SEQ ID NO: 86013 - DNA, 6476 bp, Oryza sativa
taaaatagtaaataatgcattacaattatttaaagtcgaacaattaatgataaaaccttcgaaaaaattattgttgtacgtagtagaatacgtggataatatataataagcacatgaatgatttaaaattgttaaaaattctaattaacatatctaaatagcacatgcatgatttaaaattaatacaaaatctaatatcatatataactagcatatcatgatattaaattgttaaaaattctaattaacatatgtaaataccacatgcatgatttaaaacctttagaaattctaataatcatatatatgtagcatatggatgatttcaatttgattaaaattctaataatcatatatatgtagcatatggatgatttcaatttgatgaaaattctaataatcatacataattaacaaaaaaattaataatcatatataactagcatatggatgatttcaatttgataaaaattctaataatcatacatatttaacatttgccatacaacaattgattagtatagatattcggtacatccaacatagtttacatcgtgtacagaacaattacggcaatacatcggcggtgacggttgaccggacgtactttctcctcactattgttccttccttgtgatcgctacgtgagtaaggggtgtcttcatttgataggaggatgctagggtcaattgtcaccgtgaaagggggttgcccatcaaactgatcgtaatcctcatcagtcttgtcctctactccgacgatttttctttttcttgggagaaccacgtggcgcttcggctcgtcagtcactttgcccttttttcctttgctagacatgtccttgacgtaaaaaacttgggttacatcatcgacaaggacaaaaggttcgtccgagtatccaaccttgttaaggtcaaccgttgtcatcccactgtcatcaatcgttacgcctccaccagtcaacctaatccattggcaccggaacagagggaccttgagaggtccatagtcaagttcccatatgtcctcgatggcaccgtaatatgtgccagttgtaccatcgtgtcccatggcatcgatacgaacagcactgttctggtttgtactcttcatgtcttgggccctcgtgtagaatgtgtacccattgatttcatatccctggaatgtcgcgatcgagccagatggtccccacgccagaaaggccagttgttggttaatcgtcttgctacccatgagatgttgtcgcagccacgtggagaaagtatcaatgtgataccttgtaatccatgcatcggacttaccgatgtttttggcgcgaactagagccaagtgctcctcgatgtagggagccaccaatgaagattgttgcagaacagtgaaatgggctttacggaataaatagttgtctgccgtcattattgctttcctttcgagagtcccctttccccgtagtctcccttcatggcgtgattcaggtaccccgattgggcgaaggtcttcgataaattctacgcagaattcaatgacctcctctgttccataccccttggcgatgcttgcctctggacgagcacggttatgaacatacttcttcagaacgcccatgtacctctcgaaaggttacatgttgtgtaggtacacaggaccgagaataccgatctctttgacaaggtgacaaagcagatgcgtcattatattgaaaaatgaaggtggaaatatcaactcaaagctgacaagacattgcaccacatcattctgcagggcttctaatctatcaggatcgatgaccttctgcgaaattgcgttcatgaaaacacatagctttgttattgttgtccggacattgtctgggaggataccccttattacaactggtagcagctgtgtcatcaacacgtgacagtcatgagactttagatttgtgaacttcttcttcttcgtgcttattattcgctttatattcatggagtatccagacggtaccttgatgctctccaagcattcaaacatactttccttctctgccttgctaagagtgtagctggctggactcaagtaatggcttcctttcttctttggttccggatgaaggtcaccgcgttgttccatatgcttcagatcattacgtgcttccagtgtatctttcaactttccatatacacctaggaagccaagaaggtttacgcaaagattcttagtgaggtgcatcatgtcgattgcgtggcggacgtccaagaattcccaatagggtaactcccaaaatatagagttctttttctacatcgccgcgtgaccatcttcgctctctataggctggctgccaggcccctttccaaacactactttaagatctttaaccatagaaaacactgtttcccgctgcgatgtttaggcttcgtacggtggtcctccttatgttcaaagtgcttgcctttcttccgtacctggtggtttgctgcaaggaatcaacgatgacccatgtacacaaccttcctacagtgcttaagatacatactttctatttcatccatacagtgagtgcaagccttgtaccccttattggactgtccggataggttgctaagtgcaggccaatcgttgatggttacgaacagtagcgctcgtaggttaaactcctcctgtttgtcctcgtcccacatggggacaccttccttcttccacaacagtttaaaatcttcgaccagtggtcttaggtacacatcgatgtcgttaacaggttgcttgggcccttgaattataatcggcatcattatgtacttcctcttcatgcatagccacggggggaggttgtagatacacatcgtaacgggccaagtgctatggccgctgcacatctcaccaaaaggattcatgccatccgtacttaaaccaaaccgtatgtttcgtgcgtcctttccaaagtctttaaattttctgtcgatgtttcgccactgcgaaccatcggcggggtgtctcagcatcccgtcctgttgacgctcttcagcgtgccaccgcatcattctagcgttccccttgttcctgaacaaacgccttagccgtggtattatagggaaataccacatcaccttagcaggaattctcttcttcgttagctgcccgtcaacttctcctggatcatctcgtctaatcttgtatcgtagtgctttgcaaacagggcatgcttttaggttctcgtactcctcaccgcgatataggatacaatcattcggacatgcgtgaatcttctgaacttccagtcctagagggcacactatcttctttgcctcgtacgttgtctcgggcaacttgtttccctccggaagaatgttcttgacgagtttcaataaatcgccaaatgccttgtcactaacaccattatttgccttccattgcaagaactctagagtggtatccaactttttgtgcccctgctcgcaacctgggtacaacgacgttctgttgtcctctaacatcttgtccaatttatgggcccccttttcactttcgcaatcctccttggcgtcctgcaacatctgaccaagatcatccgcaacgttgttaccatcagcatccctttcctcctcacccgtttgattttcttcaaatccagcgtactgagcaaagtccggaatattatcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccttttgcctgttagcttcggccactctcaaaaaataatgcacgccgtcaataaactctttggaccgccggtcagcgtacatccattgccgatccatctacatgacatgaaaaaaaatcgtacacacataattattcgtacaataatgacaatcatacaataattataaaataattacaaactctttcaacagtcacacaataatgacatatcattattcctacaaatattatgaaatattacaccgaataattatatatttactatttataaagttttaaactaatattaatgtgttgtacttattttaatttttcattttactttgttttctattattcaagattaactttcactatattttccttctcaacttttttataaaaccttctttagcaaataaactaaatttctatatattctttcttctccacacaaattttctctctcatcaactaacaacaaaattttgaagacaaaaaagtgtgcaaaacatagctccaaatgtaatatgaaaaaaaaaatattggaggatgaagttgctaaccttttaggcacctccgatttgtatataatcaccaaaataaattcactagaaattttggcatgacctcccctcttttttgaagaaattttgaagcttgctcgggctggaggaggaagaagacatatatataggggtaggactttagtcccggttggtgttatgaaccggggctaaagatcgccgtgatctgttaccaaccgggactaaagttacgatctttagtcccggttggtgttattaaccgggactaaagatcccagggggggcctgacaggtcctgacagcatttgaacagggactaaagatcatttttagtcccggtcaaatatgcccattaccctttttaaccgggactaaagatcatctttagtcccggtttttgttgcaaccgggactattgtggaattagcccgaccgacgaaagatggtttctccaccagtgaattgacttgtgtgtagattatatattgtatgttaaattgaaccggccatgtcctttatataggggttagtcttgccacctacaggtcctcctctatgtctaattcgggaaagaaaccaaagaaaacctgtgacatagcctcccgagtaaggaatcccgaggccgacgaaaatggacttgggctcaaactctgccggtctgaccagcaacatgccttcggttagaccggccctcagaccatggtctgaccggcccatacacggcggttagaccgacctagtggaggaaaccggtgaccttcccaaatcttgggcaatttttcttattttgaacctatctagcaaatttgggtgtaaacaattgtatcaacatatcacctcaacttcgttgatgtggtaaacttgtaaacataggtcctctctgtcctttttcttggcaaagaccacactattttctttatcgttgaatcgttgtagcgcatcaataatcggaacccaaactcctttaattttcacacttagtaaattaaacatagttagcccggatgattatgttatcagtaatcaccaaaactctaaacaagggactaggtgcttacactcgacactgccagatgctgggaggctgtccgaggatgttgagtctcacatggttagctcagagggtggaaaataattgagagaagttgcaagatgaaaaaacaaaggaaaaccattaactctactcactggagggcaaatataagtatatgtaatttcaaattgctattaacttacaccacaacacatgatgatttcaaaatcatagatgagtaaaaagccccgtaattggttcttatatgtattgcatgcatggctgatcataaatttgtataactaatcatgctgtcgaatgacttgcttcactaagcactctgcattctttagacagaagccatgtaatccttttttatcttcgccagtctcacaaccacttcgctcattgtcattctttggtctggtaattcatgtgagcattgtaaacccaactcaaaaactgggactataaagttattcaatgaactagaggaatcttgcaccagtaaccggttatccaccacatccatgacatttgatggaaatgcactagtaacccactgccttagagatagttctccaacaaacatgggatcagttggcctctttccagtgaataactccagaagcataataccgtagctgaatgcatcgcttttccgtgatgctttcccaactgacccatactctagcaatattttttccaaacaggagaggaataaattagtagcaaaactaatagttgaatcaaaacgagagaaaaaaaaacatactagaaatacctggtgccatataaccaattgttccaggcatacttgcagaaataacagagttatcgtcaccacgtaacagttttgcaatcccgaaatcggccaccaatgcaaccatgtcttggtcgaatagaacattgcttggcttcaagtcgcagtgtaggactacctcacagtgatgatagtgaagatactccattgccatggacacatccaacagaatgtccagtctctgaaggaatcccagttgctctccaccttcagagtgtagctgtgtttctaagcttcccttgggcatgtagggaagaaccaaagctctgaagtccaggttgccaccccc

SEQ ID NO: 86014 - DNA, 8055 bp, Oryza sativa
ggttgctcatttcataccagtgcacactacttatacaggcaaagggtggcagagttctatctctcaagaatcatgtgtttgcatggagtacccaagaagattgtatccgatcgagggaatcagttcacctcaaaattttggcaaaaactgcaggaagaattggggacccgtttgaatttcagtacagcttaccatccgcagacagatggccaaaccgagagggtcaatcagatcttggaagacatgttgcgagcgtgtgcgctcgatttggtggggcatgggataaaagtctgccttatgctgaattctcgtacaacaacagctatcaggccagtctacaaatggcaccgttcgaagcgttgtatggccggaagtgccgcacgcctctcttctgggatcaaacaggcgaacatcaaatgttcggaacggaagtgctaacggaagcagaagagaaagtcagaaccgtcagagagagactgagaattgcccagtctcgacagaaaagctacgcggacaaccgccgaagggagctcacttttgaagcaggggattatgtgtacctccgtgttactctgctccggggagtgcatcgtttccagacgaaaggcaagttggcaccacgcttcgtgggaccgtacaaaatcttggaacgaagaggagaagttgcctatcagctagaacttccatccaacatgatcggcattcatgacgtgttccatgtgtcccagttaaagaagtgcttgagggtacccgaagaacaagccgattcggagcacattgacatccaagaagatctgacttatgtggaaaagccagttcgtatccttgagaccagtgaaagaaggactagaaacaaggtcaccaggttctacagggttcagtggagccatcactcagaaaaaaaagcaacctgggaaagggaagatgagttaaaggccgcccatccgcacctcttcgccagctcttccgaatctcggggtcgagattccgtttaagggaggtaggtttgtcaaaccctgaagttctttcccaagcctaaattgaatttataaattacctagaggaaatatcggtgtaaaagtaagagagaaaccctaataaattaatgcaaataataattgggattggcatgtggaatttttcttgagttctacatgtcgaaatatgctaacaagatttttagtggaattttcagagctctagaaataattttaaccaactaaaaatgagcacaagcattatttaatctctggaaattcaattctttctttttcttttcttattcccttgtcacgcccggaatttctatccaaaattccaaacgcttacatgtgtgtgaaccctcgtccaggaatcagccgaggcacacaataacaaattgataatagagttcaattattactctaaataataagcgaataaaatgtcattacagaggtagatagttcctctcaatcaataaagatctaagtagcggaaaaataagataaacggcacagacgactccactctacaggcagcttgaccagggttacacctaatcctccacaccaacagcttcactgtagaactcttcctctgatgaacgattgcaaggtgagtatatgacatactcagcaagtcacgcagcaaatatgcaagtgcacaggataacaaaggatggcatagtagggtttcatttgcataaacagcatttaataaacatttgagaatttaataaaacagttaagtaataattaaacaatattaatccaacgctatacaatataccctgttgtataagcccaaccattctgaacaaccacacccggctgtacagatctatctccaaaccaggaatataccattccaaaccaggagctaatcaaattattaccagttatagcatcttttattatgatgagaggtgtgagactaatcacgaaagacattgttagacccgcccataaccgcgggcacggctattcgaatagttttactctgatcagaggtgtaccactgtacccacaagacacagccccacatcatgtcaccatgtgcctcaataccaccacggtacctcggaaaggagctgtgacaataccccttgcataacacaatccaccgcaacgcaccattcctggatcataatcacccccttataaacaaggcatggactccccagcgacccctgtgggcttatctccgccacttctcagtctggtgccccgcaataaaccatgctatacaaaaggtaaagccgttgcccacgctggcttgtggttggcacggttaatgtttcacaaccaaaactcgtgaaccggtccttaattgtcatgagcacgactctcaaaaccacgtgctcacaacccaccattatcaggttttaattggcacattaattaattaaccaatcacgattgaccatcgtgagctatcattaagccatcattaaataatagtgagtcataagttatcccagtaatgtgctaatgtttctaagcatggctaagcaatcatatctaatatatctagttgaaccaatatataaagcccaactagtcaagttataataacccaaggtatcaaggaataaagtagacaagaacaaaagggctataacaaacaataggttaattccacccaatgacattcgaaaataaatgcaatagttgaatagaaacagtagctttaaacaggatcaacatgctcaaagggttatttgggatctgtgtgacttgccttgctggccttggaactcttcaaattcttctcctgcgaaaacggactctccggaaacgtcggaatctaaacagaaaagagcaaaaacaccaaaacagcacataaacaagcatgaacagtacatgtggatatttttaacatgtagatctcaattttagaaaaatttagaaacttgaaccaactaaatccgagctaagatgaattaggtatgaatttttaaagattaaaccggattaaaacacttatatggattttaattgaattatgacgcaataatgaattatttttgaaaaggaaaagggaattattgcgttagcggctagggtttgcggtggaccaggtgcatggcaacggttcacgggaacgaacggccgagatcaatccatccaaaacggacggccgagatcgatcgggtctacggcggctcacggcagacggccccgatgacgtcggcgatgacgtcaccaccggcggcggctcggcagctcggacggcgcacactcaccggcgaacgacggcgcttcggcatgaacggaaggcaccaggacgtagagcgcgacgcggcgaactcaccggtgaccaaagaagcggcggagaaacaacggacggcggcgacgacgaggaagaagcggcgacggtcttcggcttgacgacgacggcggtgctccggcggtcttcagcgacggtgaagtggcagacgaggacggcgacgcgacggcaaccacgatggcgatctccccgagcgacggcgacggctgaagcgacggcgaagcacggctggagcgacggcgacgacggcggcgctaggtcacacggcgctagagctcttccgacggcgagagacgaaggcgagggtggcggcgggtagaggagacaccgggggtccttatataggggttggagggcggcggcgaaggcccacggcggccggcgacgcgaaggaaacttcgggttcgggagagagagaggaatccgattcgacctcaaatccatgaacttccaaagcgagttagacgatgattccaaaagagaaaaggtagaggagatcccaaagattgtttcccctcaaatgatttcaccggatcgggaaagacgcggccgaatttggaaggagacggcggcgctagggtttcgggcggcggcggccagaggtagacgaagactgacaggtgggccccacctgtcagcgggcggacgcgcgcgcgagcggcggctgcggctggactgggccgactgggccgaaggagagagagagagaaggttttcggccgactttcggcccaaagccaaaagagacttttaaaatcctttttcaatttaaattattcatgaaatgcaattccatttaataaaaatacttccttagctcatataaatcccagaaaaatctaggaattatagaattaagcacagtatttaatgaaattttatctggccccattttatattggaatttattaattaaaattagatcttctcttctagactttttaaaataaattctaataattccaattaaacaacaatttatatatttaggatttttagggtgtgacaaacctacccccttaaacagaatctcgtcctcgagattcggaagaactggcgaacagatgcggatgagctgacttcaattcatcttctcgttcccaagttgattcttcttccgaatgattactccattggactttacaaaaacggataactggattcctggttcttctctcatctatttccaaaatacggattggtctctcaacataggtcagatcctcttggacttctatttgttcaagattagcttcttcgataggtacccttaaacactttttcaattgcgacacatggaacacattatggactcctgccaaagattgaggtaactccaactgataagcaacctctcctcttctactgacaatcttataaggtcccacaaaacgcggtgccaattttcctttggtgtgaaaacgatgaactcctcgaagaggcgtgacacgaagatacacataatctccttcttcaaaactcaaatctctgcggcgattgtcggcataactcttatgacgagactgggccactcgcaatctttcttgaatgattttcaccttttcttctacttccctcaggatatccgtcccgaaaacctgacgttctcccgtttgatcccacaaaagcggagtgcggcacttccgaatatacagtgcttcgtaaggagccatctgaagactagcttgataactgttgttatacgagaattccgcataaggtaaattcttatcccaacttccaccgaagtctaaagtacaagctctcaacatgtcttccaaaatctgattcaccctttcggtttgtccgtctgtctgcggatgataagcagtactaaagttcagcttagaacccatctcttcctgaagtttcttccaaaaatttgaagtaaactgactgcctcgatcagacactattttcttagggacgccatgcaaacacacaatccttgccatatacaattccgccaaccgacttccggaatatgttgtgtttactgggatgaaatgagccactttggtaagtctgtcaactatcacccaaatagagtcatggcctgatgacgttctgggtaaaccagtgatgaaatccataccgatttcctcccatttccattcaggaatcttcaaaggctgcaacaaaccggcaggtttttgatgttctgccttgactcgctgacaaacatcacatactgctacgtactctgcgatttcacgcttcatacttgcccaccaaaatctttccttgagatcctggtacattttggtactaccaaggtgaatggaatataaagtatcatgagcttctttcagaattgcatcttttaaatctttgttatcggggacacagattttctcgcccaaccatacagttccttgctcatccctcaagaaaccgatagcttttcctcttctcatattctttttgatttctagaatatcaggatcattaatttgggcttctctaacttgatcaattagaatgggctttgcttctaaggctgcaacgaaacctctactggcaattcccaaattaaatctttcaaattccttgcataattccaatggcaactgtcgtcctttcgtagcattgcaatagcctttcctgctaagagcgtctgctacaacattagcctttcccgggtgataatgaattcccatatcataatccttaattaattccaaccatctccgttgtctcatgttcagatccggctgagtaaagatatactttaaactcttgtgatcggtatacacctctgtacgagtaccgaaaagataatgacgctaaattttcaacgcatgaaccactgcggctaacttaagatcatgagtagggtagttctcctcatgcggacgtaactgacgagatgcataggcaaccaccttcccatcttgcatcaaaacacaacctaacccaagcttggatgcatcacaatacacttgaaaacccttctttggatcaggcaaaatcaaaataggagctgatattaagcgatccttcaactcttgaaaactctgctcacattcttctgaccacttgtacttcacatctttctgaagcagtcgtgtcatgggcttagcaatcttggaaaaattctctataaacctccgataatatcctgcgaggcctaggaaactgcgaatctctgaaactgtctttggttgtttccagttggttacggattccacattactaggatcgacggcaactcctcctgctgagatgacgtgaccaaggaacttcacttccgacaaccaaaattcacacttgctaaacttagcatacagctgatgttctcgcagcttctccagtgcaaggcgaagatgttcttcatgctcttctttggttcgggagtagataagaatgtcatcaataaagactaccacgaacttgtctaggtattccataaacaccttattcatcaagttcatgaagaaagtgggggcattggtaagtccaaaagacataacagtacattcgaacaatccgtatctagtggtaaaagctgtcttaggtatatcttcctctttgattctcaactggtgataccctgatcgaagatctatcttggagaaaatggtggcacctttaagctgatcaaacaaatcatcaattctgggtagcggatacttattcttgatagtcacatcatttagagcacgatagtccacacacatcctctgggtatgatctttcttttccacaaaaataaccggagctccccatggagatgaactcggtctgatgtatcctttctgaagcaaatcgtctacttgcctcttgacttctgcaaactcattggttgccattctataaggtctcttgtggattggagttgttcctggtaccaaatctattctgaactctatatcccttttaggcggcataccaggtaaatcgtctgggaacacatcaggatactcccggactataggaatctcttccaacgttatttggttcagtcttgaccttaaagactcagaagacaatgcatgaacagttacaactcgaccatcattactggtaagagttacttttctgttagcacagtctatcacacctttatatctggctaaccagtccatccctaggatgacatcaaggtctttggattctaacaggataagattggccagaaatggtactccctgaatttctattctgacagaggggctacgttgcaaagagagtgcttgattacttggggcactaaccatcaaaggacgtctaagatcttctacttccatcccatgatttcccgcaaaactcatagataagaatgaatgtgtagcaccagaatcgaaaagcactgttgcaggaactaagttaacaagaaacgtacccaaaatcacatctggagcatcttgagcttctgcagcagcaacatgattgacacgggcctttgatgctggtacggtagagttgctctgggtagggacaaccttcacacgtcggggcttcggacacatgtcagcgtaatgtcctgggtctccacagttgaaacacaccacgggcttgctgccttgctccctcttggcaggttgttgctgtgtcggagctgcaaacaggacgtggagcttgattgcggatgttgttgccagcattgttgttgaagaactgacgctgcggacgaacaacagacgaagaacctccctgtggcatggactggggtcctaaagtaagacgcggcttctgactattccccttgtgtgccatgaaatgagcaatctgacggttcttcttgtccatgcgggtgtactttgtcctccctgacgaatagct

SEQ ID NO: 86015 - DNA, 2035 bp, Oryza sativa
tcacatctaatactaggttgattttttttgatggagaaagagtagatcactagaatgaattaatcgatctggtagtggtatgttaggatcaattgattagctaaactataataagttgtctcccacttatacttattaaatttacctttgttttgccgcacgtgaaactacacatgctcaaagccaagttaattggctttttaccgatcaagcgatgttaatttaccgcacatttgtggagaaagcgtttgtagtcccggttcgtaacctctttagtcccggttttcaaaccagaactatcaatccgggactaaatatcgctatctttagtcccgggtgaattgagatgacctttttttttcatggccctgttgctgcatggttaatatatatatatatatatatatatatgaacaaaatatatatttacattaaagaaaatgtgtacatgcgtatagaaaaatagacatgtattatttacaatccattatgatgtcctagctagctacgatttcgatgagtagtagtcgttatctcagaagctaaggacctatgaattgtatttccgtcgtagtagaattcacccttgggatcaaggatttattcgttgatgaatcccatgagttattcttgaaccgccgcgataaattccttgtgtgtgatcagattatccctcatgcgaataaactatatgaatgtatgaaattaattagtaattaaacaacaaatcgatacgaacgcagtgaaattttgaatttatttgtacgtacatcgagctctcttgtggtgatgatttggtctgcaaggcagtggtaatactcgcacacgtagtagccgcacaaattagttctctgcttttgctttgcgcacaataaataaatgacaaacggcgagagatctaattaatatacacttattaatatacacttgtatgtatttgaattggagattgaatataaatgtagagcatgtgtactcacaggaaaattgaacttccgcctaagtctttctctccatttgccgcggaccaaatgacggaaccgataccaagccctatatggagtttaaagctatgattcgtagtagcaattaattataacaagattcttaattaacataggaacttatgacaatacctatctataagttcgaaaaccttgttaaacgtagactcttttttatccattgagtcatatacattgacggtgcaggcctccaggtcgaagagtaaaaggacccaatggaatctgcaatgtgcgtgggatgcattacacatgaaacacttagcatgttcgtacgggaatgaaatttggtataggaagacagtaaaaactaactctgtgttggacggcaatagtataaacgtcttgtaatgctgcgccttcaggagatggatgagattgtcctctgtggcttgcggatactggtcgagcattgcgacatttactttccaagggtcgatgaatccagtatcgaaaaccccccgccgtcgggccctttgaatctctattctacaacgataaaaggaagtatatattatatatagtctacttatatagaaggacctaattaattaaaggaaacataataagaaatctaactgaacgatacttacaaaatccagcaactcataatagagacgtcgagggcgtccagctggtatagttcgtagatacccttgaaattgatccagagaatgtcatctccttgcaagaagtctgtgtccctgatcctcgctccgatcatctctctaccggtggcgctcatctccatgtacagttgatggaacttgtacatttgtgtgggtagggactgcagctgctcaggctagacaagcgatttaccgagttcgtacatgtatttcacttccgccttttcgattggtgcgcctcgtagcaattgatccgtagttagcctggtgtcattacacgcgagtggaaacaactacgtactgcgcagtatatagttacaaatctcagctcagctcagattctcaaaaaaaaaagaaagaaagaaagaaaaaaactgctaggcg

SEQ ID NO: 86016 - DNA, 5031 bp, Oryza sativa
taaactaactttgtcagcataagtaaaattattcgagtagattaattttccattcatgatataaaaagatcatggagccataccttttattggcaagagctcatttgtgtcatgacaaagagttggcaaagcatttgacaaacggatatttgcactgtctgccccagcttttcgtgaccttttgcttatgtccatcacttgggagagctgtaagtcagatgtccacgaggaacttgaagtggtgtttgcatggttaagtggagcgttattatcccatgcgaaacttatttgctgcctatcatctgcaataacatttgaaattaagaaagagaaacttttagaaaattacaaagacaaggagggaaactacccaagcattattaaggtcaatggtaaatgattttttgattcctcaaagaaaacatgtcaggagaacgaataaatgcatgctctttgttttgatataccgtccaatagattttgcattgacaaaatcccaaactaaagtggcattaatataatacagtagtggctaaggctactatcccatatggccatacatgctattattttcatagaaaatagtgaaggatccagctaagcattatttcagggaaatacagtgtatgacatcgtgagatataatcttgattttttttcagatattaaatatgcatcacatcagccaaccaccaacaattttctccaatatattactagacagaaactacaaacaacactgtgattgacttttgtagtttatataggtcacgagggtattaccaaacagtgatcgcggtagtgttccagagccaaaagcaaacacatctgtctgtggtttccgtcgacgggcattatgatcagaaagtcgtctccggcagctccgtttctcctgatcaaactccgaaggcgcgtggaaccttgataatcccaagatagaacaaaaaaaatcatcaaaacgacataaacatgccgcaaaacgtaatgaattattgtttataaccacaattaaaagcagaatttggtcacagggagtttctggcaaaagcagatgcaagaatgcaactatgcaaaatactactatctacacatagcaatcactcattgtactaacacacacctctttgctgaaaatacacattcacatagacacgcaagccacaggccgtcctaccagaaattcaggaagccttgccttgcacagacaattcactgtcttggcagctttccagatgcagggcgtacaggcaaattctagcacagtactatcgacggggaaacaggatcttacctccccaaatcaggcaaggggcagagaaccttgtgaccaatcagtcatgcacagagtttcacactgtaccagcacaaaatggccacatacatatttataccctatcttttactgcacaggtagtatagtaatagtcgtactaatgattactactatgcacttaggcatatcgaagcaattcaaacagggcgcgaattcgcccaatcgaatcactaacggggcgattgaatcaattactagtagaactttagggcttgtttagagagcttcctgacggccgcagtttctccagtctcctaagagaagtcagcttctccagattctcaccaactatgcttctcagaatcttaagcgcggtattggaggagaggagagcgagaggggaaggggaggagggctgagtggctgacctgctgcactgctggcagaagcggcggtcctggccggcgacgacgacgcggaggcacttggtgtggggctcgcagacgcggtgcttgcggtagtactccttgtagcctcccagctccagcccgcagccctccacctggcaccgcggcgcctccgccgccaccgccgccgcatcccccgctgctgccgccgacctcccacgcttcgccgacgccgacgccgacgacgaatccctcccgccgcgcttcccgggcggcggcggcggctcggcggaggcggtggcgtcccagtcccagagcagggaggaggaggtggtggaggagacggggttgcactccatgggcgggatcccgggggtggatcggagtcggaggaggaggaggagacttggggagggaggagacgacgcgggtggaggagggcgagggtgtgggggttatagaatagggccactacagtgtggggaaggaccggaggtaggggtagtggggttggtctctttgttttccttctctttttttccatcctatttggtgatttttgatatgtttggagtagtgtcaatttgtgccaagctaatatttcgggagttttaaatagtactttgatagtatttggattgtaaccaatttttgcctagctagtaataaatctacgcttgacactaccaacattttggtagggcctcaaaccaaatcagctctttatatttattactccctctgttttttaatagatggtgtcgttggctttttaatacatgtttaatcattcgttttattcagaaattttatgtagctgcataagatataaatcatgcttaaagtactttagtgataaaacaactcacgacaaaataaattgtaattacataaatttttttaataataacacgaatggtcaaatgtgtgttcaaaaaagtcaacagcgtcatctattagaaaacggagatagtgttaattttactccctctatctccaaaatagactacatttgttcgggaaaatatgtaagtgtaaatcgcaatgtagtaaatacttgaaaactatcattggattaaaaaaatagatgcttgagatttgtttttaattcttggtgatgtggacaaataccatgcgtctattttttaatacaacggtagttttcagttttcactgtgtatatggtttaaactatatattttccttggtataaaccatccatgtatgcataaataacacgtctctatcttctaaaattattttttagtcctctaccctcgagatcttttattctattagatgcgtacattgaatttattgagatgattcaaacaaggatgcagttgactagtttgtataaatatttaatgtttatgataatatttgattaaaattttaaagcttttgctataaatattttcttaaatgtttagttttgaaacaagaaaacgatatgcctatattttttttcttcaaaagtaataccacaatatacaaacttattagatttcataaacttactttaatataaaattgatgataaaagtttaaaagtttgaccgaattttgctctaaacgttaaatatttgtaagcagtgacaattatatagtatttgtaagcagagattgttatataaggttgtattagtttatgcatatagcatagagctatagaaggaaaataaaaatgcaataggccatgacaaaaccataaaaaaaaaaccttcaaaccgtgtgccgacgctgatgtgcatatgatttttttttgtcaaatactatattatgcatgtcaacgaggagcagtaacgacctaaccaatatctatattctgagctcagttctcaacccgtctctaaactttgaaaaccttctagaaggtcatgcacggtgctaccacatttaccttaaaataagttaatctagcactagatatgatatattctagtattgtaaatctaaacatgcaatacatgatttcgaaaggaagtatattaaaacatgtagacaaggcagtatgctcatatttagacacagaactatatggtttagtattttcgttgtcaactagggttgcgtgtgtacttgatagtatggaatacccagagtatataactacaattctacaactattagggaatgtctatagttaaaaaaatgtaccctgctatatttcagaacctattgccttatgtaggaatgctactaaccttttattgataatggtacttggtaggatgtaaaggaatatttctcatgctaatgaaaaaatacattatgagagagcatagatttttggttgtgtaatgtattgacctatactagtgttggagctcacttgtcattgagatttacaatccattctttgtcgtatgggcggtttttaaatattatctctgtttttcaatatgtaacgccattaatttttttataaatgtttgatcattcatgttattacaaaaatgcaaatataaaaaagttatgcttaaagagcatttgatgataaatcaagtcacaataaattaaatgatggacaaatgatcaaacatatctcaataaatcaacggtgtcatatattaagaaaaaacggatggagtaactcagaaagttcagagaacggaatgcatcttgcattatataggtgccaaaaaaaccctaagatggagccggtcaagactcaagagatggagaaaattttcaattcttttgacaaatgacaagtacaggggctacgaccaatttagggagggaatgtctgtgcgaacagtacaataactaggatgtttcatgacttctcgaacaagtatgtacacaagggaaggtggacattagagcaattttaatagtatagcccattactaactttaaatcatctatagccaatataatagccaattcatacaataattgcttactatactattaatacctggtcccacctatcatacacacattatgtcttgaaacatgtgctgcagctggctacagatctgtaacccgctgctcttctctcttttcctttatctttttaaaatatgtttataactggcttatagcctgctattatacctgctcttaggacttgggacttgggaggctctggttcagctactagttgatcaaatgcgaaagattgacttggtaggattttttattctttttttcctttttgaaaagaagattgacttggtagttgctgatcgtatgcctctcaatgttgcatgagctactagtagttaggccgatagtcatacaatactttgaccatcattgagacgcatatgaaaatccgctagcttttattaagagcaaattccctgactagattatcatgaaactacagatttcaaaggg

SEQ ID NO: 86017 - DNA, 1080 bp, Oryza sativa
cggtcggtgaagacgtagacgcccaacagcggcggcataataggccaagacgcccaacaacggtggcataaaggccagccgtgcaggcggaaacaccagtcagcagcggcgaaggcaagccggtcggtgaagacgtagacgcccaacaacggcggcataaaggccagccatgcaggcggaaacaccagtcggcagtggcggatgcggcggccggtcggtgaagacgtagacgcccaacaacggcagcataataggccagccgtgcaggcggaagcaccagtcggcggcggacgaggcggccggtcggtgaagacgtagacgcccaacaacggcggcataaaggccagccgtgcaggcggaaacaccagtcggcagcggcgaaggcaagccggtcggtgaagacgtagacgcccaacaacggcagcataaaggccagccgtgcaggcggaaacaccagtcggcggcggcgaaggcaagccggtcggtgaagacgtagacgcccaacaacggcggcataaaggccagccgtgcaggcggaaacaccagtcggcagcggacaaggcaagccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtggacagcggacgaggcggccggtcggtgaagacgtagacgcccaacaacggcagcataaaggccagccgtgcaggcggaaacaccagtcggcagcggacgaggcgaccggtcggtgaagacgtaaacgcccaacaacggcagcataaaggccagccgtgcaggcgtaaacaccagtcgccggcggtcgaggcggccggtcggtgaatacgtagacgcccaacaacggcggcataaaggccagccgtgcaggcggaaacaccagtcgccagtggacgaggcggccggtcggtgaagacgtagacgcccaacatcggcagcataataggccagccgtgcaggcggaaacaccagtcg

SEQ ID NO: 86018 - DNA, 1776 bp, Oryza sativa
acgcatatacttcagttcatctcttgaatcctcatctgctgaggaatttgttgatccgacggaagcgttgcttcagaaatagagaagaagcaatacttgttctggagtactgcttgagtgacatgggagatccttcctttcctgataaattgcaagggttagctcttcttcctttggcaaatggatcattcacaacatttaccaaccggggggagggtgaaagagtattcttttcttcacaaatggaatttgagcttctgaaggactctataccacatcttgttgttgataactctttaccggatgccattttgaagaagttatatgacatagcttgttctgcacggtcaaacatttacttattcacatgcaattttctccttgagttgttgcctaggatcttgccacctgaatggcagcatgctaagcagttattttggtctcctggacatcaaggtcagccaagtgtggaatggatggtgtcactctggaatttcttgcgacattcatgtgaagatctttcaatttttgcaaaatggcctatattaccactggtagatggcaagcttatgcaacttggcaatgcttcaaatgtaataatagatgatgggtggagtgaaaatatgtactcgttgcttcagaaactgggatgtttctttctgagatctgatctgcagatagaacatccgcagctggcaaattttgttcaggaagccactgcagttggtgttttgaatgctgtgcagtctgttgcttctaattttcaggatatcaaggaattgttcatgggtatttcactggcagaaacacatgagctacgcagttttattttccagtcaaagtggttttcaggaaatcacatgaactcttcccatatgaatacaatcaggaatcttcctatatttgaatcctataaatctagagagcttgttagcctgacaagtcctagaaaatggcttaaacctgaaggtgttcatgaggatctgttgaatgaaagttttataagaacagaatcggcaaaggagaagtcaattttggtatcatactttgctattacggaacctcaaaaggctgaattttacaaggaccacgtgcttcctcgaatatccgagtttctatcacaaccagctgttgtttcagcaattctccgtgatgtgaaactattggcagaaaatgatacttctgtgagagctgcatgacatcaaacccctttcgtcatggcagcgagtggtgcatgggtacatccctccaggtctctctctctctctctctcttgcgcgcgagcgcacacacatatgtagaagtgtattttgtttagtagacctcttgattttattgtgtgctgcatcatctgctatgtgcactaggactaatgttcatttggcaaatgctttgtctaatctgtacatcagcttttcctttgatatttgatgaaacagcatcccatgtagaagtaaaccttcataatggaaacaaataactggaacctatttgatgtaggaagttttgtataattctatattggatgtaatctgcaatttctttttattttcatcaataatgagcttgttacgtccatgaataccatggatttcatttttatatttttctgcttccctttactatctagattttggtacatagaaataacttatattttccttcagactttatgatcctcgtgtgcctgagttacataagttgctgcacaaagaaaccttctttccttcagagaagttcatgacgactgaagtaattgaactgcttgcaagcttg

SEQ ID NO: 86019 - DNA, 992 bp, Oryza sativa
tttgggccacggatggcgagggcggcgagggggccaatggagagggagttgatgtacgtgcaaggctcggtgcaggacgagttgccacgcttgtcggagaagttgtcgccgccgtcggggccgcccatgatcgcgccggtgagctcgttggggttgggccggtcgggggtgaaccactcgctgaagctcatcccgcagttgacctggtagcccggggggagcaccggggtggaggcgccgcggtggtgcggctgcgtgggcgggttgacgccgaagccgacgacgtaggagcggccgcgcgggttggcgccgaggaggtagtcgatctgctgcttggcgaactggaggaggcgggcgggctgcacggcctgggcgccgcacatcaccggctggttgatccggcggaggatgtcgctgtaggcgacgaagaggaaggccgtgctggtgacgtactgggagttggcgccgtcgcggaggtggatcatgccgcccggggtgatggacacctggtggaacggggtgtccgggagcacggcgcacacgaagttgtcggcctgggacttgaagctctggaggccgccgctggatgtcatgttgagctccgcgaggagcacctgcgcgcccgggaacttgaggtcccagctgaactcggccacgctcgacgagatcgcctcgtgcccgatgaagtccgcgtacacctgcctcttcgtcgccaggtacagccacgtcgccgcccacagcaactcatcctgatcgatgcagtcacaatcacaatatatataacgtgtcaaattttttacgttgataaattttgcatgcatgcatatgcagagacgtacgttgtagccggagtaggagcagtagaaggggcactcgccgtcgtaggttccctggtgcgtcttggcgaactggaacagctgtgaatttccatttgtcatcaggtagtagctaattagatgcaaattaactatataagagaaattaacagatga

SEQ ID NO: 86020 - DNA, 8158 bp, Oryza sativa
attcatgctgaaagatgtggcactagtaagtaagcttaagtacaatttgctctctgtttcacaactctgtgatgaaaatctggaagttcgtttcaaaaaggacaggtctcgagttcttgatgcttctgaatctcctgtttttgacatttctcgagttggtcgagttttctttgctaacttcgactcttctgctcctggtccttctcgttgtctcattgcctcagagaatagggatttgtttttctggcatcgacgtcttggtcatattggctttgaccacttgtctcgcattagtggtatggatttgattcggggtttgcctaagttgaaagttccgaaagatcttgtgtgtgcaccatgtcgtcatgggaaaatgacatcttcttcccacaagcctgttacaatggttatgacagatggaccgggacaactgcttcacatggatacggttggtcctgctcgggtccagtcagttggggggaagtggtatgtcttggttgttgtggatgatttctctcgctactcttgggtctattttcttgaatcaaaggaggaaacatttggcttctttcagtctcttgctcgtagtttggctttggagtttcctggtgctcttcgagccattcgcagtgataatggctctgaattcaaaaattctgcatttgaatctttctgtgattcttctggagtcgaacaccagttttcttcgccatatgtcccacaacagaatggggtggttgagaggaagaaccgcacccttgtggagatggcacgaactatgcttgatgagtttacgactccaagaaaattctggactgaagctatttctgctgcttgttttatctccaatcgtgtgtttttgagaactatcttgcacaagacgccatatgagctcagatttggtcgtcgaccaaaagtttcacatctcagggtcttcggttgcaaatgctttgttcttaaatctggaaatttggacaagtttgaatctcgatcattggatggcattttccttggctatgctactcattctcgggcttatcgagtttatgttctttcaaccaacaaaattgtggagacttgtgaagtcacttttgatgaggctagcccaggagctagaccagaaatttcaggtgttccagatgaaagcatctttgtggatgaggattcagatgatgatgacgatgattctattcctccacctctagacagtacaccaccagtgcaagaaaccggttctccttcgactacatcaccttcaggagatgcaccaactacatcatcttcagcagctgaggagattgatggtggcacatcaggaccgacagctccccgacacatccagaaccgacatccgcctgactcgatgatcggaggcctgggtgaaagggtaactagaaatcggtcttatgaacttgtcaattcagcttttgttgcctcttttgagcccaaaaatgtttgtcatgctttatctgatgagaattgggttaatgccatgcatgaagagttagaaaattttgaaagaaacaaagtttggtctttggtagaacctcccttgggttttaatgtgattggaacaaaatgggttttcaaaaacaaactaggtgaagatggttcaattgttcgaaacaaagccagactggttgcacagggtttcacccaagttgagggcttggactttgaagaaacttttgcaccagttgctagattagaagctattcgaattcttttggcttttgctgcttcaaaaggtttcaagctttttcaaatggatgtgaaaagtgcttttctgaatggagttattgaggaagaggtctatgtcaaacaacctcctggttttgaaaatccaaaatttccaaatcatgtgttcaaacttgaaaaagctctttatggtttaaaacaagctcccagagcctggtatgaaagattgaaaacctttttgcttcaaaatggttttgaaatgggggctgttgataaaactctttttactcttcatagtggtattgattttcttcttgtccagatatatgttgatgacatcatatttggtggctcctctcatgcacttgttgcccagttttctgatgtgatgagcagggaatttgaaatgagcatgatgggagagctgactttcttccttggacttcaaatcaagcaaaccaaggaaggaatctttgtacatcagaccaagtactccaaagagctcctgaagaagttcgacatggccgactgcaagccaatcgccactcccatggcaactacttcatcgcttggtcctgatgaggacggtgaagaagttgaccagcgcgagtacagaagcatgatcggctccctcctctacctgactgcgtcaaggccggacatccacttctccgtgtgcctgtgcgcgaggtttcaggcttctccaagaacatcacatcgccaagcagtcaagcgcatgttccgctacatcaagtctacacttgagtacggtatttggtactcctgctcttctgccctttcagttcgagctttttcagatgctgattttgctgggtgtaagattgatcgcaaaagtacttctggcacttgtcattttcttggcacttctttggtctcttggtcctctcgtaagcagtcttctgttgctcaatcaacagctgaggctgagtacgtagctgctgctagtgcatgtagtcaagttctttggatgatttcaactctgaaagattatggtctgtctttctctggtgttcctctgctttgtgataatacaagtgcaatcaatattgcaaaaaatccagttcaacactccaggaccaagcacattgagatacggtaccactttctccgagacaatgttgagaaaggtaccattgtgctagaatttgttgaatctgaaaaacaattggcagacatttttacaaaaccacttgatcgctctcgttttgagttcttgcggagtgagttaggggtgatccacccctatggcttgatttgagggggagttgtttttcttttgcatgcatttgtaacatattgcatcatgtttactttatgcattgtattatacactcttcaattgagctttgcttgttatctcttggtcatcactatgctatggatgtatcactcttatgctagtttgatctcttgtctagctttcatttgcttaagtagcttgtgtgatcatgttatgctgttcaagcgtgttgaaacctgcttaaattaactattcatttgaactcaatcaatgtgcaatgcttgctctagaagtttgtttaaattgaagtatccttctcatactcatgccatgtttacattcttttcgcaataactgtcagtacatgcttatgaatgctcatgcttatgcgtccatactttgtatcaatcatgctttacaagttttatctctgtttttgtccgggctactgagtgcgtttacgcatgagtagtgccgaagatagcactgagacagcctgtaatgggaactctagctggaaaacttgattgaggtcagacggcagtgtttggcacaaccatcacttgctgactgataagatcaggtggaccgtcgtgattgtgctattgtctttaaagaaattaaaaaaaaaatcataaaaataaaagtcatgagaaaagattaaaagctcatgttctatgctttgttatcatgttgatactctttatgaactgggcattagcacattagcatgggttcattgctttgtttatgtaaatcttgcatgattatgagctggtttgcttccttttaagcttcttctagaaatagctttgcacactaaatcactaattcacttgaaagctttttgcttgctggcgatactaacttgatattcatgacttgtttcatacttcttatgcacatgcttagctaggcttgagcacatgcttgtatctgtgtgatccatgtctaccttttgatgcctttagataactctcaaagctctcaaaacctaaaatttgcaagtttcatctcatttttatcttgcatttttgtctcttttgatcttgatggcatcattgacaaagggggagagaaatttgcacttattgaaaattaaaacttgctttaaatcttggtgaaagggggagtttggcacatagggggagcattcttgcatttgcatttgcatcccttttttcttcttgtcacttggtcttgatttttcgcgatttcaaaatgaccaaagttcgcttttgcaaaatggtttgctttgtgaatcaaaaatcaaattttcaaaattttgcttgagattgtcaatgttcccatcaagggggagattgtgaaaccatgtgtggttatagttcttttgtgatgggaaattgacaagtaccggatgtgcaagaagtgtgtgtgtggactaacgttggtcaggttgcgacatctgtgccaagacaacggttgtttggttcatgtgtgtgcaggtgatcggggtcgatcttggtcaacggcggatcgggactagactcagggaggagttgaggtccaaagcgatcaaggatgccgggtgacaagattggacacaaggttgcacacggtggacgaacaccgtgtgaaaaggtctttgcaacaggcttcacaaggccaagtgtgcaagcatcggattcgcgaagaaatcagaagggactgtgcaagtgcattgctgctacagtacttgctgtaggtagcatacatgcatgtacacgtactgtacttgtgcaaggaggagcttgcactgtactggttgctactagcatggctcggtggaaaagtcaagctagctagctgtgcatgtgcgctgtgattggttggcagggaggccaagccaatccagccgttccacgtggcccaagatggtgaatggctcggctcggcaggcctgcatcgtccaagcagcgacggcccaagacggcggcccatggcgcatgggctcaggaggtgcaggcagcttgcatgcgcaaggacgcgcgcggaaaaaccgtacgcggcaacccccgtttcgcgtgactcgatcggaggcgggtgcaggagcgcgggacccacacgcgattttgcaagcgcgcgcgggagcggctcagcgggacgcgtggcggcttcgggctggttgggcgctggcgagcgcgcgctgaggaaaaggagacggaacgcgcacgacgcggctgggcaacgtggcaagtttggattcgtcaagacggagagcacgcggattcatcagcaagaagaccatgtgagggttcggatcgatgaggtggcaatcatctggagcttttcctttgagtagaaggaacaatggatggaccagatctgttctgagttagggtttcgccctaggggtatttgagaaaatgtcttaggggtcttaggctataaatagagagatggatgcaagggtggaggttgctccttttggtaatcattttgagatgctcggtgagagagtttccgtgtgagtttggagtgtgtttgcccgagaggcttttgtattaggattagtttggagtgtgtttgtccgagagattttaagtttgtgttaatgttcctctgaaggtgtatgtttgctcctagttgagcggttattttgcatcacctataaatgaaatgatttgaaggatttcatttttgccttgtccatttaaattccgcaatttaaattccgcttgcaatttgaactttgcgatgatgagttttgctctctctttctcacctcacttctagtttcgggaattccttttctcttcctcctctagtttcgggaattccttttctcttctttttctctcttcttttctagatccggcttctctaatagccgcgattctagtaaggattttgagaaatccggcttgatgagtattttcgggggcaagatttgaattgctatattcacccccccctctatagctgttcttggtctttcaattggtatcagagcccggttaagttcgttgtaacctaaccgtggcaacgaacgcagctatggaggaaaaatactctgcgaaaccatttgttttcgatggacacaattttgtcatttggaaggcacgaatggaggcctacctccagtcgcaagggcataatgtgtggaataaggttaaatctccttatactgtgcccgatgatgctgacatcacgcctgcaaatatggctcaggttgattttaattatcgtgcaagaaatgcaatcattggtggaatttcttctggtgaatttaatcgtgttcaacaccacaagtccgctcatgacatgtggactgctctgtgcaatttccatgagggaaacaatgatattcaattggttcgtcagaatcaatttcataaagaatatcaaagatttgagatgcacccaggagagtccattgattcttatttcaaacgttttggagaaattatttcgaagttgagatctgttggaaaagaattttctgataatgataatgctcgccatcttttgaattgtcttgattatggtgtttgggaaatgaaagttacttccatcacagagagtgcacctctgagtgaccttaccatggacaagctttactcaaagctaaaaacccatgagatggatgttttccatcggaaaggcctcaaacactcgatggctttggtagctgatccctctggtagtacttcttctaatgactcagcctttgtgtatggtggcttctctcttgccgctttacactcagtcactgaggagcaattagagaagatccctgaagatgatcttgctctttttgctagaaaattctcaagagcttacaaaaatgtgagagatagaaaaagaggaaaaaccaatgaaccatttgtgtgttttgagtgtggagagcctaaccacaaaagagtgaattgtcccaagttgaagaagaagagtgacaagacgaccaagaagcccgagggacaagggcgaaaggggaagaaggatttgatgaagaaggcgatccacaaggtcttggcggctcttgaggaggtgcagcttagcgacatcgactccgacgacgatgatcaagaaaagggggacaaggacttctccgggatgtgctgtctcgccaacaacgaggacttcatcaacctgtgtctcatggcgcttgaggataaggatgactcatcggagcatcctgaggtatgtcttgatgatatcccttccttggatggttctctttgtgatgattcttgctcagataatgactctgttgatgatgaactaagcaaagaaagaatggcacacttgatgattgaaattagtgataagtataggtcttctaagtataaaattgagaaactaaaatctgaaaatgatggaatggcgctagaaattgctaggcttcgatccatgattcctgaggaggatacctgttctacttgtgcttcatatctttctgaaattaatctcctcaaggataagttgaaatcatgtgctttaggagctgggaatccttctagtgctagtgctgcttgctctacttgctatgaaatgaaagttgatatgggtttgcttgagatggaattgaaagaactaaaagaaaaatttgttcatgataggattggtaggtgtgaaaattgtcccattctcactagtgacaatgatgaattaagacaacaagttgccatgcttaggaccaagaatgatttgttagaatcttttgctactaaggaacctattcattcttcatgtgctaattgtgctatcctggaaactgaactaaaagatgctaaaactgtcattgattctatcaaatctattgattcttgttcttcatgcatttctctgaaagttgatcttgagtctgctaagaaagagaactcatacctacaacaatctttagagaggtttgctcaaggaaagaaaaagttgaacatgatcctagaccaatccaaagtgtccataaacaatcaaggtataggctatgattttgctgagtctttgaggataggtacccatgagattttaggtgtcacagatgggatgatagaactagctcaaaaacctataaccttcaagtctgcaggtttcattggaaacactagttctagtacacccaaaacctcagaaccaaagatggtacctatgactagcaagtctaagcctgtagagttacctagacccaaaaatccaaaacaagttgagcacaagcaaaaccagagacaaaccaagcctgtagagaaaaccaagtatgag

SEQ ID NO: 86021 - DNA, 2058 bp, Oryza sativa
aactggagtaacaacccttttgcagaatggaataaaaaagatggctgaagcaggcgctgagcgtgagtgttcttcccctgctgaagattgtgctaaaggtactccaaaggaagagcatggaggattggtaagatttattacttttaatgattctgtacacatgctcatacacgcatgcacgcacgcacatgtgccaatttgggaagtggaagatcattgctacatttatggacagccaactattgtttgcacgaatgatcaaattataatcttattacctacaacttggcaatgaaagtgttctctactggcagcgaataactggcacaagcatttaaagtagtgagtagaggccactttcattgtcagtgttgcaatctatacttttctgccagctgtcaggtgagactataatttgctcattcatgcaaacgatagttggtctgtaaatgtagcaacgattttccacttccccaattagtctctcttgtgtatgtgcgcgtgttgggtgcgtgtgcgcgtgcctgacatggaaacacttgcattccatttatactggttacacagcaatacttgccttaataattttatcgctaagtgttcaactaaaaaaatattaaaaacaaactggtgaatttatcattattttattatcttaaggaactaaatctttcatcataaatactatctgactcccatccttgtgacagatatcgaacaacatctctggcaatacacaatttggaacttccatggcgataccaaatgaaaataaaggtaaaatatgatgaagtatctccctctgccttttcgtctctctgtgtaatcggtacaatttctggactgtaaaatacattttgattgtttgatggcctatccttttgttctcttttgcattagttactggaagttcaatttactgttggtaattgttcatccacaatcagaattaggaaaaaaaaattaaaattccacaaagccgcaaaaaacttaaatagcctgaaaagagattgcacaacattttctctgtaatgctgcatcagctctgaatgctatttgtagttgtgctagattgactgcttttatcagaatgtagtgcctactaactttgtaaattttcttagttagttagcttacttggaatatttatatgttgatggttgtaaatttgcaagtgttgatttaacactatttatatgtttattgctaaccatttaaaatattgccactctttagtggttagttaagagtcaaggtatgtgtgctgttattattattggtaatactgaatttgttgacttgtgagatgtgatagggctggtctgttcctctatatctatctgttttgtcgcaggcatttaagggccatagtgtatgccttctcaatttcttctgtttatgttctggtttatgggcatttacggctatttggatgtcttctcaatttcgtctcacttggatagctgttgctgcaatgctatctggcaatgcatttgccctttcttcagatatcattccctttcttccattatccggtcatttgtttgcctttttttagttcttacaatatgttattacaggtacatctcctggaaagaaaagatataacttaactgaggctgaacctggctcggagctggagggtgtctcttcattgaatcaatattttcctccaggtgataatgtaaaacatgagttaaacttggttgaaaatggtgttgggaataaccatgattgcaacgcagatcatgttcctggacagcccttttccaagtaagacgaaagaaatttcaaccaattgaattatagttgttcttctatggttttacttcccttctttgtttaatgtgacccccttccttattttctttttctgcatgctctctggaagatcttaactgctgttttgctgtgtgcagcttcaatgattcacactattatatccatccactcatcaaggaaaagatgactcagctttgggacaacacgttcaagcaagataagctggcaccatgtcaccctggtaaagttttaagggcttgtcctagctaactactt

SEQ ID NO: 86022 - DNA, 939 bp, Oryza sativa
ttccgcctgcacggctggcctttatgccgccgttgttgggcgtctacgtcttcaccgaccggcttgccttcgccgctgccgactggtgtttccgcctgcacggctggcctttatgccgccgttgttgggcgtctacgtcttcaccgaccggcttgccttcgccgctgccgactggtgtttccgcctgcacggctggcctttatgccgccgttgttgggcgtctacgtcttcaccgaccggccgcctcgtccgccgccgactgatgcttccgcctgcacgactggcctattatgccgccgttgttgggcgtctacgtcttcaccgaccggccgcctcgtccgccgccgactggtgcttccgcctgcacggctggcctattatgctgccgttgttgggcgtctacgtcttcaccaaccggccgccgcatccgccactgccgactggtgtttccgcctgcatggctggcctttatgccgccgttgttgggcgtctacgtcttcaccgaccggcttgccttcgccgctgctgactggtgtttccgcctgcacggctggcctttatgccaccgttgttgggcgtcttggcctattatgccgccgctgttgggcgtctacgtcttcaccgaccggccgcctcgtccgccgccgactggtgcttccgcctgcacggctggcctattatgccgtcgttgttgggcgtctacgtcttcaccgaccggcttgccttcgccgctgccgactggtgtttccgcctgcacggctggcctttatgccgccgttgttgggcgtctacgtcttcaccgaccggccgcctcgtccgccgccgactggtgcttccgcctgcacggctgacttattatgccgccgttgttgggtgtctacgtcttcaccgaccggcttgccttcgccgccgccgactggtgtttccgcctgcacggct

SEQ ID NO: 86023 - DNA, 1910 bp, Oryza sativa
  unsure (1)..(1910): unsure at all n locations
ttatttgtattttattgaattctgaagtcttatggtactcccttgtgttactaattctgacatgttcaacaggctgcagtccacataggttgctatagaaatattgagaatatttctggcccctggaagtgtgaactttgcgaagatatttcaccagaagacacttgtgttggtgatcaatcagattgcaatggcacaaacctgtccttagtgcagtgtgatctgtgccatggcacatcaggtgcatttagaaagactgcagatggacagtggattcatgctttctgtgctgaggtatttaaatgagtattatatttggttttcatgtgactcatcttgtgatatctaatatttctaatgctttcttagtggttgttggagactgagtatgtgaggggacaagatagtccagtcaaaggaatggtagtcttctatacccaacattacatttatccctttttcaattttaggaactcataggatcgtctcaactgcgtttattgtttgcacaattagaagctgaggttgtttgtcagtgttggcatatcatcttatattgcatcatcttgatgcttggctatttgatgcatttatcaggaaagtcttgtaaaggacaaagatacttgctgtgtctgccttcatactgttggcgcatgtctaaaggtacatcataatctttgctctttcttctagttcaatgcatgatgaaaccaaccatttggaatcttgataagtttgtctttttctaccattcagtgcaataatggggactgccaaaccacttttcatccttattgtgctagacatgctggtttctacatgaacacaaaaggatctggtggtattttgcaacacaaggcatattgtagcaaacacagcatagagcaaaaggaggtgagtgtattagtttaacatagaaactgttctggaatgatgagcctcttctttcctacctaagatcaggattctctactaatgctgtagataatctttcattatgataggaaatgaaattagtcaattgccttctcattttagcattgtgacacttaaacaaaagaaaggggggtggatgagggttcatataatcctatatccggtttgaaggctttggttgcatattctcattttccttccgatataatcggaaagggagcatgtgatgcatgagtagatggaaatcctgtgttggtacaattattttctgtaatcttattttgttattcgaaattgatgcaggctgatatgcaacagtatggacttgaggagttcaacaacatgaaaagaatgagggttcgtatatatgatgcatttcacttttcctattttgatctgtgatacaatatttttgttcagttactatctaaggtttctaacttccagtgcatcaaatcctgtgttccctcacttcctctttcttctagaggccctgttaatttttttttgtatttctataagtaatatttgtttttgtatttcttttttgtacttcaaacaatccttgaggaaatgtctgaaggatgtccattctcattgaacattgattaaatgatccctcaatccctgatgaaatatttacattacaattttgcaggttgagttggaaaaattgcgactcttgtgcgagaggataattaagagagaaaaggtgaaggtatgtgtggcccctacttatactttttgctttgtttcttaaaattgaactatatgaggaagctactttaagccctgtttggagaaactacctttgaccttgtgttttttcctctttgtgaatcaccttttgtttccttcatattaataggtgaaaatcttgcttgagttactcatttagtactccttccgtttcataatgtaagactttctancattgttcatattcatatagatgttaatgaatctaaacacac

SEQ ID NO: 86024 - DNA, 4719 bp, Oryza sativa
cccctatatgcacctgaactgtttaggctgtagttcaaattaaaaatgactatacagtagttaatgttattttctgctatcctgtagctttcagtaaggtgatacattggtatgcatgagtaatgttatatttattcatgttcgtgcttatgcgggacattttgtttgtttgttgctgaaaagctacattttccaacttttgcagaccagggatgaatagatgtgaagttagtgaagatgagactaccaatgctctgaatgcactatatgtcagtccagcccctggcaatggcgttgcttcggttggacattctcatgttgcttcttcagggctaacaacatcaaacactttgaatgtaaatggacatgttgaacaaagtaggaaaaggaagaatactctgagtgacggaaatgtttcctttgatgtttctcagcaaatgcaaggttcggtttatccactgagcaaccaacatgctcctattagaagtaaaagtgctgctgatagtatccagtttcctgttgagagagattctaaatcagttgaccatttcgttgagaagaaaaggtccaagagcaagaatcatggtagctcttctgatggaggttctgtctactgtttttccttctattctcctagtttggtttcccgtatgaattcactctagttgcatcatttggttatgtttcttttctgaaactttctttattcaaatacaggccatctcgtggaaagatccaagaagcattcaaaagtaaaaagcaagagagagatggatcatgatgaatacagaacttctaagaaaattaagaaagaggagcggcgccagcgccagtctggcatagattctaaccctggatatgatttagctagtggagacgttcctgatgaggccaaagctttgccttcaaaatcgatggccttacagggttcgagtgaaaggagtgatgttcctccatcaaagtataaaagtgtttctaagtataattcttcagaaaaatctaagagatctaaggatggggatgtttttcttcctgaagacaagaacaaggaacattcttacccctctgatgcacaaaaaccagatttgtctagtaagaagaggatagtgaaggaatgggaggagagtcagcacaattcaacacctccggtgagtaaaatgtctattgtaaaccaaagctcttcttccaaagaaacctgcaaggatcagaacttaaaggaaacaaagtcaaagttaacaaagtctgaagaaccgtttgccatgacagattcaaaatcaataaaagttgcacattctaatcaaacttcacgcaatctaaataatgagctatttgaggacagcacaccttttgctgttaaaagtggtatgtctgaaccacctgaaaatcgatcttctgaacaagctttggatttggctgaacctgcctccagtgatttggcctactttcagactacagctgtaacttcaagctcctcaaaggcttccggctctcagagaaggaaacaaaacttccacgttgcaaaaacttcaccaattgagtctgtctcttcatcaccacctagaatctctaacaatgacaaggtctcccatgacaaaatactgggaaaggatggatctacatgtgctaatacaaacaacatgcagagcttggtaaagaatactgaagttatagtagataatgttcggcaggccaggaagtcacatgagagcatgcttgctagtgaacctgttatgaatggtttttcacaagggaactctgataaagataatgaattgcctcagttaactcaaggccatgcttccaatgggattatttcgggaaggagtttggatgatgatctgcagcatgcatctgggaggaaagattcttctttgaaaagctccaatgcagctagaagtcataaccacttgcattatgctaataaaaataacttgcttactgatggctcttcaatccaacataggatggcagtcttggatactaaaggtgattccatggtacatgaaaacaagagaagtgttacttctctccaagacagaaatggatcaactcattacccaccagatggaaatccccaatcagaggtgtcattcggaaaagaaaagtcacatcccaagagcaacaagcatgatatgcagaattccaaagcccaaatgctcccctcacctctgaaagaaagtaaagtggaatcccactccgctccattaagatctaatgcatcaaaattgacagcacagttaaagcggggcaatgttgaaaatggagggcaacatggcattacaaaacaagcaatttctaatcctgcagacacttccagtccagttaggaaggataataactcaactggatatgctctcaaagaagcccgggatttgaagcacaaggctaatcgtttaaaggttcctcaccctagctctctttgctgtaatgcacatgaaagtgagttttttatatgtaaggttctcacatacttgtctgcaggaagaaggaaaagaacaagaaagtacaagactttattttgagtcagccttaaaatatttgcatgttgcgtcaaccttggaacctcctccaagcattgatggctttaaacaatgtgatgcagctcagaacttgtattccgataccgcaaaactctgcaagtaagttattgtagtactaatatatatgttggattacttgtacttgattgaccatagttttcttcctcaaataattggcactttcctgatccaaggtggaattccacatatatccatcattctccacgctgtgcgtcgatttttgtgcttgtaaaatcattaaagggtattttggtcctatatttatagcatatctttcccagtattcattattcagtcgaaagtgcctaatatttaaaaagcatacgagtattgtccttttccttctaccagcccaatttattgctatggtgaaacgtggtacaaattgagagggtgcatgatgattggatgatgacatcatttctgtgactctgcaatctgccatgcataatattttttagtgacagttctctcctgggctatgtttttttttatcttcttcatgaatactatgcatgaagaaccagaatgtactgcaaataaattcctggtagttccctcatgttgtaagttggaagtttgaagaagaggctctttcgtaatagaataccgatcgacgctagcgaggagagtggaatcacccgttggcctgaacggagagtggaatcacccgttggcctgaacttttcttctgcatggatcgacttagatggggtagtctaataacttggttcgcctgacggctgacgctgttcacagcacaatttatgtaaacagctgttgtactcaattcctcatgtttcatcactataattaattgattcatgtgattgtccagctttgttggtcatgcatatgagaagtccaagaaaatggccgctgctgctttagcatacaagtgtgtcgaagtagcctatctcaaggctgcatactataaataccctactgcaagcaaggatcgccagatgttgcaggcaattgtacagaatccaccaggtacttgaccttaaacactaaaatttaattacatacattagtctagcttgcattttagaatttcaaatacttttagtggtcataatgatattctttttttggaagtgtgagctcatcatactagtaatatgtgccgtgcccaaaaattcagaataccatatccaatcccctgcccttgctgatatttcactgttacattcatactttatataactgcatcttttccaggcatcatcatattgttactgtttcttctctggattgtgtttgttgctttgctatttacttctgtttattaccttcgtaggtgaatcaccatcatcttctgcctcagacattgataatttaaataacaatggattatctaagggcccttcaagcaaggatgctaattcgccccaagttaccgggaacaatttgttactagctgctcgcaatcaaccacacttgacaaggttactagcctatgtaagttcttcatacattgatatatataggcagttcaaaaagttctggtttcgagagtggtttatcttttatagtgtatcggatgagttcacaatctgttatctatgtaataacaaattaaactgttcactatgatggtattagcaaattgcacccaacaaatctagattggatatcataaacgagcatattggatagattttggcaagtcataattaagtttggtttgaaggtgacttgtgaaatgtttgtcgggaagatcttttttctgtcttaagtactatacttgttttacatcctgttgtgatgttgctcatgaattctgctgcataaccttattgctacatattcaaatggcaatgccgttatgtggagtcatatggtgatgaaccaactcattccattccccaaaaccaaaaagggttaggtttgggattagaatctaatgaccctaaaaccctgaagtgaacacctcataacttgatagtacgttacttacagtgcgtcatgccatcgattacagttatgatctgatgactctgtttatattcttagacaaatgatgtcaactgtgccttcgatgcaactcggaaatcacagatggcaattgcttcggctgctagcaaccaagaaaatggaatagatggtctttcttcagtaaaaacagttttggattttaacttccaaagtgtga

SEQ ID NO: 86025 - DNA, 1592 bp, Oryza sativa
aattattacgaacacaacggtgtaatcggattgtaaatcggatgagtaatttaagagaaaactttatttgaagcatagatgataggaatatttcccctacttgctcaatcgattaatagcaaccaaaactcctaaagtactagcacgtgggtgtctctggttaagactaattggagaggcctctccaattagatttaccgatttggaaaactttgaaaccatatttttttaaaaaaaatattctaataaataaaattaaaaaaaatcccataatctgccgaatcgcaggcgaccttcgctacggaaaaaaattatgtgcagaccggctgcaaaacccgcaccgtgtatacccgacttagatgggcgacgcgtggacgggcgagcaatcccacggcgcccttgcgcggctccatccgctctaggagaaggctcaactcggctcgctcgtgtcgactcccacaaccaaaagcgcatcgagccgagcatgaggaatggacgggctcatcagcgcctcactcctgtccttttcttccacttttctttcccccgccgccgccgccgctgcgatttccttccctatctcgcctccatctatcgggatcgcctcttctcggtgccgtcagctagccgataatcccctccgttcaacaaccgatgacctctctgttaggttctctcgaattcactcaaaatagcacaggattatggcaattatattggttgtattgctccatttcaacaaaattgagcctccaccgccttcgcctccaaattgccaaagccgttgttcttcgtattcgtttcagtatttaacgatacaagccaactcccacacgcaactctctctcacgggtacaactcacgcacgccagttgtcacgccacccactctgcgccatggtactttgggttgggcttcttgggccttgctagacgtgtcttctgtgcgtcatcttccttagtctgagtatcctcctcgcgtgccaccagctcgccctcttcagttatctgctcttcttctccatcatcttcagtaagcttttcctactcttcttcagccagcttctcttcttcttcttcagcgacatcatcgtcaggtggaacaggtggacacctgacaatcccctctccttgagaaatggcttgtccccaagccattgctttagggaaccttgccttcagctcctccagatcttcccaggtggcttgttcagatgcagtacctgatcattgaattagcacttgcataatggttgaattattcttcctggtcaacctgtgatccaggacatgtaaaggatattgaggagtagaggagacataagataagtgagtttgccattggcttgtcaaatcccttggctggctttagcaatgagacatgaaaaactgggtgaacactgcttccaacagggagaagaagcttgtaagcagctgtgccatttttgagatgatctgatatggtccatagtacttgaaagctagtttgtgattagaacgaggggctactgagctttgcacataaggctgtagcttgaggtaaacccagtcacccactgcaaactccctgaaagttctctttttgtcagcaaa

SEQ ID NO: 86026 - DNA, 8771 bp, Oryza sativa
ccagtggtggtgggaaagggaagaagacatgtcggcttgggaaggttaggggaatgacctgggaagggaaaaggaagcccggcgtactgtgggagattaaaatttgttatgtgtggcttcattcacttttttgtctatgtcgagcacatggtcacacgaaccaagccggatgcactgctaatgcccttatgtgaccaacagtgtgctaaaagcagcgatcaatcacacattgtccccaccagtaagtcatccgggacttgttacaaatagacttcccagccatcgtattatttgcttcattcaagttagtacagtcaatactacaccctttccttccttttttttttcatataggaagactttactactccctctctaggggtcggtttcactgtccttggccgactctacaagctttactgttgaaatttgacgatgactccttttttttttcttcagaagtataatattttgacatcttcaaggtacgaaacgtacgtaatcttgtactatcccaaaagttctaaacaatacatagcactccacacatcatgcagctccatttgttggtcccctttaccataatcagtcgattagtcaggtctcgccggcccatttcggcctaagcctgatgattgctactcctgcatgtctagctaagctggtcattaggagagaatttgttgaaccgcggtcccgttgaatgaaaccgtgcaaacaaactcggctagctaatcgtgctacacgtgcgtcccccccgccgtaacctatgacatcggaccaacggacagatcggcgacaggttcatgcacacggtttcctgcaaaaatgtgtgccgctccagtgtgtgctgctgcctaccgagacgcgatgtgaccttcagttactgcagcaccggccatttcatggtcccgggtctcgaaacagaggttcatttccatgtttctgtctgtctttctgatagagatatttggtgaccatattggtgtcgtcccggatgaactgtgcagctagccattcactgaaatggcgtccgagttctcttcagagaatctcgagttaattaccgggtcagttataaattgttactgcaattccatatttgcatggcatgtcgtatcaacagaaactgaacgctggcaacgttggtctggggactctgggcgtctggctggtcacagaagaaactcaccaagttggtttaagaaacacgataattgccaaatcaatgacctgccgaccatcatctcgccgtttcttccgtacatgcatggccgtggctcgatcgttaagtcggcatcagctggacaattggacgaattcaaagacgctacatttgacatggtacatatggcacaagcagacagctgaaacaacaccagtcttacttttgagtagcgtcactttcttggctggtaattaccaagggcttcatggttttactggccaaagcgcgtgttaaaatcattgagctaagtcagactgacactaattttgttagataatggaataggaaaatattagtgtcaagctgacagtaatattccggttccctctatcccactaagtcgttcaaaatttgtgatcgatcaccgtacgatttctagggattattgcaaatcaggctaatgcatctaattaactgaagtctacctagaaaatacaattaacaaagagtattaattagtgggtacgtacctagggtttccaattgatgccagatctcgacccctagcagtctaacatttttttttgtcaatttttgatcaaatttcatccgaattttcatgtttccaatttggattctaaaaaattattcaaaattacattcataatctactttcaacccgtgtcaaaacctcgagatttcgtgcatcgaaaatataaaccctaggtatcatggtcattttacatgactgatatgtgtgagaattgctacaaatataatgaagtcgacgaagcgagtagtcgcttagttgccgcgtgccatcgcgtaagcatcactcagtaagtaactccgagctcgtcgcaccgtccatggaagccattttccagggaatacatatatattatgcttatattgacaaatgcgaagatctgggtcaaaactactcctacagaagagaaattctaattggtcagtagaacgtcagtgcgcgtgttcgcagttttttatactagtatatattcatcgaccttaaaaacaaactagtatatattcatcacaagggagatttaatttccccgaccggttttggtcaaaacacacgtacgtgtgttgcagaacagatttctgtcagagacctcaagctacagcgacttcatagcggtttataatataaattgcagagattttgagcgttgttttgtattgttgcgtgaaactaactacgcatgcgtggatggaacattctaaaatgtgatgggccctcgccatgcaatctgctggagttgacagagaaaaaactggcgggtcaaatgcgcttgccggtccaggccgtagaaaaaccagaccgtgcacgggtctttaattattcagcttgtctatgcctatgcgtcatctctcccacgattagcctgagtcggcctagccgtcagatgcttcgagcacgaatcttgagaacacggggggaagaaagatctggaaaacataatggtgctagaaattcctgaccaattaagtgagtatcatttctgtaaggatggattatattaagccgttttctattttagccatatataaatttgacttattttataatattattgacgtcgtattaaagatgtcatcaaatacttaaatttataaataaaaaaaatcaaataatcaagaactattttctagagatgatatcgtttccaaccgttttcattttatcttggagaggttaagaaagaagcactcagccgttggatgcacatccaacagcctggagaggtttctaagtcgagatcagagcactagcaaccaacagataccagggccaatgatatgagataagagaacatcagcgtcatgttagagcgcgttagggagactggttaaatcgaatctaataaatctgagatcaagttgcacatatgcccaacgacccgtactattatttgtccaagttcggttcaatcttggtccaatgtcaataaggagatccaacttatagaatatgtcactcaccagctacatgctgaaagcggtactgatccgagatattagttaattactagtacaaaacgagtttaattagcactaactaggagtataagctaaacctgtttaagccggcccgagcgtttcgcctagagcttataagccgtagcaaattaatattagaaaaagaaaattataggtaaaactttttatgtgtatgtttttattgacttaaaacccaatgttaaaaaataaaataagtacaagatcgaaactaaaatcaacttcaaattaacttttaaaatttaaattttgactgcaaccggtaatctcgagagttgctgcacatgtcccgttagaccgtagtcctggtgagaaagcatcactatccccgttatatatatattttttccctagaccttcctagtcattgttctcacgtcccaatgagagtcagcgtacgttaaatatgatatgaacatggcatgtgtcaacttgtgcaatggaaaaaaggattagacccaatcactccgggttgacacgtaaagtattacggtgtagttagacacaaagctggaaagaatatccacttttatcacctcagaatggcatgaacgactgaaaagacaaatagaaatgcagtgtacgacttttattgtagacaatgagatgcaatgtacttggcgcaagatttgcgaatgctgaatgattctttttttcttttttggaaggtcaacgctggatgattcttaaattggggacaatttacacagtggtacatcgaatgatttacgcgcagagttaggaggttacggtgtagttagacataaagctggaaaacatccacttttatcacctcagatcagaatcgcatgaacgactgaaaagacaaatatatagaaatgcagtgtacttttgttgtagacaatgagatgcaatgtacttggcgcaagacttgcgaacgctgaatgattcttaaattggagagaatctacacagtggtacatcgaatgatttacgctcagagttaggaggttatgttcgttgcattgaagggttcccttttttggtgacttttatttggtagaagaccccaaaaggccaaaactcgtctgcagttagctaaaagttgatctagaaaaaaaaagttagcatctgatacattgaactcgaatctgaaacgttttggagccatcttgacctgagagaatctgtgatatacctgtgttgtgattgatcgatcataattaaactctgctctgggcctcgggtacgtgtgcacgtgtgatcgtaatatttggtttactgacgagggagatttaggcgttgatcacaatctagaaaagctttagaccctatttagatggtgttaaaaattttaagtccctatcacatcggatgtttgaacactaattataaatattaaatatagactattaataaaacctatccataatcttagactaattcgcgaggcgaatctattgagcctaattaatccatgattagcctatgtgatgctacattaaacattctctaattatggattaattaggcttaaaaaatttatctcgcgtattagcttttatttatgtaattagttttgtaagtagtctatatttaatactctaaattagtgtctaaatatagagactaaagttaagtccctgaatccaaacaccatcttaggcgttgattagtggctgagaattgagatgacccgcgggaatcgatcacacgtatctcagttagttctaggaagaaaccaattatttactccgcctaatattatatctaactatatattattaaaacaatttaaaaggatgcaccatattgtacgctagaaaccatgattatcattaaggtttttaaaatcgaacatgattaacattgagcttttttttttactttttagaagtcccgccaactgtcgtgattatgctcttaacagtctatccgtcgtcccttcttttaatcgtcattgggattatatttgagatttcgttaatagtttctagatgtcccatcaactgccgtcactcactcctttataggccagttgcttctcccatctttgttgttatcgttgtgctttatatgaacttttttaaaaaaattccatatttttattccgatatttttatttataaattgtactcctacttaaaatcttataattattttctctcttcataatttattttagttgttattctgaattttaattaatctcggtcatgtgttctatatggtttattctttcaatagtttttattttttattacgaattttagttatttataaattatatctatagttgaactcttattcttatttttctaattacagaatttattttactttttctttcgaactttaattaacctttaaccttgtgttctatatggattattcttttaatactccgtccattccataatatagcaacctagtatcggatgagacatttcatattacaataaatttagacaccctcttgtccagattcattatactatgaattcatatcccatctgatattgctatattatgggacggagagagtatttattttctattttatattttaatttcagttgtttcaaaattgtatttctacttgaactctcttttttattttcctaattttgtattttattttattttttattatatattttaattaatctcgtattagattctcagatggattcttctttcaatattgcttattttccattccgaatttcagttattttgaaattgcatttctacctgaactcttcttttcttttctaattttgaattttattttatattttattctgaattttaatttctcgtatttaattcttatttggactcttgtttcaatattgcttatttttaatttcgaattttagttatttttaaattgtatttctagttgaactcttatttttctttttttttctaagtttaaattttatttttaatttcagttatttttaaattgtatttctatttgaacctttttttttccttttatccgattaatgtgggaatttttatttccttaccatgaacttggtgtctccttaagggcaagttttatggtagaggtgactaccatatccaatttcatacatgacatacataattaaattaagaggtgatatgtataataggctatctctatcacataattcccaatatctctaacactctcacatgtttattgaagtttgtgtaggggctgccccttgcatgagaggtgactatttctctctcatccttcttctctcctccacctcactatttagtcttttgtgtcatcttgggatttatgtttgaatgtccatagtacttgccctaagttatctacagatactccgatacttcgatcagtttgatgagtaaaattttagcacgacacttcgaaaagttcatcaccgagaagttggctactctaaaaaaaagttagcatctggtacagtgagctcgaatctgaatcattttggagcgaccttgaccggagcgaatctgtgtggtacacttgcggttgtttttcggtcaatcccaatcccctgcatgcgcccttccctgcgcgcgtatgcatgtgatcgatcgatcatgagctctctgctctgtacatctggtacgtgtgcacgtgtgatcgtaatcttggttttactaaagaaggagatttaggcgttgatcattagtagaaaagatttaggcgttgatctgttcctgccaacgacgacccggggggaatcgatcgcccgtatcttattgaaaccaatcgaacaatctatctattaacttattaaagtaatagaaaaataagcatccacgttggcttttacggtctaaaaattattatattaatcggagaaaaataaaaacaaattccatataaaaatacaatttaaaaagtaaggaatattggaagaggagactagaagcctccacgctcgctctcccggcctagaaattctcatatttaaaaaataaaaacagagtccatatagaatacaatttagaaatagctaaaattcagaatttaaaaaataaacaatattagaagaggagactagaattcatgacgatatacaatttagaactaatgaaaattcgaaattaaacaataataaaattaaaattaagttagagtccatatagaaatacaatttagaaataactgaaattcgaaattaaaaaataaaaaatattagaagaaaagtatagagtgcatatagaaatataattaagaaataatagaaattcggaattagaaaacaacagatattagaagaagagtatagagtccatataagaatttagaatgaactaaaattcggaataaaaattaaaattaaagatagaatttagagtctatatagaaatacaatttataaataattaaaatttgaaattaaaaaatttatggaagaagagtctagagtcaatatagaagtaactgaaattcaaaaataaaaaaaaagaatattgaaagatgggtttaaagtccacatagaaaaacaattagaaataatgaaaattcaaaattttaaaaaaaatattgaaaaaagagcctagagactatatagaaatacaaattacaaataacgagaattcagaactaaaaaaatgaggaatattggaagacaagtctgcagtccatatataagaatacaatttagaaataactaaaatttgatattaaaaataattaataactatcacgtatatacaatacagtatgagacagtggtagtttagtaaagttagtacaaaatttaaaattatgttatcattttaatatattttaataataaattgagaaaacatatatgtggccaccgtgctagttctgggctgtttagttggaaaaaaattttgctcctgtatatcacatcggatatacggacacatatttgaagtattaaacatagtctaataacaaaacaaattacagatttcgctagaaaactaagagacgaatttattaagcctaattaatccgtcattagcaaatatttactgtagcactatattgtcaaatcatggcgcaattaggcttgaaagatttgtctcgcaattttctgacgaactatgtaattgatttttttatctacatttaatactgtatgtatgtgtctaaatatttaaggtgacaacgtgaaaaattttgttttggactaagcaggccctcagttgatcagatgagagatccacatggaacacaggactctgaaccatgtgatgatgtaacgtggcgacgatcgaggacacataattaaaaacttggccgcgacacgtttttggcaacttctacgcgcggccgtcgtcgtgactctcgccatagttttatcatcatcatcagcgatcgatcgatcgagtagccgagtacagtgaccgagtagcactagtgtacagtgtggctcctcgctccatcgatgggtcgcgacaacgccataattggggacatcgacagagtagttacgtgtactgtagtagcggaaggggaatcacgttgcggccaggtgatcgagctgccgaagccgagtgaagtggcggggcggagatctcgttgtcgatcgcgcagcaacaaagcgggtgctcggtcgctgagcct

SEQ ID NO: 86027 - DNA, 11941 bp, Oryza sativa
  unsure (1)..(11941): unsure at all n locations
agctgcatgtactttgcgtggggagggtaggccagtatctcatagccttttataacctgatccgtcgcatccggacaaaaaaaaacaattacgtaattctgggtctttgtatgctacttccactctctgttaaaatgtttttgtgatgttccttttttcagatgcatccaccattggtcgggatgcatccagctggactaccactgcctaccgatgcaattgaagagcctgtctatgttaatgcaaaacagtacaatgccatattaaggcgtcgacaatctcgagccaaagctgagtctgaaaagaagcttgtcaagggccgtaaggtaaatcttattagcaccttttacgaaaccatataacatggaatattaattagttatccttttcctgatgcttcattatagttcgagttggtcagaagcacaagtgaacaacaacttgcttcaagtagtcgactaaattctccaatctacatatcccacttccatactaagatcaatctgctctactgtaaatcttatggtgaatatacatccaatcttttatcatgtctagcataccaagtttccaatgtcttctggctattgctcattngtaaacattaaggatctgggaattggataccacacaacaagaaatttgtgtcaaatatggatgtgggnntgatntgctctctatttccatgtaaatttgtaagttcaagctgtgcctttttcacttctttttgtaccaaaataatacaaactcttgttacttggatcactgcattggttctaatcttgacagagtttaaggttggcactttctgtcagaagttaagttaggacttccacaaaattataccatctctgggtgttcttataggtgtttctcactatcaggaatgtacagttcttgcagctgtcaagttctttgtacctatgtttctgtatcttctaaagattttgattcgtctgcactgtgcagccatatctccatgagtcacggcatcaacatgccctgaaaagggctaggggagctggaggccgatttcttaattcaaaatcggatgacaaggaagagcattctgattccagttccagagataaacaggatggagttgcaccccgtgatagtggccaaccgtctacctctccgtcttcaaagggtgcatcatcagctaaacaaaataagaagtcaaaaaccagtaactaaacgggatttaagcacctggtgtgaaacatggaaacagttttgtacagtacatgctagtgatcgacaaagaatggtgtcattgggtgttgtaggataatgctccatagagaatatatagacagggcaacagattttgcagcctttggttcggtctgctcagtttctttaccttcttgtacaatgagtagttttcgtcagttgtgctttgtcatggggatagctgaatttcttcagaagtcttgtagttttaaagagttcattagcttgccaattgtttgctttggattggattggtctcttactgcctttgcatcatcatctgcagtgcacagaataaaacattggctatgtgtatgttcatgacaataaaccttaaatgtaggacaagcagtgacttcatctggagctttatctcttctgcacacactccagatgccaaatgatattcccatctttctcttggaatatcatgtattcatgtgatcttaacagctgttatggcaatccatgatcttaggttatgtcttcgcctctttggcttgttgatatgatgcttgcattgcatacctgtaatgcatgttctccattgagttgcctgatgattatgtgagactaagaacatatctctgaacctgattttgataggcctattacaatccaggcatgtcttctccatcatgttgccattacatgagcatatgcttttctcgagaagatggaaattagcagccattaccaagaagaatatactttctcgagaacactgaaacattttaatttgtaccttttctcgcacgagcacatctcgcttttttgcttagaaagaccacaaggataaaggataatactgaggaagaaaggataatctgaatctcgactttcttcaaaggttctgaacttactttgaatggtaagggttctgaacttaatgtgaacaattctgaacttctgaatctcaactttcttcaaaggttctgaacttctttgaatggtagggttctgaacttaatgtgaacaattctgaacttctgtttggcttctgggaagctgggcacaaaatttcctctcgtttttctagaaaatagtttctgaactttttctctgaaggatacagtagttctgaacttcttctttgactggttgagttctgaactttgtgtcataaatccagctaatctcaagcatgagctttctgaaaatctgaaccaaaactcgcatgcacaccctctctgtaattgaaaacttttgcagacattggtgacccacgtgattatcttaggcaacactctgtgattatgtcaggtgcttaccaaagtccagacacaacactgccaagtcaccatacttcttctcccttagcacacaagttactaacaaaagcatagatctcctcatccgaatccttaaacaaatcagctcacacataaacatggatatgagatagagagagagatgaacgaattaataatcaattgaggcagaaagcaaatgataatgcttgttaattgggaccctcttctgaagaattatgagtgaggcagagcaggcatgcagacaagaacccagagggtatttgcatatttgcagttgcagaattgccagaatccacacaggttctgtgtgtacgtaccgaacattaatcatgtattcctgcatgtagttatggaatgcaaatttaggtcaatcttataatcatttcttggctagattgatccatctattcagatttaaaaagggcacaaaaaaggaacttgataaagactagttttggatggctaattattcctcatgcattagtttgaatctgcctgcacatgaagcagttttggatggctaattattcttcatccattagcctgaatctgcctgcacatgaagcaatctttgtaacaatctgttcttcaaaatgcaactgaccaatcagaaattgggtgatcaagtgaagtgagcttcagtgttgttactgaatcaagatctagttcatgttaatcttttgatggaacagtgagtgggaggatcaagatgttgatgacaccccccctaaaaagaacacaaaaaggaggaggaggcatgcatgagctacctcctcagagaacagtgaaagggatgcttgacatgctttgcttgcactacaaagccaggccccattcctcctccatggacaagaatagtttttatttatactaccatgcatctctctacggtgggaagcatatttgttgttgtgaagttgtgcgtgcagagttcaaatcttggtgcccacaattaaaaagctatcgtgcatccgtaaccggtgcagaggctggaaattactttcattatctaaaaatgcgatctatatggttctcggtatgattctatcactttgatgtaatcggctgaaatcaataaagcttcattttatcttaaaaatgcaatgtgacttctaactggtgcattttgtttccattatctaactggtgcatctgtaaattgttgtgaaagaacaagccatgcaagaagaaattcaggagagaaggacatggagggatggcaaaagtgacatgagctcttatcatgccatggcagggggacagaaacacaacattggtgtaagacagacagacaggccctttaggcccatttgacctcccacacttacccaatatccatcagaatttttttcggttttagattttttttttttaatatttacagaaataatctatcgaccaaaaaaattgcagaaatagcccctgccgcccacctctggggcggcaagctgacgtggcaaacgggggaggaacgggtggtgacggcgggagggtttttttgcaggaaaacccttgccgccctctggtggggcggcaaggggcccgaatgcaaaaaagccagtcggggccggctattttgcaggcggccccttgccgccctctggccgggcggcaggcctcgctgcctataaaaggcctgctgcccagcccccagccctcattcttctcttctcaattccagtgaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgttgatatcggtaactacgtagatctgctagtttggaattaatacattaccgttgcattggcttacacaagaagatattacgttgtagatgtttattgcatgaaagagtaatatgatctagttatttcgttgacagatatgtcgaacaaacaaatattccaagtttaccatggaccaagaaacgtccgttacaggccaagtggggtagatctgtcagattttattgtatcagaaaggggaattgatagaccggctgagaggagtgtaccttctataaaaggatggttaatgaggggcttgagagttgatccacagacaagtgacataacaatcaatgttatagtaagtcgggcaactgagggtttttattgggaactaatgccagttcaaaactctcgagtgtggagatggtatttggaaaatgcattgcaacgcgggtggcctctagctttggttccgtttgttcacccgaaggatctaggtgtgcagacgaacatggatgatggcgagggaccaagtgctgaagtaaacgagacttctgtggaggaggtcaacgcacgagaggacgggggcgtagtagctccagtgggcattcaaccaggtggagtggccgacgagggggagactgtcggtgccattgtggatgaaatggagagggaggattctgacaacgaacgtgtagaagaaggtgattcgtcagatgatgagacggatattaatccagcagaatgggctagtgaggatttttctgggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtcgaaccggtcgcaatatgaagtttggtgtgttaaggaaaaagatggttgtccctagagagtgcacgcgtataaggggaaatggaaggattattggacagtgtcagttgttaccaagcatacatgttttctacctggtgttcagaaataccataggaacattacatgtgcatttgttgcatctgagatgtatgcgcatgtcatcgataacctcacatatgaaccaaggtcaataatccgacacattgaagagacatacaagtatactattagctatgccaaggcctggagggccaaacagaaaataatagagatgagatttggaacttacgaagcctcgtatgacaatttgccacgcctgcttggtgttatcgaggaaagaaaccctgggagctcttacgaagtgaagaaattcccctcaattgaacatcctggcaagagtgtgctgcaaagggcgttcttagctctacatgcatgcaagatggcattcgtaaactgtcgtcctgttctctgcattgatgggacattcttgacaggaaagtatcggggccagatactaacagcaataggggtagatgggaacaatcaggtattgcccttggcatttgcttttgttgagagtgagaataccgacagctggtactggttcctgaaattggttaaaacaaaagttgttggtatgaggccaaatgtatgcctgatacatgataggcacgctggcattctgcgagcgataggagagttgcagtttgggagtatggaacgaggataccccggtgtttgggaagatgtacagagtaggtggtgcatgcgtcatatgggagctaatttcttcaagcaattcaagaacaaggagctcatgaacatgttcaagaggctgtgcaatcagaaccaggagaaaaaattcaatgagctttggaagagattagatgagttgacagccaaatgcagtgatcagcgtgcagcagctccatcgaccgccgttgctgaccctcctcaagctcttggacctctcccaacggataatccaacattggttagaagaactggattggagattcggaaattttctcagtggattctgcatgaaccaaaagagaaatgggccaaggcgtatgacacaggtggtgctagatatggaataatgacaacaaatttggcagaagtttacaactgggtgatgcgcggtgcccgtggactgccactagttggcatagtggagatcattttacatgggacatgcaggtattttagggatcggttccaggcagttcttccctctatgccgaacaacagcattttgtttggagctttcatgcagaaaaagctagaggagttgcgtaaaaaggccatgaaacatcgagctctagtgcaaggtacccaacagcacaggtttgagatactatgtcaagataaggcaggcaggggtatctaccacaagagagtgaagcaggagtgtgttctcaaagccgatggcacatgtcattgctcttgtgcaaagccgaagctgctccacaggccatgcacccatgtcattgctgccgcagcggagtgtggcataccagatgcagtatatgtgtcacagtacttcagtaagcaagcaatatatcatacatggagcggcgagatttatgggttcggcatagctggggagttcacagagactaacgatgaagtactcaatattcctgacccatcaaagctccgaggcaaggctggaaggaggaggactcgtcacatccgcaacgatatggacgagtcggaggctggcagggtgaagcgttgcagcaaatgcgatgaacatgggcacacctacaagcattgtcctaaagacaaggagaaaccaagtgcggcggaggcaggactatcaggattagcagcagatggagctcgccctacgggtgaaggcactacctccactcgaccacgtcctaggcgtcgtcgtgccacgtctggctacgtggtgtagttcttatgttctatgtcggcatgtggatttgcttgtaattcgtttcgaacttatcgatgtgtttatgtttcgtcgtgtaatgtcagacttcggcatgtcatgtctttaggtctcgtgatgtaacgtcggactaaggcgcctaacgtctttaggtatgctgatgtatgtcggacttcgacacgtaatgttatgttatattattgaactctacatatatgttaaattgcacgtcatcgttatgtaccattagtaacgtttgctatatttaaatagcctgtactcttgttgtacataattaatctcatgattttattactatttcataattttgcaagttatcttttgttttacagtactattttttgaattgttctaacacgaaacactatatttttcagagatggcacgtcaggatacacctcagttgttggacccggcgatagatcaccgacaccggtctcaccttactgcggtgcagggggctcagcttgggacgttccgggcatggacgtgcggtgagctactcacggttcacgactcctttgtcgagaggtacgaacagtattttactataagttagttgcactgtaatattttttataatgacatattaatttgttattgcaggctacataaggccggcctcctaccgatgtgtcggctggtggaggctgcggctggcgacgcggacccggccagacgatggactgtggacaggtccctcctagcagctttggtcgatcgatggaggccagagacgcacacttttcacttgccgtgcggtgaggtagcccctaccctacaggacgtatcatacttgttggggctaccgctcgcgggagacgctgttgggccagtgaccacggctgtggactggcaggacgatctgacggcacgtttcgcactagtacagcgcgcaccgcaccttccgctcgagccgttggcacaccaccgcaacaccggacctacgaagaggtggctgcttcagttcaccgtgagtgtttttgtaccgaaatgacaatcgtattacatatttagtccgcagttaaggtgcctaacattttatcgacggcttgcaggttgagcagctataggtggaggccgacgagtactcctacagccgatgtttggaggcgtacttgctctggctttttggctgggtgatgttctgtggcggtcacgggcacgcggtcgacaagggactcgtgcactacgccaggagcatcgccgacgccgcggtaggcgaggtgcctcagtggagctggggttccgcgttgttggcggctctgtaccgtgcactttgtgagtcttgcacgaagacggatcccagcgcgacctttggtgggtgccctctctttctttctatctgggcagctgagaggattgcgatcggccgccctgaggtggaccagcacgcgtacgaggagtcactgtacgaggagcgacgagaggtcgactaccctacgatgggtactctatggtgccgtcgtcaggtacgttgcatcgatcttatcgtattgttaagttaattgctaagttcattgtacatcacatcgatcgtctcgtattgcagcgccgatgggctcacgtccaagttaggcggtcgtatcctgagtttgttatggagttcgaccgccttctgccgactgacgtcgtgtgggagccctacagtgcagcggctacccaggctcgtgcgccgttgggtctgtccacactctgcaccagggaccaggcgtactggatgactacggttccgatggtcttcgacatctgcgttgagcctcacgcccctttccgcgtgatgcggcagttcggcttccgtcagccctttccagtaccgtttccgaccaccgtcccagctgctattcaccggtaagatcttgcactatgctttccgttgttgcattaaaatctgcctgttcacaataatttgtaacatctgtcgtttcacactaatattacacattaattcgcaggtactcgcgcaagggtcagcagtcagctggcgactggcccgccaagttggcgacttttgttgaggactggttgctcacaaccgaggaggtcgtggaccacgagggagagccacacactgaggagtcgtaccaggcctacctacgctggtaccagccacgcacccgtactagggtcaccttcgctcccttggagcagcagccccacgttgcgagcactagagacctctatgccaggcaccgtgaccaggacttcgctcgtgctgtgagtaccctgcatcgcaccattcctttatgttttcatgtctttctcttcgtcaaattttacgaatatttacgaacaaattaaccatgcaggtcgacgacatcaaccgggtcgtcgttgacggttcaacgacgatccaacgtttaggcgcggggattccggtacccgtagaggagcacctgacgacgtacacgcggatggtggagtcgatgcgctcgattctccgagttctcacctgtcgtgcagacaacgttgctcgggcagacgcagctgtacagcggccacccgtaccgactggtccccgtccagctgcgcacgttcctaggccgactccccctccgcacggaggtaagtatttttattactatttctgtacatgcctcgcacatataagtgagccgtttcacttgccgattgcttcagggtttcgtgcaccgttcaacaccccgccttcctcggctaggccttctgttgtgcccctcacaggtacttaaaaaaacaacattacttcgacaatcaatttacatacattttatgtcttagcttacaagggtcccgttgtcgatgtgtaggtttcgcccagttcgctatgacgcaggccgcccacttctcccaggctgcagggtcagcgtctcaggcagctgtgtcgacctcgcactcagcgcagttctggcagtacaccgggacttcgtcacaggcagccggcacgtcgagtcagggtccaccactggaccatgctgggacctcgtcggaccacttgttgccttccaccttcctcttcgacatcactgacttcgacttcgcttcaggctcgacagaggacgtcatcggcccctcacagctgggaggcgcaccgccgttgcagacgcaggaccaggcgcaggccactcctccgcaggacactcgtgctacccgtgctgtgccaccggatcgtttcacctactcccaggaccacgtgcgagcacaggcccggaggaccaagcgtggtcgcggcgcggggcagggccagtagagcagtcttctctttgtttacttgcttcactttccagtactgtatgcttgtgtaatgactacgttgttgttatatgtgcacgatacctttcggcgcatgcactatacctttcggcgcatgcacgactactttctgccgcaccgatgcagcctcctttattcgcgtgtgatacgagtatttgcccaccatttggcgcatacgaccaatgtaactttcggcgccgatcatgcatgtatctttcggcgccaatcaggcgtacccaccataccccaccacgttcacatgtcaggggtatcactcgattttttgcgcctatataagtcgccttaacgagtgaggcctcacaatctttcagaactcaatcacatttagtactctcttccccacttgcttcattacaaatccgaccggctttcgtcaatggctagacgccgaggtgttgaggatccaaactggcgtagcgatccttgtgtatacctactaccaacttggtgccagcgtcctctctgcctatgcggtgatcgatgccaactaatggcttcgaggaatcctgatattcgaggaaggcgcttttttaggtgccctaactatgaccgtgaggtattttattatctgcatatgcttattcattccgtatgggcaatcgctttattcttcgtaacactactctattcggcagacccgcactacggcttgcgcatacatcgagtgggtcgatacagaaaatcccgttctcgacctaaccacttgtttacaagaaggtcgctggtatttcacatccgaaagtactgagcaatacttacagagaaaagcggcttatgaacgacaatgtcgtgaacaacagagcgattggcgggtgctaactacggcactccctccatgggaagcccgtccaagatgcaggtgtagtgatcgttgtcaggttcttcgttccataaatcctacaacattgggtcgaaggttctttgtttgtccaaatattcttgacgacgatttcatggtaagaatattttgattacatgaatccttattttctcacaacatttactaactttgcttgctttacatctattctttcctcccaggaaccaccaagcagatgtcaatacaaagaatggatagacaccagaagggttctaactccacctagccatgttgtgcagcttgaactaccagagcaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccttcctagttcgaatctaatatcatctatgaaccgcaatgcaaatagttgtatcatgttcaaattgtactactatttcttcatgttacataattctccttgtt

SEQ ID NO: 86028 - DNA, 3888 bp, Oryza sativa
tgaaagcttacctcacttcccccctgtcttggtagccctggggccggagaaaccattgctactctacttggctgcgaccccccatgtggtgtgtgccaccctagtagttgagcgcgaagaaagtgaacgggaggcccctctggctcgcgatggtccctcgtcctccgaaggcctagtgcccaaagcccctagcccccgggagggcctcgaggcccccgagggaggaggggaggctttggcaagtggccccgagcccgaggtgacccgggatccccccggggcccccgagcaggggcgccccgggtcacctgcccctgacaacacgaaccggccccgccgaaaggtgcagcggcccgtctactttgtcagcgaggcacttcgagatgcgaaaacccagtacccgcaggcccagaaaatgctttatgccgttttgatggcctcaaggaagttgtgtcactacttccaagcgcatcgggtttccgtagtgacatcgtaccccctcggccaaattttgcacaaccgagagtgcactggacgggtggtaaaatgggccattgagctggctgagttcgatttgcacttcgaaccgcggcacatgatcaaaagtcaagtcctggctgacttcatcgcggaatggaccccagtggacgaacctgttccatccagtgtcccttttccccccggagaggaagaggatccaaacgccgacattcgtggcgggcactggattatgcatttcgacggctccctcaaccttcaaggtgcaggtgccggagtcacgctgacttcgccaagcggagacgtcctcaaatacgtcgttcgactcgacttccgagccacgaacaatatggcagaatatgaagggctcctcgcgggattgaggacggcagccggaatgggcatccgccgtctcctagtcctaggtgactcccagctggtcgtaaatcaaatatcgaaagaataccagtgcaccgacccacaaatggatgtatatgtccgcgaagtacggcgcatggaacgccacttcgacggactcgagcttcggcacgtgccccaacgcgacaacatagtcgctgatgagttgtcgcatgttgcgtcggcacgagccccactccccccggggacctttgaagaaagactcgcacaaccatcggcgtgaccgaaccccttaagggaccccaacgacacgccctccgccctgacccctggcgacccgcgcccctcggggcccgagggggttgaccccgacccccctcgtcaggtcgtgtggatgaccgatatctgggcgtatcttgacggcaatactcttcctgaggatcgcgcagaagctgaaaagctcgcgcgcatctccaagcggtacgtcctcgtagaagggaccctctaccggcgtgccgccaacgggatactcttgaagtgtgtttctcgagagcagggcatcgagctcatagccgacacccatcagggtgagtgcggggcccattcagcctcacgaactttggtcggaaaagccttccggcaaggcttttattggccgactgcattacaagatgcccaagaatgggtccggcggtgcaaggcatgctagttccacgccaagcagacccaccagccggcccaagccttgcaggtcatcccactctcttggccttttgtgatctgggggctagacatccttggaccattcaaggcggctcgaggcgggtatcagcacttgtacgtcgccatcgacaagttcaccaagtggcccgaagcctacccggtcgtcaaaatcgacaagcattctgccctcaagttcatcaggggcatcacgtctcgattcggagtgcccaaccgcatcattacagacaacggcacccagttcaccagtgagctgtttggcgattactgtgacgacatgggcatcaaattgtgcttcgcctcgtccgcccaccccaagagcaacggccaagtcaagcgagccaacgctgaaattcttaaagggctcaagaccaagacgtacaacgtcctaaagaagcacggggattcatggctcgaggagttgcccaccgtgttatgggcaaatcggaccaccccaagccacgccaccggggaaacgccgtttttcctggtgtacggcgccgaagcggtcttatcctccgagctttccctggggtcgcctcgcatcgcgctgtacaatgaggccacccaggatgaccttcgccacgacaatctcgattatctcgaagaacggagaaggcgtgcggccctacgtgccgcgcgctaccagcaaagcctgcgacgctaccatcagcgccacgtccgggcccgatcactgcaaattggcgacctcgtcctacgccgcgtccaatcgcgcctggagctgagcaagctctcgccaatgtgggaagggccatacaaagtgatcggcgtgccccggcaggctccgttcagttaaccacggaggacagcacagagttgcctaacccctggaatatcgaacacctccgtcgtttctatccgtggcatcgagagtttttgctttccaggagctcgggccaacccccgcacaacccctcagtttgtgcaggcttggctgggggctaccactgtgtatcctttttccttttacaagcaatgaatttttctacttttttgtgaagaccgttcattcccttcctctggcttgtcctggtttaagggataatctgtgtttactctgaaccctaagtgccgtagggcggcctgaaaaccgccaaaagggagcactaaagcgggccacgccccgggttgcgccgaaccccaggggatcggaagggcctacacacggccgtccccgacccccggtcgtcgcagccttggtctggccagtcccgctgggcggctccctcggggcgacggtcttgcctatcaccacttaggtaccatggaccgagcgtggatttaccttcttgctagaacaagcccgagggggggggatggggtcaaaacggcatttcgatcacaggcagattaattatacccttttgctctggtttcttcttctctctatgtcacagacatccgatggaaaaggcaaaagagtaaaggggactaaggaagttttagttgcagaacaagacaggacgacacgatggcctaaatacaagtgcccgctacgggcacacaacaaaaggggaattgaaagcgcgagtagtcacggagtgtctgggcccccgaggccggcgccgctgacgacgtcgtcccagtcttcgtcgcccacgtcgtcgttgtcacccccgcttctgctctcctcgtccgaggcgagcccgaaggcgaaccggggggccgacccatcgaagttcgagacaatcgcgtcggccgcctcccggacttgctcccgggcccttgcctcggtccccgggggaaaatcttcgagcgcgcgccatgggacgaagtcaggctcgcgcgcttgatggctcgcgaggaccagctccactgcagcccgtgccaaagaagctgacgacaactttatggtctcgccgacctcctcctctagcctctccagatctgccgccagctcgtccagccggagcatgagtgctggctgtgtgggcggaagtttgctatcccggcgcacagaaatgccgactcggcgccccgcgcgctccagccggtcgacggcgtcggagagctgcccgggtccgatctcgttggtgaggcggagggccgcgatctccccagcctgatcttgcaccaggcgctccaggtcggcgagggtattttgagccatggcgagctggctcgccaaccccacgccgccgagcggcccgcccgctgccaagtccttctcccgggcctccagctcggaagccttcgccgctattgccgcacgctcggcgggggatcctctagagtccgggccacgcgccc

SEQ ID NO: 86029 - DNA, 732 bp, Oryza sativa
acggccaagtcaagcgagcaacgcttgaatttcttaaaaggctcaagaccaagacgtacaacgtcctaaagaagcacgggaattcatggctcgagaagttgcccaccgtgttatggccaaatcggaccaccccaagccacgccaccgggggaaacgccgtttttcctggtgtacggcgccgaagcggtcttatcctcgagctttccttggggtcgcctcgcatcgcgctgtacaatgaggccacccagaatgaccttcgccacgacaatctcgattatctcgaagaacggagaaggcgtgcggccctacgtgccgcgcgctaccagcaaagcttgcgacgctaccatcagcgccacgtccgggcccgatcactgcaaattggcgacctcgtcttacgccgcgtccaatcgcgcctggagctgagcaagctctcgccaatgtgggaagggccatacaaagtgatcggcgtgccccggccaggctccgttcagttaaccacggaggacagcacagagttgcctaacccctggaatatcgaacacctccgtcgtttctatccgtggcatcgagagtttttgctttccaggagctcgggccaacccccgcacaacccctcagtttgtgcaggcttggctgggggctaccactgtgtatcctttttccttttacaagcaatgaatttttctacttttttgtgaagaccgttcattcccttcctctggcttgtcctgg

SEQ ID NO: 86030 - DNA, 13116 bp, Oryza sativa
  unsure (1)..(13116): unsure at all n locations
tcccacgcgccacgggatcgtttcctggagaggtgcgatgcggcggcgaaagtaaacgccaaagaccattgcccccgtgaggcccaggcttcgtaggcccctgaggcgatcccacaccgtgtcgtattcctcgccaagctccgaaaccgccagccatgcggcggatctttcaggaggaccagcaggaactcgaagtcgcgggtggtctggcaatgcggtgtagaaccagtctgtaacataccaaaaattaaccattttctaattctgtatcatgctgagtcttatgttcttaataacttcctaaacctaggaaaatataattagagggaccttttaaaactatcttgcataaaatatctttctggtatttaacttcttttgtgtttttcatttaaaatacatgtggttgaattgaggtatttcttgctttggtttaaaaccttcttttgactaaaatttctttattcaaaattagtttgaaaaccctttctattttttttatggattatggtccaagaaatcctccaattttgcccttgaacctaaaccaaagtaattccaatctcattggaattaattgttagcccatcctttgatcttaaacccatcctttgattctcgatccaaatatccaaattcctccttttgatttagccaccaatttaatttctgtggcttgattttctcttcggcacaagaatagtattatttcaaaaattgtgaatatttactcttgtgctaagaaaagtccaatttatattcttcactcaacttccccttttagccacaaatatacatcacaccaattttagagttcaaatcctatttattatcttcaactaattcccttctatattcccaaaaatatttgaggaatattattaatttcccttcctatttgagtgcttccaaataaattccctcaaactccacctctaaatattgcactcaaataaattaggaaatctcttttgtgaattctttccgaattcgaatcctttgcaaaacctagttatccaaatcaagtattcaaattagacttcctttctttttgtcatcgggccgaaactccattctttcttccttttggtccaatcccttttcttttctattttcctcctatttcttgggctgccggcccagctaagccgagccggcccaaaccagcccacccacccagccgagccgcctcctcctcccgtgcgcgtgccgtgcacagcgcacgccgccgccaacgccttccctcgctgcgaagtaatcggccgccgtcattcttttcttcacgctaccgtcgtcgtgcactccttgacctcctcctccacaaccgcctctctccaccgacgtccgccgcctataaatagccggccatccctcctctttttcatacaactctctctctctctctctctctctctctctcttgccatgcccggccgtcgccgtcgtcggtcgatctcctcccctatagcttccctcctagtttccttgcaacatcggcttcgcctcgctccggcgagcccatttttcctgtttcccccttctcccccaccccatagcaaccaccactgccacctctctttgccgccgaagacaagctcttgactgcgccgttccggccaactccttcactctctccaacagccaccgccctccccgggtgtgtcttgctcgggaacatgtgtggccgctgacgtcgccgccttccaaccgccggaaaaccggcgcccactctctccctctcctctgtaaccggcaggaagaaggagaagaagagaggaagaagaagacgagagaaggagagagaaaaagaaaagaaaaaggaaaagcattgacaggtgggcccctatacagtgtcttttcgtattttctagatttaattcaaatcccaatctttagaagcccatatctcctaaaccatatatccgattccagtgaaacttggacctaaattcatctaaattcaaactcttcattttgataccaaattttctattttaagattttatttgaatttccttaatttattcaaatactatttgaataaatatttgattaaatcttataattgaatttacaacttaaatttatatttgcttttcaaatattttcttttattccaaattacccctttagccactaaaaagccgccggttggaactttacgccttccatggggacgttcgcggtttactatccccgacgtcggaccgttggttgtaaagcccggcaaaaaccaaacctaaggtcgaagtgctgctcctggcaccctacgccttgatgcgtatagcggtcggagcttcactattccctcgacctccacagcacgccgcacagttagctcttgggctctgtgtgatcctagccgctccgccgccactcacggttgtaagagtaacacttccgccccactaaacccacacaaacttcctatccctctagccgttatgctatctgttgacaccggctagagaagataccaattctagtcgttatactgcccaactctagcaacgactagcaaacacccaaatcccagccgatattcatcctacctcgatatcggctgcttaatcaaatgaaaccccagccagcctgctatccaaactccataccaaccatttacccttctactacccatagcctatgcatgaaatacgagccgatatgctatcctatttcagcatcgactcgagaacaactaaatcctagccattcttctaccaaagcccaacctcgaccaatgctagccacatatccacttaaccagttagattattcggtatatcccctattctccaagaaaccaaaaaccacacataaaatataagtgacaattgttacttaatcccctctagcctccaacccttcagaacctacacatattagcccagtaatccctacaccttataaaggagataggttataccctaaaccctagcccttttagttgtttatcgttttcttgttattttatggattttattgaaattggttcttcctctttcttagtagagtctattttggatggcagcctgtgatatttcgagaatcggataatcaggttgcctatctcggatttatttgcgttggagcaaggcaagttattattcctccccttgaacataattaccctatattctatatttctattctatgcattagccattcatgattttgaatgcataacctaaacatatagcaaaccagatatgctaacttttgctcagccctgcctagttagactgcataaaaatataatgaatttagattgggacagtacgtaagatttggttgatttccgggtggctagtactgtctcagtagatataagtttaccaaatacttatgtcaaacgaacgagtacgaccgcagcttctagaatggggacagacctagatattatgttaattaacaatgtggtacctctgtacagtggttccttttgtaagtcctcgcgcaggaggcaatcttatgccgagcagggcatcttatgatatttaccgaggcgcaggtaaatatactaattttcgctcatgagctgtgtgtgattttatggaaacctggttgagatgacatggggtctctcatccagttctctctaaaaaccccgggaacgccagaactcctctcgccgctgataacattacgttcagagcgcatggggagtagagttcatggaataggtgccactattgttaataacctaatactgggccatgactaagctaatgaatattggcaagtcgtggactgtgggtaaagcgtacatctactgcagtagaatatttatgaaactattcgaatagccgtgctcacgaatttgagcatcgggactcatatggtatttggttagaaacttaattccagattttattaaatactgttgcatcaaacacattgcaggatttctccttctatattctctgctttctgcaagtaatcatagctctactcaaatactactaattcatacattcatattgaatataatagcttgctgagtacattgtactcacccttgcttcaacccccttttcatagtcattttggagttcttatcgaagccgggaattcaatcacataagttagttccctttaaacctagtcttgaaatctagtattgttagatggtttaactctatagcaaaacattagagttgatttattctatagcttatgctatattagttagccacaagtttgtaaatacccatgtatcttataataatatctcctctagagccttgttcaaatgtatgcaatgaagatccagattgttgaacctgtatcaatctactggtccagggcttgatacagtctaaacatgtcggtttccgaatcattaattttgggacccgacacagtccttcttccaatcctcccatttcttgcggagatgactctcgatgtactgccccgccgtgcctggtcgcggctggaagtagcatccccccaccaccgcaccttgcagcagctgcgggatgaagaaggcttggaacagctgcatcgtcggccgtaccccgatgaacatctcgcacagatgcgcaaagatggccagcgtcatcactgcgttgggtgcgagatgcaaggcatggatttcgtagaaatccagaacctcatggaagaatctggagaacggcggaatcaagccgccatggcgaaggacaacaggtgcacggatcgctccggatatcgcggccacgattcccccgccctcacaacggcgccatccggcatgatcttgcgggggaggctaaggtgcctatctaccgtaatgcgggaagaagggagcactgtgtcgccagcatcttgagccatggtggccggcggagcagtggcggagagcgcaccgcgcggaacagtgtgaagtggcgagaatgttagggttcgaggagcgagaggacgagtgggcggttggcgaaaggaaggaggcgaagtccctgcctccgcccccttttatcctcgtctcatccgcgctcacctcctcgtttcacgccctcatcattgcccccacgatcctcgcgcccgcagttgtctcttcgtttgccgcgcccactcatcacgttgcccgttgtatccgtgtcccgcctttagtgcgcctgtcagtggcacactcgaggtggaatacgcaacggccatgagcgcgagctgagcgaaccgtcaccactaccgccgcgggagtagcgggcgagggaatcgaggtgtggtctggccgaccccccggttatcgcgcctcaagcatcctcatcattagcgcggtcagtggtggtcaaaccgctgctatggttggcacgccaacccggctgctaggcaactttcctttcgattccccgacgggcccacaaccccagcttgagaagtcgtgaggcaccatgtcagaccgatctcaggaagccaatgtctgatatggtgccgggggctactatcggagatatgggcccgggggtatgtgaagtaaaggggagttaccttcccgtccagccacgtggcccggcaagctggccccacttacgcacctcgcgagtcgcgaaagcggcggggggggggggggggcctcggggcgcaacgtcgccccctcgggctctcccgttgcttcccccgagaggcccttgcccggctgccacgtggcagggggagagagtgagagggggacgcaggttgaacagccataaatgtgcggcgccccaactgtccctcactgcatttaatgcggtaagggcagacgtgtggtgcgcctaaccgacccctgtcaatcggatgtgaccagtctgtgaccggcctgttgccggtcatgtccggttgaacgggcggccgtgcccccacgtcgcctctgtctccggcggagtgggggtaggtatgacccgtcacgtcatagcgtcactcgaaggagggctgccacaagtcttcactcttttatgagggaatgacagggctgtcccctgtgtcaggcgggggacggcgctgggacccactcaaggaccggttgctgcttagcttccgggggaaggcacggattgaggcccggtcaaagtggagcggggtccccctcccatggaggggtaggtataggcggtgcatgtggtatccccttgagctataaaaggaggaccttgcccaccgagacaagaggacgactatcagaaaacttgaactctaggagaaggaaagcgagagcgctctccagagtaaaggatcctttgtaaaactcatccataatcccaaacataggagtagggtgttacgctccatagcagcccgaacctgtataatccgattgtgtgcaagctagccggtagtcttaggggcgaacacgtgttttccaagaggcgagcctcagcccccggccgaactcacgaaaggggggtcttgcgactccccgccatcgaggatcttccctcgacaagactctattccaagcagcaaaatgtttccttttgtaagaaatatcataccctctccaaagacagtttcttcttgcagagtcaatggccaaaataactgtttttggcagttgcaaagagcacataaagtatgtgggtattgcagataagacagaattgatgagaattagccttctctcataatgtaaaaaagtagcactagaagttaatcttcttttaattctatccgccaaaggtgcaaaatctatcactttgggcctagtagttcccataagaagacctaagtatgtgaaagggagagttccaactttatagtctaaaaggctagacaacagctcaatcttatcttcagcaacattaagaggataaacattagacttatggaaattaattttaagtctagtagattgagcaaaggtattcaacaaagctttaacacaaaagaattccttctgatctgccttcagcaagataatggtatcatctgcatactgaataactggaaaatcactttcatcatcaggcctaataggtttagttataacccccaatctgcaggcctcattcaaaatagcctgaagaagctcagctcctaaaacaaaaattaaaggagacaatggatcaccttgccttactcccagtttacacttgaatccattgctaggtactccattgagtaacacaactgaactggcagaactaaagatcatttcaacccaatttaaccatttagcgggaaagcccatatgtctcataatatcaaggattgcaccatgctcaatggaattaaaggctttttcaaaatcaatttttatgataacaatctttcttttagattgttgacactgatgaatatattcgaaggcccaagctaaatagtcctgaattgtcctacccttgataaaaccatattgattctcatggaccaatttagttataactccctgcaacctattagccaatgccttagtcagaagtttgagacttatattcatcagagaaatcagtctaaaatcattcacaacctctggattattcttctttggaaccaaagtaatgaaggaagaatctatggactgaatatcaacacagccttcataaaaatgtgccataagcctgtagaaatcttctgcaactataggccagcatcttttcataaagaagctattaaaaccatctggtccaggggccttacaaacaggcatccttttaaccaaatcatcaatttcctgagtgaaaaaaaggatgaactagagagtctaggtttgttatcctctgaaatagactaggaagattgaaagccattttggcatcagtggtagtacccatttcgtctttaaaagacatgtaaaacttgctttttctttatgagaagtgactatattacccataccatctgaaatactagaaattgagttcattctatatctctcagtagccatggcatcgaaaaatttagtattctcctcccccaaaaccatccatttatttgtacatctctttttccagtacttcctcctgtgagccaataacttaagaatgtgcctttgaattatttctctcaaattccattctgacaagatcaaaactctatattcttcaatcaggtccatgaagtgaatcactctacagctgttttctatcaacttattgaggagcaaaagatttttactccatttggaaagggccttatacgagatgcattttgcaagatctttaaaaccaggatcaatcgaccaaatagaagccactctttcaaagaaaccatcaacatcaacccaataattctcaaaacggaaaatattacacttcgggatttttgttttgatcttaacaacacaagggacatggtcataaattactcttggcaaaggaatgactgttgtattaggataagaagagtccaatttggagaggtaaagaatcaatccagttgttccaaaaggggatattgttgcatattactccaagtaaaggctcttcctttaatagggagttctaaaactttaatagggagttctaaaagacccagagtgtttatgatatcatttaaaataaaaatatcattcatatcagctcccattttatttctattttcaattgatctatagaaattaaattaaagtcaccaaggaaaagctagacatcatcctgatccatctggaagtttcttaaccaagatacaaaattatccctctcctgtccactacaaggaccataaacacaagcaagaaaccaagtttccttgttctgggtggagacaaattttaccaaaagagcatgatcagtgcttgaatgaatatcacccttaaaaaacttactaatccaagcaacaagaatgcctccaaaagcccctctggaagggacaaaaagaaaactatctaacttactaatccaagcaacaagaatgcctccagaagcccctctggaagggacaaaaagaaaactatcaaaaatttttggcaaaactttcttcagaaactccttatctataacctctcttttcgtttcctgtaaacacacaacctggctattactgtcagacacaggctgtctaagagcatcccatttttcaacagcatttcaacctctaatattctagcagagcacattccaatcacgacagctgctgtcagccataacatactgcatataacgaataaaaagttataaacggagtttgcctgataaagattgggccacagaacttcattacaaataaaataactgagtgaatatatcaagttcagactgcaagcaagcaaaagataaggacttgtcctacaaaggtttaaccaaaacaactaacatgaccaaactagacaagaattaaaattattctgcatcttcagaaggtcttgcgagttccttcagcttttctccttcaagctttgacttagccacatcctcaagatgaaggccgcacatctctgttcccatcttttgcaataaagaaacagaacattcagcgcataccagtgatagcttagagaccgagagctaagttgacaagggaagaaatgggctcgctgtgcttaacaattccaacaccatagtagaatatcttaaacatttcaagcctttcttctgttccagctacttctttcagcgccttatccatttcacactgaaagaaaacttcattgcagtggctactgcattgcttcatccaaatgattagttctactgcgactcgccttatccctgggaactcgatggctggtgacttgtataaatctaggatctttctaagcttctgcatgaccatgtacactgtaacattggcactccggagagcttcattgaaatcgcttgcgtgaatggatgtgcagatctgaacactgagcccaacaaagctctctagtagtgcaccctgcttggtcctccattcttggaaattctgtgtttatatacaccaccaagaatatatttagagagagaattaataactgataaaagatatatgattttggagaaatgtgtgatttggaggataactttcttacattagcatgttctccagcatacagtacaggatcctctagcttctccacttctgactttattgctttcagcagctgtagatgatgacagcacaagcattagaattatagaatttaacactgtaaggacactataaaacttttagaaaataataaccggacattaccgttggtagtgcagtgttgattattgtcttctgaagatgagcatgctctgctctggagttggcgtgtaaaatgcccgaaagttttgcaacgttcgttttgaacccagtagagtcagcagagagcatctcgacaagtttctgcatgtcttgaggcttcagttcttcttggatcttccagacaatgctttgattatccattgcaagcataactagtgcttcagcattaggttttgctagctgtcttctatcagctgaaatttcagaaatcatctgtgaccttggaacaaggaaagagacaagcttcctaataatttgtggagaggatgcaatctcttccctcccggtctcatccaatgctaaacaagcaagaactccaatggcttcaacaagtagctttacttggcttctagggtgttgtagtatcttgctaatgttcctgagtacatagacattgtcagagactttgcacctaagcactctcccagaatcaccagcagcgctaactagcttgtgcaacacctgaactgctccaaaatgatctcttcgtctctgactgcagatgatgagactatgctcaagctgcgatcatcaccagtaacagctgtgaggttcacaatgcttgcaatcacctggccatcagcatccgcgaccttgttgcagttgtccggattgtccatgatcttgttgaggattttcacaccgaaccaggtgaactccatgctcacagtcacatcgttgccagagttgtcagcagcaacgatcaacgatgacacgatcggcagcattgctgggaagctctcaaggagaaggtcccgagagagctccaagatgacgcctgcagcatgccctctggtattcacttccttccgggtgttgttcgtcagtcctagcatgctgaccacgccgccgaccgtgtcggcagaagctcggagcctcatgagcgccagcgctctgtacttgggcactctaaggatgctgtcaagaacaccgaccccgacgaggcgatccgcgatggagttggatcgcaccagctccatggcgaagctaaccaggtccatgttcatggcttcgcggacgttaccaccggagcatctcaggtaggtgacaagcatgtaatggctcaccatctgcttccccaagggcccgagctggtacgcctccgtgatcttgagcaccagctgaatgtcggcgacggtgaacatggcttgggctagcaagtcggaggcgccctgtacgagcaccaggccgtagaagaggttgagtgaacccttgatgctcttgtggtcgctgctgccctggtccgccggatcaacatagtcttgcttgctcaggcgcagcgcggcgaggacgacggaggcgacggcggcggagtacagcacgagcgcgaagcccatcagcaggagcttggcgaggaagaagccgcagctgcagcgcttggcgtagtatgacgcgaccttggctctcaagccttgtgctgtcacagacgacgacgacacctgccggttgatgcttatgtgtctttgccagcttccattctccatagcctcaaatctttcggtctctgccgccaccacttcaggagcattgaggatgaactgatcccttggatccacggcactgctgaaaagcctgccatttgaaagtgggattgcaaagttgggggcccccaaaaaggtntagntgaggatccgtttaattcaccccggccttcttgttttgtacaaggcactatatgcgagagttgaagaaaggaagggacatgtgttgagttaatctcgttgtttatgttttcatcatgttcagtcaagtcctgtatggcggtctgagttcaaattggttagtgttttgtatggtgaggtgagctgatcagccgttagtgaaagcacaaaataagcacaaagtggaattttttttgaaattatactgttgaagtttttttttctcaaaaatatatgagattcaaacggttttacatgaatagaccgtcgtcgcagttcagcagtacgaactattaggaaaccgccggcccatgaaggcccggcccggttacccactaattaggcccatcactaaatatggaaagtgctcatggctatgcctatatatagaggggaggaggtgctattgtattggacaagtgaatgaatgaaagaaaagagtcctacccctacatctctatgtctccaattcttgtaaacattacgggaccctcttgaactacttcgtgtagcaggagggttgcgtaatacgttatcagcatgacgttttaccgaagaccaaggaagaaaaagggtaagaactcgcagatccgttttgcatctcgccgatctaatcgcgaaaacgaattcctctctttctctttgttcttgttccgtttttgccgttctcgacgaaatccaccacagccgacttggagtcgccggtgtatgccgattggtggaaaccgcgattgacaatacacggcgtttgcatgctgacgaagcgccatggcggcgaacccgcgccatggccgctagcctgcgcatgcaacaccacggccgcaccctgcaagggcagcgtgcctgcgtgccatggaggcactggccggagaggacttcaaggatgaagaaagaaccaagaaaagaaggaaaaattgaaaaaaaaaagagaaaaggccacgccggccgcaccgctgaggcttgcgacggcgacagcggtgcccgtagaggtcgcgactgcgccgtctatacaaaaacggcggcacccgcgccgccctcgccgtcgacgcacgggcgagcatccccggcccacgactgcactgcgccgcgcctcgccatcgaacggcggcgcgcgcacaatcttggcatggccgcatcttgtgccaagcccgcgccctgcaaacgcatcgttaggccaccactgccgaccggcttgcgcctcgccgagccggccgagcccgcaccaagtaccgtcggtgccacaccgcttgcggctcgccctgaggacgagccgcatggcctcaccccaccgtcgcacggttgcaccgcgccggtttcacccgcgccg

SEQ ID NO: 86031 - DNA, 3869 bp, Oryza sativa
tttttatgtaatcaactaatttttataggtgttgatagttattatcggcagtgaagaaggtaacggtggacgtggtgagtggtgaccgtgcctggcctacccgggagctggctccgctgctgcacgtggtgaggaccgtgccatccgcccaccccacgctaggccgtttagcggcaaaacgtccgggcgtgcttgggccgttgttataccgggacacggcccagaaaatacggccggttcagattcaggggacattctgtagcgttgggccgagacgatccaggtatccagccctcagccttgcattgcacgcgcagcatatgaggggcaaatttggatctcaacacatttcatttcaaaatagaaatctgaatgacagataaacagcccaaacctgaacttaatcacagaactacagcccagatctggataacagctatcagggtaggcttgtacatgaactgggaacggagtgtgtatgtatgtgtttctgagggaagccaagtataattttgctcattggcaagaccccaaaagtcaagagcatgatcatcagcactgcaagcgaatgagatattggtatggaatacatgaatgatggattaatatggcaatgaccttatcttgttccaatatcaatttgcagttccgtcgaactggcatctaggagcttaggagcaaacctagctgaattttacatatacattcagaagcaaatttggcagttctgtaaccaactgaacccgtttttttagattttatgtacacgagaaatctattataaaagcagatatacttagtgcgcagggttcgccgccgagctgcgcaatcgtcttcgtcagttaccagctgatcatttgatgatgcaaccacgctggctctggacggtctgatacggttctgaaattgctcaagcgctgctcttcttgccgttgccaaacaagaaagacaagtttggctttgccagggtacgcttcagagccttcactgccagtggactgtccttagcctgttgtgttcatcaagcaacaaaacagtaagaatcacagggaattcttgcacttgcaacagtgctagtaaattaccaatctctgcaattgcttaccatgaggcaggttccctgctgaacattgcagatggggtactcgtgagggcagcagctgtagtgatcatcgcagcaggtggcgccctcgagtgggcagcagccccaggcgtagcagtatttgccatactcgtagatgcagcagcaggtggtgctatcggggcaagtgtagtagttgtcgcagacggtgggaggcggggttggggacggcggagtagggccggggttcggggggttctcgcccttcttcagagggtaggatggctcaacggcaatgccgcacttgccactgctcgccttgatgttgcgctccatacggacgtagccggactcaccccagctcttgccccacgagttcctcacgatccagtagtccttgccattctctgtgccgtacccaacagcagcgacgccgtggtctagtgctgttccacatttacccgtgaagataccctaagaatgatatcaggaaatggcaatcagtgcaagcccaagtcatggaaataacaacataattgaaaagaacaaggaatttaggattaacttatttaacaaaagcagagtacaatgcatgtttcaaattttgagtattgctttatgggaaaaacaatcataatctttttccctatctaattgggtttcgaagtggatgacactggatgatggctcataccactccactacggacctgggaacacatcaaaagctactcgttccattaaaagtgtttcacaaagcaggggcaggaaagcaacaaatgaacatggtttatggtctatgaataaatggtgtgcactgaggtactaatttagtggaaagctgaaatgggattagattatctggatgataacaaattaacaaagtatgccaggactggacaaaatgataataagatttgcttagtagttgcgacttgcaactgacaacacaatcatttcttttagtgcaataaccgtgattaaagcaaagtaaagcaggcaagggcaaaagcaatcagtgagcctgcctatttgtttctctatcaaagatagcaaaacttactaccgactacacattgttagaacttagcaaaggatcaccaaacgaatttgaacaataacgttaaatcgacttaccgatgagtagagctggaatgctctgccaccggcttcaattgcaacactgacgggctggtttgctaccgccttctgcagactcgtctcactgtttggtgttacatcttcgtagctgtcaattgtgacaacctttgcgtttttctgtgagtatagcagcacaagtgagcaatagcatatcaaaattatgctactacctgaaaaaccaagggagcaaagaagacgaaagataccctgtttacgtcacaccgttcgtccttgcctttgtaagggtagtcatcctcggtgtcgattccaccattgttgatgatgaaatcaaatgcatagtccatcagacctccattgcatccctcgttatatgaagtgtcacagtcaactagctcctgctcagacaaagatatcaggtcgccagtaacaatctggttgatgccttctacagctgctattgctgagaaagcccagcaacttcctgcaatataggagaattggaggttatatttccatattattgtgtcaaaggatgacatgaaacattgtttgactctcaaatatacaagtaaataatgaggcaatacaaaacaaatgcagccaattatgaattagatagaccatgtggagcaacaacatttttttttaaacgacctacatcagacagtgcgaagtttcttttttcttttttaagcaacaacatgatgaagaactttagcaatgcaaaggaggaccttctaccaataggattgtgaaacgtctgcaagagacgtgaatgaaaggtgtttccaagggctcttttggagccatatgccaaatgacagctgaccactagtgtggctccaccagctacaattcaaacagtgaccactaatgcacagtatgattttctgtttggctctaatacgtccatgcacccacaaccaaaatatccacctttccaactaaaacaatttatgaatgaccatttattatagcttgccttcctgcctcccctacaagccacagtagagtacactcagaaacagcaggatcagttgcaggctctggcttattcataattccagatcagaaataaaggtgtccgattattgagtgatactccatacagagtacacaactggaatcaagttagtcaaccaaatatttttttgaggaccatgtgtatagccaactacacaaaccataaaaacaattgaatttcaaagaatttcattttgtgaatcacactgtacttcaaattctggattcagatcgaaaattccccccccccctttccggtctgcttaattttggggcatattgaaacatgtcctgatttatcgtttgacctggatgtgcccctaatttatgttcacgtggagtactaactactgaactgttgcaagcagaccaataatttcttgaggatcatcccgaataaactaaccgcgaaaatgattcatatgtaaaaaggaaacatattttacccctgaaactgaaatgaagagaggagacatgaaaaggatcaacggatgcttaccgcaacctccctggtccttgatctcagccacggcccccttggtcctccagtcaacggactccggcagcgcctcgttgtcggcggcgaggtacctgtcgctgaccttcctctccctccgcggcttgttcctgaggccgaggtaggt

SEQ ID NO: 86032 - DNA, 1897 bp, Oryza sativa
catgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaatctgtccttaagtgcgagagcgggaaaccgtacacccgttacgttccccggtccgcggttttggaaattcatttagttcgcaagcaccgacccaggtgtcgggttttccaagtcttttgtaaaactccagttttacccaagttgttactcagattttaagtttaaaggcgaccgtcgatactcgcacagagtgcacgaatatcgagccgcaactgggtggttacaaggggacatggtataacaattaacaatggaaggatcaaatgtaacaaattaggtaggtctgccaatctgccttgcagacgggacaacagattaagtgtgatcctatcaatgcataatatttcgcaatcaatataattaaatttcaaatatagggtcaagatgttcaaaggtggcttgccttgctcgagatccggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaatcgaatttacggttgggaagatattgaatttctaagattattggatttttggtctaaaggaaaaaggatttatttaaatcctttttttggaaaagaaaaagaaaagaagggagggagggaatatagacttttctcgggtggctagggtgcggcccaagagatttggggcggctcggccgagcttaacggaccggccggcccaagacggcccaagcgcgcgcgcgcgcgggagggaggagagagagggagccggtggaccgggctcaccacgcgtggtcccgggtgggacccgcttgtcagcggctcggctcaccgtgcggagggagtatgcggcgtacgcgcgcgggcggggctgggacgcagtgcacgcgcgcggttcgcggaggaacggatgcggcgggcccacgcgcagcctcacggctcaccgcggaccacacgcacggggagaaacggagggagcggctggccgggtcggcttatccggtcgcggccgaggtggcgccgacgtggcgcctacgtggcagccacgcgggccggcgggaggtagacgacgaaccggccgcgaatggacggcgggcgacagcggcgagcggcgtagcgagccacggcgataccggcgaaagcgagcacaccgggtggctgcacaggacgaggggagacgagccaacggctcggattcgctggaggttgctcgacggcggcggattacggcggcggcaaccggcggcgagggaagagggaaacggcgacgaggccacgaggggccgattcccggcggtgagagcatctacgcggcttcgggaactcgacgctagcgtcggattgggcggaactacgccgagcgaggccggcgacgagcgggtgctacggagctcgggcggcgatggcggcgagcacacggcgagcgatggcaacggtcggggcggcgccagctaactacggggaggctactcgagctactaccgaaatctaaggggaggagatggagcgaggaggaagaacggagggagacactaccgtgcgggacgaggcgatgtgacgagaggccgacggcgcgggag

SEQ ID NO: 86033 - DNA, 4372 bp, Oryza sativa
acgtgtactattgatgtagagtagtattttgtacggagtaccttatactactgagtatttccacggtaataatgtgactgtattttttgtaggtgttcgtacttgtacatttgattcaggatttggtacattagaaatggatctaattagctcccgtatttatcatcacaactcacaagtatgcatgcatggattttttttccctttttatggtaaggatttataatggtttgttcaaggtatttttactatttttttttaggattcaacttattagatttattttatatgttactcgaacattgttgataatgtactttctgtgaggattttttgggaggattcaacttattctaatgactgactttgtagtactcgaacattgttgataatttactttctgtgtttagtatgcgtagatcttgaatgtcttttttattttaagaaaacctataaataatatggcatcataaacattaaaactttatatggttataggacaaagaagttagagagataagcctctataggacgtggccactactttttatagggtaaagagaaagatatagccaccactcatgaaatattttttctagatgttggaccttggacgacacgggggcggaaaaataaaccgaatgagttagcctaaccatggataaggcgtcacgtaagcatcacatgctacatacgctcacctcctccccttctcaatttatctcgcactcccacttatactttttttttctctcacacaatctctccatatccttaagtaaacctaaggtttcccacacgctttcctttcctcttgcctccaaccgtgcaatgatcagtgtgaaataaacatgtatgatcatatcctatctacttttgaccataaaccaaacaagccaaaccattgtttcgttggtataaaattacaccggctttcattagtactcactccatcccaaaatataataagctagaatcaaaagggatatttcctagtatctgtccagattcgtagtactagaaaatatcttatattttaggacggaaggagtaactatgttagactaaccgatcacaaatcaataggagtcgaatgtgataggaaaacataattctattttgttctttaattttctttctcttccataaatacttttttaaaacacatataagatctattcatcgatatattagacgaaactaccataaatgtatactagagttgcacgataacagatatgcagcagtggtccaataacattattctgaaatctaacttcccaacaaggccagtacccatgctatgtgatctcccggcaatgatggcctcatggacgagaggaagtggtacacaccacactagcttagggtgtgtttggttggagggatatctctggatgggagatggcgatccagtttttgagtgtgtttggttggtgggcgagggaggatagggcggcccaaagagggaatattccacgaagatgctggatgagtgtatccggccaaattgaccggatgaggatatccaccttagctaatcttgataattagttcttgattagcaataattaaagtatattgttgttaattagtaattaacttgtcaaaattagtgttgattagatatatactctattttattgttaattagtataaactatagctatattaatgataattaacctattttattattaattaatatgttgttttcattcaatccattcccattcacccaaccaaacaagaaactggatggccatatccatctaaccaaacaaaaaactggaccaccatatccctccaaatatagatggtcatatcctatctagccttgaccacgaaccaaacacacccttatctaagctaggtagcacgttgttctcactttaagctcactcaatcatgctcctgttcttgatttgagagtgtgtccaagccataagcacgtgtcaacaacctactcaaacacaagattttgtgccctaatccttgccgctatctgctaatctatgtgttccatgtacagtcgtacagagcacatacccaaagtgtgagatggcattacaacctaatcattgtgtggttagcagctgcattattttgttaatttgacgtgctaactaccaacatgctatgctgctggtatatatatgctataatcaatatattccctgatattattatcatcccttaatgaatagtagtagctagtacccctgttatttattatatggattagagcatatgcatgcgtattaattaataaaatgtaatgtggaaaatgaagaacaaattaaaatgcaatcatgctgctaatccaagcattgcctttcaagatacaagaaaggcagaaaaggcaaaagaagcacgagactacactctaagccaaagctgctgttgccgatcgaggaggttaagaaactaactagccaactgaatgaaaaagctcaccaaaaaatccaacacaaccaacatgcaagatgcaaccataacttagcttgagccacacaccatgcatatcttcttttttattatttttctcactcacccaatcatgtcttaattatcaatcaatcacacagttggttaggggccactctaatcttactggggacactgtaatgatcactggaaagttaagtcatgtttgacacttcagaagttaatactattgttttaactttctcatagctactagtgtagcttaaaggttgagtttacttgaacaatagtacaagaatcggattacagatcatcttgccttgttagaataaagagacacatacagttgcacttgtcagtacagtgacactggacaatggaaaaatggaatgcatctcctcgtcagtacggccatgttcatcacaataactctctagcttgaacttaaagccagataggagagaaggatctatttacttctgtccttcaaaatgagtttacatatctgtttatctgtaaacaagtacataaatatgaactaggaacatcctaatgtttatacatttcacagtactagtgaaatttgctgatatgcgtgcaaattgaggaaacaaaaaccaacataggcagattcttcagcccggcgtcagagagtttcagtgcatctgatgcaactttggttgctctccaatgtgtcatttctttggcatgatgcataattagctccaggaactggaaaaaatacaggtttgaaaaaattaccagtaattcatggggaaatcacactttagctcgtttcaggtaaaccatcactgctgcaccgctgagagcgaccacaccagccatcagcccaacacgaacaggcgacaaccgactcctgcgtgcagctgccagctgctgtgatggctttgtcacctctgtgctggattcagacaggtcgatatgcaacttcagaacctgacaatgagatattcatagtagtgagatagatggaagcaagaaaagttggagagctctacgagttgctacatagagtaaactatagtaccaagagtccaagaacaacagataccttcaaaccggacgatttggcatggagcacggcaccagcaagatcggcatcagttgtcagtagcacccggtcaccttcatcgtcttcgtactacatagaacaaacaagattaagtggggaagtgcttgaaatattggctgtcctctagtaagtgccttagtggtgcagtgcaaagacaataattacaggtttagaggacataaatacatgcatataagctcatagcaatagcttcgctctcgaagtagagtacattaaggcagcgaatatttcgtctctttgttacacatgattatgaaagcactagaaatattcttatgacaaatactcagttgtaccaggagttgcattatgccctcttcgtcagtaatacttaatctttgttttatagaagacgctagctcgtttaagctctctgagcctgcagcaagagaaaagaagttaagaacagttatgtttgaatgatatgagaacaatcaacatacttgtgcaaactatcaggagagcaattaccacaagtgaatctatgcacgcgtcccttttggtcttgaagcttaaaggcaaacgaatttccaataacaggggggtaaatgctactctttccatctccagtttctgatgccaagagcaatgatacttcactgggaaatgtagaagagaattgtattaggggagagcaagtgagcgaaacattcaacaaatgaaaaccatcaacagacctacggctatcgcattcctcatcaggagactccaaagcaagagtagaatcccaaaacctctgcattactgtatttgccacatcatttacagtgtcatttcctccttcaacctacaaattgagaatgcattcag

SEQ ID NO: 86034 - DNA, 2787 bp, Oryza sativa
cagcaagcaagcaacatttggaaaacgtgaaaaaaattgcaaggcttgaagcagaatgccgcagattacatcatctaactcgcaaagcaacattaattaatgattctaggcctctggcaaacaatacttgtgtggagtcacttactgatagccaatctgacagtgctgaacgcatggctgctgttgataatgaactgcggaattccgactcatgggcatctgctctggtagctgagtttgatcagttcaagaatggaaatgctgatgagaaaaatcttgtgaacaatcctgttgtgattgatctaatggatgatttccttgagatggagaggttagctgcattgcctgaatcagatcgcacaagctctaccttcgatatggaaacagattctgataaagctgtgaccagaaacagctcctctaaacttgaaactgaagagttgaggaatcaggtggctgatttgcatgcacaggttgagaagattgaaagtgagaaaaaggagcttgagatggcactaatggaggcaagaaatcaacttgacatctcctgcaatgcactagtggcagcaaagaacaggctagttgaaatgcaaatggagttggacttggcaaatgactccaagcatgatgctttgagggattttgagggattgaactcagagaagaaggctttggagtttcaactggagtctaaatctgtacgagtggaggagttacttcaggtggtggcttcattggaagaaaacacagataaaaaggaattggagtcacaattagaactgctgtctgcggaagccaaagagcttcgtctgactgtaacatcattattagagaagattgaagctgaaaggtctcttttgtgcagcatcaagcagaagcagtggctgcatgtaatgcgaaagaatcgttggaggaacagctatattcagcaaacactgaagtagagagattgcatgtcattgtcaaagaactggaggatgaggtagaaaaagagaagatgaggcaggaagaactcgtggcagaattagaaatgaagatggaaacagctgtcgaggctattaaagaatcattggaggcacaactatgtgcagcaaacactgaagtagagagactgaatagcatagttcaggcactagagaacgatatagaaaaagagaaggcgctgcataaagaactgacagcacagttagaggtgaagtttgaagaagagaaagctcgttctgttcagactgttaaggaatcaatggaggcacagctatgctcatcaaacaccgaagtactaaaactgcgtgacattgttaaagcactagaaaatgaggtagaaaaggagaaggcactgcatgaagatctttcagcacagttggaggcgaagatcgaagcagagagaactttttctgtggaggctattaaagaatcatttcagtcagaactccagtcagtgaactcagaagttgtggagctgcgcggtatggtgactgcacttgagcatgaggtggtaaaggagaaaacattttctgcagagctccaaatgcagctagaagctctggaggcaataaaaagggtgttggagtctgagattgagtctgcacatcaggataacagaaagctcaatgataaggtgaagtcttttgaagcaaaactgaaaaaacaggtgtcttcagcggtggacttcacagccaaggaagaagccatgcagtcagagagaagggccatgaagcaacaacttgaagcagcaaagatggaagttggaaagctgacaaacaaggtgagcttgctccaaggggaggtgttacaggagagattgttatcagaagagttcgaacaagaataccacaagctggaggctcggctgtcaagggatagccgggacgcgaagctctggcgactcgcaaattcaaatgggggtctgaaggccaagcaggtatatatatactgaagtcttgtaatttacatcacaccatttacccttggcttaacacactcgcctggtatttatcaagaaatggatccaactataaatcgttgtgtttgtcacaggagaaggaacttgcaaatgctgctgggaagctcgcagaatgccagaagaccatagcttctctcggccgtcagttgaaatcattgaccgacatcgacaatacgattgtggagcctgagagactggaacccagagaaatcagagaaatgccgctcgattttagaaatagtgatgctgactttgcagtatttgcagatgagttatatgattttgatcttccaaaggtcaacagcagctgcttttcgccgttaccgtcgatccagccctcttcgccaccttcagaaatgtcagtatttgcagggggcctgtcttcacttagtagtttcagaagcaaaagaagaaagtaaagagctggtgaaaacaaactgtccagatgctactaacagttcatggatgctctcatctgtaggtagatcagtgtacatttacagaaactgattgtagattctgtgtgctgaattccgttccagcaagctcagtttttttttcacagccttcttgatgagatttttactgtatcagtgttggctgttttggtgccagaaaaaatgggaagaaaaatgtaaactcagtatcagtgtgagactgcagaagtgcagatacattgtggtgtatttgtgttgtgcggcttatacttgctgtgtaattgatgatctccatattaccaatcatacttattctgcctgattgaacgaaatgtccaaattcagtctcttacaaatttctctgggataataattgcatgtgttata

SEQ ID NO: 86035 - DNA, 1961 bp, Oryza sativa
atttctgtttctgtaccactcagcactttgacgctgcaataggggacatcgctattgtgacaaatagaacaagacttgttgattttacccagccatatacagaatctggacttattattttagctccagcaagggagattgaatcaaatgcctgggcttttctaaaaccattcaccttccaaatgtggtctgttctaggtgttctcttcctttttgtgggtgcagttgtttgggtacttgagcatcgtactaatactgagtttcgtggacccccaaggcaacaaattatgacagtatgctggttagtatctgcctcgtgactcttctctcttttttttcacttcttcaagattcaaaagttattgtttatttgtttataatttaattttgttagagttttgtaccatttcaggtttagtttttctaccatgtttttcgcgcacagtaagtgtaaacatgaaactagccaaaagtttttttttggatctcatagtccagattcatatccttctatctgttgttttacacaggagagaacacagttagtgcacttggtagatttgtgctgcttgtctggctgtttgttgtgctcattataaactcaagctacacggcaagcttgacatcacttcttacagttcaggaactcacatcagggatacaggggctcgatagcttgatatcgagtccaagttcaattgggtatcaagttggatcttttgcgagaagctaccttgtacaggagctcaatattgccgagacccgattggtaccactaaacagcccgtcagattatgcaagagcgctagagttaggatcaggaaatggtggtgttgatgcaataattgatgaacttccatacgtggagatcttcttgtcaaaatactgcaaattcaagacggttggccaggttttcacgaaaagtgggtggggatttgtaagtgacttggactataattgtatactagagatttcgttccagccttccaggatatcttctgaatatagtttattctgtttcaggccttcccaagagactcccctcttgctgaggacttgtcaacagcaatcttgacattgtcggagaatggcaatcttcaaaggatccacgatgaatggttaactgggacagaatgcagtgcagatgacaatgaggttggctcaaaccgtttgagcctttcaagcttctggggcctctacctcatctgtggcttttcatgtgtccttgctctcttaattttcttcttgcgaatatgctgtcaatacagtaagtacaataaccaggttggacttgactctcctgaaccagagattgtaactcgatcggcaaggttaactactatcaagtcaataatctcatttgtggataagagggaggaggaggtgaagaatgctctcaagaaaaagcctaatgacagtctgcagccaaggacaggaagcacaggagaacaatctacattaccaccatgacacatttatcactgcctgactgacatattcaacaaaatgcataattttgcactgggcttgctggcagcttcagaaacccggtgatgatttgttctggttctgaaggtcaaacctgtaggagctcctcagagtattttctctgaactctgaagcatgacaggaacattctgaattgtgcccaacagtaacatgtctgaatctccttccaacagctacttccaggagaagtagagcattggttgcaagttcaatttcaaactagttgagaagtttgaacctctgtcaagttgagaggccccttttttcgttcggaagcaacctctgacaagttcttgtagctacaatcttaagcatcttccaaataagttgagaagtttgagtctttgtttggtgtggaatttgtctggttgagcatttcctttcactattgcactgtgctgaaaaggcagtaacatatcttctcttttcaattggctatgggctgcaggaat

SEQ ID NO: 86036 - DNA, 2518 bp, Oryza sativa
tctgttcaatgcaaacatgtggtaataaccatcacgtagttttaaagtatatgactttcagctgtgcatttttcatgttatgatacatggttcctgttttcaggcaaaaaccaccaagaagattgtgctgaagctgcaatgccaaagctgcaagcattactcccagcaccccatcaaggtatttttgcaatgtgaagattcaagctgaaaattctcatgaatcagtatctttttagatgtgttggatgctcacttacataattattctgtgcagaggtgcaagcattttgaaattggtggagacaagaagggcaagggaacgtctcttttctaaactacctactggatactgaagttgtgggtctactgtgcttcatacttcaatgttattaggagcttaatttaagcagaccatatcatgtattcaagtactctagcaaggattggctttctgctgaatcaagttttgttgcttaatgctcattgaatccaatgtgatgcatgtgtttatgttgcactgcaattttgtcttatggcagttttatctccctaagtactcggtgtctgtttttcgttatcttacctatgtttgcaatcctagagcgacccacttaaacgaattcctgtgacatgaatccctgagaggttagtctgatgaacttccatttttcagactgaatttcgtatatggttaactatactatgttttgttcaatatcttcgtcacgagatagaaggtatggaataccatggatggaggtgaattgtaagataggccttggtcttgtgattgttatcttagaaggtcgatactaatgtttggtcttgtggcgttagtgaaactgttttcgtagcaatgtttggtcttgtgatgttagtgaactgttttcgtagcattgtagtacttgttccattcttcatgcatgatttggataggttattgacaattgtttatagtaatgaattaaatattacactcctaaatctattatataattaaaggaatagaaaaaagagcctccacgtttactctcatggcttagaaattctcacattaatcggagaaaaaaaaacagagtccatatagaaatacaatttagaaatagctgaaattcggaattaaaaaataaggaatattagaagagaagactagagttcatatagaaatacactttagaaatagttgaaatttggaattaaaaaataaggaatattagaagaggagtatagagtccatatagaaatacaattaggaaataatagaaattcggaattaaaaataaagaatattagaagtagagtatagagtccatatagaaatacaattaggaaataatagaaattctgaattaaaaataaggaatattagaagtagagtataaagtccatatagaaatacaattaagaaaaaatagaaattcagaattaaaaaataagaaatattagaagtagagtatagagtccatataggaatttaaaactaactaaaattcggaaaaaaaaaaaggagcctctacgttcgctcccatggcctagaaattctcacattaatcgaagaaaaagaaaaaaacagagttcatatagaaatacaatttagaaatagctgaaattcagaattaaaaataaggaatattagaagaggagactagagtccatatagaaatacactttagaaatagctgaaattcggaattaaaaaaagaaatattagaataggagtatagagtccatatagaaatacaattaggaaatagttgaaattcggaattaaaaataaggaatattagaagtagagtatagagtccatatagaaatacaattaggaaataattgaaattcggaattaaaaataaggaatattagaagtagagtatagagtccatatagaaatacaattaggaaataactgaaattcggaattaaaaataaggaatattagaagtagagcatagagtccatatagaaatacaattaagaaaaaaaaatagaaattcggaattaaaaataagaaatattagaagtagagtatagagtccatataggaatttcaaactaactaaaattcggaaaaaaaaaaggagccttcacgttcgctctcatgatctagaaattctcacattaatcggagaaaaagaaaaagcagaatctatatagaaatacaatttagaaatagctgaaattcggaattaaaaaaaagaaatattaaaagaggagactagagtccatatagaaatacaatttagaaatagttgaaattcggaattaaaaaataaggaatattagaagtggagactagagtccatatagaaatacaattaggaaataactgaaattcgaaattaaaaataaggaatattagaagtagagtatagagtacatatagaaatacaattaggaaataaccgaaattcggaattaaaaataagaaatattagaagtagagtatagagtccttatagaaatacaattaagaaaaaaaatagaaatttggaattaaaaaataaggaatattagaagt

SEQ ID NO: 86037 - DNA, 2572 bp, Oryza sativa
ctgtacggctgcaatcatatctgtgaagctctgggtaggctttaaatatgtagcaaagggatagcaaatgctcaatcagagaatgtaaagttgaataatggttcaaagtcaagtaccgtgctggtcctaggctagaacgtactagagaccgagcctagacacaaacgataccacaagatagcactaggaacaactcatgcacaactctgatatatgaagttcagctcaaacataacagtattttctcttttctttctttcttctttcttcttttcttttttttctttcctttccttttctgttttttttggtgcagtttttttttcttttatttttttatgcacctttctgcctttttttctcacttttttcttgattttttttaacaaaaactgactcaaggaccttaatgtaaggttacaaggactcaaacgtaaatataaaatttacagggactcaaatgtaaaagtctaaacccaaaattcaaattatacaaaaatggaatgctgaatttatgccggttccgtttttccaaacagatctcaaaaccgataccaaacaaaaattcaccaaggtgtttgacacaacttggaaccgtgaaagggagggagggagtcggactcggccaaagggacgagtgggagtcggccaggaggtggagtggatggtagccgataattaggatttggtgtatgggataaaaatgaaactgatttttaaccaatccaatctactatatctttccaaaacaaacttgactacttccaaaatcagattggtaattcactttcctcctctcgtgcacgacacaggcacggccaaaacagaagcacggcaatcagcaaacccaagatgcaactcaacaactccaaatccaaccgatagaaacttttgaaaactacaaaaatagaatcgtggcagcaagccgattccgttttcgtaggtcccgacgataacagagacacagaggcgacgacgactctggtataaaacatgaccagaactcgaaactctaaacgaactagacgctaagaccagcaacacgacgagacgatgcaacacaaaattcaacaaagcaaaaactgaaaaaaacaatgcaatggcacaatatggctaggtaaatgatacggattttttttgtatggctattttctggttataggaagataaaaactcaccgagtaatgaaagctctgataccacctgatgaaccctgagttcctctcgacactcaaggctgttgttggcccgatctttcggtgagttgtgataactatgatttgggagaaacgttaacgatccgactacaaccgtacaagacgttctgttgcgccttagcgatcaatacacctctccgtgggttgttgatcttgccggtgcagatcaaccttattcctgcaagcaaatcgaagaaacaagcaagaacaagataaaagcaatctgaatagcaaataggaatgaatacacaagataagttggggttccgaagagcaagcagacggacggtctagccgacacgcgtgctgcaagcaagtagcaatggctaaactttaatctatcaaaacccaagaaactctaaaggggtacctaactatttaaggaggtgggaggacgacctaaggggaccctagggtcgtgctccacctggttggggcgcaccccacatgggccccacttgggccggggttccagacgaagttataagcccataggccattataggtgacgcaacaccttctttttgtgatttcggccgactaggatggaatttggcgatgaagctggatccattggaaagatgactccgagagctttccatcaagtactcatggacccaaaatggagctcgcatgcatatttggcggccgtttgaagtccatactgtagcaggtggccgaactggattgcagaacttggacggcttgatcttgatgtgaacgacggttgtatctatagtagctatggtcacatcatcctccccttcttcacggaaaaccgtcctcggtttttccatatggtgctcttcgtgtagtctatttaaaacaacctgtttcttccaatcacaacaagacaaactcgagataattttgttagcaataacatttctctctagcttgcatgttttatccacaagtacaggaggttctaaatctgaacagatgtaaactctatgcaccaaatatattcctctatcattatattcaccaaagagatgaaaaatagtgttacttggaatagtgacatggcaaatcagacttagcaaataatttctccttcaaattatcgagctcatgaaaatcagcaaactgaacatagcccaaagtatttaaagaatatgtcaattcacgttcctctactctattagcaatgtgaacaacatgcttaaaatcagcgcagttagtattaacaacaggaatagcatgttcattcactagttgtggcatggatataagtgaagcattatcgcacaactcttctttatcacaaggaacagcaagtaaatcaatttgtgacaaaggcaactcagcaattgattccactaatggggtaccgagctcgaattcgccctata

SEQ ID NO: 86038 - DNA, 2316 bp, Oryza sativa
ccagttgagttggtcagctggcttcatcaatttttggaaaagtatgcttgttgctccagcggctgagctagcaaaataatttattacctgcaattagaaacacaaacgagaataaggatgccacagatgttctcttacctgttctgtaagctgattcagattgattgagctgacaccggccatgattcttatactcaaatctgtggaacaatccacacaacacaaatatacacggttcaatttaattaaggcatgtagcttggcagtgaaaggccacgatggtgatgggtgatcataggcatctaccatcaggttggaccaccagagatgatctctctgctgatgacgtgtactaatctacaatctatgagaactaaacatgtttaagaggatgaagtaacatatttaaggcattatatgcgtgattgcctgtccttgctggagagattggatgctggtcgggacatggcagagagctccaagggtatataggcatgcaagacttgcagtctcgcacagtgccctccaattctgggcagttgcaggtaagaaccacggctgtctccggtgggatgatccattgcagtgaaccatcatatttcattgacttattgaaggaatggagaaggattgattgttgagcttaagaggagattaattaaaaggaatgaacagtgcgctcctttggcttcccatctttttattgcatttctgatggtttccggctgtgataccctgggtgatcaaggagtgccgatctgagccacacatggctatcatacaatgcgagcctctggtagtcaatcaggtgtttgtgtacttgcgtggggaaagaggagataggcagcctggctgggctgggcctcaagtatgaccttgattagtactgcaagtttatctaacggctgataatcgagagacatgttgatccaatggctgaaacttgttgatgacgtggctaaacttggtgacttctttatggtaattattgctgtcagtgggttgtaactgtatagaaagaaaggattttgtgatggcacagtgcacaccatatattgctgggggcaaatagaatggtaaattgatttatgtaggggttactaaacttccattttttatatcgtagtaagtattttgtgtatttgtctggtgatttttaccagtattttgcacaaaaggtctttagtgggtctgcttgttaaatcttggaaacaaaaggagggaaaaataatggtcagtgctagttggcttactgttcagatttcaatgaatatacttttaaagtttctgctgatattgttacattatgtaaaaagggaaaatggttgatgcaagttattcttttcagcttttgtacaaattttcatggtcatgatgcaatattgaataacttcatctttttaggcatatgttcaacaattggagaatagcaggctaaagcttacacaactagaacaagaattgcaacgagctcgtcagcaggtttgcttctattgtgtctcgctgttttgagctctggctgcaagagttcatttcaagtaggcttacgggaatttctcacagggcatttttatatccagctcagtggaccagactcattccatgagtggaaatggtatatatcaaatccttcaatgtttaatatataatcactcttttttgcagcagcaactgtttggttgatcattacaatgggatatatgaaagcaatacataaacattctgccttgttgacagagcaattatactgtattttcttgcaggggcattggcttttgatatggagtatgcacgttggttggaagaacacaataggcaaattaatgagctaaggtctgcagtcaatgctcatgcaggtgataatgagctccgtggtgttgttgacaagatcatgtcacactatgaggagattttcaagcagaaaggaaatgcggccaaagcagatgtctttcatgtgttatcaggcatgtggaagacaccagctgagaggtgtttcttgtggctaggaggattccgaccatccgagcttttaaaggtctgtaaagtcttacgatgttcttgttgtttatttgagccatccttctattgcaaagcccctcctattaccaaaaccaatgtttctaccataatattattagcatatcaagaacaaattatcagtctatacctatttttccttctatttcatatactcatatcaccaggtcattgtaaacttgtgctgtaataggcagattgtagttttgataaaacactatcttgctttgcataactcttgcatacctcatttcttgccattggagagcatgttagtac

SEQ ID NO: 86039 - DNA, 5217 bp, Oryza sativa
caccaaactacatccattgatctaaatgtcacacgataagagaaacataagggaaacaagcattatgaatagcgcaggaaccaaatctagccattgatgaatcctgaattaatgaaacataggaaggttcacttgcacatacaatatctccatttatagtagccacaggtgagagaggcaagcagtagaaattttcgaagtccaatgacagctgtgcaaaacaataacaatgagaacagaaaatcaacagaagtgataaaaagtactaagcatgctttcaacaaactgcagagagcatgtgacacacccccaccaaaatatatttaaattggtcaaatatatacagatttatcatcaatacatcttccataataccatacttataatggcatacatatatagctagataaaataattgtcaaaggtgtgtacagcaacatgcatttggtaaaagatagagaagaggacacattaatcgtcacaacatacgagattaggagcatagttaacagctacaaaaataggggcataggtatctaccacagatgaacaatttctgcaagataatatgctgccaatagtcccatcaaagggaccaaataggttttgtttccatcgcttgcattcaggctggttaccttccctttgactatatactttggaaggaaacatggtgatgtctgccagagaactcctatttggtacataacaacgggaaaattcatccctcagtgaggtcaaaagatgatgaaaggcttccgaagcatcctatgagggttaaatagttctcatcatttaaggacatataatataaaagtaaaatttaaagagaagaaatatacaggattaaacatcatgcctgctctcttgtcaaattaaagtggccgacgtagaagctcaaagcatccattactctgtgtggactcagttcagtccttttgtctcgaactacgctcaagtctacaacatttaagtaaagttcataaactagtaaaagaaattttatgagtaaccaactaaatgaagttttacaagtatagaacttgaaactgggagcatcacaagttatattctttttaagaaaaataaaacaacagttaaaaagacatgctttttctttcatattgaaggaagaaaccgtgatgtgtgaagtggagcaagaacatcaaactgtgagctgcaagcaattcattttaccaaccaatgcaatgacatgatatgatgttcagcaatttatgtaaatagattcataaatgtcaacactgcatcagagtatacctgtaaaaacgaaccgtgtttacagtattacagtatgtaacgattccaccagaccaccactgctcggtaattcctgagaccactagggtcacaggaaccaacactttattttccactcaaattatgtattgcacagataattacagacaaatcaataaaaaagaacttaaaagttgctaagtactgattccacaccaactcccttccaaaggtgcattttagaaagagtaaacggtgtaccttttataagagaacttagagcaaaaataagaggcattttttcggacttttcctcaggtagcacatcctcacttccaagcaaattatctagagaggaaacaaacccgtcacagctagcaagtgcctgtcaaacaaacattttctctagtttagcattttagctccagctgatgacagtgctatacataaagagtaccatatgacggatcattcaatagagaacgacatatacctgcaggataacattaagaaagcaattgttgccaagatttttcaggcctccagtgtaataaagtctatctgagttcgaaagtaacttcttctgagaaactggtggtatcaccaagctgctatgcagcgccttgcacaacccagcaactcctattgccaggccaactgctgctgcaagactataatggggcagcccatcactgagagataccagtagattgccatgctcggattttcccatgactcgacttatcctgcccccaatgtccgttgcatgaaacaaaatcaaataccgggacacaggacacctaaagttgtttgcaccagggacttttgctttctatccaactacctcacacttgaataaatagatatataacctgcatccaatgtaatatttcagaacaatggctaaaaaataaacagtgattcatgacctatgtagataacaattaaacggactaggatcgattctggttagcaatttacttaccatcaaaccgatggttactattacaaaacacaaagcaaggaatagtaattttacccaaaataataaaaaaaaacatcaagatcaaactgcccagctacatgtttatgaaccagtataataccataatccgacaaaccagtggcggatctaaactttttgggagccatcaaactgttactaccattaaggttaaggcaaatttctagaacagaagctagggttaacgcgaattcgagaagaagtgcgtgggaagagagagagagagatgcggcggaagcagcagcacgaacgacggcgacaccgctcgctcggggatcggcgcaggcggggcgcggtggcggaggatgtgctcaccgggatggatgcggcgggagaagcagcagggcgaacgaacggcggcgccctgctccgctcgcggcgcgggatggatggggatcgccggaggcggttgcggcggcggtgcgggtgggctaaagggcaaactgacgaggaagtttatcagtattccgatccgtatccctactctcttcctattctacggatccctacccttctacgactccgatcagtattacgaaattttactgtcgcgtttctacaatcctacaaaatattactccctccgttcctaaatatttaacaccgtttactttttttcatcgtattataattattaattatttttctatcattgattcattgttaaatatacttttatatatacatatagctctacatattttaaaaaataagatgaatgatcaagcatgtttaaaaaagtcaacggcgtcaaatatttaaggacggagagagtatttagtataagatagattaaaaatagtatgaacaaatatgcttaagtttacataaaccaattaaatttatcggaatcaatttatatgctttaatttatataacatattatctattttatatcaaattttgtattttctaaaatctggtagtatctcgatcctatgatactatccggatcctatgacattataaatcagaaaacgattctacctggtatttcgatactgattacctttatcaggatacgcacaaaatggtaacagtaattagtaatttcgtctagcacatcctattcccaccctacctgaacaatggaaacctgaaaaatggaaaataatattaattagttttaatcgcattatccaaatggcttggatagacgagtcatgctagcacgatccacagccaaacggatcgtgtagttcctagtttgtcatgacacatgcacttgtcatgttggtacaccgggccgggtagcggcccaagcatggcttggcgacgagtcatactagcacgatccacaaccaaacggatcgtgtagttcctggtttgtcaactacacatgaattttcgggcgggcaaggaaagacccagcccaattgataacctactgctacaatcaacaaacaatcgttcctctcagaaagaaaaaacaagtgatgattgatcacaaaaggagacatgctacctagacagtcccaaaaaaaataatggctgatctccaaaaaaattcttgttacagtgaacaaataatggctgaactaaaaataagttcaaatggtggcatatggaccacataggcgtaccgaaacgcagacatggagtagacttcgaaatttgtaacaccaggtatttcagggtttccatgagtaaacatactcacgttaatggtatttgcaataagaaaaatatgaccttgcataattttcttaaccaaattgtatcagggaagataatcccctaaacctcaactatgtctgacaatcaatctctagcctttttctagcttttacaagtccaatttgtaaatcggttcatggaccgttttccaagtacatcaatccattttgctctgtaggggccgcgtcttcttttgatcttagaggtgtggaagcaagattcttgataatggaagcatacagatcaaaatcagctttgtacttgcagcagctagcctcaatccacttctctgcaaggcttgtggccacgctgtcttgactatccctctcatgctcttcgatcgccggccttatctcgtcgtacaggctgtcaatttcagcagcagcttcattcttcatttcctgacatttgatttggaaaaaaggtcattgcaaagcctaagctttcctagagcaatgttcaataaaaagggagttacagtagttctttacctcgcaatacaatatttcttcacgtgccacctctgatgctaaccgatcacagatacccacaacattcagttgcttgcgcataccacgtttagcttttccaccacgaagtgtgggtctacgtttcaccgcaaccaactctgtatggttgttgtcccggggcgcactttgattctggaggtttgcaactccacgcgttgagttttgcagagcatcttcagcacattgcgcaccatattcaattgatccattctgagtaaaatcaactcccattggaatagcattcaatggttcaatagtcattggtgtcaattcatttgagctcacattcaatggttcaacattcatcggtgtgaactcatttgaactcgcaatcgatggttcaacattcatcggtgtgaattcacttgaacttgcaataataggaatcccagtattttggattgtgttgttgttgccatcctgtgtatttggctcatcttttattaagatgtcctttggaatgctggtaggttcatcatcagcagaatcataaaggggaacattctcaacagaaaacctgcaatttaagatggaaagcatatgttaaccggtgctcagatttgttgtatccgtcgatatttcggcatttcaagaaattcaggctttgtttgaaatgacaggttgacccaggcaacacaaatctgcatatttttaaccaactaggatcttcttctatgatgataatgcaagacatgccagtaatatggatctgagagataataaagcaag

SEQ ID NO: 86040 - DNA, 1327 bp, Oryza sativa
aggagcctagagtccatatagccatcccattagccaatgcctgacattcggcattcaccataaggaatattagaagaggagactagagtccatatagaaatacaattaggaaatgactgaaattcggaattaaaaataaggaatattagaagaggagactagagtccatatagaaatacaattaggaaataacttaaattcggaattaaaaataaggaatattagaagtagagtatagagtccatatagaaatacaattaggaaataactgaaattcggaattaaaaataaggaatattagaagtagagtatatagtccatatagaaatacgattaggaaataatagaaatttggaattaaaaataaagaatattagaagtagagtatagagtcgatatagaaatacaattaagaaaaaaagaaattcggaattaaaaagtaaggaatattagaaatagagtatagagtccatatatgaatttaaaactaactaaaatttggaataaacataataaaattaaaagtagagtttagagtccgtataaaaatacaatttacaaataactaaatttgaaattaagaaaaatatgggaagaagagtttaaggtcaatatagaaatacaaatataggaatacaatttagaagtaactaaaattcgaatttaaaaattaaagaatattgaaagataagtttagagtccacatagaaatacaattagaaataataaaaattcagaaataaaaaaaaatattggaagaagagcatagagtctatgtagaaatacaatttacagaaaattcaaaattaaaaaaaagaaatattaaaagacgagtctagagtccatataggaatatatataatttacaaataactaaaatttgataataaaaataattaataactaacacgtatataaaatataatataaatattacacattagtagtttcgtaaagttaatgcaaaatttaaaattatgttgtcattttaatatatttgaagaatataatgagaaaacatatatactattatataagagaaaatataatgatgctagccgcgtaatctgtgtgggccaccatgctaattattcaataaaaaaacaacttaaactaaataaatgtcttttaattgatttgataagctagaaagttaatctgttttggttgcaacataatgagtcaaagacacacatgacaaaaacaagtgatgtgacctaagcacaacggtgaagttgccgcgtgtaatttggctcccgtttcccaccactcaacggatccgtgagtccgtgactcgtgagtcaattgccattagaaattgagggca

SEQ ID NO: 86041 - DNA, 2096 bp, Oryza sativa
gttacaagcaaaaactcaaaatctcttatattatgggacggagggggtagttgctatgcctatattttgtcgggtgagctggtggtggtacgtttggtttagggtttagagctgactctggtggagaccctttcgggacgttgcatcagctacagcctacagggttgcgcgtttgttgggccgaatattgaagtgcgtgggccgtgggccgtggccaggacggcggatggatcatcctcgtgacgtatctcttcccctcgaccaacaattaacgagttgcgggtggcggcgttgaagcagctggactttttttttttttttgctatatatagggcatgtttggcacaagcttcagctccacctctcttagagctggagctcagccaaacagttttagctccacctaaaatgggagcagagctgggtggagctctcacaaaataaactagagttgtggagctgggtttagacagctccacaactccactccagacccaactcctagagctaaatttaggagttggagctctatcaaacaggcccataaagtcaattttgctatatctcactcgaaagatttcttttatctctcactcaaatttacagtgtattttcttgtaatttatgaaatttacatggtaacttttgttttgaaatttatattggatttggtctttttctcgaagatatggtaatttagtatccattatgatgtttcttagttgctttttgctttttactatgtctattggattttaatctaaaaatttaaaatatgtgtgaaaagatttatagctactcccatataaagttctatttttctaacttgctgatcttgagattttttttcatcgaaatttatttttcaacatttgcttttagatcgctaagaacacatataaaagttttatttacaaattattttttgcttgcaaatatgtcgggccctttttttgtttttgtttttatctttataatattcgttgcagtttgcaaaacacgggaatttagatagttatgtaaaagatgtcaaagagacatgatgcggtctgacagtccaacgtaaggaagcttcgtagcgcaactatggggatgttcataaatctaggtgaaaagttttaccgtgtcacatcggatatatgagcacatatttaaattattaaacatagtctaataataaaacaacctatagattccgtccgtaaactgcgagacgaatttattaagcctaattaatccatcaatagtaaatgtttactgtagcactacattatcaaatcatggagcaattaagcttaaaagatttgtctcgtaaactagtcgcaatttgtgccattagttattttttagcctatatttaatattttatgcaggtatttaaacgttcgatgtgacagggcgaaaaattataaggcgggatctaaacatggcctatatcagttggcatcgcacgtttacatcctcgagcagtagcactgcatgtctgcatggcagctggagcatcactcgccggcatctacgtgcgcttgagcgaatgcgtccggcaatattatggagtaaaagattgcttatgttgcccctctttgatcaaaaaatagttgggtgtttggcttaggtaaagttggttttaaattttagaaataattttaaggacctttcggaaaacacaagtacacagaacaaccagaacacaagtagaaaaggccacatgaaccagcttttatagaaaaaaaccaaaacagggtcacaaccacttgaacgttcactggagaggagagattccccatctaaatttccattaaggtcctgtttagttttaaagttttttttttccaaactttcaatttttcatcgcatcaaacctttcatacaccactggtggacaaaccatctttggtcggtcgaccaaatcccacaatagccctggttccattaaaaccgggactaaaaacgatttttagtcccggttaaaaaaattttgatctttagtcccggttggtaacaccaaccggaattaaagatgatttttagtcccggttcatcccctgtcagatgtatgttagggggtcgaggatctttagtcccggtttatacta

SEQ ID NO: 86042 - DNA, 4196 bp, Oryza sativa
ggtcaacgtttgcgagatatggctgctgcaaaaaggtcgcagaagatagcagaacttgaaaaacagctttcttatttggaggaactaatggagcaacttgatggagctgaggaagaagaagcaacagccattttaggtagatctgggtatctttcccagcaggaaatcaaatctgctattttgaaagcaacacaatccttaaggaaggcaaagggggagtccaatggtaacgaagagaaagcagatgcttctggggttgataagtatccacttgtgtctgtccctgatgaaacattgacaccagaacaggtgtgtgtctgtccatttatcatctgtagcaaaggggtttgtttttgcttgtgttttggggagaccttttgcgactgtgtgacatgagcacatatctattataccaagtttagatattttccatgtttcaaatatttactattcttatttcactttcgtatactttcagttaaaagagaagaagaaacagatactacttaaaaccacaacagaaggtcgaatgcgtgccaagcagagacgtgctgaggaggaagcattgagggagaagcaagaagaagagaggcgtttgtaagttgcgatgtccccagtctgaaatttatcattcatacggccgtcataattagtttatctgcattcagcttaagatcctcttttttgaaattttaagtacactgggttagttaaccagttatttcagagccatctttttagtttttgttcttgtgatacgcttcgtgctgatataagccctggaaatcaagcatgcattctgcaattccaaacaatgttcaatttactattctattatcctcatatcaatgaaatatacactctatgaaaagggataaatttttctcgaatctgtcataaatatttgccatgcgctctatacgctgcttttatgatatgttttactttaatatccagggagaacccagagttataccttgaagagctccgtgctcgatactcggaactttctgatagggttgatcagaggaagcgacagaaactcaatggtggtaagaccaatggtaatcataattcatctggtggagtaggccgtggggaacgtcttaatgccgcccagaaagaaaggatgcggttgctcacatctgctgcatttgatcgggggaagggcgaggacacttttggtacgagagatgaagattggttagtctacaaaaagatgagcaaagataatgacgacgacgacgatgggaacgatgatgatgaatcagaacttgctcgaattgcttctaagatccaggtaagatctcacgttcaagcaatcttgcttgtgagccgtgatggccattttgtcttacttagatctcacacctcaatagtttcttttacaatcataaactatttgatgcttccatgtgcaggatatggaccctacatttgtgaacaaagctgaagctgtccaacagactcctgagcctcctaaggtccggactcttacagcagaagattacaggatttccatagggatcgagcggttccggtgccctgaaatattgttccagcctggtatgataggaattgaccaggctggtatcgatgagatggtcagcatctcacttaggcgactaatggaagacgaggctgtcaaggagcgcctttgccagtccatccttgtcactggaggctgttctttgatcccaggcatgatccctcggctggaatccggaatccggcagtttcggccctacctctcacccctgaagcttgttagagcagccgacccccttatagatgcatggaggggcgctgctgcctttgcagcttccagcaagtttgggaggcacaccttcagcttagcagattacagagagcatggagaaaacttgtttcatcggtacaacattgtttactccttgtagtatctttggcagcatgggctaacatggatatgctgacacccaatgttgttacatatttatgaacaaagaacacaagtcaatttattgacaggcaatagcagtaaccatttttgaagcaactcggtgttcggcgtaattttactgtggcatttatggttttattatgtatattggcctgttagctttagaaccttttaatgtaagacaatggtagcttgcatattatacagagagggtcttgagtttcgtcaagaattttggtttcggttacgttatatagtcagcgttttattgtcctgtataatttaccgtcgcgaagaattctacacacattattataaattgtcaataaaaccatatcgaaactgtcaagatggccgagttggtctaaggcgccagtttcaggtactggtccgaaagggcatgggttcgaatcccattcttgacaagaaatttttttttgttttttgggtaaaaaaattgaattttcggtcttcatccctctctctgcaactcaaatttcatgaaacttccctaaaaactcgaattttcggtcttcatccttctctctgcaactcaaatttcatgaaactcgaaccttctgtttttttttactcgaattttccataatctgggtcttcagcctcatgaaactcgaaccttctgtatctttatctagcgctaggaagcctaggatcgcttttttttttttcggtctacaaaaataacattacatttgatcaaaatatccctaaacctgctcagttcaaaacatcccgcacatgcatgatgtatgtccttacatttttcagctgctcgtggcaaaaacatatgaacctcgtttatgatctgggatggctccaagaaaagcatggccaccctccaaccaccaaacaccccctagaataggttggcaacttaaccgctccaccagaatttagcccttgtcaccactataactcagaaattggttccctcagggttgccaactttaggatagagtccattttttgcctgatcagctcctcccaaagctctaggatttggttccattcttgcacaaatcatgaatgaaatcagaaaattgaagcgcgggatcagcaccaaacgaggtgatcaccccgtccaaaatggtaatagatttgtcggtcttggttcttttcttctcatctcaaatttcaccattcctgcatgtttcataatttctcatgacatttcgatcttggaaaatgtatagcttgatcaatgtgttccaaattattcttctggaagtaatgatacagggatgttagtgcctcacctgcctagaaataaagaaatgatcatgcctgattgacatttccctcagcgtctctgaatattgcaggccaaaatccagtcgatgaatgggaggagcaacaacgatactggccttcgccacgggcaccgccggtgagtccgatgggatcgccgcggaccccaaatgggagccagaagaagccagttctcggcaaggtgaagagcaaggctaagaaatggatgcacctgctgcatcacaagaagaagccgcaagaagacatgatgtggaccccccgagcaggacccagtgcagacgacagcaaggagcacaacgatgcagactacggatccccaagcacagctcgacatccccattcctgtatgtctgccagacttcagaatattgcatgcattggacaatctccagttaaattcagtcaagatatcaattatagtataattttgttatgatgaagagtaatacttgtgttttccatgtaaatcgtagcgtgtgaatcagcatgtgcacctgaggttttcttggaagcatcatcaaggcagaattccccactcccgagcccaactgcacacaaggagcaaccatacttcaaggtcagcagcaggtttgagtcagaaatgaaggaagccaatgaaatgctgagggaatcaaagcagctccgtgtcaacacaaccaaaccgaagactgtaacatttgcgccaatcttagaacaggggccagaacctgtaaaaaatgattggcacagcaaagaactgtcagaaacagcaaccgagatattcagtcatgcatatgctatagtctgtgaggcagtcctcaggatggtctctataatccaaggcgcgatgtcatcatataatattgacagaaggcaaatgttagagaagatcgtatcgttcaagagatacatgatgctgaagctggcactggagaaggtgataaagtactctcagaagtcattactgaggctgtcctcgatatgt

SEQ ID NO: 86043 - DNA, 7158 bp, Oryza sativa
cattattatcacctctttgtttgaataatcttaactaatacaatgcatgcacccaatagaattaagcatcttgatttaaaaacaataatttagaagagagaatatgctattaattgtcatgcatacatgcacgccttatattatgaaacacctttaaaaagtagttgcgccctatattttagaacagagggagtaatattttagaataactttcatataaaaagttttcgcacaaaatacatcgtttagcaatttgaaaagcgtgccatgaaaatcttaatcttcggccaagtttagttctaaattttttcttcaaactttcaactttttcatcacaaacttccctacacacataaattttcaactttttcatcacatcgtttcaatttcaaccaaactttcaattttggcgtgaactaaacacaaccttcatctaactcttgttgaaggaaagaactgaagcttagtactaaacttgtcttgggaatgtaggaatcgatttttttaagggacggagggagtacgttcacacattacattattgcagctctgcctccactgtactcctccattgcacacctgccagaaatgcatgtctagcacgcagtcacgcacacatgtagtagtacaaccagacattccatgcaaagtataatccccaaactgccttcgttcgagattccagcgaccagcggtacagagcgcggaactggcgttgaccatattccgatccatttcgaatgcctaaagatctgaccacagggtgacaggggggacagagatcagttggccaggaaaccacggtgttaacttctcctgacgtggagttctcgggccttgtgcgatctcatgtgttcatctccgtttttgagcaagtttaatagtatagccaactagaatctctaatttatctatagtcaatttaatagttcattcatacaatagttacatactacactattaatacttgatcccacctatcatatacatactgtgttttgaagtccgtgctacagctggctacaaatctgtagccaactgctcttctctctccttatttactacctccgtcccaaaataagtgcagccgtggatatccgtacccaacgtttgaccgttcgtcttatttgaaaaatttgtgaaaaaattaaaaatatttagtcacacataaagtactattcatattttatcatttaatatcaataaaaatactaatcatagaaaatttcaaataagacgaacggtcaaacgttgaacgtgaatagtgcaaaactgcacttattttgggacggagggagtatcttcttagaatatgtttatagccggcttatagcctgctattgtacctactctaactagcaagtttatagtgtagctaactactgactttgaataatttatagtcaatttaatagccaattcataaaatagttacatataagtatatactacgtaattaatatttggtcacacctatcatatcatacacatgcatttaggagtttgttctgcagttggctacaatgtagccagctgctcttctcaccagccatcttcaaccctccatgtcatcaagtatccataacatttaatacattgacatataagaaaaatatgtgatgcactacaagaaaaatactctgtatagacatttttctagtactgtagaggcacttatcaaatgcctttacaacaatgtagaggcattttaaaaaatgtctaataagtgtcttatggtgaattgtctctacaaacgaagagacattttataaaatgtctataagatggtagaggcattttttagagacactaaattgtaccgcaaacatataaaaccagtccaaaaaagagaataaaatagtttccttgcttttgataagtcttgaactcatgatcttttggttaaatcattttaatcttcgatacactaaccaactcaactccatgtcattacttgtatacttgttcctttaattacttatatttagtcgtttagtacacattatcattctaaaaagtgtctctacatagtttaaaatgtctcaacaaaatgcctttacatattagacgcattttatagtgccgaaagaatgcctctacaagataaaatctaacaaactgatataaaaatgtctctagagtaaaagttttctaggcaatttttaaagtgtctctataaagtgtctctacactataaaacttctgattgtagaagcaatttacaaaatgcctctacaaaagtgcctctatacgaggtttttgttgtagtgatgagagttaataagaagagaggtaaaaagatgaagataccatttctcgtaaagaaacatctttacacgagaaccaagaataaaaacaaggggattagatgtgaatttaatttgaagacatcatccattggatatatagactctatatatagtgtctatatgacatggtaagtatggaatatagtttctgctattgtgtcttctctaactactttaccgaattattattgctggtcgccaacgcgcggatcattattattgatattgtatactactccatattttaaagtttaatatatgttgaatacataggctattttctatactatagcgatttagattactaactgttttcagtttttttttaaaaaaaaatcgtaattaaaataataaacatcatatttatttaatattgaattttgcagttgctacatttattaaaaaactatatgtaattaatacctaacacattattacgatctacagttgtgatattatgatttattagatcaatgactagatttttctgattaatgtgagagctcatagaaaatgttaggttagtataggtatagatatagatagatagatagatagatagatagatagagggttaaaagctatttttctttgtggtggagttacggactgcaaatccatgtcttagctaaatacaaaagacgcccatttttttttaaaacaacggcagagcttgccatttcactgaataaagaagggagcaatatttacatgtaaggagaaaagtaatatttacaaaggcgaccgggcactaaggcaacatctctgctgagcgtttggcttcccgccgtagcccaagcttttgcctcatcctttatctttgcgatgaggtcgcagtgcttaactctttgtttcggaagatttgtcggtttcactcgttccaaatttcccaggagattaggaggattaaggatataattccaagttttggtacagtgtggcatgtggcaagaaattcccaccattcatgaaccgtggtcgattgtgtccagcttaccggcgccatggatgcacaggttatccaactggcaatggcatcccatattttcttggtgtatctgcattgcattccaccaacaggtgtatagtaatctcgtcggtgtgccgacatagcgagcaaactccattcttctgtcagccccgggtcgctagtcggtccgccatccaaaccctattttgaatgattaaccacgcaaatgtccatatctttgattttgtgacgaacccgtgcaccatccaaccgtgtcggtgagaaaggtcgaatggagcccgtactgacgaccctgataggtgaacagttgcacggggttgcacccgcgcggtcagttccaaaccctctagttcaccttctcctctataagagtatatacacatgtatatatagtataagagcgcacgcgcctatatatataatttttttagggtgaatagctaatttagtccctcaagtttcagtgaaggcttaatttgatccttcacgtttcattttgtctatatagatccttcaaatatttgttttagcttgaaatcattcttgggtccacttaatatgccatatggctatttctagtcaatatttctattagaaaatgtcctttttgcccataatttatatacatctatacactagaaaatagaaagccaacatgaataaacaacattacagatctacttcccattatttcaacatgtgcacatgaaacttaagcaattgctatcgtatacacttgctagtacataatttttttcgttttacataatatactatgtattatctataaaaaattcaagcatgcaatttctctcttatatatgtgaatgatgaggggtataagtgtcatttatgaagagagttgttggttcaaggataagtttgaactaaaatgaaaacttgaaggactaatatggatagattgaaacatcaaggactaaactgagcctcagataaaacttgcaggaccactttggctattcaccctttatttatgtataaaaaatatacatctatacagaagtttatatacgacatatacaaactttgtatatgacgtagacaaaatttatatacatgcgcatttaaaaaatttaaaaaacatcacgtatacaaagttcgtatacatatataaaaagtttgtatacgagtgtaaacaaactttgtatacacatatataaactttgtatctcgtacgtatagaaaacaaaaaaaacccaaaaaaggaaaaaataaaaaaatactgaaaagaaaaaaaaccaaagaaaaccgaataaaacaaagaaaaaaagtgaaaaaaagtcccacgcgcggcgcggcgtccgccgccctcctctccgcgcgcgccacctgtccatccgcgcggagggaggcgcgcgcggacatccgcgaattagcaatctcttaacctggcagccatatcgcccgccggtcaaacccgccctctttgttcgtcgacggctcgacctcttgttgcttgtgtcacctccttttgtcttctacccgagattttccatagagaaaacggccctcacccacggccacagccacgggccgtaggtgtcagtcgtgtcacacacaaaaaaaaaaaaagttccacccacccgttgtcttcgcatttcaacccttaatatccgtttgcctataaatactctctctgtaggtacatctctctaccatctctgtcgtccaacctcttagtttcctgcttggttttgatcgattcaagctagtaaacgctgatcatggtgaacgttgctcgcttggatcaggctgacggcgctgcgtccaagatcgccacggcgcgggcgctgggggcgttcggcctcgccacagcctctctggccatcaatctggccgcgacacgcggggcaccgtcgtgcttcggtgacagcgcctggtactaccacctcgctctcgtgggttccttcctctccggagtggcccaggtggccgccgccgtctgggtcgccgacgaccctcgcggccgccatgccgtcggcaagaaaatcatgtacccctctattgcacccctcctcgtggccgtcggcctcaccggagcggctctgctctggtaatatttccagttttccaccttggttcatctacacgtaccaacaccgacatcgccgcctaccgcgccagcttctccccgcaggatcggcgcgaatgtatctgttaacaaccctctccttccaaactcggtaatctcaagaacaatccaattcaatacaatctcaggaaaatagaagaggaattgaaggagaagaagtagaggatgcttctagaagtggcagtgaggaggaccatggagagagagaaggatagagatcgacgaggttcaaccgaaccaagccgccgccgccgccgtggccgaagccgccgattcctgatctgttcgattcccctggtaagagttgtcctgttgttttgtagcttcaccttggactggcctgggccaacattaggagagttgatggactggcccatttggcagcccagccaggaccttaacagtatcttacctgtttgatttgtgtgatgttgctttcttgatgtttgctgtttgggtcatcgatcgtgcttttgtgtatcacctcgagtatctagtatctaccatcaatcaatcacgctgtttccctccactgcctgctgttgttgtgttgttgatcaatgcttggattgatgaatatgtgatgcaaattttgagtcactacggtatactcaaatcaaacaaaaaaatcagctaatttgcagaagagtgtatttggaatgttggagtaccccgcgaattgtgaagccggtggcggcgcggcgaccggcgattatggtgtttgtgatcactaattcaacatccacttcatcgctgccgctggcggggctccggcgacggtgcgcaccgtacggccggcccgccgccgccgccttgtcctcccttgccccttgccgctgtcatgtgatggccaaaagggttctttttggtgatttttctatccagttttttaatcaagattctgatccaattgtttcgattttggctgaaaggtgggccataagtggaccccacatggccataggagagtactactaatagtaggagattactggagaaagagaggagacatcacagggtccccgagactgggaaatttaactatttgtaactctcacaattaacgatttgccacatcctatctatcacatgtagactcttatgtgtctatgatatgtgggtctaatagtaaattgttaagctccactggtaagagtggcaaatatttaaaagccccgcggagacttgcggctgcggcggccgagagggccacggccatggcgacctcgccttcgccctcgccctcgcccaaaaagtctctatctcgctgctccggcttcctaactacatcctcttacctcctctctgcctcaattcgctagatcttgtgcagcggtgaggaaacgacggcgcgccaaattttgctcggccacgatccgatcactgtcgccggaagccgtcctccggccaccccctcgccgtgaacctgcgccggcggacctcggccaggatctggtcggcatcgcggctgtggtattgcaaacagatttgtggatgctatgatggccgtgcgccgttcagccgttgacttgtaagaacacggcagccacctcttctgattttagtggttcatacaggttatcatctgcttgccccttacaattacatatggttacatacttacatgcattttggtggctgtggtcatgttgtgaaagaaagacatcagtcaacaggtgcttaagggaatttcacagttgagcgataacctatcaaaatttgatctgatagggcagtttggtatg

SEQ ID NO: 86044 - DNA, 1037 bp, Oryza sativa
ccctttaaaaggatccccaagctttcttttacccgtcgccactctcgccttcgcctctcgtcgtccgtagcgccctagcgtcgtgtaagctagcgccgccgtcgtcgccgccgctccagccgtgcgccgccgtcactcctgttgtcgccgtcgctcggggaggtcgccttcgtggtcgccgtcgcatcgccgtcctcgtccgccccttcgccgtcgctgaagaccgccggagcaccgtcgccgtcgtcgagccgaaggtctccgccgtttcaacctcgtcgccgtcgccgtccgctgctcctccgccgttgctttggtcaccggtgagttcgccgcgtcgcccgcttcgtgctggtgtcctccgttcgcgccgcagcgccgtcgttcgccggcgagcatgcgcgcccgagccgcccgagccgccaccggtgatgacgtcaccgctgacgtcatcgggactgtccgccgtgagccggccgtggaccggttgatctcagccgtccgttttggatggatcaatctcggccgttcgtttccgtgagccgccaccgtgcgcccggtccaccgcaaaccctagccgctgacgcaataaatcccttttttcttttcaaaaataattcattattgcgtcataattcaattaaaatcaatataagtgttttaatccgattaaatcttcaaaaattcataactaattcatcttagctcggatttagttggttcaagtctctaaatttttctaaaattgagatctacatgttaaaaatatccacatgtactgttcatgcttgtttatgtgctgtttggtgattttgctctttcctggttagattctgacgtttccggaaagtccgttttcgcaggagaagattttgaagagttccaaggccagcaaggcaagtcacacagatccccaacaaccctttgagcatattgatcccgtttaaagctattgtttcttttcaactattgcatttattttcaaatgtcattgggtggaattaacctattgtttgttatagcccttttgttctgga

SEQ ID NO: 86045 - DNA, 1527 bp, Oryza sativa
ttcaccatgttggttaaggtattaactaacactccagattggttaatcaaggcatgttgcacggcatagtcgatcctatcctgaaaattgttaaactgcaacggctcttggttgccatctgcaccaaaatcttcaacagtgccatcttgaggaacatcacctttgtcaccttgagatgaacccgaaccagcttcatcggctgcaactaccttcagcttgtacttctggacgatggttcctctgcgggtttcttggaaagaattcatgaactgatcctttacattgctcatcatctgctcgagctcatccctttgctcagtcgtcaatttatccaatgtgattggaacaataatactaggggccagttcggctgaacaagaaataaagacaaagaaacagtagttaaatccataatgatagccgattagccagccgccgatgacatatcatttatcttcgagccgatgtcatatgtgaatcgatcggcagttataaataagtaattaaaactaaatctactcgatcgggtatagacgttaacaatgcataatttttatgtcgatatatacttaaatcaagtgattgggatagatcggtcgccatgccgagacagtataaatcacttagatcgaaatatatattaacaatgagattatagatgttcacagcataaccgattagatagatctagcgcgtatcggctaatacaccgataccactctatattaagatattaaagcgagtaaaatatatcaaacaaaaagcttaacatatctaaaaaaagcaataagatctcaatataaagggcagatttagcatatcaattaagcacatgaaatataaggctaaatcaggtaagatcggctaaaaccccgatactactctaatcgacaaccaagaagcaggctagagattatagttctaagcacgacttatgaggtcaaacctaactgatgcagccataagtatgaaaagaaacacaatatctagacaatcaagccattggaagtttcgtagagtggtggatattctatataatctagatcaacatcggtaattaacctgatcggctgcctcccagtaacagatgttagcctattagaggttaggtaacaatgttgccggagattatatagaatatatgataactcgacaacttacatgcacaggattagagtgtcataatgatgcaagcactaatcccaagaacgcaagccgccataacaagtcgtacctctagttgaagatcgaaaccgatgcagctcaactcgaaagcaagaactcgtcgaaacaaaacgaaagtaaaaggtggcgatgcgccgagattgtatttgaacgtgtgttaattgattacatagggctcggggtctatttatacccgagattacaaaatatgtccttgtcggacacgactctcatctctaacaaactctaagataccataagtctttgcggcagacttttgcccacacttatctctaaggaaattacataaaatatcctaattaatagatacaattgccttct

SEQ ID NO: 86046 - DNA, 3200 bp, Oryza sativa
atttgctcttttctaggattgaatcaaactttgtaatcctgataaccattttctaaatatatgtataatctgcttatactacaaaagaaataatatgtaaatctttcaatttttaaaaacactataattcggataaaacaaacacttatgtcggtgttgtagtcttatttcatatctaaacatcatgatgctcaaaatcgtacaagaaaaattaaatattttgtatgttaataatgtggtttttaaagaccaaatacataggctaatcagctggcgcgctaaccaacgcgttgatttttctacttaaaaacaaaacatggaccactagaatttttataaagatatggaggagaaataaaaaaacagggacattgagtatatggaggagaaccatagagaattttatgtgggtatggaggagaactaaaaacaaagggcaactgaattttaggatgatataaaagacaatcatgtagaaaacacaagtaatgaacattaaagaatgagtacaaacagtacatttaagtcttggggtagatatgtacaagttatcaatcttacaaatatatcaaacggttgttggcaaccgcgtatctatccatgcatgcaagtgtgttacaagaaggagaccaaacgattaaacagaagtaataatctttcgtaaaacactcgaactgaactaacgaatctcaacaaaatctcacaaaattaccacacaaacagaagaagaaacgagataagcactagaccgattgtcccattaatcatcaatcagttaacgagaatgataaaatgtctataattaagatccaaaagaactgacacagccgattgaaacatatacaattcacagtctacattctgcaacgcaaaattaaattaagacatacatgcaaattcatgatgcctcctagacctacgataattacttgtgaactcatgacgaagaactccttcatggccttttgccaggagcattcgttagcatgatcattttagaagccatggctggaagaaatacctctcgtaatgtctcacgttggatctatccaataacatgttctctaacatatgcacattatcgatttggtatcttcataccatgatccataatacatgatcatctatcaatatatgtgctgatcatctaatcacatttgtttcatatgtgatatttgattagggaatctttgaataaatagtaacatacaacataaagagtttcatgaatgaatcacatatttattaatcaataataataaaaaatacctgcagtctgagctgacattgatgcggctagcatgcctatggctaccaccacgccgaagaccacaacggcaacggcgatgagcacaagaaaaggatgcttcgcttctggcgtgcagagcgtgcacaacagcagggcgacatgtctatctcatgttttgcaaaacgtaaaaaccagtggtattgtacactttatagtcatttgtatccacaaacgaagtatacgcaagtgcactacaatgtaactagagatgaaaacggagcggatacggacggataatgcatataccatattcattttcatatttttttccaaatacgaaaacgaatacgtatagctcgaatacgaaaacaaatacggattatctcgaatataaataagaatcgaattgatcggactcgaatacgaaaacatttttttctcggaacacgaaaaccaaactcaacttctaatataaacaaatatcaacatatataattagatccttttatataaaatgtagtatactttataattttttaaaaaaacttaaataatattaatagtgtagactagtgttaagaaataaactactattaaaatctaaaaaggtatattgaaggtcatagagttataaagaaatggagtatgtctcatggcttctgcagatatcctaatagcactgttcaccggatatccgaattgttatccgtattcgacggaaaccccgataccatattgtcagggttacgaataacgcctaccctccatccttggatatacgatgtatactgatatggtatacccgcgcatatacgggtgtttcctgtatacgttaaggaaatctatcacgtaacataaacaaagtccacaattggaaggagtcctactcggacggaactgggtcgttaccatatcgtgtggggtccgatatctccgagttctacttggagatcgactaacccgcgatataaaaggaaccccccgggaggacctaaggcatcgaatcttaccgccaacacatccaccacagcctacgaagccagagcctacatgagccaagtcgctgggtgatctagtcgagccaactcgactacgatctcgtcggtatcgccgaatttcattattccctttgtaatatgtggtttccactatataatcccatatcaactggactagggctattacctaccaaggagcctgaaccagtataatcctcgtcttctgtttgcttgatgttgtattacgtaatcctcgtaccagcgtaccccaataccctctatatccggtctgcgggtatcccccgtcgacacatatttgtattcgtatctgggaaaaaatatccgtattcgtatccgtatctgaactatccaatccgaaaggtatccgttttttgtttttctccggagcggacggaaactatccgctccgttttcatccctaaatgtaactgcaactgaatgtataacacattcgatttgctatagtagtgcagcagtgggagagtagattattttaaacactctcgagagaattcttctcattatttgcatgtcgcttaaatagttaaaatattaaaaaaattgagaaaatatattagtatgtgatatatatatatatatatatatatatatatatatatatatatatatatatatatatatatatatatatatatatatatatcattctataaacattaagttaaaattcaaattttacaagtaaaaataataaattacattacaactaattaacttacatttatagtcaaatttatttttttctttcaacatgtagaagttaaattttgccttgcatatttgtgtagtaatttatcacatattagtctaccttgttggtattttttaaaaaaaaacataattatttgagagtgacatgcaacaacgagagtacataccctcgggagtttatagaatagtggtgtgcaaaa

SEQ ID NO: 86047 - DNA, 1882 bp, Oryza sativa
attcctgcagcccctgcaacattgaatgtttcttcttgcatttgagtgtctagccgaatagcctgttgtatgtcatgtaggcttaatgacatagggacaggttgggagatgtgaacccagattttcctgttaaatgtgatatctttacaattagtggtgaaagaaaggaacatttcaggtaggtggcttacattagagcttctgcataagcgattgaagttgtatatgtgtataaatcatcaagtgtttcagataggtggcttacttaagagcttctgcatcagtgattgaaattgcatatgtgtataaatcatcaagtgccttctggtcatgcctgacgaaagagtgttgcttgctcagaaatggtgatttcaccgaatggcttggtttaatcgacctctttggccgatcgaataggatatcagaaggaccgccgataattctcctcttggatttaggtgggagctttgtacatgcgtactcctcacgcatgaaaatcctcgccccactcgtctctttcaacatagagtacggagagaaactactaagtttagtttgttggtaacctattatgagacagaacagtaagagtgagacatattatgtgcatgtggttggttatgaatgaaaatgaaaaactgatacaggcttgtgggtatcattacctccatgcgaagagggagttttgtgcactgcattaccttctccggatttgtcagaggcatctactgactttgagattggctgatctggggtacgtgctaaaaagttgagttcttgttctttgtcagagtcttcagccacattggagatgtcatgacctggggtacatgccaccatgtttgcttcttcgatatcttgtgttattcctagattaaagcttgggggctcgatgtcagacctggcatcgtaggtacgatccacatggatagcctgtgtacagatatatcaacaattcttatggaaaaatggattctttttatattgaatagattgacaaactacatgagattgcacctctattgcacccgtatgatggccaagattgtatttttcatcatgtttgtttcgcagctgaaacccaaaaaaaatgtcaatagtctgaagtttctgcacaagggaaatttcaacaagaatactctaccggcaggagagttgattttaccttcatctttccatacgcggggaaaggattccggttcttgagaattacatccctctcaatgaattctgctatcatggagtcattgtacacgccaatccttggaatgttttcctgctcgggagtgtccgtcccgaaatccagattgtccagataaaaaagctgagcagtataaattatagcatgtgaaaagatgttgcgagtatattagaaagtaaaaggcaaataattcgaacgaataataggataatctcacctgaggtagtataatgcagccattgatgtaaccaatgctttttcgatggcgtattttgtgttgcaatgctgctgctgcatctttgatgtcatgcaaaacaaattccgcccagttgtacttgtgaatattttctacatcaaccaaagccttcatataccttatagatatgtgattgttaacagattgaggagccaagaatttggttacaacgaagattataaaagcagtcttgaatacaatctgttcgtgaacagtcatcgtcctgttaaattttttctccaatatcctctgaattgttacaatggtaagtccatcaaaggaatctttctcaaagatttcacacatataagccttaacatcttttacctcattttttattgcaggcaaaatctccttccgtccacaagggattcccaaaagtaggctgacatcctcacatgtcaaacaaatttcatgtctagatc

SEQ ID NO: 86048 - DNA, 11271 bp, Oryza sativa
  unsure (1)..(11271): unsure at all n locations
cccccctccctccctccctctccctctctccacctggtttacttttttggcaccgcattacttttctattttagtaaatttatgcacctaaagtttatacacctcaagtttacacatctaaaatttagagaccaaaagtttataagtcaaaagtttatatatccgattcaaatttgaatttgaattcaaatactttttatatatagtatttctatacatctaaagtatatacacctaaagtttatacacccgattcaaatttgaatttgaattcaaataattcaaatattttctatatatagttgttaacagtgaaatttggtaagcccaaagttaccatcgatttagagtcagtatcggcttcaaagttctagaatcagccgatgggagtcaagtcgccacgatgtcgtgttcttggtggagtcggatcaatcaaaggaagcttatctagaagagttcgagttcaagaaggatgcgacataacaattatctattaattaggcatagtttattagtttccttttatcttaggaaagtgtgtttagtgtccgataaggactttatcttttcatttttagtttctttcttgtccgacaaggactagtatctccctatgggtataaatatgtacagccggggtctatgtaatctatcaatctatcgatcaataatactctcggcgtatcaccactctcttccctgaggtttttacttatcttccggcggaacttgggcacctgacgcagggctgcatcggctttcgatttccagcgaaggggtaagtcctacgttctgtcgggccctggtgaatctgtcggctacgttggtgttgttcaaggctgcatcgattcgatctcttggatcgctctggttttattgatatatttgcctacctaatatctcaattctatctctaattgcattgtgattagagacgcatcggtttagttgggactgtctcgattaggtctgatctcctgtcttagccgatatatctctacaatcataatgctgttctaaatagatttgttatatccatcacattagatagatctatcagctcatcgagtattagattatcatatacaatctcgtgctgcatcggttaggttcgatctactagattgttgttgataatataagtcttgttaagccgatagattcatgctaatgttttatcggggtgctagctgataagttatctggacgttgcatcggcttgtagggattgcatatacatataagttggatttagccaatggcaacaaaggttttactgtttaatctaatcttgtggatcttatgacatcggacctccagccgatgtgtgctttaacctttggatcaatacttgttctactatttcatattggtagccgattggtttctactagattatattactatattatattatcatcagccgattgtctttatatcattatctacattggacatatagccgattgcttaaaccctatcgctatcggctagtatcggtatcggctatcggctggaactactccatcggcttgttagccgatcggctgtttgatctattatttgcaaatcttgtcagttgcaggattaaactgactggcacgcccgcatctcatcaacctttggacctgcacagaagctaagcagatctccaggccggtgtgttcgattttttcgtcaacaatagtatttctatacatctaaagtttatagatccaaagtttataagtcaaaagtttacgtacccgattcaaatttgaatttgaattcaaattttttatacataaatttttctaacttttttggttttttaaaattttttgtggtgtactataataggaaaagaaggggaggaggaaggggagaaaggaggggggaccgatcgcttaagcgagcgatcgnccatcaggcgccccctcccttccttcctctcccttttttaaacgttactataatgtattttatatttgagatgatgggtattatcatatttaatttaaagtaaattattttgatggtatataaatatgttaggtaggtttaatttaattaatatatcaatttataaaactatcattttggtgtatgagtttgtaaggtacatactccgtacgaactaaggtaaaaaagacacaacacaacaacttttatcaagttagacgtgggtttagaacatgacgtacacacgtgaaatggacataagactgagacatgctatatttataaacttgattttctgtttcattattctttgttctatctcaatgtttttatattttctccatgcaatccttaggctttatagaactttttactgaacagacgcaagcctatgtggcattcttgtcactaaggttgtttggttagtatacccacattaccaaagcttgccatacttaatttagctaacatgtctaacatgtggccaataaattcgaagccacatttcagccataggagaacaaacttgccacacttttacgtgccaatgacatgtgggacccacatcatgatgaaggaatcttgccataagtgtggcatgaaccaaacagatgtctaacttagtcgaacttggctaacctaagttgtggcatggtgagacaaactgtggtagtgaaccaaacaacccctaacaccatcactcaactcctggttacaaatttagacatagtgctacatgttcgtagctcggatttgattatgtagtaaaataatcaacatttaaattaggaggattaggtttattaatattctgtggccttagtttgcacagaggcataataagttcgaatagtaaaacgaatattttacaaattcatatactagctacgtacaagctgttggtctggctaattaacctcgtaactttttcactaacacctgaagagtactaattttcccatgcaaacctaataaattttgtgtaaataaccttactaaaatatcaagcaatgataagagtaaaattgttggctctacttatattttttttcttttttctgattacgacctttatatcgtaatctcgtaatttttttccactctatcaatataactttgcacatttattaagaaaaacaatttactctttaatttacgtgaatggatggcatcaagacaaacgggacctggctagctagtaggaatagctagcaagctcagctcacagtgtatatgaagcacggcgtgagtgaagatgacaaaccagctgctgctccgttattgttatctcttcattatttaattacgaatacttctccgtccttgtttgtttccaggaagaaaataataattgaaatgaaatgaaaagggataaacattggactttagaagatgcgaatgcgacgacactgggtgtgcagagacaagcgaagccagtactgcagctgagtgtgccgtacagccaagcagcaggtcagttctgtggatatgtttttctataatttaaagctgcatgtacgacacgtacattaccaacgtgttgcacacctgtgcatctctaaatccttccttacttcctttggtcatctgcatagtataagagctactagcactacctctgtggagttattaagtaaatttctagcactgataagccgctgataacttgcatgttctcaattaaatgatggaaagttgaacggtgatttacacgggcgttccaaataataacaatttaatttttccacttaattagtaagaaaatcttgtgttcaggagtgagggcctcactccctagcacgtaaaacaaagcagtgtttagcgtatgattaattaagtattagctaaaataaattttaaaaatggattaatatgatttttttaaaataactttcatatagaaaatttttacaagaaacgtatcatttagcagtttgaaaagcgtgcgcgtaaaaaacgagtgaggtgagttggttaaatggagataagaattcggcctaaatcgctacagctattcttttctaccaagctagctactcccttagtcccataatataagaaattttgacattttgattgcactgtttgaccactcgtcttattaaaaaaaattacaaatataaaaaacaaaaaagttgtgcttaaagtacattagataataaagtaagtaaaaaaatagataataatttttaatttttttaaataagatgaatggtcaaacagtataaacaaaatgtcaaaatcccttatagttttatattataagacggagggagtagatcatcatcatagcctcataggtgggttagtttcttggccataactctagctagctggcaccagtgcgcatacatacatacacacacacacacacacacatatatatatatatatatatatatatatatatatatatatatatatatatatattacatttatattttgctcggagcctccataggagtagttgggtaggtagagtagcaagttgtaaaccagccataatcacatattgagaagaaaagagaagagagagaagaaagcaggctacagatttatagccgactacaacacggactccaaaacattatgtgtgtatgggaggtaggaccgggtattaatggtgtagtatatttttataagtaattattgtataaatgggctattagattagctataaatgatttggagccagtagttggctatactattggacttgctctagtgcttaggggtgaatctgcttaatacttttattttataacggaaataatttacatcttttaatagatctgggcacaccgtttaccaaatctttttttaaaagagaaagagtgttggattgtcttacttttatggaaaaacaacaatgctttcccctaattaatactctctccatctatttttgatagtaatatttcatcttggcacatagaccaaggataagtaattctacttatcattcatttaaatatgctactagtcattcctcgtaaacaagcgattcattaatatttacatttctcaatgtctatgtagtcaatcatgtgtggaagaatgaagagtcatgcattaaatccaagaaagcaattaagatgataatttgttggattgaaatatgcctatcaaaaataaaatttttagatttggaaatatgactatcaaaaatagatggagggagtatttttttagcgagattatcttttgttaatactatacatatgaacataatatataaatataaacataactgtacgtgatatatagtgcgatcacatatatatgcaggtggcagcgagacgggcgggcgaatatcttggccgatcatgagatgagacagcccggtcgatgtcgccgatcgatcgtgtttgtgtgaaagaaacttcacctgaaaactatggcagtatagtagggcgtagcgattgccaattgggcggccaagttacgttacgttgtcagttagcggagaggagcagacggtttgcgcatccatcgtccatcgatcgatcgatgagaggcgtttggaaagaaaaaccagcaaaccgccgtacgtatgtatcaacggacaaccgcgcgcgcggcgggcggtttcgatcacttgccaatatctctggcttctggcgaagcttgcattggctgcttgtgctatattcgatcagccactttcactgtactagtctccatcatctatatattcatcgatccatctgttccaacaaccacttcaattccttcttttctgcttcttttggaatatatacgtacgtcttgctatatattctgcttaattaattgccaccgctatatactctacttgtatatatacttgtatcagagacgatcgatcgagatgcatgcatgcacctgcctgcggtatgctatactagataccaagccaatcgtcgtatgcagatgtcactagctactccatccgtttcacaatgtaagtcactttagcatttttcacatttatattgatgttaatatatatatatatatatatatatatatatatatatatatatatatatatatatatatattcattaacatcaatacgaatgtagaaaatgatagagtgacttatatcgtgaaacagaggaagtagtacagatcctctcatctcaaacagtctgtaacataactaaattttacgggccgtcacagtgagtacatctaaaacatgctaagaaaaggtcgattgagtatatagctgcttgccaccgctatatactctctacttgcatatgtacttgtatcagagacgatcgagatgcatgcacctgtgccttcctgcccatgcggtatgctacggtagataccaataagccaatatcgtcgtatgcagatgtatatactacaccaccgtgcatgtaagtacgtacgtgtagtacctctcattactcttactttttcaccgttcaacggtaaagaagtgccctgatcaaattttactacgagaaagtaaaaaacgatttcaacaaatataattattgagacattgacgtatatgggtagtctaacttatgtaattcttttataaatactctaaatatagcaaagtcatacgtataaattgatcaaatactgactctggtcttgagctcagctattaaagtgtgatgaaaaaatcaaatcagtgaaagttgtatgtcgtaatcttaagtcattggttatgcaactgttcgctaattttggatggagattcacaaatagaattcaataatttttgtgatcttttatgctgtgtgagtttttattagtttgtgtgtacttttgtttattcaggtgtgagtttttgttgagttggtataataattgactgtatctctttcagcaaatgccgggattaaatttcattatctaaaaaataaattgattaaatgtgcatcatagtatattaataaagaagttttttttcttttttttaaaagtttcttttcacatatgtatatatatgcattgcactaggattttttttggtggttcagggtcattgggaccacccctgaatccgcctatgtattgagatgattacaccatacagttatagacaaacatgattttaattacatcatccaagttaaatcatgtatatcggattggcagtcagtattgcactctaaactagcaacaaatatgacatattacctaagttgcccactcgtgacgtacatcattcctccatgtccatggcacctcaagcgacctctattggggcactatccacgcatggttgactgtaaaatagtcgtctggccaagttaggcctcacttgttggggccgctggcttcagcaactcgcgtgttatccattaacacgtttttcgaactgctaataaatgatgtgttttgtataaacttctcatgaataattaaacaaatttatttttaagtttataactaatgctcgattaatcatgcgctaataatttgtttcttttttgaacgcaaactgctatacagtcgtacaaccgatttaaactcagacataaactgggaattaattaactcgaatttaaactgaagatgaataccgcaggtaggaagcgagattaaattaaataatcaccgaaagatatgtatagtacgtaagagtagccaacgaaaccaatcaagcgattgatcgatcgatcgaccgacttgcgctagttcgctgcactttacgtgcgtacgccatatatacgaataattcaccgttaaatgaatcatcaggatatacagatgcaatgcatcgacgatactagtgcccagatgtcacttgttccttgtccacagcgaattcaagactactactagtattcacatgctagctacgagtactttgaactacttacattgacctcacaattcatggagtaataagtaatccctccatcccaatatgtttgacgcagttgactttttaaaaatacttgaccgttcatcttattaaaaaaaatttaagtagttattaattatttttctatcatttgatttattgttaaatatatatacttttatatatacatatagttttacacatttcacaaaagattttaaataagacgaacggttaaacatgtttaaaaaagtcaacggcgttaaacatttagggaaggagggattactagttaagtaacatatccggcctgcgcccgaaaaatatttttttcttccaaatggaccgtccatcgatcgatcggtcggtgcatggagtaatctatacgtcctgcgcatgaaattatggacgtgtcttcttcgccgtattcaactcgtagctgctaccaaaaccatcatgtttaagaccggccggtcaacactctgacggttacctcaaatgaaaaaaaaaaaaaactctctgacggtgcaatattatactggctgcttacatctcaagtccaagtaaagccgtatcgaaactcccatcttaatcaatattattacgtatggaccttttcatactattgacaaggtgcgcgtgatgtatttattatcttgatgatcggatatatttttttcgaatgcgcaaaatcctgatgatcggatagattgtgcactggcataaagcatatcaattacaacttcaccgtgatgccaaattaaaagagatttatattttcatgaaatatataactgaaggtcttcacaattaagtcctcttgatacgacccctcagaacacttactttgtccggctacatttacaacatatttcccatccttcgtattgttcagaaggtgaaacttcagccatatatatccttaccagcactgactattgaatctgaaacaaaaaggtctactgaactttttttttttgtcttggaacagaagaagggcccaattctttactagatgatctgatgatgaaaagaactgtttccatcgatcagcatgccaccgactaattctaagatgcctccagcatcattcgatctggaaagccataaacaaggtgttactcatattatatcacgattcacaaggtttggagaaattagtcctgttttatggtttggacaaattaacacaaaaacttgtcaacatgcacaacaggaagccgatcgaaaccctgtgtcttttcccactaaaaatgtttatcagaaaacccactaggatagataatgcagttttactagcttgcttagtcgtagtgttttgcagcaaacaaatgctatgcaagtcaacaagatggagatcgagcaagaagtacaagagaaacggtgagctctgaaagcaataaatctaaccaaacaacccgtgatcaacagtataagaacaacatggagacctgaaaaatgaggcaaaaacaatcattggccagtgctgaaagccatacaagtcaatccaaattaaaagctgaaggtatatatcattgacacgctaattcaatgtgttagaacaaggaaggatccgatcgacttcattgtttttgttatgaaaatatatgcgtaacgaatatacgaattttacgtggaaaacccttacgggaaaaaaccacgggcgtagaccggcaatgatcactatagatgaattgatacaaacggaggacatattagactacacaccctccccgtgcggcttacaagcgatacatagagatatcgaggagtactagtgggtaaagacttagagtcatactagggaactaatcctaatagttaagttctattagtaaacttatttgaatatattgtggacccaaaatttggatcacatatttaacaatttttgtgataatatggagcaccaatagagttgtatgcagcgaaatagtattaattattattccttactatagtgaaaagtaactaattaattttgttagatacaccaactgtaactaacacatttcaagaatgtgtagtgaattcatgcatatactgagaaacactcagggggtctttcggctagctccacaagatggtgggatagccggtctgggttcgaagtctcaccccttctaattaattgatattaggtcctttcctactatatattcacttttttttaattcatgcatatactgtactggaggtaattctaattgaagtgagcaactaatgcaatactagcattttactgtaaagtgcaaacctgattagaagctaagctagtgagggaagttgttaatgcgcaatctgatgatcgcagcagaaagataagagcacggtatggataagaaaggaaagaaagagagttggtaccgaattgaattccgatgtggtccgtccttgtactccctcctctcctctgcatcgatcgatggatctccctgagcttgtccggcggaggggatgaggatgggccaccaaacttgggccttggtttgcggttagaatggttgggctaatttaggcctggaaagagctgaggtttgtgggtctaaaataattcatgggccaaaacggaaagataatttgtctctatatccaactttagttaaattaatttacacagcaccaacaaccttttcaacttaatttctcatggaattggttgtccttgtctgctgcttggagtgtactccagtccagtatgcaattcaggctcgctaagtgctggacctcgtacatcttttgctttaacaccagcacaccgaaccaaactaatcaaatgatatcacgacgatttgcttcgtaacttcaacaattaatgatctgtgctaattaactacatccacaaaattaagttgtgccttttgaatgcaacagtgtcgcatgcatagacacatacgtactctgccagctgcgtgcaaactgatcgaatgtgtgtgtggaacatactcctccactccactgtagtaatccagtatactccacttagtagcgagggacatatatatcacatgctaattaagcaatgagttagtttgtatagcgctcgatccatatccattcgatcagtctagtacagttaacaattaattaaagagcacgtaaacacgcggaacggaatgatggcttagaagaccaatcgatcgcgacttagtttcggtcatttaatttatggtagctactacgtaccctaaccacctagcaagccatatataccagctaatcttgtatggagtactagctaactctctcagtcatcaccactagtcgatctacaggacagcaactaactgttagaaaacgataaagcgaacaaacgataaaaaacaatagatcaatcacagaagacacaagatttaacgtagaaaacccttttaaaacaggagagaaaaaaaccacgagcgccagccagcaaaatatcttcactatatctggagtgaggttacatcgccgtacgacggcttacaagaggtatatatctggtagaaccctaaaagggatgacgatctg

SEQ ID NO: 86049 - DNA, 1172 bp, Oryza sativa
cacatttatgatgaggatttattgcattataaagagagaagctcagattgtctgctagcggtaccttcaacttcctttaaggctgagtccctttgcgcagccagttctgtcttgtctctctccagggcttcaatttgcttcgccatctgttccatcctggcggcttgcgctgtttgaaattcagatggttgaggatacagttatgccagtttaaaccgatgaaacggatctagggattaccttttgatgaaccactcagctcatagtttgaatcctggagctgagcgattcggtcccttaattccttctccgtcttcttggcgtgctccttggcctcatgtagctggtccctaaccgcttcaagagttcccaaatgaggaaccagcctttctaaagttgcggttttggcctcattgcgaagatggattctctgcatagtggttcacggttaggttctgctaaaaagaaaacaaagttaccgaaggccgtcacccggaggacttacatttacaatacgagtggcttctccgagcgctttcttcagctggcacacttcttcatcttctttttgacggtttatgactataccgccggcttgtgagttctcgtcccaccatttgatcaagataggaggacgagagtcgtcggttgcctttatgcgagggatttcctctccgtcatcacctgatggtcctgatgtgtttccaagacgttagacggataaactgaggttatttaaatcgccattgtttgagaagacaactaacctgaagatgtacctagctgagcgtgaggtgatctttgttctttatttggagacccgattatcgagtcgttaccagcctctggtccttgcgaagtcgtcgtctgcgcttctacttcggggatctcttgatcaggacctgcatccgactgatttccagtcgggggctcttgagttgttgccgtttcagttgttgccgactggtttccagtcggcggcaggtcactcggattggtcctatcgcccgaagtatgggcgccagtcggctggctttcagcagtcggtggttttcagcagtcggctcggggtccttggatatattttgctctgtcatggcaggatcgcggtctttcccagatggatctatatcagatggtttcctgcagagtgttctttcaatattcagcat

SEQ ID NO: 86050 - DNA, 7856 bp, Oryza sativa
ctgccaagtgggcccggccgtcagccgcccgcgcccgcgggtgcggctgacgcgcgggacccacggcgccgaccgccgccagccgcgtgcgcccggtccaccgtggaccgtggggctgacgcgtgggccccactcccgtggacccggtccgcgcgccctctccctcggctgacgcaataaatgagtttttaattgaaaattaaatgaagaaattcgcaaatatccatttaaagagcatataaacttcaaatggccatatcttggccatttgaactcggaattggaccgttcaagtctctaatttttccttaagaagtcaagaacccatttttgtgctttgttcctgcttgttgtatggagtttattagagtaaaagccgtttcttttccgttggtcgtgtagacgctgcagcttcggaagatccgcccttcgtggaagttgaagccggcgtttgggaaagtgagcaaggcaagtcacatcacccttgagcatattgaatcccagtttataaaattatttcgatttaaattattgcattatcgctttgtttaaattcccgcgttatcactgttttatttagccatgcctatttacctttgttatgacattattattgctattgttattattaccttgttcaccctagaataaacaaaaccccaactagtgggtactctattcctggttccactagtatgaatttaggtagatgcttcgctgattaattaggcaacattaggtggttttataactttagactttgggaattctcatatcatttggacactatggaattgttggattatggtggaattggacatacacctctcttcctctttcaaaacccctaaaacctgttttcggtggggtttgggtgcatgccagttatgggaagtagcaccccggccactataaggattaagctcgggcctctgttgcaaagcactaccgtactaaccacatgtctaatgggtaaggcttaactcggtgctcagtctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctgggacccaggtcgggttgccagttcggtccaaaccatcgtaggccttgggttaaggcaggttcgtgagggttcacggccttgtttaataatactgtgtagctctaggatcgtctttacaaaatggctttgggcaactgagtgacttttaaatgctgtttactgcaaaacttaatccctatattattactcccttgtacctccattgcattaattatgcatccgccggtgtggcttgctgagtactgtggttgtactcattcttgctcaatctttcccctcttcagtaagagaagctttgaagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcaggtttgtgtggtgtaccccggcttttcctgggacggggatcaatacactagcgttcgggaaaaggcaattttcccggtcgcgacactaggatcgacggcaactcctcctgctgagatgacgtgaccaaggaactttacttcagacaaccaaaattcacacttgctaaacttggcatacagttgatgttctcgcagcttctccaatgcaaggcaaagatgttcttcatgctcttctttggttcgagagtagataagaatatcatcgataaagactaccacgaacttgtctaggtattccataaacgccttattcatcaagttcatgaagaaagcaggggcattggtaagtccaaaagacataacagtacattcgaacaatccatatctagtggtaaaagctgtcttaggtatatcttcctctttgattctcaactggtgataccctgatcgaagatctatcttggagaaaacggtggcacctttaagctgatcaaacaaatcatcaattctgggtaacggatacttattcttgatagtcacatcgtttagtgcacgatagtccacacacatcctctgggtatgatctttcttttccacaaaaataactcgagctccccatggtgatgaactcggtctgatgtatcctttctgaagcaaatcatctacttgccttttgacttctgccaactcattggctgccattctacaaggtctcttatggatcggagttgttcctggtaccaaatctattctgaactctatatcccttttaggcggcataccaggtaaatcatctggaaacacatcaggatactcccggactataggaatctctttcaaagttatttggtttagtcttgaccttaaagactcagaagacaatgcatgaacagtcacaactcgaccatcattgctggtgagggttacttttctgttagcacagtctatcacacctttatgtctggctaaccagtccatccctaggataacatcaaggtctttggattctaacaagataagattggccagaaatggtactccctgaatttctattcggacagaggggctacgttgcaaagaaagtgcttgattacttggggtactaaccatcaaaggacgtctaagatcttctacttccatcccatgatttcccgcaaaactcatagataagaatgaatgtgtagcaccagaatcgaaaagcactgttgcaggaactgagttaacaaagaacgtacccaaaatcacatttggagcatcttgagcttctgcagcagcaacatgattgacacgggcctttgatgctggtgcggtagagttgctctgggcagggacaaccttcacacgtcggggcttcagacacttgtcagcataatgtcctgggtctccacagttgaagcacactacgggcttactgccttgctccctcttgacaggctgttgctgtgtcgaagcggcaacagggcgtggagcttgattgtggatgttgttgccagcattgttgttgaagaactgacgctgcggacgaacaacagatgaagaacctccctgtggcatggactggggtcctaaagtaagacgcggcttctgattattctcctgttgtgtcttgaattgagcaatccggcgtttcttctgctccatacggttgtatttgtcctcctggcgaatagccttatccaccaacttctggaaatcaggataatccccagtcatgagtgggtaagaaagctcatcattgagtccttccaagaacttctcctgacgctcttcatcagtgcgcacatcttccggagcataacgagccagacgattgaactcgtgcaaatactccgtaacagagcgagatccctgagtgagcgacctgaattccttcttcttgagagacaccactcccgatggtatatgcgtcttccggaaagcagcggtgaattcaagccaagtgataggttcagcagtagtcctattaaggcggaagtgatcccaccattcagaggcagggccatgcaactgatgtgatgcaaatgagaccttttcctgatcggtgcactgaagcaaatccaacttcttctctatggcatgcagccaatcaccagcttcaacaggattagtggtactagagaaaataggcggcctcacacgaagaaattctgctaacttattctgaggaggtgcatggttgttcccttggttgagctggttctgctggttctggagttgctgcatcatcatgttcataagctgtgcctgttgagccaggacttgggcaagtgtgggattctctccattgttgttgttattgttgttgttggggccattcctgttgctgcgagtgagcaccatctggcatgggcaggagcacaagaagagaaaccggggaaaactacttaggacaggggattaatttttcttttattgatcttaagtgagtttcattattacaaaactgaagactctcacaccactaaactcaccaacttcctaacactcagaagcaaacaaacgcatgcacttacatcccaccactgatgtaaattacatgcgagacacacacaaccaaacttaaaacaagcaaactaacacaacgatctaagacaacgactagacatggcactctagttcttccgggcatcggagttgattgaaggctcgttcggctcatcttcatcatcttgagtagctccccactcaatcttggaacgagtgtgcttggattcttcttcatcatcacttatgttgatgaccggaggatccgctagggctggggtaacttctttctccaccacacggacctttggcgccaattggtagcgagggacaaatagagctctcttccttgcggtaagacgaaccctggccttctgcagcggtgcttctcccttcaatgcggctagttccttctccaaacgatccaccttgtcttctagcttgcaaatcttaccacgattccggtcttcacgatcttgagctgctaacacagtctccgcacgactttcatccatagcccatagcatctcaaccaaatgccttgtggtagcatcattctcaattccttcggtcttaaggtagctgccacggtcacttccctggggttggcgaggatgatagcgatactcagtgtcggccaaccgatcactgtagcgatcgcggagctctcctatggcgatccttgccacctcctgacatgcatggatgtagtttctccctccagcttcgaacattactgaggggatatcctcactattactgttcaaggtgactttgactcggcacttctcttcatgtcgatcatgaggaatctgggcataaaaaggggcagtcccaaatccaatgacaaaggacatcgtacgcaactcctggacaaaaccctcaacaccaaacaagtactcaggcttgtagcgcggcatctaaagacaagtgaaaggagggagttaagacatttatccaattaatagcacaagtttttggattaatttgaataaagttagaaaatcaaagtaaaaggtaagtaaataaagtaaaccaagcttgcaagacaagttgaaacagttggaaacaaggtcacaaattttgtgcttttgaataacaggttccaaaagaaataaaagaaagttataaaatcaacatgctaaatttatttaattgcagcaagattaaataaaacaatgttgtagaacttttgctggtaaatgagccattagtacagtaatagatgtacagtactaataacactggaatagattttgaatgagaaccattaaaaaaaagattatgaagtgcatgtgccattagtttggtttaattaaaagagaaagggaggagaacagttctacttttccaatatttttagagggcttctatgggtaaccatttggcataacctagggtcaagggggctctgataccaacttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtaaatagttcctctcaatcaataaagatctaagcagcggaaaataaaataaacggcgcagacggctccactccacaggcaacttgaccagggctacacctaatcctccacaccatcagcatcattgtagaactcttcctctgatgaatgattgcaagatgagtatatgacatactcagcaagccacgcagcaaatatgcaagtgcacaggataacaaaggatggcataatagggtttcatttgcaaaagcagcatttagcaaacatttgagaatttaataaaacagttaagtaataattaaacaatattaatccaacactatacaacataccctgttgtataggcccaaccattctgaacaaccatacccggctgtacagatctatctccaaatcaggaatataccattccaaaccaggagctaaacaaattattaccagttatagtatcttccattatgatgagaggtgtgagactaatcacgaaagacattgttagacccgcccataaccgcgggcacggctattcgaatagttttactctgatcagaggtgtaccactgtacccacaagacacagccccacatcatgtcaccatgtgcctcaattccaccacggtacctcggaaaggagctgtgacaataccccttgcctaacacaatccaccacagcgcacctttcccggatcatagtcacccccttataaacaaggcatggattccccagcgacccccgtgggcttatctccgctacttctcagtctggtgctccgcaatgaaccatgctatacaaaagataaagccgttgcccacgctggcttgtggttggcatggttaatgtttcacaaccgaaactcgtgaaccggtccttaattgtcatgagcacgaccatcaaaaccatgtgctcacaacccaccattatcaggttttagttggcacattaattaattaaccaatcacgattgaccatcgtgaactatcattaagccatcattaaataatagtgaatcataagttatcccaatagtgtgctaatgtttctaagcagggctaagcaatcatatctaatatctagctgaaccaatatatatagcccaactagtcaaattttaataacccaaggtatcaaggaataaagtaatcaagaacaaaagggctatagcaaacaataggttaattccacccaatgacattcgaaaatagatgcaatagttgaatagaaacaacagctttaaataggatcaacatgcttaaagggttatttgggatctgtgtgacttgccttgctggcctaggaactcttcaaattcttctcctgcgaaaacggactctccggaaacgtcggaatctaaacagaaagaagcaaaatcaccaaaacagcacataaacaagcatgaacagtacatgtggatatttttaacatgtagatctcaattttagaaaaatttagagacttgaaccaactaaatcggagctaagatgaattagttatgaatttttgaagatttaatcggattaaaacacttatatggattttaattgaattatgacgcaataatgaattattttggaaaagaaaaaggggatttattgcgtcagcggctagggttacggtggaccgggcgcacggcgatggttcacaggaacggacggccgagattgatcgggtctacggccggaccacgagagacgacgacgatgacgtcagcggcgatgtcacctccggcgacggctcggcggctcgggctcgcatgctcgccggcgaacgacggcgcgaggacgcgaacggagggca

SEQ ID NO: 86051 - DNA, 1887 bp, Oryza sativa
ggcatgcctccgtcgccgccgattggtgtcctcgcctacacggctggcttattatgccgccgctgttgggcgtctaagacttcaccgccggcctgcctccgtcgccgccgagtagtgcctccgcctacacggcttgcctattatgccgccgctgttgggcgtctacgacttcaccgccagcctgcctccgtcgccgccgagtggtgcctccgcctacacggctggcctattatgccaccgctgttgggcatctacgacttcaccactggcctgcctccgtcgccgccgattggtgcctccgcctacacggctggcctattatgccgccgctgttgggcgtctacgacttcaccgccggcttgcctccgtcgccgccgagtggtgcctccgcctacacggctggcctattatgccgccgttgttggacgtctacatcctcaccgttggctcaccttcgctgccgtcgactggtgtttccgcttacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagataagataatttattttctgctcttaataattgcaaaagtacccgagtagtaaactccgatccgtgaaactttgttccattaatgacgaactcatatcacccatatgcatgtttgggaaatgcctaggccgactcccgatgcttggggactatgactagtcgggcagagtgtttaaacgtacagagtcatctgctcggggaaatcaaaattgacaagaggagaaatacatatttataaatattttaaaatacttgattttttctcgagtattatatttatatcagatactactcatcctatatgattgttctgcaggatccagatccagatatgcataaaagggattcatggctttaagcttatctcttacgctccaggaatggatcagtcagaacatcaccgaccggcttgcctccgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggccgcctcgaccgccgccgactggtgttcccgcctgcacggctggcctattatgctgccgttgttgggcgtctacatcttcaccgaccggccgcctcgtccgccgccgactgatgtttccgcctgcacggctggcctttatgccgccgctgttgggcgtctacgtcttcaccgaccggcttgccttcgccgccgccgactggtgtttccgcctgcacggctggcctattgtgccgccgctgttgggcgtctacgtcttcaccgaccggccgcctcgtccgccgccgactggtgtttccgcctgcacggctggcctttatgccgccgctgttgggcgtctacgt

SEQ ID NO: 86052 - DNA, 3299 bp, Oryza sativa
cttgcagccactgcaaaggaatgataacagggatgccaattgcatgagcctactgcccaagtgtggagatgattgtgtttggcaggcccccctgattgtcagttttggtgtttggtgcatccgccagattctgaacctgtgccttgtcgaaagtaggccagaactttggggcaagtatacatatgttcttaatcgtctccaggtatttttttttctattgctgtctattttgggcaaactgcaatatggagggtaacccagggatgcagatcatcaatggttgcttcctgcatgtagcatacatactatataggctattttggcattgttgtgaattatgcttcctacatatagcatacaaactagtactatataggctattttggtattgttgtggattacgataatctttattcgtatgatggctttaagatatttcggttttttattacctgtttttgcctaaatcaaattgacaaagatatatttcagtaaaaaagagagagagattgatttcccaataatagtagaagtggatggatatgggagaacggcaacagcttgataaccaaatttgacactctctctgatttttcaatggattgtgaaaatactccatatagcaatcctattttccataggaactttaaaaataagcactgtcagcacacataacaactgcaaactaaccatatacttgctatggtggctgggaatatttcgtgatgtatgaaagtatgaaacactgcaatagatggcattcatttatataaatttaaaatatagttgtttgcagagaactttgttttgtatgactactatcattttcttcgcctgtagatgaatcctgcaacttgtaagtgcattttgtcctactctgtgcttttaaccataagataaaccttaatcagaaatcccaactactgatttccttcagaagtgcataaaaacttgtgagtgggttcggttgcattgagaaattgacttctaatgcgacttgcatgcagcagaactgcccaaacttctgccacactgtttggacttcaagtttgctaattttctttttcatttacttgctagggaatacttgatcctgcattttccaagcctcagaaacccatgaaaggatgcgtatgccttcaaaaagttgccaagcccatctctggtactttcaccactgctggtatgatcttggagatgattaaagacgtggaacaagccatttctagccgcaagggccgaagcggcacagcagcaggagacgttgcttttcccaaagggaaggagaacctagcttctgtccttaagcgatacaagcgtaggctctcgaacaagacatctgcaggacaatagcgtggcagcgagctttcttttgtttcttgtttgtatagggttcttggggctgctccacaaagttctgtttttttgtgctcctcaaaccttgggttttttcgatgcacacgatctccagagtgcctgagagcttcttgatctttggtcatttttgcacatgttgtttatgaagtggccaagggtgaatggtataccttgtttattcatcttatcagcgagatctcaacagtagatgatatttgctggagcagcaacattgtaaagttctttttccagatgaacattctgaagtccgctggcttggctttctgaaatctccactagactcgttgttcctttcggctttcgctgttaggttgttactgagaattttctgttggtcagctaagcttgagttctggtccttctggactagacacagtggcacacgatgcagcggatacccatgtgcacggcttatgtccacttgtctgatgttaatttttcatcgtgcttgcttgttactgtagttgttactgccttactggtatcatccaggagtcatattttcgttgtttgcatctctataaccttttccagggaaatgcattgttgcagtctttctgaacatatacttgatgaattcttgagtttccatgtactacgatttattgactgtaattggatggatcctgatcagctaggaaaagctcaggatcagcagagagtacagtggacggttcactgtacagtacacacgatctatctcgctttcgacaggcaggattggtcagggtccataaaattcaggcttctgtgcagctgagctatagtgtcttggacaagggcccccacatttgcatcattgcacgtgccacaatcaatacccccaggctttgctaaagatgctttcaaggatgcaccaacttgggggcgaagatacacggtcatgtacgctggcgatttttgcacgtcgcacgcaccgaccggtagaagatgcaaggataggaccaaagatcatcggaattgtgaaccgttgttgcaacttttctgaattacccggtaaaggttgtaaaaaaaagctacttttgattatgtttccacaaatacaaattgtattttgtgtacaactattgcttatgctttcataattacagttttatattttatacgcgactatatttattaatcttcaccattataacctagatccatagtgatggaacattttttttctttaattaatatggttttttctcacataatataataaatagaccgtcgcaccaaataaatatactttttatgtgaattgagtgtagcttaaccggttaaacttctagttctacccttgacacatgtatttatatttacggttaattattcattcaatgatagataacatacccgtcagtagtgagccgtctatggcgactttgtgaatcttaaaatatatcggtacaatcttcgaaattgctcatagggatagggtgcgtatgtacactttcacaaggatgagctgcgcgtatatgggtgtttgcatctgtactgtgttttttttaaaaaaaaacttttaatcaagggttaattagatccatgccactgcaaatgtggcaaatcaaaaaaatgccacacatattcgcattatcggctggatgccacttcaaatttttaaaattgaaaccatgccactcccgtccctttttatgtctcctctcaaacgccgtccccgtttccgtctccctcttcgttctcccttcttctgcccggcgtcgagcacggcaaggtcggcggcggcggcacagcaaggacggtggcggcggtgcccgtccatctcgcctctctcccgctgtccatcttctcctccctcccgccgtccatctccatcaccgcgctcccggcgctcctggaggtgtccctcgacgacctcccccccgacgcgtatcctcaccgtcatccgccacgcg

SEQ ID NO: 86053 - DNA, 692 bp, Oryza sativa
ttggacaagaatgaccgatttgtgaccggtctgacactgctcatgtcgtcagcacacagccaccttcccacgacgtgcccgcctcaggcagaagtggaggtaggtatgtgccgtcccgtcaggaggatgttcggaggacgaccgtgcaaatctccgtccatttatgaaaagaagaaaagtccagtttggaaagggaggggtgcatgtggtatccccttgaagtataaaaggaggaccttgcccatagagaaaggggttggttgattctttccagattcagagcctagaacgagggagaggtcggctcacactttgtagctcctccatacacagatccaccaaaacacaggagtagggtattacgcttcttagcggcccgaacctgtatacatcgcttgtgtttcatgttctcttgagaggtggcgatctttccgtcatctacagggagagcttgagatctcaccctgagcccccggccgaaccggcaaaggggggcctgtgcggtcttccggtgaggggccacgagctccgtcatctggcgcgccaggtagggggctcagcgagtgttttctgagctctcgcactttttcgggtgcgtcaagtttttcttgatcagcctcatggctgagcaagcaaaaggcacccgacctttcttccagtgtgagtggcgacgacggggagccgaattcacg

SEQ ID NO: 86054 - DNA, 693 bp, Oryza sativa
gggttatactgaagcatttctgcaagaaattattcacaatattatcacctcacatcttgttgaaaatttgaacacaatttacaaaatcaagagaagttgggcacaatttaaaaccaaccaaaatcatacataaaagattcctttgaagctattaaattagggagaacttcaaattatcttacagcctaaataatttcgaatagtgacaaaatggaaaaccagtatagatcagttttcttaccgataaaaggtcaactccttcaggctccaatgatgggacttgacgttctaaaatctgtggcttccactgtggaaactcatgccagtccctcaaatcagttactccaggccactgctcctcagtaggagttcccaacaacctattaagaagtcggttttagtcaatggcttaatgcataatactccctgaataaattaccataaggtatacaggctgaggcaaactatcacacactatacagaaagtagtttatgaaattctagcatggcaatttttcatcacacagctatatgttcagactatgtcaaacatggatttatgaaaaaaaatcatcatctacagcaataactaccgattatcaaattattaaaccattgtcttagcagataagcaatgtaactcatattatgataactgcacttcttgctaatcatgaaaggcagaaggaagaa

SEQ ID NO: 86055 - DNA, 1132 bp, Oryza sativa
tacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaatacacggcct

SEQ ID NO: 86056 - DNA, 7595 bp, Oryza sativa
cccccccccccacacacacccccttccaccgccgccaccgccgccgaatctagggttcatcggggattcgggatcgatggagaagtacgagaagctggagaaggtgggggaagggacgtacgggaaggtgtacaaggcgcaggacagggcgacggggcagctggtggcgctgaagaagacgaggctggagatggacgaggaggggatcccgcccaccgcgctgcgcgagatctccatcctcaggctgctctcccagtcgctctacgtcgtccgcctcctctccgtcgagcaggccaccaagaacggcaagcccgtcctctacctcgtcttcgagttcctcgacaccgacctcaagaagttcgtcgacgcctaccgcaagggccccaaccctcgccccctccccaccaacgtcatcaaggtacacctcttgcctgattatcccgtgtcttctccgcttctgggttggttgcctaggtgaaaatcggttgcagcaaccatgttagtgaaaatgaatgaaacactagatgtatgagttttcaaatgacattattgatttttcagtttttttttcactattcagaggcaaatactgggccatggaagtgtggatcaaattaaatacgaaatggaaaaaaaaattaacaatccttatagttcctatgtctctctttttttatatatataatctctgattgttggaggtttttcctttgattattgtgagaccttttacaaacaaagatagatgatgcacgaccgactaatcggttagtggtttcatattctgtcaagttgcacattgctctaattgcatagaattcacaattgttgcacgttaattatgcatacaacaacagtgatccaagttagttctctacaaattttatatggcaatgaaaagaaatgacttcttttttttttcaattccctgcagagcttcttgtatcagttatgcaaaggagtcgcacattgccatggccatggtgtccttcaccggttggactctgttctctccctgtgatttatgttgctgggcttatcagccccatacagcattgcagttgttgataacatggtttatacttattcctgctcaattttgtagtgatttaaagccacaaaacctgttggtcgacaaggaaaaggggatattgaaaattgctgatcttgggctaggtagggcgttcactgttcctatgaaaagctacacacatgaggtaatgtttacacatctcatctgggctaatttctgaacatgctctagcaatttccttatatgtctgttttgtgttgcagattgtgactctttggtacagagctcctgaagttttgcttggatcaacacattactcaaccggtgttgacatttggtccgttggttgcatcttcggtatgctccttttgatctttgttacggctttgtgggggcacttcattcttatatttgaaaaaccaaaagcacaacctggatacaacttttaaacaaacgcactagcagattcatggtcacctgtttatatcaacctttaaacaaaggagaggtagatgtgcaccagcagttctaaagtttttcgtgtatgtgttatcaaggattctttagttttgaatgtgtgtgtatatttgagctccaatttttcatcgctgtcatgatctttgaatttctggctgactaagcagcatatatcatacttttgcttcaagtttttcccttgctttcagtacaaaaaacatactgcctcctcattttgattctcgtactgttctatacagctgaaatggtcagaagacaagctctttttccaggtgactctgagttgcaacagttgcttcacattttcaggtctttcttccttctgcctttcatgattagcaagaagtgcagttatcataatatgagttacattgcttatctgctaagacaatggtttaataatttgataatcggtagttattgctgtagatgatgattttttttcataaatccatgtttgacatagtctgaacatatagctgtgtgatgaaaaattgccatgctagaatttcataaactactttctgtatagtgtgtgatagtttgcctcagcctgtataccttatggtaatttattcagggagtattatgcattaagccattgactaaaaccgacttcttaataggttgttgggaactcctactgaggagcagtggcctggagtaactgatttgagggactggcatgagtttccacagtggaagccacagattttagaacgtcaagtcccatcattggagcctgaaggagttgaccttttatcggtaagaaaactgatctatactggttttccattttgtcactattcgaaattatttaggctgtaagataatttgaagttctccctaatttaatagcttcaaaggaatcttttatgtatgattttggttggttttaaattgtgcccaacttctcttgatttgctaaattgtgttcaatttttcaacaagatgtgaggtgataatattgtgaataatttcttgcagaaaatgctccagtataacccagcaaatcggatctcagcaaaggctgctatggaacacccctacttcgacagcctcgacaagtcccagttctagtttgtaccatgtgattgacgaagtccatgttctgttgtgtcatttgattataaacgtgttgctgttagcagcaaggaaattcgttttgcctacttagcaccctactttgtgatccaacaaggaaatccgtttgccatctaggcaacttgaatacagtttgaatgtaaaatgggtttgtttctatgctgtatggcatatgtattatggacaagaaggttgcaatatatttgcctgtttctttgacgaagtattgccaagcattagtttccacctttacacttgcaatgattttattagtcgttgtttagtagattatcaaattcattcatgtgctctgaggggcgatttgcttatatgttaaaaatcttttttgtgctctaaaaagatgaagccatggtccaatatttgtcaccgtaattagctgggatgctgaaaatgatgaagatgattgattaagtttgaaactcatgaaaataaagattaagttggtgcacataaagcgagaaaactattagtacatgattaattaagttttaattattataaacttaacaaattggtatatttgatattttaaagcaactttcatatagaaattttttcacaaaacgcaccgtttagtagtttgaagagcgtgcttatggaaatcgaggtaaaatcttaatcttgagaaaaaaaacatcaattgactttcaattcaactttagtgagatcaagcatatactattagtttacgttttttgagcgtgtactacttttccgttccaaaatatagatattttttaggttaacacggttattaagaaattagtatgtgataattattaaagaaaatgtgtgattaattgaaaagagaacgtatgtgaaagagaatagatgtgattagttgagaggaagacgtaggaaaaaaaattgcttcattttaagacaagacactgtattataaataaattttttttggataaactattgtgctagaaataataccgaggtaataggaaactcatttgcgagtgagtatgacattatgtgtcatgcacacaggtcgtccactcgtccaacttggtcaaggaaaatcaaatccttcgtcaggactcaggacccacctgtcagtgacggcgcgcgcccgcgagtcacggcgtcggtccgccacttctcgcgtgtgtgccggggcccgactataaagtggccccgtggtcccagtcgacttggagtcgaagccttctcagaatcacatccagaacattctagatccttccagaagcacgcgagagaggggaggagagagagagcagtgggggagaagagaaccatggagagcgcggggagcgggtccggccacgcggcgacgccggtgaggtacgtcgccctcccgccaccgcggggcgtccgcgacggcggcggctggaacgtcctcgtgccggagtccatggcctccgagtggacggtggcgcacgtccgcggggtggttcgggtggcgtcgagaggcggcggcgccccggaggtttccgtcgacatggccgcgctgcaggccgcgctgaacggccgccgccgcggcgacgacgaccccgacctccatctccgcccggagcggggcgggggccgggacgcgctgacgccggtgaggtacgtggccctcctgctaccacgaggcgtccgtgacggcggctggaacatcctcgtgccggaggccatggcctccgagtggacggtggtgcacgtccccgcggcagctggcgtggttcgggtggcgtcgagaggtggcggcgcaccggaggtgtccgttaacatggccgcgctgcaggccgcgctgaacggtccccgccgcggcgatgaccccgaccacctccatctccgctcgggccacagcggtgtgggaggaggtgttgcggagcggggcggcggtggcggcgccggcgggccgtgctacgtccctgtggtgttcgtcctcaacaccagcaaggaggccgagaaaaaggaggtaaagtattctctctgccctttccgtgccatttgcttcacgaaacatggagcggatgccgcagcagcagcgccgcggcgaatttgcggcggtggtaccgtggtagcggtagaactccatagggttgtcgccttgtcggatactcggatctcgcttgctggggaagggcaatgctccaggcgagcagcggcccaaagtttggtttgccaaaattatcgatgccgtgatgggatgagttgttgattgttgtcagttctagtggtgtgctagtttttccgatgatgtgtcgctgtcgctgtagtatttcgtcgccgcatggatcgttccatgtacatgtgtggattcattgttttacttcaccttacttgatataaaatagtagagaaatgcacatagttatttttagtcaattatttttgttgacgtacaggttgattcagctgaaggttattgaaaaataatgttctgattgcttagtaattgaacttgcgtgtcactactcaccagtatccacatatcgttaaattcattttacctaatgcaaaattttgtggagaacacctcagtatattatacttcagttagctttatcactgtgaatctgtgtgagggttcctaatgctttgtgtatgcgtgtggtactggtagactggtagtacctgaagctgttggattggacgtggacatgttataaaagtaactgtgctaagctggtgcttatgcagtttcaataaatttggactaggacattgatgtgcgtatctatgcattgttcacctaaagaaatgaacatatataagttacctattattattgattccgttattgcctacgtatgttattgtttgttttgtctaagtacactggataataaaacttcacataagcatgctaattatgtatgttattgtttatataacttgtacgttttgtgggcactgaaggtagagtctcaactgtgattctaaagaaacaatggatggctaattattagtttgttttactcaagtaaataggtgagcttaattagatatcgttgttgtgtgattagcaactttgattctttgaacgactgtgcatgctatctttgcttggtgacacgcagatgcaactgtggatagatcgagtagttggaacacagacatgcatctgtaatcagttaactcttcatcctttaacctctaacttctgaagttgtcttctgccctctagctgtgttcatgtttgcgttacagtaataaaatggtgaactgacagtgatcacaacagctattctgttcagccgttttgtttactgagtgttgaagtgtagtctgatgtacactatggcattcattggatgtctctttttttagtacttttgaaaactatgccacaagcccacaactaaatacttccttttgtttctgtgctttcaaccagcaccaagcacgcatgatcagtctgctcatgttgtcaacctttgctgtctacctcctctacgctatgcagcacatctccaaggatacgttcctcacagtggaattgcttcagtttgtgggccacattgttatgtgggctgtggtgagttattgtctcacttctaatcattgacccttaatttttgtcattgtactatcctactaagttgcaccaacaattcacaacaggcctcaagagttgctcgaagcacaaacagaagtgagcctcgtcttgtgccaaggtaactcaatcacatcatcttatattcttatgggtatttcaatttgttgctgctccgtgctcctccaagtagctctatttagccccttgacgctatattcttacccagcctggcattacagttctagtcaaaatgtgttctttctgaactgtgtaatatatccgtccttatgtctggtcacttactcactcactcacttgatgttgtatcttccaggtcttttattactgtgaccaagaagaacgcgtgagagagacaatcagtgtgctctctagtctctaccccttcgtcagatgttcaagatgttgggagtttttgctacctcgaggcgatactgtcctctgatgtcgcttctattcgttggtttctacttagtagttagattggcaatggaagttgttctgctctcttacccatatctgtgaattgtggatgtcttaccgctgcatatgtagcaatacggcagaaatgatcacgagtttgcgacagtttgcttcacatttgcatgagtatattagaggattagtactttcaaggtgttgccggtagtgttggcgttctcatgaactcatgcttggatctacatgaaattttgatatgcctgcattgttcctaaactgattcctgcaagccgctgctcccataaggccgtaactcgcttctagttgcaatacccgcatatattttagattatatattatcttagtttgcatgtttatgtattaacccattaactttgactaaaatctgcgtctgaaatgttgctgcgaaatggctgtcgtttaaattagtccatgaagagctaccaccaagtgagattctctcgctttggcttacttagtaaaccaatttgagatagatttggagcatccgaggcagtaatatgtgaaatttgagatagatttggaggcggtgtgcattgttagctattacaaaccagttgtaaagactcttaaaactggagcatctaagacaggagtgtgtgaaaaaaaaattgattgaagagtttttctcatgctggactgtaaagactcttaaaactggaaaatctgagacaggaatgtgagattaaaaaaatttgattgaagagtttttctcacgctggacggtcaacaaaaatgtgtgaatacttttgattgaatagttttgactcatgctggacgatgaacattagttaattaagagttgttggttcgtatactgccaaaatctcttcatatagaactatatgtcaaaatctatcaaaacaagcatctatatgcttcgcaatatcatcaacataatggatgagcaagcaagca

SEQ ID NO: 86057 - DNA, 4375 bp, Oryza sativa
aggcccagaccagcaagccttctggatggcttgcgggctgggacatcagcgccagccataatggcgctgaccgtgggacactcagcgccagcccacctggcactgaggtgggacttggccgcaacccccaaggcccagaccagcaagcctgctggatggcttgcgggctgggacctcagcgccagccataatggcgctgaccgtgggacactcagcgccagcacacctggcgctgaggtgggacttggccgcaacccccaaggcccagaccagcaagcctgctggatggcttgcgggctgggacctcagcgccagccataatggcgctgaccgtgggacactcagcgccagcccacctggcgctgaggtgggacttggccgccgtttcggccgtggcccagcccagcaagccttctggatggctgggctgggacctgcgctgagctgagtttggacatgtcagcgccatttagcatggcgctgacgtcccagccctgctaaactttagcaaaactttgcacacaacagaggcaaacatcaaatcacagaaatttacaggcagtaatatatccagagaaccatacaaaacatacatccatccatcaatcccaacatcattccatacatccatagaatgcatcaatacatccatatatgaagtccatatatataagaaataaaaacatcccatcgatcctcgtctatacatccagtcgagtccatacatccagtccatacatccatcgaaccatgcatcaagtccatccatctatccatccatccattgaaccatgcactcacctcctcctacctctagtgcgaggacgaggcacgtcgggggtgtacctccagtcctgcgaaggagcccgccggcgtcgtggtcgagacgggccgggctgcgagatatccggctgtgacgactctggtgcgtcctctagctgcgagggtccgagctcatccgcctcctcttctctgtcctcatccccttcttcctcctcatctccttcctccgcctctttgtcttgctcgccctcctcgtcacccacctccccttcttcatccccctcttggtgggcatgagcatgttcgaccacatcagtcgacctgcagccgagccttgctgccaacttccgacatcgctgccgtagtctctgcataaaaaataatccatgttaagttatcgcttttggaagaaaacaccgtagtttcatctctttccaacgattacctgtagggcgttgcggagggtgccgccctctccttcggagccaggagccgtgcctagcgccactcccgcgtcgttgacggtccgcaagagctctcgagcctgtaggattgaaatgaagtaagtcacaacatatatggcattgaaatgaaataatatacaacattaatgctagaaactaaccactctgtcgcgaacaggtcccgtctcgaccgtggtacctagacgggtacgagtatcgtactcgttctgctcctcaacatcctcggggtcatccgctatgtcggctagtgtccaagccggacgtaggacaagacggtaggtcctgtggagccacgccaagtacaagtcgaactccgtcccgttgtgctgaccctggtctggtactccattctcctcgaacttctcccattgcgtgatatgatcctgatggtagtaagcccaatcagtcaccttcttgttcttccgacggtccaccctgcacgtatgcaaaatgtccaactcaaatatgtagtaaatgttgaagtgactgattgggcaagcaaaataaattgttaagtgaaattactaacttgtgtaggtcgatactcgtggagaaacggtgcgggattgtttgaagcctcccgaattgccgcatcacgcggtgccacatctggaactccactgcatagaagcagatcagtgggcaccgtaaggtcttcaacgcatcctctatatggcacatgggattcagttctagctcgagcacttcctgtgcctgatatggcatccacaccacctgcagcaacaaaaataaaacacattgaagcacatttagtactatatagtaagaaaccatcttcatgtgtgatagaaccccgaatagcttacatgttctggctgtaggtagtccatctcgtttgtgtagtggtagtacgccaaattcctgcggcctactactggagatgggaccgattcccacaggtgagctacagtgggacgtcggtctgcatcctggtgcggccaagcctgatgggtcctccacatgggccgaccaactggaagcctcatccacatccaaacctgcgtcacatacgttagcttccaacatgttagcaagaaattgaaatgttatgaaacataacatgcgtgaacttacctgtagcaaccaaacacagcctgctaggttcgcgtccccgccttgccttcggcaagcatcacagagttgccggtacaaccaggctagggcagccgacccccagctgaaggtacccgcctcgtcccagtccgcgagcaacggcagccacatccaagaagccatgtttccaccagagtcagggaacagaatacttccgaagatgtacagcacgtacgccctgcagtatcgctgtactatagcctcgtctgcctcagcgggacactgaccgaagttggctcgcaaccaactcaaaggaacccctgatgtcttcgtctgcctctgaccatcaggtgccactggaggctccagaccaaggtactcctcgaccctctccctccagttccccgacgctgtgtcacctgtaaccggaaattaaatggaatcattagtaattgcaaaaaaattaacaaatgaatacgaagactcgttagtaattccctgacgctgtgtcacctgtgaccgcctgaccccggataggaagacccaggatcatggcgacgtcctccagagtgaccgtcagctccccgcacggtaggtggaaggtgtgtgtctctggacgccaccggtccactagggccgtcagagcagcggcgttgtacagaggcaccggtcgctgcgccatggtcacgaacgccaagagcttcgcccgccgtaggtacgggacgtaccggtcgtcgaacagtatgtgcgccgtgtgacctctgactcgaagggtcttcaagcgctgcatcaatagacaaacataataacataaagttagcgacaatatatcatatacaagggttgtggaaaatacatcatgcaactaggaactttaattttgggattgagcaagaaaactgaaaagaagatctatgtgtttacatgctctgctttgaggctcctgaactttgatttgagatatctctatgatggatgatctatctatacaaactaaaatcaaagaagaaaaaataaattcgatcataaaaaaaatggaatattgttgatgctaacctctccgctggcaatctgtggggcccggtgcttctcctcgtagaaatcctccaaccccggaaagtgctccatcctgcaaatgaaaatggaatcattagtaattgaaaaaatattaaatggaaaaatcacaatgagaacggaaaggaggacaacagaaagtaaacattgatgcaacaatatgaacttagcaaatgaatgtcatccaatcccacctgtgtgctaccctcaccacctccccccgtcctacggcgctttttcggtcgatccttagacttgtctcgcttcgggcacctagttttcttatggcctagttcgtggcatagcgagcatctattttgcatgactggctctgaatttgtattgttcggcttttgtgaccgtcggttggctgagcctttgtatgctttgtccatatcgttcttgaaccttcttgtccttcttcttcctcgtgtgttgttctttaacgacaagtcgggcacgaagaactctccatcataacttggccactgcgatggatctaggtaaggttcaaacctaggggagtacgagtcctgcacagccttattggaagcttcataacacattcggggggccacctccacatccaaacctcgcaacttacaaacggttatcatgtgggagcatggcaagtgatggagctgagggaactgacaactacatgtgttatctctcgcaaccacgacgtagtgacgtccaccccattgaaccccagccgccgtgactccgccttgctcgctgacctcatacttcatcgaagggaaatcaaaacatgctgctctttgccccaaggttcgtctttgctgctcctccaaaatgtccttaacttttgtgggccacttctttccacacaggatatctacagttgcctctttgtgtctatcgacaaaccaactattgcacttcgaaaatgtgtatgccccaatagctgtaaccggcagtttccgaatgcctctcaa

SEQ ID NO: 86058 - DNA, 2936 bp, Oryza sativa
ctcgtgatcgggctcagtatcggcgctcatcaagcatcgcgactggatcgacctttgtgccttgtgctctggcagcggatgcaggtggaactgcaattatccattcaggctgccggtatgctgtcacggagcattcccatcaagaaaggagggaaaaacttcctaacatcgtggaaatcggaaggaatcgattcatgtttaaataaaacgagaagaaggattggaaaggatacttttcccgacgatcaattcacacatcgtttccttctgaacaaaggtagatccccggcggcggcggggaagctgcccgtagtggcgcttttgatagccgtcccgtcgctccgacgactgggccccggacgagaatctatctgttgggccttgctgttcatgatggaggcccaaccagtccgagttgggacacggaccgaacgtttgggcctaaaacttactcctatctgggccaaatctgccgttctaccgttagtttacggcctggtatatggtactagagcagaacaaggtcgcctcattgatcgagagatacgtacatctgcatgtagcgtagaccgtagagtctcgaggtactactagcttgtcctggccggtcggacacgaggcagttggaagcgaggatgcagccagccggccggccggcaaggaggaggagctaggcacatgctcttgccatgcatggcgcccgcctatgccaactctgctagtcccaagtctcatcggccaatgcacaaactacaaggctaacctagcagcaggtggtgtacccaggtgtactgtactggcgaggagtagaaccccaactactggaggagtacacgggtaacacggcgcacagaatgcaagcgaccaaaagacaagcgtaccgtactgcaagctacagctagccgaggacgcctgtgtggctgtgttcatttctgaatcttttttttttagatggtcaggacactctctttctgtcacggtgtcagccgtcgctgaatttgatggagaggagggtactcctactgcagaaagaaaattggatgtgcgtggtggtacagggctctgctccatgccatgtagaacggtagggcagcatatgcatggtttatgatctgatgagtctgcctggccattggccatgctttgctgcggccgctctgaaccacgtaggcgccctgcgtacgtgtcgtgtactcgtgtcgcgtgactcgcgtcccggcatgcgttacagtaaccagtatgtacgtccgtacggccgcactacttctgattggaatttggtttcacttaaaattgtggcgccttggccacagtacaaccaagtgagtgcagccttccaggcagtcccagctcgatctgaatgtatgtgtgtgtactcagacaaacaacagctagctagctgtatgggtatggcgctcatcgtgccgtcgtgatgactcacgcgagccaaagagtgagctgtaagtagcctgtaatcgagcatatgtatgggcacagtacctgcacttcgttcagctttgtgccttcatgttttttgaacagccatcagtactcggagcacaaaacgtcgatccatatccactaactgcatgattagcaagtgagcttaatattagcacaaaactgttgccgttacagtaagcaggaatcaaacaggcgatgcctcgctggaaggcctcataggcagatagatggagtaggcagtgcacaagcagacgaaacaggagtccatcaaatcagcgtgacaatagatgaagccaaggcacgcatatgcatgcccaatcccatgccaaggccaagctagatgcggacgggggacgggatcagactcggagcgcagcgcctgacgcagcacacggattcctcccgtgccgcgtctccccgtgcaagcggacaaccactacaactgcaaggggctctcccatcttttcggcggcagcagcagaaaagttcctgtacttgcatcgcctgcacccgagggtgccgggctccgattcgacggaagaacctggccgcgctgcacatgagcaccctcccggcctcccctccctgcgactgcgtgccagcacagcagattaacacagctgtaaagctcatctctctactgtccgcattgtctcgttgcaattcttaatagtgcgcgtgtagcgtcaactgggtgtactagtactctactagtagtacgactgtacgagccaagaccttgttaagagtattcttctgcgtggcgcctagtacacgagagacagagaagagagccaaaacccaagctatctggggacaggagccaagatcccggcattaccagacatgaacaaaacagagctgtgcaaagtcgatgtcctcttgttctttgagatcaccctaaccaaagcattaagcgggcaaaaaacagcgagcgagcgagctcgtcgtcctcccgctccgcacgtcgtgctcggccgcagcgggcagcgagacagcgattcagggatttcgggggagctgcccggctgatgagtgctttagggggtgtttagatggggctaaaactttttagtccgtgtcacatcgaatgtttgacgctaatttggagtattaaacatagactaataaaaaaactaatttcataaatgaaagctaatctgcgagacgaattttttaagcctaattaatccataattatgaaaagtttactgtagcatcacattgtcaaatcatggtgtaattaggcttaaaagattcgtctcgtgaattagtccaaggttatagaataggttttataattagtgtatatttaatactctaaattagtgtataaacatccgatgtgacataagtccctgttttccaaacatgcccttaggttgctctgctccccgcccggccagccgatgaccgaatcgcgagtgtacggaacaatttatcgcggaagctggaagcacgggtgcgagtgt

SEQ ID NO: 86059 - DNA, 3756 bp, Oryza sativa
gaagccctgctccatgaaccattcagaagtgcagatatctttcactgactcacctgacacaaacactgaagagagggacatcatggtagacacattcagcagcatggacaaaggcaaggaaaacaactacgtgatggctggcaagaacagattgttatcagaagaagcactatcgcgttcttcggatgctcggtctgcaggaagcagcaagggatacaactctgaagttgacatctacgtggacgctctcaccacaatggattctgaggttgagacagacacagagcacagagatcatggacaccgtgccttggtaccggtggagtccagcaaaccgtgctctgatgttcacggtgccgcggtttcagggtctattagcttcaggaacaatggctcaatggtgcctaactcttcagatgttgtcccagcagaggaagaaaataatgatcaccatcaagggtatgtctgtgtcccttcaccacaggccaaacctgttgctggtgaacatgagaggagcagctcgttggaggaattgtttgcacaagaaaaaccggtgtcatgcgagcatgagaggaccagttctttggaggaattgctccttggagatgtccatccttctgggcataacatgagatcatcagctactgaatcaaatacaaatggtgttgtcagtactgttgaatcaaatggtacagttggcactacaaagaaagaaaaggataaccccatcattgcaggcatttccttcaagaagacagcgagcaagaaatcaaagtatgtgggcagcatggagcttattgtttcaaaagtgggcattttgccgagaaaactctccaaaaagcatgatccgttctctgattccctcagaaacatggccaagcagttgcttgagctgaagattgatggcaccaaagacactgagttatatgaatttgaagcaaatggtgagggatgtgatatgaagtgtctggaaatgtctcaccctcctattgaaattatggggagtgccacgcaaagcgttcctcctgattcacctcaagacaacgttgattcaagagcatgtcgaccagaagaagtgaaccaagagtatgaccatgatgttccaccaagtgatagtccccaagattcagttgatggaaatgtatttcgggacattgcattgttacgttctcaagaggaacaccaatgtgcaggtcctgtaactgttgacaatttgttggatcatgcacccgaaaatactcaagatcagattggggaacatttttatagggaagtgactgaagatattcatactgaagttgtccctgaaaatggccctgatataggcgaagaattagaagaaggcagtattactgaagagaaggtgaacgaggaagatgtcgaggaaagcaatgagtccgatgcatacacattggatgaaaacaccgagtacatagaagagcaagtggtttcagatgatttgatctcctcaccgatctcatccaagcaatctgatgatccttgtcagatggcaccactcactcttacagatgcagatgatgccttggcaggtaaaaatgtagacaatgacatctctgaaatgcatatcacattgtcaggaacaataacagaatccaatgtatctacagtggttgttgaatcagcaacaaccaatgatgtggccgtccaatataatgaacaatgctgtttacatccagaaaccagttttgcacaagatttaactcatgtcagcagctgtgaagttgaaggacaaaatgagccattaccactgtgcagctcatccatggtgggtacaactccagatctgtctgtagacactgaagaaatacatgaaaaccccattttgtgcattgacagcagttctgatttgttcagagatgcactagctccagactctagagatgtgccattaccaaacatctcaagttttgattggatgcttaatggtgcaatgcagaagtcgttgaatgtacttcctgctaaaccacctaatggaattttacaggaaaataattcttccaaagatactgaagatgcaccaccgccactaccacctctcccgccaatgcaatggagaacaacaaaacttcagccagggcctgcagttttatctgcaaaatttgggagaccaccaagaccaaaacctccagttaagtaccaggaaaatgagagttactcctcacaggatgaaagaaatagagagcctgaaattcttcaggaagcaagtctgcagaatggctcgacttcggtcactccagagaaggaaatggtagtggcaaaagtttctaatgagatccagacaaatataatgtttggtagggattctcaagaaagccacctcaaaggactcaatgagtatgatgtgcaagcttctgattcattctccacatcagaattcaagagcgtgggaggtgttgcttcagtagaaggcgacaatcttgaaacttcacagttatctgagcttatagtaattccagaggaggcatggtctgagcttgtagatataaaatcaatatctggacaggagaaaggaggaaaacgccagcttagcactggagttttcaattgcaatggcatgcatactactggtctgtcagcagaaaagagggatgactacaaaatatatgatcaaaatgaaaagaatttattagctggaaagggaaatgcaatagcagattcagaagaaaaggaaccaaatggagttacttgtcaggatgatacgaagaattctgacttgttggtgcaacaggaagatggacaacatgatagttctgctggcacggcaagggaatcgtcttcttcatttgaagaggaagtagcaaagttttcaccaccgagagtgccaacaccacctaaatatcctctattccaagttactgctcatgatagaagcatggtatggttatttttgcattattcgtttcaccactttatgactaagatttcacctgaccaaatgtctatctttctcatgctttattagctaaaaagggctccaactttggttcagccttctatcaagctttcagacgagaacaacacaatactggaacagataaagaataaggtaaagtactcactgttggacctaaaaacattggcattgagtttagttttgctaatgtaattttttcttgtttacttcacagtctttcaacttgaagccagttcttgcaaagagaccgaacatgatgggtgctccaagaacgaacttgcaagtggtggccatcctggagagggctaatgctattcgccaggtttataaaccatctcttgcaacattattaatctcccttacagtttcagctgatcatagctttgtcatctatggtcatatgattattttctctcctgtaaatcaaacaggctgttgctgatgacgatgatgaggatagctggagtgactagctgattcctcagagcatgcaatttggcgcctgatgtttcttcacattcacatttcacaaggtctgtggtgatcatgccatcatggacttgcgtttcctgttcttgcataagtagagctagcaaactgtgaaatgaactacagggtatcatctgataaagaagcttaatgtctcatatgaagttcatgccatgaagatgcaacatgtaaacggtatatcaattttttcccgcttttccggcacgtgatgtgtttacgccccgtttggaacaggaatttcatagggatttcacgtcgaacaattcaaattccgttgaaatccagagaaattccctcttccaaacatggcc

SEQ ID NO: 86060 - DNA, 7345 bp, Oryza sativa
  unsure (1)..(7345): unsure at all n locations
caccctcatttttcacaggtaagcaagtgagcacgtctactgcctatatatctccaccattgcatagtacaagggctgggaatttagaaaatatttggttcaagcaaaattgaaaagataaaatttccaactaatgaaattcttcctatgattaatcttgtatatattttattcttagctaaacttgttacttgtgaacaaccatccatgttagggaaccttatgcatctaagtaattgttatatgagagatggttaaagatgaaagaaaatcttgctacatttgccatgacttttgggaatttgtttttcaaaataaaaattctttttcaatgctcattcctctaattgacttcatcttatacctatcaaggccatatgcaagtatatcaatgataaaccttattacgcatatgattgcagctttgtcaaatttatatgactcgtgttagatatccttcatactctcatgatcaagaggccatttccactttcattttcatttccatatatataatcaagctaagcttctacattggaagttggcttcccaaaaaaaaatcattcaaataaactcctattcagactatgctttcttctcctaaaaaaccttggcaaaagaaagaaaatgaaaaaaaggagggaaaggcatggctataaaaaaagagagaaataaagcttgccctcaaaacattgagcatgatgaaaaaaaacagtagccatgccccttccatatttatgcaaggaaaagtggagaagaaagtataggaaaaaggagaaccatttctattccaccattacacaaaatatttaacttttctttttaccacctcaaataaagacccttgatctagaagtatgactaataatcttcctgagtctgtatatttggctttgcaatatatatgatgcaggtatgtcacaatttatccctaccgagcccaacatatcagcttgtaaaatagggataaaatatggcacaatctgccttggtgaggatccacaaagtcaaaaatacttgagtgatagagaaaaagtcattaagaggaaaagagttgttttgcgaaacttcataaaatcccaagagtttgatagatgaagtaagaaggactggaatcaagaccattccatttaccaattacccaagatggtaagttagccactgataaagttcacaggtataggtatggttttgaataatttatatgcttgagttatatcttggaaaacttcattctacaccaatatttactcagggatgagtaaaaagctaagtgtggggggttttgttggcggctgttaaatgccgattatataccaccaacatctgcataaagtccagataataaaacatccaacatactgataggtgttaaatctcacattttctacaagtgttagtatatatttgtatgtagatggtaaacctagaagttgggaggaaaatcagactaaagttggagaaggaacttattcattcaagagtaggctttttaacttccaaagaatcagcccgaaatttgcagaaaaggataaggcaggtcaggggaagtccacaggccaaatcctgggcttgttgggccaggccagggttcagccgaactcacatctccaccgtcgatcctatggtttggcatggacgtcccagatgcattcctaatggcggttgcagggcacttcggacaattccccatccacaaccgtcattacctgctctataaaaggagcttcactccttcacttcttcagacacttccgagcttcacctgaattacaagagactctattgtactatttgtatactagaattaggaagagagtagagtagaagaagtcgggagaattccggagctgtcggtaatcctctcttatttcttttattctattcataactctgatattaatagaattatttttcctgagtattttagatttatcttgtgagaattatctcttggttagttcgtaaatagcatatgggatttttgtcactataatcaactaactatagtgattgctttggtgagttataaacactaaggtatatattaattgcttagacgtggtgtttaggtaattattatccagtaattattacgtatcccacagtacgtttgaggtaggtagaggtggtgacagccctcaagagcacttaagtccttcctgtccaggtatgtagtagagcgatatctggaaatagcgggttcccagtgcctcaagtatcacgttacgattaaagttaagcttttcctagacactgtttctcactggtaaatcctctctatcctagcctattctttgcttggtgtccttagatgaaccggaggaagaattaatcacacacgttcccttcgattcgatacccttggaatactccgtaggtgaagtgctacattggtatatcagtgcgcttgcggattttatctgtgaccataagaattaccaatagggcatctaccactccctacgacgacgcgtctccgggtgccgccacgggttgcacataacgtgctcaaggtgtggcggtgagtttttctctttcctagcactctctttcctctgtcatagtatagaaatgacgtgttaacttttatagcccgtttatgcaggactaatgtacccgctttaagtgcatcttcactttcctcgtaaaggtaaccttaaacaataaattaatatttatagtacaattctttatattagaagataaacttaaattaagatgttgctatgggcgatcttaagcttaaggcaatgttacataccgttgatgtgaaaagatggcagcaaaattttgttgttaacacatactacattttcccaacttatgctcccttctttttcacgcgcatgtgttccctaactagtaaaccatgcatttttgtgaatagatatattgaaaagttgttttcaaaattcatattaatcaatttgtaaatgttttcactaatattgaattggtcatgtgctaattcatcgttccattgtgcatgcttggggtgagttcccaactcttattacccaacacaacctaaagctacaccacaaggtacaaacaattacgctatttttttatttttaaattgttcacgaagcaggttagaccgctgcttatggaccagtttgaccgacggtgtgtgggcggtcagaccggcaaagtctgaccccgactccactacatattgtcgggtcttgggtttccttgttccggaaggtatgtagagggggaccagttggactctaagtagaccaacccctatattagggacaaggtcagttcaatcggaggtataatctactctcagcacaatttagccaattgaatcaccttttcaatattgcatctacttttcgcctagttttagccaagttcgtccatctttgtcaatttgtgctgtaaatcgtccgccttcactgtgagagtgcgaaatccttttgtagttttgtcccgtacactttccgttcgcccatgagacgagtgttaccgcctgtttcatctaaatcggccctgctagccggtttaatctatcaaaactcatcttgagctaggttgagctggctagcctgtttatgtgtcccagtcatgattgtcttcttgtcaaaaaaaaattaccaacatatatacagtagtatttgccgataagtagaccgaatttattgtgttggataagtagaagttattgttttggattgaggacaactagaagaacgatttttcatagcgttaccctataattttcgctggcggcaatacgtacaaaccgccaacaaaaatataacgagggggggttacggaccgccaacgaaaaccgatttttgctgacgggcacactaagagatccgtcataaaagaaactctatttttcgtagtggacctcttaagtgtccgccacagaaaacctgattttaggtggcggaccaggaagagcaccactacaaaaaatatatgtttcaccgctattaaaaatgcaccgcctctcccccccccccaacgctccacgctattaaaaatccatgctccgtctcctcggctccccctcctctccggctttctccctcccacctctccccaacctccctcccacctcctcctagccttctccctcccacctctccccagcggcggctggctgtggcagatctaggggcgacggcagtggcaaggaagggcgatggcagcggtggggtggacggcggctggcagcggtggcgggcgatggtccggcggcgggctcttcgtctcccccgtggtggccggctgcggcaaagggcgacggcggccagatctgggggcgacggcagcagcggggaaggggcaacggctggctgcggtaaaggagacggtcgtccgggggcacggcatcgacgacgaagactgcgatggcgatggcagaaggagccgccagcggcggtgatgcttggcgatggggctcacacatcggtgctgctcggtcggcgacggcggcggggaggccgaggaggagcggcgagctcaggcgtgggtggcgacgaggaggcgtgtgggcggctgatctggcgacggcaaggtcccaggtctctctcccccactcccccgctcctccccggccctctccctctctcagatctggcgcagcgacggactgggcggtggtgaggcggatggatttttttgagagaacaatggatggaatgtttttttttggtattttattgtggtttgggaatggatatgttaatttgtgatttgtgaatgaatctgttgaatttattatgnaatggctagtatttntctcttgntggctggctcagtgtaacccactagcgaactacattttcgctggcggccaataaccgctagcgaaaatcttgatttttcactagcctttgctttgtggcggctccaaattccgccagcgaaaacccaaactgaccgccacgaaagatgattttcgtagaagtggagccctcttgctagtgcaacaactgtaagtactggctccatcttctgttgctgctgatgctgcttgcccatcatagtgattctcattctataggcgagacgagctgtagcagtgtactcggcgtgcattcatgacgcccatgatttggctcgtccgggtcgacaattaccgctcatcagctttattctccatgaggttgacaattgatcgactatttgtggcgactcccaaatcatatttattaccatccgatttggcatctactacttcactaacaatttataatgccatcatgcagctagtttacactacaaacctatcgctgcctagcaggggcaaatctagaatgagggcgacgaaagctcaagcctccacggctgacaataggaccaccataaaatccccaataaaactttttatcacatgcacatacagaatatacatacgaagaagagatatatatagctttctcaagtttactgaaacccctcgttattttcttcttgatccatcagtgtctagaatattaatttgggtcaacttgacggtccttcttagggtgtgtttaggaggtgagattgggaactcacctttcccgcacgcaaaataaagcaacacattttcttatgattaattaagtaatttattatttttttaaaaaaaattgattaatatgatttttaaaacaactttcttacgtaaaccttttttaaaaaaacacaccagttagcaatttgaaaaacgtgcacatggaaatgaagaaggtgagttgaaaaagatgggggaataacacagccttagacacagtacaaaacatatggatgtaactgtacaatattaattttagtgcgtctgctagctagatcgagtctgtttcgatcggttcttccattggtacacacacgtcctaatctatttataccgtgtacgtagcacaagtgcacaactggtgagattctgggctggacacatcaaattgacgagggccagcgggtctctcgtgcgcccgtgcttttgcctgtctctaaaacgttgatcgggttcatggtgccatgtgcattctatcccatgcactgcaatgaatgaacttaactgacaaccaccgtatcatgccaattgatagtagaagcagtattagctagctctggcccgtagttgcagaggagtactatactgactggcaagagctaaagaaaactgtactatatattcagtgctgtggcggcaggagaacgcacattccgctggtccaggcagagagaccaatggcgtcttgctgggagcagctgcagggcctctgcgccgccggccacttgcgtcgccgctgccgcggtagaagcttggtcctgctgcagcagctgcagctgctgggggttttggtggtggtggtggccggggttgcaccaggcatcagtgaggcacaggtgaggagccggttcaaggcgatcttcatgttcggcgactcgatcgtggatccagggaacaacaacgggcaactaacggaggcgagagccgacttcccgccgtacgggcaggatttccccggcggggtcgccaccggcagattctccaacggcaaggtccccggtgacttgataggtactactacgcacgtacacacgtactcctaaattaatttccgagaatagctccgaacaaatatttatctattggtctttgaattttttttttatggagggagtactccttcctatagacgatgcactctctggatactttctgctaattaagtaactgcacttaattgctctatttttagctatttcctctgttccaaaataagaacagctctattaatttaaactgtgtggggctacacttatttgcaacagagaaagtatataagctgtgacagcgtgttcgggcttattttgacactaaatagtcgtagcaccatcattttgtgtagcttcggtttacagcatgtttatttaaggagtactccacgtcctatggtttgcactatgtaacacaattaattattattctctaattctgtttttaagtaggagtatgtttttgagatagagatagagtactccctccgtcccaaaatataagcatttttaaacttgcatacagtttttgatatgctattttgaccaccaatatctataaaaatatgatattttaaataaaaagagttacatattatgatagtttgtttaataataaatctaataacatcaattttatatgattgatcttttttatttttttactactaatagttaaagttaaaaatatttgattttacagtatactaaaaatgcttgtattttgggacggatgaagtacctcttaattggtttgcaccacacgccctatgcaacacaattaattacacgcaccaagcgacacagttagtttgctcaccgtggg

SEQ ID NO: 86061 - DNA, 732 bp, Oryza sativa
gccgatcagcaccgtaaaccagcggtgcctctactggtatccacacatacagagacagaacgccacacacagatgtgctagcacctgcgcgcggctagggttttgctcggggagggaagtgacggctagagtttctcgcatgatgcaatgcctccgctggtcacacccctcacgaatatataggatccatcactcgggcctccaacgcccgtaggactcctattcggatccctatccgaattaagctcatattggatctccatccaatccccttattccggcccattaagcgtccgaccctgtaggttcatgtatacttggctgtaacccgaaaactccttttcggtccacgcgtcaacagcggcccctagcagaacgtattgacccaccgggcatacataaagatcatatcggctgaacctctagtgtatacttgtatgaacccctttgcctcatgatatcgattaagctcaaggctagatatgtgtcatcctctaatagctcaatcattcactcgaacctgttgatagattatataacttgtgattgactcctcaatcacctttgccatggccatgaacttccataatctacaacatcgaggggccaagagatatctctccataggaggggcaaatcccatcttgattattcatatccaatacatgtttcatagcatacccgaaaactacttttataacaacccaattacggagtagcgtttagcagtcc

SEQ ID NO: 86062 - DNA, 968 bp, Oryza sativa
  unsure (1)..(968): unsure at all n locations
atgcgcttttgaaattctactttcaattgccagtatattagtttaatgctgatgctctcctttttttaatcttttaaatataatttgacatggtagttttatacctgattgacacaggctagggaatatgacaacaaacagtactggtgatctccgctcggcaggagtggtccaagttttggatgttggatgtggtgttgcgagcttttctgcttaccttcttcccctagacattcatactatgtcatttgctccaaaagatggccatgagaatcaaatccagtttgctctagaacgtgggattggtgcaatgatctctgtgttggccaccaagcaattaccttatcctgaaaatgcatttgaaatggttcattgttcccgttgtcgtgttgactggcatgaaaatggtaaggtttacaactttaaacactgtttgtgtcaagctatgcagccacatttgacttattatgactcttgagattttgattgggcaacatagttttgtgggaacattcagctatactatgctggtgctattcagctataacaagttcatctaaaagtttagttgctctcaagttaaaaatctctgttctacattggtgctcttcctaaaatgcaatgatcctttgtttcaaaattttaatctgaatacataattcatattttgctgtatgacttattttcagatggaatattgctgaaagaggtagatcgtcttctgcggcccaatggatattttgtatactctgctccaccagcttatagaaaagataaggactttcctgttatctgggagaagttaatgaatataacaacatcaatgtgctggaagcttattgctaaacatgttcagaccgccatatggatcaagcctgaagatcaatcctgccgacagaaaaatgctgatacgaaactactgaatatctgtgactcgtatgataattctccaccttcatggnagaatc

SEQ ID NO: 86063 - DNA, 14624 bp, Oryza sativa
ccaccggggcaatcattcaccaaatgcccaacctcatggcacttggagcaatacttaccattgcttttgacaaaatgagtggcacggtgagaaggtttcttacccttctttggaatgaatccaagtccctccttgttaaggatgcaccgttgttcactcaaaatcttgtcaagagtgttcttacccttgaagcacctctccaaactcttgttgagcttggccacttgctccttaagctcattattctcaacaacaagtgaggcattacaaatggaaatacgagagctagagctagagctaggcatatccacaagatcatcacaagaggtagaaatgctagatgatgcaatatgagcaatatggcaagtagcactatcatcaagaaaattacaagatatgccaacatcaatgagagctccatgttgagtggtggaaaggaggttgtcatgagcttccttaaacttctcatgagaaatggtgagtctctcatgagaggtctttagctcctcatacaagacctccaaagaagcatgatccttctttagggccttgaacttgacaatctccttctcactataagcatggagctcctcaaacatactcacaagctcatcataggaaacatcatcacaatcatcatcactctcactatcaataagagatgttaccttagaggagccctttgccatgagacaaagtggagcgaagagtgatggagcctccttgatggcaacaacggccatctttttcttcttggagcttgcatcatcaccacattcttcctcggacctggatgaggcggagctctcctcatttgagtcccattccccgatgaatgcctcaatcttcttgccttcctgcttgagcttcttcatgagcttgtagcctccactcttcttcttagatgacttgtctccatcatcatccttggaagggcacttggaagcaaagtgtcccttctccccacactcaaagaccctcaagttggagagagtcttgttgggtcttctatttcttctcctatttgagttgtagccccttcctctctcctttctccttcccaagagatcattgaaccttctagcaagaagggcaatctcttcctccaagtcctcattgacttcatttacctcgcccttacccatattttcaacttcggcttggagagccatgcacttcttggaaggtgaggcttcttccatctccttcttcttcaacttgtacatgtcattggtgttgatcttccccaagaggcttgcgggtgtcatccttggcatgtcggagttgatgagcatggtgacaagggtctcatacttctccggtagagccctaaccatcttttgggcaacctcaacatcggtgtagtttgccccaagccccttgagatcattcacagtggcattgagcctcccatacatgtcttccacactctcatgaggcaacatggagaatgtctcatattggatcttgaggaaatgaagcttggcatccttgtactcgcttgtgccctcatggatctccgccaacttgttccaaatctcatatgcggtctcaaggttgctcactctatcgaactcctcttggctcaaagagttgaacaaaacattcatggcttgggcattgagttggaggttgcggtgatcaatctccgtcaagggcgtgccggtgatagcaaagcctacatccacaatactccaaatattgtggtgataggaagaactacccaagcctcggtcactagggtagttcttccttcactccgaaggtggtgaactccaaaccactcacaaagcggcatcgggcctcctccataatcttctcggagaggtcaccgggcaactcctccacaagccgtctaggaggcggcaaccttcaagagtaacaagcaatgacccggcgtggagatgatcaatcaagtgccacactagctctacaaatggaagcaatgcacttgaatcttggcgaattaaccctctaacacactagatggatgaacataaagcacaagtgggtgtgagagaggtgcaaggggtgtatgcaattgaattaggtgccaagagagtccccttgccgctggtgggggagtatttatactcccacccaccaaaactagccgttggtggcgaaatctgccaatcattgtgctctgccggtctgaccggaggtatgaggccagtcagaccgtgctactctgcaacggctagaaaactagccgttgtagtgctgtcagagggccccttcggcccggccggtcagaccggcgttgagtgggcggtcagaccggcctcggctcggtcagaccgccatcggctcggtctgaccgaatacggctccgtctgctctgtatcagccaccccgagtagcaccatcccggcctccagggggccggtctgaccacgcatgagccaccggtcagaccggccttatgggccggtcagatcgccgttgtgaggccggtcagaccggctagggcacgccggtcagaccgccactatgtggctggtctgaccgcccctggtcaggccgagcttagtgaaagcaaaggtgagtgtgtgtgtgtgtctgatgaaaaagtgagcacaagtgaaaatgcaatgacctaatgtggcaatttaatcatctctttgctaggtcataagccctcttaatagtacggcgaaactagaaaataaactagcaaatttgatcgccctacacctcgatcaattctaaattaaagcactagttttaccgtcttctttctctttgctttgcgccgtcaattttaatcaatcgatagtcatccatgcgcacacatgacatggacctaacttaaaatattatctcaatagcaacggttagtccacaattagcgcttgtcattaattaccaaaattaacaacgggggcctagatgcttcaatgactccccaatgacggttggtgagtattaccgacgtttccaaccgtcacaaccgtcattctcaacctataaaaggagctctcatcttcacttaactcacacacctcaagaaagagctctctcatattctctcaaattagtttagtattattaagttagtggaataggaatagagtagaaatcgggtgttcggatgtctttggaagagttcggatatagttctagtagctttccttttctctttcgtaagctttgtactttatttagaatactcttctatatacatttatggtattgaaatactttccgagtatatgaatacctactttacattatgttcatgttatactgaatatactgctagcttatctgggagatgctttcgtgccggtataatgttttcttatgcaattactctatgtcatgacgatgatattagagtagtatctagtagtttagatgtggtgtttagattacaggatatcattatttggggttatatgctgcggatgagaggtgggccgctgatggtgacagctcagtacgggtattcttccgcgcgtgtatatagtcctaatttaatttcctggggagggtactccgtatttagccccggttgtatggtcatgacgggctgtcgtaaggaactcggcaattaggagtggcttctcgaagtaccaggagggcatcagatagagtgtattagctagtatatcagatgactagaatatatgtaagtataggaatagattttctctctttattttccttttagcttagataatttagtatgagaatgagtagcttaatacttgtgtgtcactctaccttgaattatcttaacccctacttaggctatgattatcacaagtaatatataaattattagtcaacttctctctaccatgatcttcccacggggattaaataaatatgatacccttggaatactctccggtgaaatgctacaatggtatatctgtgctcttgcggattaactctgtaaccataatataccaggagtatttctgcgccattactgggaattatatttctagtaacgtcgttaagaaataccaacagtaagcaaatgggaatcaggctcatctaccacagcaaacctctgccaaccaacagctttccaaatagcacgaaaattaatatccatacctatctttttcagtagctccggagagtactctcgcgtgtgagcatactcccggtctctcagcatttagtaggcttgtcttttccgatcactgacaaggtcgagatcagcatcatttaggagacgtcgcggagcgtcggcatcctccatcgagagattagtggatgaacgagcgctagactcattatgatgacttgatgaagagccggacccattgaacagataagacaatcgcctcctcattctgcacaatggagcaaaacggactaactcagcgggggttagaatagcaagagtttcacccgcaggctagtttcaccaaagcaacttgtatatatgaaactaagtatttaaatttgagggaaactatcaaagcttgaatgaacttgagagcaaactttggagagggaatgaaaatgtgttgaaatggggtggaattccccctctcggccggctggcttttatagggtacccacaacggcaagaaatgacatgtgggacccactagctgttacactgccaaaagtggcaggtggccgttgcctggccggttcggccgaaccctgggtgggcccaaccggccccactttcggccgttgggttccaacggttagtgtggtcgtggcacaataaattatcgttgaaaattttattttggtttgctttgaaaaattcatttgaagaatttcctcaaaattcaaaataaatcctaaatgcaattctgaagttcaaacatgtgctgatgcaaaaaatttaaattgttgaaaacaaatatgcagatacataccaatttacctgttgactaaggtcgtgtcattttaggtccgacgtgcaagaccatacctccttgcagttcagttcgcggattttctacccgtctccggagaaaaggttccagttccctaacggatctgaagcaatggcaaggaattatgcattgcaaacaatggacaagtcatggcgcggatggaaaaacactctaaacacacaatacgtgaagaagggcaagacaccattcaagacatatgggaaaataacatcgttacaatgggacgaatttgttaagttcaagaccttgccggaagaaatggctaagagtaaattgatgtctaacttggcaaagcgtaacaaatggcaccatcgactgggctcaggtggttacgcacccaagatagaacaatggaacaaagaggaggaggaaatgaagaatgcgggggttccggtgcctatggaggactggaacatatgatccaagcactgggtgaaagctagaacaccgaagatcaccttggaaggcaaagtgcaatttgaagaacccgagctacaggtagttgcagacaagatagatgatctatcaagcaaggaaaagaaaggagaattcactccacagagggagaaggatgtgctaagacaggcgctggggaatcgggagcatggaggccgggttcgaggcgtatcctctaagctgagttggaaagaaggtttcaaacaggacgcctcctcatacaagaaatgtgacgcctataaggacaagttgagggacgaagggggtaagcagtttgaaaaagaattgattgatttctacatgaaatattctattccactacaagagcccaaagaaccggagccagaatatcccttcgatgatttacaagagactaaaccttgtcggttgtatgtcccgattggatgcgctgggaggacacttgaggcagcgaagggaattgttattcctggcagaacgtaccatggcagatttattgaatctgcatatgcaaaagtgcagccgcaagaggtgaacatagagttcgagtcgtatgacctagacatcccaacacctgatggaatcatagtacttggggatgtggtcgaccttgtcgttctgtagcacaaaaaggatatcatatttggcaatgtcgccgctgctcctaaaaaaccaccgagacctcctaagcataagccgttgaaggacaaggcggaagaacctgagatacctaagccaactgaagggccatctacacctgtcatgccgcaaaatgaacaggaggtgcaaattgtaccggatgtccaagaaccggctgtggctctaccagatgtgcaagttctgtcatccatcggtgtagagctggaagacatactgtcacgccctgaatttctatccaaaattccaaacacttacatgtgtgtgaaccctcgtccaggaatcagccgaggcacacaataacaaattgataatagagtacaattattactctaattaataagcgaataaaatgtcattacagaggtagatagttcctctcaaccaataaagatctaagcagcggaaagataagataaacggcgcagacgactccactccacaggcagcttgaccaaggctacgcctaatcctccacaccatcagcgtcactgtagaactcttcctctgatgaatgattgcaaggtgagtatatgacatactcagcaagccacacagcaaatatgcaggtgcacaggataacaaaggatggcatagtagggtttcatttgcataaacagcatttaatacacatttcagaatttaataaagccgttaagtaataattaaacaatattaaaccaacactatacaacataccctgttgcataggcccaaccattctgaacaaccatcccggctgcacagttctatctccaaaccaggaatataccattccaaaccaggagctaaacaaattattaccagttatagcatcttctattatgatgaggagtgtgagactaatcacgaaagacattgttagacccgcccataaccgcgggcacggctattcgaatagttttactctggccagaggtgtaccactgtacccacaagacacagccccacatcatgtcaccatgtgccttaataccaccacggtacctcggaaaggagctgtgacagtacccctcgcacaacacaatccaccacagcgcaccattcctggatcataatcaccccctataaacaaggcatggactccccagcgacccccgtgggcttatctccgccacttctctgtctggtgctccgcaatgaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccacaattatcaagttttagttggcaagtaattaattaaccaatcacgattgatcatcgtgaactatcattaagccatcattaaataatagtgagtcataagttatcccaataatgtgctaatgtttctaagtatggctaagcaatcatatctaatatctagctgaaccaatatataaagctcaactagtcaagttataataacccaaggtatcaaggaataaagtaatcaagaacaaaagggctataacaaataataggttaattccacccaatgacattcgaaaataaatacaatagttgaatagaaacaatagctttaaacgggatcaacatgctcaaagggttgtttgggatctgtgtgacttgccttgctggccttggaactcttcaaattcttctcctgcgaaaacggactctccggaaacatcggaatctaaacagaaaagagcaaaaacaccaaacagcacataaacaagcatgaacattacatgtggatatttttaacatgtagatctcaattttagaaaaatttagagacttgaaccaactaaatccgagctaagatggattagttatgaattttcaaagattaaatcggattaaatcatttatatggattttaaatgaattatgacgcaataatgaattatttttgaaaaggaaaaggggtttattgcgtcagcggctagggtttgcggtggaccgggcgcacggcggtggctcacggaaacgaacggccgagatcgatcctatccaaaacggacggctgagatcgatcgggtctacggcggctcacggcagacggaccctgatgacgtcagcggcgacgtcatctccggcgacagctcggcggctcgggcgcgcaagctcgccggcgaacgacggcacttcggcacgaacggagggcaccaggacgatgcgggcatcacggcgaactcaccggtgaccaaagcaacggcggaggagcaacggacgacgtcggcgacgaggtcgaagcggcggagaccttcggcttgacgacgacggcggtgctccggcggcctacagcgatggcgaaggggcggacgaggacggcggcaacttggcgaccacgatggcgacctccccgagcgacgacgacgactggaacaacggcgaagcatggctggagcgacggcgacgacagcggcgcgaggtccacggcgctagggctcttctgacggcgagagacgaaggcgagggtggcggcgggtagaggagacaccgggtcctgttataggggttggaagacggcgacgaaggcccatggcgaccggcgacgagaaggaaaggttagggttcggaggagagaaaccgatccgaatcgacctcgaatccacggatttccaaagcgatttagacgatgattccaaaagagaaaaggtagaggagatcccgaagatcatttcccctctattgatttcaccagagaaggaaaggcgcggccgaatttggaaggagacggcggcacggctcggctagggttcgggcggtggcggccggaggaagacgacgggtccgacaggtgggacccacctgtcagcgaccgagtgcgctcgcgcgggcggctgctgctgtggactgggccgacttgggccggggagagagagaaaagattttgggccgactttcggcccaaagccaaaagagacttttaaaaaaaattttcaatttaaattattcatgaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaataattccatttaaacaacaatttatatatttaggatttttagggtgtgacacataccaacattgcaatgggatgaagcagaaccggacatctataaggacccaaatcctgcaaaggaccctgttgaggagaccctcgtgaatgacacggccaaagataagtctgaagtgcctagagtactcagaagccacgactccaagaaaaaggatgaacacaaggagaagtacatggtaagcgtcttcaagggggcaaggaaagagcactactaagaggggatgatgataagaaggcagctgcactatccggaccaaaatacgtctggactgatgactgtccggaaaacttcgaacttggctaaacttttctgccggattgggcacttgatgaggttcgatgggagatgagaaggtttcatacatggtacatggaagccagcaagaaaggcctacctaatttaactattcaatcaccggcaaatgcttttgccggtgaaggattcttctggcttgatttcaatgatctgcacgccatctatcgtcgggaaaagacggacataaactacgttcctgcatggtgcttgtgagtacaagtgtttatttattgcacgaataagtatgtgatcaattattaacaaattgcttttgtaggatgcaatccatagatgctaagaagatcggtgaacctattggatttctggatccaataaagatctgtcaaactcagcataccatgacattatcaccaaattctgaccagctcaagggcaagactcctgcagagatagcggaatacaagaagagcttgcacaagcagaagatgattattgtcgcacagtgcatcggacgagccttcttgcacttccaaaataagagagtcatcaaggccacgtacaacttcaagtaagtcaagtagattcattgtacatacctatgttatttcatatgtgagtaactgcatcgccattactatgtagcgatcattacatatgttccttatcgacccgaatgcaggcgtagtgatggtcctggacccccttgattattctcacatgacgtatagacattttctacaaatcttacaatagtaagtgattctcatacttgcatgcctactattaatgttttataattaaataacggtccttaatgcgaaacttttgaaaattccatacaatgcgtacaattactacaagttcaagggtggagaacaaactaaaacaagggagaagctgctagtacatacgtattgcccggtatgtaatacttataactcacttaatgtatttcaattgttttattaatttcaaattttaactatttccttctatctcatgaagtgtcacaagcaacctaggggcactatcctctgtgggtactacgcatgcgaatacctccgggttactgggaggtatagggttaacgcagaggatgtaagtctctcgactcaacgtacaagtctattggaccactacacttatgaatcgtactaatgtattatcattctttcgtgtaaacagttgcctagtattgagcgtcgagaaggattcgacgatatgagcattaaaaatgtgcaacaggacctctgccacttcatccaccgcatgtgttgtcatgtcttaggcaagttctttgacccagacaacatccttgatgaggacacaagtagctcagatataaccatggttaccttatgtattaatcaaacaaaggtgaatatgttctacattcgatttacttgttatatatttgaacaaacgatgctacacaataagttttgtgtgttttcgtttgcagaggtacttgcttgaacgaaagaaaagaggccgagcataacgaatgcatggaatatccaagaagttgattggggaccaaatcaagaccttctccaagtcgacttcgagtgcaattcggagcctaggaccagtatgcacgaaaacgggcgcccgggtcgcatacgtgctctgattggggcattctttatatggatggaaagctaagaagataacctttccaatggtttttgtcccacgtccaaattctttccaagtcaacggaaatcaaccgaacaagttgacgtccagaatctatcccggtgctgcgtcaccgtatttgggcctttgggtcgtgtatcatgttggaacccattagggttgtgtcaagaggggattgcacgaccctaaactctatatatcagtagttgccatcacctttagattttgggttttgcttagattattctgtcgagaacagtttcgccgctagatcggtttgtaagaccccaacttgtgagtttaatcattcatctataattttggttgtattttatctcattcttgtttgtgttcttcgatgggcaaatagggattagccttcttggcgaggtcatccgtgtttcgacacgggtgataaccaaaggagacgtggtgctgcaattgcggggctcaagagcgtgcgcgttcaagaagccggatcaatttgtgtcgcgacttcgcccaaatcgttgtttatcagaacatttcagaagatcgggaatcctagtgcacatcaatcctggctacaagcgatgaattcaaggaccttcgggagtagagtaacgcgatgccatgacatggttattagttacagattacagtgtgcattcgaagtgaacaatataaattaatgtacaattttttgtataatgctttgaatgatactttgaatgcaatacatgtcagtattgaatgttcattagttactatcattaattatgaattaattaattaattgcaatattattgaaaaaattattaatacaaaatttgcggctatttcaattcttgatgctattttcctaggcggtcctattctatcatttcgggcgggcttatcttatcttcccaggcggtcagtactagctcctagccgcctgggaagaacatgttcccaggcggaccggccgcccgcctgggaagatattctacttcccaacgattgtctacaggcggaacgccggtccatctgggaaggctatttttgctcgcctggaaatacttttttctagtagtgctcaccccttcaaaaaaaaatttcacacctatcctatctctctccttctccagatatttctctctaactctcctctcctctcttcctctcctctcactctcctctcctcaatctctctcttgcctccgagccgggtggcggtggcaaatactgtgttttttgcaaacgcaaatctatttcaaggtacagtgcagcaaaactgatcacatatcattttcttatgaaaaagatttacattaaaaacaatgacctgatcatattggtggtctttgttggacatggtggcacggtctattgtataactataccaggattcttttatccgtcgtagtctggactacggatacagacacaaagctgtggtcctaagtgcatggatgttgctataatcaaagttgtttatgggcttatggcatgtactgtaatctagatgtagatagggcgccaaaggagataagcacaaggttaggccatcatgttgtatcctaagtaaatgattgttttgttcatctcaatttcaagcattcatatgattggatacaagagtatatcaatcatactgagctttttcagttggtgcttaataatctaaacaagtactccatccttccaaaaaaaaaagacaacctaatattcgtatgtgacacattatattacaacgaatctggacatcttagtacgtggtggttttttttaggacggaggagtacatagtagtagtgtagtactgtatcagcttagcaaattggctccattatggccgtgtttagtttcctccctattcccatctttccagcacatcatatcacatcaaaaatttttctacacacataaactttcaactttttttccaaactcctaactttcttcaaacctactaacttttttcagaaactaaacacaccctatattgctcctcacgaggctcgtgctatcatgattctatttttcacgacactaccattgacttcaccaaatcgaagtcttggctgccccttggtttcagtgtttttgccgcatgaatgagttgcttgtccattcagaagtttcatggaaacagcttaattaagagcttggaagctaaagcagggtttttaatctgtaatcttggaatcatcttcttgttgtatttctgcttattctttttctttcctttcttttcatatgttcttggggttcccaagatgggaacgtgatcagtctaccttgagagtggctttcttgaggatgatcagctaggcaatacatcacttaagaacgtttctatcctttgtggcgatttctccagttcatattgggcattcctccgagggagcgcttggattaatcgccgaggttttgagatggtaagcaggccgaatcatcgttcaaccgaattcatctcatgcatctctatttttatcctatattttagcttgtaccacacatatccttgattccttatacacagcctgaaattgattcgctatcagaaaagtttttagttggggtacacaggtaccaagaaagcataatgcagatgcatagaatacttattgtttgttagatggatcacaatatgaagattccaaagatgttcccctctagctttactttgccaaaaaaatttagctaagaaaagaaagacaatgacataaacgataaaccatactacaatttagtatctgcaaagttcaggaaccaatggcactatccagcgcactatatttcttcagattcctctctgatgactgttctagttcgttatttgcgctcgaattcttagttcttacacgatttttttttctttgccaggatgctctgatgaaccggtcccgcgccttcgcggaggcggtggtgatcatggtgtgcccggtgctcctcgccgtggccctcaagaaggtcgacctgaagagccaggagcgcagccgcgccgtgccgatcttcatgcttgtcatggcggccctcaccctggcattcggcaccgtccccttcctggctctgtccctctccaagaggttcagcgaccacaggtggagactccccgccaaggcgaccacctggctggctccctcgtcgtgcgcctgcctcgtcggcctcgcgtgctggatcatacacctcatcctctccgcgcgctgggcttacgcgttcccggccatgggcaccgtgttcggcctctgcatcgtgatccactccgtccgctactgccgtgcagggggtgacctggctaacctggtacatcctggtgatgtgttgcatactaccgatgagttaactgacagaaaaaggagagaggctttgcagaaggcgatggaaggcaagctggacgagtcgctggagttcttggcgggggtcacggcgctgctgttcctggggctggaagggctagcgttggagggccagatcaatggcggacagggtcgtctcgccgcgcccatggggctatgcttctt

SEQ ID NO: 86064 - DNA, 5574 bp, Oryza sativa
ggagaaggcggggagaggcggggcggccacgggagagcgcgggagggggctaaaactggagaacttaccgagggggttccattttataggggaggatagggtgctggccacgggaaaggcggagaacggcggcggaattcgtggccggctgccatggaaggtggccggggttggcgcgggcgttcccgacgattgggggcacgaatcaagggggaaaatgggggaaatcaaagaggaatcaatggggattaattccccctatttaatttggaaggagccgacttgaatggggcggatttggaggaggaacggcgctaggtttgcacgggagagagaagaggccgtgcgggaggaaggagatgaccgggtgggtgggtcccaccagtcaggcgcgcggtcagcgcgcttgcggcgcgcgtgagggggggtggcggctcgggaggctggggcggctgggtggggcggcttgggccgggaggcggcccaggcgggaggggaggaaaagggagctgggccgagggggggggaaggggaggcccaagagaaggagggagagaaggagagggagagaaagagagggaggaagaaaggacttaggccgcgggccgagagagagagggaggactttgggccagacttggcccaaaggaggaaggaggattatttttaggtttttctttttaataaactttgataattgtttttgttgcttaataaatatttccggcgctctgaaaattcaagtaaaatttgagggctcattttagaccaaggagaatttaacaaaaattctccgggccacattcgaatttttcttgtacgtattttagtgtttgccaatttcttttcgaattttaattaattctattattccttttagaaaatgatttttatttcgggatgaatttatcaggacgtgacatggccaaatctttgtcagttattttcaaactaaaacatcggcttttaatatctctaaacctttcaatataatcaacgaaagattcattgtatttttgccttaccgatgttaaatcagagaacctatgctcaattttaccagtgcaaaaatgatcatgaaatttttgttctaattgagcccaagtataaatagaatttgccggtaaagaagtaaaccatgtaaaagcagtaccggataaagataaagaaaacaagcacaatataaaagtatcactattagcctcaccactaaacttggcaaattcgggaactctataatttcgaggaaacgacacattgtcataataattaggatatggctttttgtatgctctaacacgattcctaggttcaatcccgaatctattcctcataatatcactaatcatatcctccatgttattaggtccttgtggatttggtggtgggtttggtggcctaataggttgggtttgtggcgcaatatgattatattggccttgcctagtatcgggaggatatcccctagaaacatcattataagcattagaaatatgtgggggaacttgaggattacttgtagcagtagatacaggaggatcaaatgttctaaagtgatacaaataactagcattagtcattggatctatgccctatattgggacgactacgccggtctgaccggcccagggcccggtctgaccggcgtcatgatgcgcggtcgggccggcctgagagccggtctgaccgctgggataaaacccggtcggaccggccatctggccagtcggaccgacgggataatacccggtctgaccggccatctggccggtcggaccgacggctgcgtcgcggtctgaccaaccgtcaggctcggtcggaccggctgtgaatgccgttccgttggttttattacccattggatctataggagattgatcaacagtggtataggctttatcctttaatgtataattatccataaaagaacctagcctactccttaaaaatccatcaaccttatctttaaacattacatctaatctaatctatctttaaaattagccatagatgaatctattgtagatgcaatttgttgttggatagattgtgatacctcgtcattacttaccatgtcgggagcgagcttgggacatggcccgggcttgatgatcacaccttgacgagtcctagtagttgatctcatcaaggcctcccgtgtgagctcgttgatgtactcctccatagctttacgatcctctccttcgaagtcatctaatgtgaccggcatcacattagatggctccacctccgtcttggatgatggcttcgtcatggcgaagtcgaagtcgagttgacaatgaacggatctcgtccccagcggactcgccaaaaatcgtgttggcaactttttgtgacaagtcgacaagcacgattgtaacacctaaacgccttgcggtgatatggagtcaccaacctactcgatctagccaaagggccaaatcaagatgggttttgtagaaaaacagctaaaccggctagcggagccgatctagagatcaaaatcagcctctaggccgatttagatcgatttgaggataactaacctgtctcgtgggcaaaacggaaggttttcaggacaaacctacaaagagatgtcgcactctcgcagcggcggcggacggtttacggcgcaaactgacaaagatggactaaactagggtaaaatagaaaaacatggtaaaagaacgattcaagtaaattgtattcagggggttttacaatgaaccggccttgttccttaaataggggttggtcttgccctctacaggcccttctccacgtccaactcgggatagaaaccaaaggaaacacgaaacatgccttcctgagcaaggaaacccgagatccgacgaaaacagactcggacttggaccctgacggtctgaccgcccacataccagcggttagaccggccctactagccggtcagaccgcccatatacctgcggtctgaccggccctgtgaaggaaacccggcactttccaaactttggcagtttttccctatttcgtccataggtgccaaatttgggtgtaaacaccaggtagtgggtgaatcctgatctgccatctaattttatgaaaaacccaaagtcagctaagagtaaaacttgttttgtgaagaaaatagttcagagtaaaaatcgtatagagtttggtaaacatagcatttttatttttttgaaagtattactaaatgggaatttctcccttggccaacttacaaaagggggggggtagggcacttttggtcttttcctacagtcgtatggctctgataccaggtctgtggacccccatttttataacaggaatcaatcgtgtaacagtaccatttccctggatcaagtagtctggtacacacgagttcatagctgaaataccaaatgcacatacacgagagtctagtgcgatttattacatcaaaagcccgcaggcatagtcttagatcatcgaaccgagcggtccggaatacatcccaaaagcagagatagataaggcagcggaattaaggcagcggcatgccattgccacaggcaacgaccgtaactaagacctactgagcgccatcgtcttcatcaccctcctggtaataggcatagggatcctccgaagcttcatctccggcctctgattaagtttatatattgcaagggtgagtaccaactgtactcagcaagccaccacagcaacaatgcacatgattggaatatttcaaggaatggctatggttcttttgcgcaaagcaagttttgcaactcttttcacaagcctaagacctagcatagactgaccaaattttagtactagttcatattaagcaatgacggttctgtccaccatccattgtgatcccaaggatggcttcccgccattgagtcgtcatgtttttctaaggacgtccatcttccctcctctcggaaagtggctccaacaacataaaatcatcatgcaatgacccatcccacacaagttaagaatttagagtctagccaagtgtaatacatgtcctggtgctcaataaccgcgagcacggctattcgaatagatttggtttagtcacactgcagtggatgtacactttacctgcactccgcaactacccaacacatgagcctcgtcccaacacatgagacgcgtcacggcaaagcttttcgataacctcgcattggcagtacccgctccatgaacttttcatcctcatgcactctaggcgtacacagtttctagcagtgagaggagttctggcgcaccgtagagcccctgcctcacacatcaagaaaccactatgcatggatactgcctctgctcagctatttacgctgctaggtctatccccatacgagaagtgcggttgtacgggggtcgtttcatgcttaacttcatggctcggtccttaattgaccagggacggtactagcctttcccagataccacccacatcctccgtccgccccagtctaaaacaagtgtttaatttcattcctactttcacaaatcatgtcatcattatcatggcaatgtggcactcatgtctccacatgccgcatctcaattacgttcccaaaggtaattgcccaagcatatagcatttgataaaatatgagcatacataaatctagagtagcatttctaagcatgggtcatagttgactaaggactcatacgtaattatggttacaaggatttgaaggtaagcaataatcaaggcatggcataattcacaagtaggatgtttatcattgcatgcgatcttatttgtaaacaaaataaattttgcaattgggatcaacatgttcaaagaatagtgatgacttgccttgctcgaagtcctgcgggtcttgaccctcgctcggatccgcaactccctcaggctctacaagtgcgtgcgaagaattgatttgaattccatttgaattcaaataaaatccaataagcaccaaatcgaaagtgagcgcgggaggcgaattctatatcaactacattatttgcgaaataagattatcccttatccttagatattttgtgtttcctaagtaaattcctaagaatttaacacatttatttatctcctaaataaatctaaattcttaccgcaatttgattactcataaagtttaccaaaatagtctataatcatattaaattttgcaattctacgactataattaatccataattaaattctaattattttatattttctaaacttcttaattttactcaaatgcctatttattttctttctctttctttctttttctttctttttctttccctttttcttttctttcttttctctcccttttccccttttctctttttttttcttttcttcttcctctccctaccggcttctcccttcctctctctctcggctcttgtctccccggggcagcgacagcgaccgagcaaaaaaggagggggggtggcggcttaccgacggcggcggcggcggcggtggcgacgcacggcgcggcacacggcgcggcgcggcggcactgagggcggcggcgaggcggcacgaaggcggcggcgcggtggagagaaaagaggggagtaatatgggaa

SEQ ID NO: 86065 - DNA, 1875 bp, Oryza sativa
tttcctcacagcccggcctgtgcttaacagcttaggaatactgaagcaggagtaaggtagggacgtagggtaaggaatggtattgaatggacattatccatgatgcaagtagttgctaataatatatacctttattaatttgacgcttcttatgagcttctacattagatagaaagatccgaccattaatgtgatggatagtattatcgtgaatatagatcatgttgagagtacgtgttaaataaatcgtgcaattgaaaatagcataagttttaatttaataattataaaatctgcatttaataaatatgatattacgcctattttggattctcaactcaatgttttattaatttcattccaaaatttgaaattaataatgagacagttttagctgatgtgaactcttctcgcatataggcaactaaaattttgaaaaggtaccctctccgtcccataaaaaacgaatttacgaccagatgtgacacatcatagtattatgaatttggacagatgtattgtctccgtccaaaaaaaaatccattcctagcattctgaggtggaattagtggagatggagaatgactaaaatgtccttaatcattgaaaaaagtagtaagagtgatagataggtaaatggtattgaagggataaaacttctcgttttacgtgttgagggtaggtaaaatggtagaagttggtttttttggaacaaaattcaaattctagaagttgagtttttttgggacggagggagtatgtccaaagtcgtagtaggatgtgtcacatttagtattagattggttttctacgggacaaagggagtaaccaacatatttaacaaatattataattttaatatttaataatattttgtgcaaatgcatgattgatgactagttaatccacaggaatgttcaggattgacatgccaactactccctctgtcacataatataagagattttggaaagatgtgatatatcctaggataacgaatctagacaaactccctaccagattcgttgtcatagaatgtgtcacatccctctaaaaatcccttaggtagtgtttggtttcggaactaagtgggatgggatggaaccatccctgatttttgggttgggatgattccaatcacatgtttggtttgtaagatgggacgatcccaatttttttgtttggttgaagggatgagaaagggaagggatggacaccgtttgcaatcaccgtcaaccgatcgccggatctgccgccacagtcctccccatcgccggaggaagagcaagaggatgagccggcggcgagcaagagcaagaggaaaagccggcggtgagcaagagcaagaggaaaagccgtcgccgctcctcccatcgccggatccgccgccgcccctcgtcctcctcctcgcacgccgccgccgctcctcccccgcgagctcctcctcgcgagccatcgcagtccccatcgccgaatccgccgccgcccctcgacctcctcctcgcatgccgccgctgctcctccccgtcgccgaatccaccgccacagtcctccccatcgccggatcagccgccgctgccctccccaccactggatccgccgtgccatcgccgatgccccgccgccgcggtcgtcatcgccgagccccgcgtggtcaccgtcgccgagcctgccgctgtcgccgtcgcccgagccgtctcccgttgctcccgagggcgaacagcgcgagcgcggtaggaaggcgttgtcacgccgttcgctcgtcccaggtgggacgagttcgtccgccacattttccccgatcagatggttccggatctgagaggaatattcctcttcagggaccaacccattccactcaccccttaaccaaac

SEQ ID NO: 86066 - DNA, 709 bp, Oryza sativa
tagaagccttcagcatgggttttccccagcagtggcacaatatacatgcattgaacaacatacgtgaatgggcctggctgaggatcattatttaatacccttttaacctgcagctgaaggatcttgaactttggggttgctttgtcagttcctgatttttcaaaaaagattgtaaaacatcagagtatggacaattaataagtgcataagatcaaggatgaaattgatatcgaaaacaaataaaataaaataataaagcaagcttgtagcaaattcatagcagagagttggttatgcaaaaagtttgaagacccaaggaattcaagagcctgcattttgcattaaccgaatttgaaaatcatatttgatgatatttacctcaaccaaggttccatacaaactactatggatttaacctgtaattattactatgtaggtaactttatttattttcctatcacgtgtttatttctgggaagattgtgtgacagcattttcatatcataatcaagcagaattagttgcaccgaagcttacagaaagaaatattttagcacaccaatcatgtagatattaaattataacagtgccacatagatgatactacctctttcttaataactgacaattttgactttcccaattaaactttgacaattaattgcccttaaattgttagaccaaagtgaacgaaagttttgatttaggg

SEQ ID NO: 86067 - DNA, 14165 bp, Oryza sativa
  unsure (1)..(14165): unsure at all n locations
ctcataataaaatgaattataattacgtaaatttttttgaataagacgaatggtcaaacatgtgagaaaaagtcaacggcgtcatttattaaaaaacgaaggtagtataacggaggtagtataagtttgtacacttgagctaaactatggtagtatattgatactagtaacatccccatacgtttctaaagggcgagaactatataattagaaatgtgttaggagagcgattgaggataaaatattagattcggtggttacttgataatgactgttttgaaggtagtaaccgaaaagagaaatagagcagcggtagttgcagcccgcatcgtttggcatattaagtaaataagccaaacgacatatttgcaaatgaaaaataatctgtgaaaaaaacttttatatacatgaataataaactttgatgaaaaaaaacccctcaaaatcaactctaaatttaaagttgaaactttaaaatttggctgatatgcataagcataagtgaaaagatcagaaaagctagttggcacgagcgcgccagcaacgctgctggcgcgcgtgccacctggcgacgctcccaccccatgtgaggcgttttttctgttttttttttcgatttttttctttttctttttctcttttttcagattttttttttaatttcagcacatgtgtgttaacgaccaaatttggtaattcaagtatcaaagatggaggtaaaaccaaagcagaatccaagatagagatcgttccggaaatagagcaagaatcggttaaagtccgaatcggctgcaaccagaatcagcagagtttgagtcggacaaggttagccgattgagccgattccgacaatgtgacttggtacatgttgtcgggttgagttaatgtgcttcatatggattgccacgcacatattaagtcctgaaaaggcaattgtatctattagttaggatattttatataatttccttatagataagtttgggcaaaagtctgccgcaaagacttatggtatcttagagtttgttagagataagagtcgtgtccgataaggacatattttgtatctcaggtataaatatgacccgaacccatgtaatcaaacaatacacgttcaatacaatctcggcgcatcgccaccattttactttcgtttactttcgacgagttcttgctttcgggttaagctgcatcggtttcgatcttcaactagaggtaaaacttgttatggcggcttgcgttctcgggattagtgcttccatctttatgatactttaatcttgtttatgtaattcgtcgagttatcatatatcttatataatctttgacaatattgttatttaaccttcaattggccaacatctattattggaaggtagccgattaggttaaatatcaatgttgacttagattatataggatatccaccaccctatgaaacattcaaaggcttgattatctagatattgcccttcttttcatacttatagctgcatcagttaggtttgatcttataagtcgtgattagaatctcaatctctagcctgctttttggttgccgattagggtagtatcggggtttcagccgatcttacctgatttaactcttttatatcttatatgcttttattgacatgttaaatctgccctttatgttaagatcttgtcgcatttaggtatattaagcttcctgtttgatatattttgcttactttaatatcttaatatagagtggtatcggagtattagatgatacatgctagatctatctgatcggcaatgctatgaatgcttataatctctttgttaatatatatttcgatccaagtgatttatactgtctcggcatggtgactgatctatcccaattacttgatttaagtatatatcgacagaagcattatataccattaatatctacagccgatcgaatagatttagttctttcttacctgtttatgactgccgatcgattcaaatatgacatcggctcaaagataaatgatatgtcattggcgactggccgatctgctatcgtttatagatttaaccgctattttcttgtctttgttccttgttgattgcagaatcaaatcaactggcacgctcacgaacctaaaggcaagatttttggacctgcactgaagttaagcagatcatccaggcctcgtgtttttcgcatcaacaatgtgttttcaaatattttgtgttaaatgtttttaaaccatgacatgaaaattttcaaattttaacttaaaatcaaatcttgagtagaaagttttcaaatccgagtagaaagttttcaaatcttgagttgaaagttttcaaagttgagttgaaagtttttcaaatttgagatgaaaagttgaaagttttgaaaatttgagttaaaaaaattaaattttgagttgaaagttttcaaatctgagtttaaaattttgaaactatgacttcatatgtagatttctttttaatttgttagttaaaaaatctcacaaaaaaataaaatcttatctactaccgtcattatcctaaactgttattatctaatagattagtataactactgaggccgaaaaaacgagcgccggcggcgcgtacacgccagctagcgatgccctgaaaagattgggactgtgcgatttgtcctagggtagggccccctgctggaatcctggaaaaacatcgatcttcttctggactactggggggtttacgtgagggaatctctccaaaaacctggaaaaacgcctagctctaagcaaggcctgaaattagtgatttaggtgtgtctgtgctctaaagttggtgcaaaggggtgctctaaggcctctcacagtgcggtgagctggaccagtgctacaccatgccagctgggattttcgcgtgcatggcagatggatgcgcggcctagctgagctcttcgcccccaagcagagccgcgcagaacctggtccaaacgaggcccataactcctagcgaaatttcgattcgccctccaaaatcctctcccgccgcacctatttcctttttcccaccaccgaaacaccctaagcaagaactcccaagcaagaactcgatccatcccaagaacacaagaggaatcaccaagaagcaaaaaaaacaaagaaatctcgatccatcccaagaacacgaggaatccaggccccagatctcatattaaccaatgaacaacacatctcacatgcacaaaaacaacaatcaataaccggagttggagccaatccatcatcagatcaagccgccgcgccaaccgctcccgccggggacgtctcccgctgccaggccagccaccgccaccgcccgggccggcaaccgcggctgccggcgccgaagggaggagatccgacgctggccaccggggacgccgcccgcttccatccttctcccgcgcccacttcctcctcaccgtgccagtcgctcccgctggggacgtcttctgccgccgggccagccaccgccaccgccaccgcgcgagtcggcaaccacggctgtcggcgccagagggaggagatccggcgccggccaccggggacgccgcccgcttccgcccttctcccgggcccgcttcctcctcgccgcgccagccaccaccgccgaggacgcctcccgccggcgcgccagccaccgccgccggggacaccttctcgccgcggcttcccgtcggcgtcgcatcgagggagaaggtggagtggcggagtagtactcgactcgaggatggagaggagaagtagtactcgatgccatcgaggagaggaggtgagggctggaacgaaaagccgaggaaataaattttcgtggggtccaccggcttgggcgctagggtcatgccccactgtgggcttggtaccctgacttgggtgcctccatccaattaatcttgacaactatgggtgcttgcactattgggtgggtgtctttgggccaagttttgaggctaggggtatgggccccatagcatgcactgtgaataccctaatggtgtgtttggataatgggaaatggggagtgggattgggattgggaaataaataaagagttaggattaaatggaaaagggagaatgaatagttaggatttaagggctcgttcggttcataagattttcaaaacgtaggaataggaaaaacgtagaaatactacaggaatacatgtgcaaacctatggattgaaaaatacaggaatttttcctatgttgttgagcaagctaaccaaatgaatacaaacattaggttggagtggattatttttttcctatgcttttccttcgaaaatagaggaatggaaaactttcctacagttttcctatggtgcattcctatgaaatgaatggtagtttaaaatccattcctatttctatgcttttcttttgtaattcctttaaaacgaataaggcctaaaaatgagtgggaaattatttccctttcccatttaccaaacattgactaaaagttgattctctccaaaatctgccgagaatgaatgcatatcatccatccgcgtatatcccggccgctccaaagcagggaaacagtcccgtacatccgggcggagatcacgtacgtacgtacgtagctgcacgcgcgacacgaccaatccagaccacgattcatccgcccgctgcgtaggacaagttaaatgggggtagtggtggtggtggtgggcaccacccgctcttacttctcgttaagtctgggcgttggattgggaccccctgtgccctgtgccgctgtgtgcgagcgctagacgggtgaacccattgaatgaaccggagtgaggcgcgtcttagagcatccgtaatagtaaagtaaggtgctatttataaaacatgtacgtctcagcaatagactagattaatagtaaaccacttcaatggtatgtctacatgggtatctatatttctctaatccatcgtctcgtttttctctatagattatctccatgttagtagatagctctgctttctctcttcatttaatctctccaagtagaaaaatatgctgacatggatctcttgtagagagtttatagataaccattgtgggtgcccttaccgttaccggcagtaggatgaaaacggtcggaataatcagtaatgccaagttcaaaaacgatgctcggttaatcggtaatggattatatttatcaatttaactacttaccccttcatattaatatgatgcttaaaaaaattgaaaaatcaggatatgtatatatttctgaaaacaagagaggttagaaatagtaccacttctacgaaaacagcgatcggtcaggaatttctgcgacaattttcatccctaacgtcagtgtacaataatactaaggactcggtaacttcatcagggttaaacgaaaattaaaattgtagtaagtttgttttagaaaagtagtaggttttgttcagttttctcacaattcaccgcggttatcataagattatattaccacggttaccgagcttactgcaagataggatataatgctagcacgggaaaagtataaggtgaaaaccatatatgtagtggaaatctataaactataattggattaaaaaaatggatgtatgcgtgatcaatagttaaaattttactcccggtaaatgttttactcatgattgaatctgcgagtaaaatttttactcacggtgacaggaacaaatgttagacgttcattttttttaattttacaatagtttctagattttcaatatattttctcccctaacaccatccgtggtaattggcattgaaaaacctttaggcatgtgcccgttttctctccggcgcggcgcggggcaggcgagagaggctgagagcatagcggtgcagcatacttagagcaaggctaataatacagccgacctgttggctataaggtttttttagccttctctcagcctacccatataatagttagctctttacagttaatacagggcccactctcacggagttttttagttcttgtgtccaagccggctataaacttacagcccgtttctcctctcttctctcctccacctcagtatttagcctgctattaggtaggtgtcgcattcatcattccgagagaggactccgtttttagtggatttggccgttctggcagctggctgcacgcgccacacggctgcagcgtacataaaaaggtttctgcccaattaaaatccatcgatgtgtgaggcgctggaatcgatcgtatcatgtccctacccccagtgcgccactgtgccaggcaaggcatgcatacttgcatagtagctgtactagtataacagtataggaccatgagatgaggccatggccactggaatcaacaaggaaccggcactacgaaagttgaagggttttcaaaggaaacaaacaatgcgatcctggggccagaccgacccgcggacccgggtggtgctggtgctgctgcatcaacttgtcccacgtattggatcgtcgccgacaggtacgctagacaagagggacggccgaggtattacttcttccgttttatcctacatatacttatatagttcgtctttagttgttgctatttctctcttctcttattaaaccacatcattccaattatttttagccattggataatagatctatggtttaaattgtctattctttattctctcataacataatgcaatctcaattatttatatgctcaaaatcataagtatcaatttgttttagttttaattatcatattgcatcatatttgtacgtattatataacttaattttccacagcaacgcggcagggtgtttatccagtattatacgatgatgatgtattattcatcttattgaaattattaacaaataaaatgggttatacaacatcgtaaacacgttctactatttgaacggattatgttaaataatagaacgaatgacaatcctaatatttgaatagctacatatacaaagatatgctaatacaggaaaatgagcctccatatattgggatgcccctcatacaatgcgagcagacaagcgcaaccacaaagttgatcgtctctgtcacgcgtaaaaacatatgaacgagtatcgtctaccgtctttggtttttttattaaaattagttttgactcaaaagtaaatttagtcttgtgaggaatggcacaacagtcgccaaaaacgaattacgaatgggacttataatttatccatattttctttgagtttcacaaaaattattgttctattatgtatacacactggtgtagaaaccatctttggtcggtcgaccaaattttataatagtcccagttccattaaaaaccggaactaaaaatgatttttagttccggttaaaaaaattttgatcaggactaaagataatctttagtcgaggcatgtcaaggggccgaggatctttagtcctggttagtagtaccaaccgggagtaaagatcatttagatatttagtcacggttgttaataccaaccgggactaaaaatctatatttagtcctgattggagttataaaccgggagtaatatttctctcccatatctaatcggttaagtccagatatttagataagattggatccctctcttctcagatccaatccccttactcctcccctctcctctcctcctcccccggttggtggtaccaaacgggactaaagatagcgatcccggttggaaaactgggactacaaaggttctaaaccgggagtaaagaacatttctctaccagtgacattatgttaaaaaaataaagcctacaaagtttcttttttgaaatttgaactaaaaaattttaccaaaaatatattttcataatttagtacaaacactcattaatatttttttaaagaatatattgtcagcaaaaaaattttatatgcctgttcgtagcggattaaatgctaatggtgaaaatgaaattatgatcaaaacaaaaattaactctaaacttaagttttaaatttagatcttaactacatctagtaagctaaaaagctaaagagtaaacgacagaactactatgattcatgcagttaaacccatttagggtcttttttttctgcaactttaaactacaactttctcgttcttggttaacatgatttttaaattgttaaatgttgcatttgtttaaaatttatataaaagtttattttaaaaaaataaatttattttctaaatttatgcaataattaatattcaatcaatcatgtgttaatgattcatctcattttgtgtaccaatagaagcgaagttagaactaaatgaagaagaatgtcactcgtttgctcttctctagtttaaacttaacccgattcgagtgtatgaacttagacaaaagttaataaactatagctaaaatatttggtagaccgagttcctggacatccatcttctacgtagctcggcctctacgtgccaaaaaactaacctctaacttaaaggatcaaaatcagccttacaacccgctctattattgtacggattgctaaccgctgtgcaaacaagcaagcaaagcttagctttacccaggccctacctccctctgacggtgtgggcccacctgtcacaccacgtacgaacggcgaccgtgtgtccggtcgccggctcgccgctgatggtgtggacggctcagcgatatggcgccgtccgcccaccgcgctatcatctttgcccattttttttgtgctggtgtgcaagcaacgctaaagctaagcttaagtccaaactaaatcattgtcattagcgactcacaaacgaccacgcgatgatgatgatgacaataacgatgattccaagaatacgtgatatacgcccttataattagttagcttgtctcgggacattaggcatcttcttgcttgcatttttttttttttgcatatatatgctcccaaaatgccacgagctaggtagttaggcagttagttactactgtgtagtacttatagtgtactatatcatgattcttcaagtatcatcaatataattgatcatgttagaggtagagcatatacggcctctgttttaattttgctgtgtccgtgttcatgtagatgtagtattaaacctagctagggacacaaaaagaaaacactaattaatcatgcatactgagattcttccttgtgaatccatgcatttgaagcctccaactgtaagattaatttgtccgtatccatagatattactacctccatcccagaatatttgacgccgttgacttttttaaaaatgtttgaccgttcgtcttattcaaaaaatttaaataattgttaattctttttctatcatttgatttattgttaaatatacttttatgtatacatatagttttacacatatcacaaaagtttttgaataaaacgaacggtcaaacatgtttaaaaaagtcaacggtgtcaaacatttaaggaaggagggagtatatccatatatatgaggattgagttgtactgggtactcttacgaaattatttctgtgtttaaaggagtactctggattggggacattttcctattccgtgttagatggtaaatgatacttcctcttatatgatgttggctaggtaaaaatgaacaaaccaacatcaaacaaataaaaccaaaggaagcatataaactgaaagaagaaggtttaatccaaatgtcgcctatacctgtggatttcgtggtcaagctctttggctatttggattgaaaaaaattcataggatttttggaggtttaagatatttgggaaaaatttcctatgacatcctttccgacaaaggaaaaggattgctaaaacgcatatttgagaaaccgaaaatgctctagttaacaagcgaccaacgtgaggcgatattatcaggcgttgctgaccactcatttcctcatcccccctctctcccttcttctctctttgctctctctctctctctctctattgcttgctctctctctctctattgcgcatccgcatctggcactcgcatccggcaccgccgccgcccgtcttcctctcctcccttttgtgtcattgccccatcaccgtatccggcgctgccgcccgtcatcctctcctccctccatgttgttgcctcgtcgcctgaagcttgggagcttgagagcttgggagctgcggacgacggcgaccgagctccgtgcggcatcgacaacagcggatatgcggacatggctgagctctgtgatgtcgacaaaagtggccgagctccgcggcgtcgacgacggtggctctgtggatgcggtggagctcggcgcgacgtcgacgcggatgtggttgcaaaaccggagtggaggaagatgtagatctaggttttcatcttgaattttgtgacatttcagtccatgtaccatgatgtttcatcagttagattagaaatgttacggtgggtattcgatggtgtttcattctatttcttgatgtatttggatttgtttcatgtttcgatacattcgaaaccgttgtttcacatgttgtagtaaaatgtttcattgtgtgatttgattgtgtttcactatattcagaactgaaacatttttatgtaaggtgtttcaatttttgtctttgattctttgtggatttgttaatatttcagtaattgaactttgatgtttcatgtttcagaacaaattgttttagtccatgattcaaccgtgtttcatcatttgaatttatctgaaacgtacaagtgttaagctagtggtgaaacatttttcttacacgtattgaaacattgcccaatttttacaacaaaaatcgggcgcccaatttataggtgcttcgtttagaaacacatgaaaaattaaagacatagttgaaatgccatgtacaaataaatcccatgtataggaattcagaacacgcaagttaaaaagatgacatgttaatttggatggttcccaggaaaaaaatatcacaggtatttgatagttttctagagagaagatatgcttatggttagattgtatcgtgagagaaataccatgaggatcatttagattggtaaagtagtactttacatatatttatatttatatctatagtagattaaaaacgctagaaatacttataatttatgaccgaaaggaatacatcaatactatgcttgaggctagggtaaatgaaaaagaatcaacagagatgttgaatgcattattgagcctaaattaaatgcgctaatatactacttaggctttattcgaagatgaaagatggcggaactttttcatgacacctaaaacaagaaaaactattagcgtatgactaattgagtattaactaatgcaaacttaaaaaatattttttttattttatttagaaacttctactgatatagtattttttaaaagaacaccattaataattcaggaagcacctagaaaaatagaccatattattgatattgtatttttctaggtgcgatgtctgtactgagtgcgtgcgtatgtttcatgcaattaaaaaaaaagactctcacaaacatagctagttgaaaattccctacaagttgaacaaaaacacacacgaataacgcgcggtagaaaagataagagacagtaagcaacagtacactaccatacaagaagctaaaatcccggagcattgtcatagaacttcttctctacttgtcagcttataatggcgcatatactgccattggaggagtacgagtagtatcattattttcagactacggcctatttagtttccaaacaaaaactttttacccggtcgcatcaaatatttagacacatatatagagtattcaatatagaaaaaaattaattatacagattacatttaaattgcgaaacaaatcatttaagtctaattacatcatgatttaataatatggtacaacagtaaatattcgctaatgacaaattaattaggcttaataaatttgtttcacagttttcagatgaaatctataatttattttattattagtttacgtttaatacttcaaatgtgtatttatatattccatgtgacatgtaaaacaattttttttgcgaaccaaaaaggcccaggattctattgcagtgcagtaaagtaacgcgtggccggccacagggagggccatcctgccagtttgtggggtcttgaggtgttgtggaggcacatgaggaggtggccgatgataggtcaaaacctttttacccccacatgccactgtctgggaggtaatcacctcacctcacattgatcttgccaacttttacttttaactggccggattattattattcaactcctctgggtcacaggatcacggcgacctagctaaataatgtccttttgacacttgacagcaacactgcctcccaaatattcttaaaaaaatgagtaacttggtgaagttactagactattgtcacaaatttacttttgaagacaaatgtatacactgcatatggcatctaatataaatattttaaaatatattgctccaagtaatgtttaaagtagtaataattattttttaaaacacaaaacaaatataaatgctcacaacgtacacacacttactcctatgaatacatacatgtacatcctacatatatgaacaccgtcgaaatactagatcggtatgttttgagattgatgaagtcaccacggacatctcgttttcgacgaaatgacaaatatgttgcctatcactgaaagaataattagccgtgaatatgagtacatgtgtcgagtttagaacttaggtgggctagttccataataaggaacgaaagacatgatcatacctcatatcattttatgttttaatgatcgttatttcaatttgataatatcgcaaaatggaaataaaagggttttttttactgttgtgacttgtgacggtatacggtttgtaaccttaattagtacttattatgggttttttttctcaaatctaaacatcaacttattcgttttctgttatcatgcttttcaacctattaaaataatggtgcatttttgacaaaaagtctctatatatagaagtttaaaaaaatcaaataatccatttttaattttataatattaatacttaattaatctaataagttttctcgctttgtgtgtgctgaaaatatctctaccaactaagagaacgaatcggcctaagggttgatggtaatgccattgttatagaaacatatttaaatttgaattaattggctcatcgtcttttacttttcactaatagttatatatgtcatgaatttgtaatctaaatctatcgtggtttgcttctttttaaaagaatattatgattttcttgttattgtgcggtgttttcgaggttccatttcaacccttttttttttatattccggtagttgatgatattgtattcggttcctcttcaagttattacatttggctcaaaatataacaacgtaacctatgtttaaaatatagtaacgtattactaattgattggacacctataaattttgatatggcacgcctagattgttatatcatggaccgatgaagtacattcataaggagtcctctagcaaagacaacctatttctcttaaaagtcggaacttcctagacagcttttacatacgttcaatcttacaagtatgtacccactttcaattcttacaaattttgatatcttcaaggaaagaaaagtttaaatattcttcctacggccgttttcccctttccctggaaaaaaggatatgtttccggttacctgcgggagaagtaactgttaccacatgacacacccaaaaccccgggcaaaagtaaccccacacaaacacaaaagctgaaccctctcgcttcccttccctcccctattacatctcttttttgccttttccttttctttttttctcgaggggttaaaactttgccatccacaattgagactcggtgggacccagacccaggtgggcccaccctcgagtcctcttgtcatctcccccccccacacccccccttncctctaagtgcgtgccccccgccgcgtgtgccccccatccggtcctcctntnctttcggttcgctttccaaaaaaaaaagacgagagagagaaaaaaagttcttcacgaggaaatagttttaacgagacaagaggagaggagggagcttgaggaggaagtaggcggcggggaggtcttgagctgcggt

SEQ ID NO: 86068 - DNA, 2959 bp, Oryza sativa
cccatgccttccggctgccccactgagcgcggagccccttgtgcaagctttggccactgcgaacaccacggtgttggatgggttaaatgcccagatggaggtcctgcaggcagagcgggcggagctcgacgcggcgtgagcgcgtgtcgaagaggggcaatgctcggtggaggccatggtggaggcgggccgcaaggcacaccgccggcacacctgagagctcgaggcccgtcggaaggagctggcggagattgccagggaggtggaggagaagcgagaggctgccctcattgccaccgccgtgctgaacgaggcgcgggacgatctccgcctccaatacgggagctaggcggcggagctaggaaagaagccggcacacctgagagctcgaggcccgtcggaaggagctggcggagattgccagggaggtggaggagaagcgagaggctgccctcattgccaccgccgtgctgaacgaggcgcgggacgatctccgcctccaatacgggagctaggcggcggagctaggaaagaagctcgacgccgcccggggggtccttgacgccgccgctgcccgggaacggcgggcggcgaagaccgaggcggcgtcccggcggcgcgaagaagcccttgaggcccgcgccatggtgctggaagagcgcgcccgcgcgaaggagagggacctggcggaccgcgaggccgccgtcgccatccgggagacaacactggcggcgcacgaggccggctgtgccgaagaggagtccacactccgcctccgcgaggatgcgctcaccgagcgggagagagctctcgaggaggccgaggccgcggcgcaaaggctggcggacagcctgtccctccgcgaggcggcgcgggaggaacaagcgcgccgcaatctggaaggtgcccgcgccgagagggccgcactggatcagcggaccgctgagctcgaggcgcgggcaagggagctggatgcgagggcacgcagcggcggggcggccgcgggcgacggggacttagcagcccgcctcgcagctgctgaacacaccatcgcggatctgcagggcgcgctgaactcgtccacgggggaggtcgaggccctccgcttggcaggcgagatagggcccagcatgcttcgcgacggcgtctcccgtctagaccgcgccgggcggtaggtgggtctctggggcgggcggactgtgaagtacgccgccaaccaggggggcctcgcccagcgcctctccgagatggccgggaccctccagcggctccccgaggagctcgaggagacaattaagtcatcctcgagggacctcgcccgaggagcggtggagctcgtactggcgagctaccaggccagggaccctgacttctccccatgggcagcgctggacgagttccctcccgggaccgaggacggtgcgcgcgcgcaggtccgggacgccgccgaccacatcgtccacaacttcgagggtacggcccctcggctcgcgttcgccctcgactccgacgaggagggcggtgacggcggtgacgaggccggcgacccgggtgcgtcggagtgagcccccaggcctccgccaatctttaaatagttttttccttctttttccgaggccttcgggcccccttcttgtatagactaacttaatctgcaattaaataaagaggaaatttctgtgtcaatttcttttgttgtgtgtatgagacgaggatggtctgtgccacggtccttctgtgtcttagcttgaacaagggctcgtgcccaggtcccagcctcaaatggcgcgggtcggggctagtgcctggggagattcacgtgtcgagactggccaggccgggaacgtggtgaccgagggttatggatgacccgattgtgggcctttgccgattccccccccgggagttcaccacgccccggggcacggctcggttctgggccccttttggcgattttagccggcccgggccaccaagggcaggatcgagcacgagcgtgctaattcaagccaagatttttcaaaaggaaacaaaggcacagacgcagtccttgggaaatcgaaaatgcttttattgaaatacggaagaaaaaagataagaatatgcatgtgtggtagcccccggccaaccctgcacgcccgaggggggtgcggggttggcccgagcccgagacctgacatccaactcccattaggggtagaagcgacgaaggtgttcgatgttccacgggttaggcagctccgtgccgtcgcctgtggccagccgaacggagcccggccgggggacgccaatcactcgatacggaccctcccacattggtgagagcttgctcaatccagcacgcgtttggacgcggcgtaggacgaggtcgtcgacgcagagtgatcgggcccggacgtggcgctgatggtagcgctgcaggctctgctggtagcgcgcggctcggagggccgcgcgccgccttcgttcttccaagtagtcgaggtcatctctgcgaagctgatcttgatcagcctcgcagtacatggtggcccgaggggacctcagggtgagctcggatgggagaaccgcctccgcgccgtagacaaggaagaaaggcgtttccccggttgctcggcttggcgtggttcggttcgcccagagcaccgctggcaactcctcgatccacgagtcgccgtgcttcttgaggatgttgaaggtcttggttttaaggcccttgaggatttccgcgttggcgcgctccacttggctattgcttctggggtgggcgggggaggcgaagcagagcttgatgcccatgtcttcacaatagtcaccgaagagttcactagtgaactgggtgctgttatccgtaatgatacggttaggcaccccaaaccgagcagtgatgcccttgatgaatttaagcgcggagtgcttatcgatcttgacgaccggataagcctcgggccacttagtg

SEQ ID NO: 86069 - DNA, 757 bp, Oryza sativa
ttgttgttgaagaactgacgctgcggacgaacaacaaacgaagaacctccctgtgacattgactgaggtcccaaagtaagacgcggcctctgactattcccctgttgtgccttgaagtgagcaatccggcgtttcttctgctccatgcggttgtacttgtcctcctggcgaatagccttatctactaacttctggaaatcatgataatccccagtcatgagtgggtaagaaagctcatcattaagtccttccaagaacctctcctggcgctcttcatcagtgcgcacatcttccggagcataacgagccagacgattgaactcctgcagatactcggttaccgtgcgagatccctgggtgagcgacctgaattccttcttcttgagagacaccactcccgatggtatatgcgtcttccagaaagcagcggtgaattcaaaccaagagataggttcagcggtagtcctgttaaggcggaagtgatcccaccactcagaggcagggccatgcagttggtgtgatgcaaatgagaccttctcctgatcagtgcactgaagcaaatccaacttcttctctatggcgtgcagccaattgccagcttcaacaggattagtggtgctagagaaagtgggcggcctcacacgaagaaattttgctaacttgttctggggaggtgcatggttatttccctcgttctgctggttctggagttgctgcatcatcatgttcataagctgtgcctgttgagcccagactt

SEQ ID NO: 86070 - DNA, 2319 bp, Oryza sativa
tatctgaggacgtctccgctcggcgaggtcaacgtgaccccagcaccggcgccctgaagagacagggagccgtcaaactgcatcacccaataggcggtgtgaggcaattgcgaggggtcggagctggcctcggggactgagacgggctcgggagctggggtccactctgccacaaaatcggcgagggcctggctcttgatagcgtggcgtggttcaaagtgcaaatcaaactcagaaagttcgattgcccattttaccacccgtccagtaccctctcgattatgcaagatttggctgagggggtaagacgtaaccaccgtgacccgatgcgcttggaaataatggcgcagtttcctcgaagccatcaggatagcgtaaagcatcttctgggtctgagggtatcgggtcttggcgtcccggagggcctcactaacaaagtagacgggccgctgcacctttcggtggggccgatcctcttcgctaggggccgcatccttggggcgctcttcgtccaagcggcctcgcggggcgcactcgtcttctgtgccgacgacctcggggtcggaggacgacaggggcggccttcccacagtggcctcggggccgtcctgggggtcgggggctcctggcgtcgtcggacaagcgggcaaagggccaactccggtcctcaggggccttaggccaccgttcggctcgggggcctcttctccctgctctctcccgggtcgagtcggcacagggttaggctcggggtcagagggcgataggtgcggccttcccgcagtggccgccgggccatcctgggggtcgggggcacctggcaccgtctgacaagcgggcagagagccagctccggtcgtcgggggccttgggccaccgttcggctcggtggcctctcctccctgctctctcccgggccaagctagcacagggtggggatgcgcggaatgaggattgtcctcatcgcgctccacaaccaacgccgcactaaccacttgcggggtcgccgctaagtagagtagcaagggttcatttggctccggggcgaccagaactgggggagagctgagatacgccttcaactgagtgagggcacgttcagcttcctccgtccaagtaaacggcccggagcgtttgaggagcttgaataagggtagcgccttctctcccagcctcgatatgaaccgacttagggcagccatgcaaccggtgacgcattgcacatccctaagtttgttgggggggcgcatccgctctatagctcgtatcttctcggggttggcctcgatgcctcgggcagagaccaagaacccgagaagcttgctcgcaggtacaccgaacacgcacttatcggggttcagttttatgcgggcggagcggagactctcaaaagtttccgcaagatccgagagtaaggtctcttggttgcgcgtctttacaaccaagtcatcgacataagcctcaacgttacgtcctatttggctacccaaagaaattcaagtagtacgttgaaaagtaggacctgcattctttaacccgaagggcattgtcgtataacaataagttcctatgggggtaatgaatgcagttttttcctcatcctccctagccatgcgaatctgatggtaaccagagtatgcatctagaaaacacaaaaggtcgcaccccgcggtggagtcgacaatctgatctatgcgaggcagggggtaagggtccttaggacatgccttgttaaggtcggtgtagtcgatgcacatccgaagcttgccgttcgccttgggaacgaccaccgggttcgccagccactccggatggatgacctcgcggatgaatccggcctccagaggtcgcgccacctcctcgcggatgaaggcttgacgttccggggcctgccgccgcactttctgccggaccggccttgcgcccggccgcacggcgagacggtgctcaatcacctccctggggaccccgggcatatccgccggtctccatgcgaagacgtcagcgtttgcccgcaggaaggagacgagcgcgtcttcctatttgccgtccagaagaccaccgatccgtatggtcttggacgggccgtcgcccagggcaacctccttgaccgggacctcgtcgcatgtgatcatccgctgcctcggggcggcggggacggaggtgccaagcctctcgtcgccaccctcgggcttggacgcggcggaaaagtggtccgcgcgctgctccatacaagcgagcgcgactttgaggtcgccatggacagagatggggccaccggggcccggcatcttcatctggaggtaggcatagtggacc

SEQ ID NO: 86071 - DNA, 3831 bp, Oryza sativa
ggagttaccccgagaaaattgttcaaacttcaaacgttatttattcttgctataaaatattactaccacaaagtttctagtggaatggcagatcaacataccatcgcgtcgaagacaaatctctggtatatttttcacttgatcattaatgctgtcattgtatactctggtttcaatatcaccctcaacataaactgcagaactgaaataaggcaagaacaaagacagcaccaaccacagtaaaaaagaatttcaagccatagaactaggaaatggtatatagttgtatacttgtatggagaaaagaaaaagggtgatcttctcactgaaaccacgtacttcttcaccagcttctggacagcaaaagcacctagctggtcattatgaatggctatccgatgccactgagctggctttggcagatctgcatcccctactaccctctggtcaaacatgccaccagttccaactgtaaaaacagtcactgtacgaccattccttaaaattttctgcacaggaacctgtccgacttttccgcatattatagcctagaaagttgaaacaatcaattaataccaagttaagcttgaaaaccaaaacatgaagtatccttttcatattatacttaaataccctgtgaacaccacggaatccccagcccttcttggggtctacgctttggggttctaactctcgtcttgaatctgtataatcatcatcacctcccatttcactcttctcatcaatatcagaaaaggaaacagtagaactccaagcttgagattttctgtagaaatctacacagacaaatatttaatcaaaacttactcagtaaaaactgagtagaaatcttgaaacaaccatgaaaaacaacccaccaattggttttctctgctgttctaagaccctcctcaagcccttcagtaatccattgctgagagaattcatggtaaatctacgcacattgaggaaaaacgttaaataataaaatcataaaaataatcatcagaacatatatttttttcctattcctttaatggatttcaaaacaacataaacatcacagtcgtcaacttcattcaacattttcctggtagcagttctattctcaaaagcatttgttcagtgtgaccttctacaaggaaaaaactacatgaggaaataaggtgcatcaggatggcctatcacgtgggagacacttattctttatgatgaggcatcccaggtttgtctcaacagtgcagaggagttccatgacagttctgcttattctttcctgcacaaaaacaacttatggtcttattcagctacagcagctccattccgttggaacctcagggacgacatccggccaagacaaggaagctgctctacctgcctaagcggctgatccgcctagctaagctgcagcggcattctaggatcgtagtatccaataaccaccctcttcaggaggctgaattaacaccacctaaaatctaaataggcaatcacagaaaaattaacagcctactggactaaactttgcatggataaaatatgcaaacggtccaagatattctaccgagacattttaacaaacaccttgcaagcatcgcacactggccattcaggggcttcacgcgacgtcgacaacagttgcataccccatagaacagtggcagacccagcccaaaatggaaaactgcagccatggcagagttggaacagtagaacgagctcgggaaaaggacgtaccttcagccccgcgccggaggccttcgcgcgtcgccgagtcgcgggagggataagacggcgggacgacgacgacgggcgcagaccgagcgagcggggaggctatccgtacggatcgagggaggatgggaggaggcggctggcggcgttgggtggtgtccggtggagtcggccgcggcggcgctcgtgcctgggtggagcggaggagcttcgtagcgagatcaaaaggttgagttattgtgaaaactttgggccgggcctggatatttctgcttctcctggcgtaacgggccgaacctgcaccaaagttagtgggttgctgctatccttgagagtcgagacttctgcttctcatcatggttctgggttgaaacttcaaacttgagaaccccctcctcttgtcttgaaataggaaaaaaaatgataaatgcaaaaggtgaattaggtggtgtttgaatcttctgaagatgaagataaagatcgagtgttttacgtaaaacgatgtgataataacgtgtgattaattgaatcttaattattacaaacttgaaaaaatggattaatcttgttgaaagttttcatacaaaatacacagtttaacagttttaaaagattgccacaagtatccaaaatttgatccaactcttgttgagtaacgaaagtaacaaatctgacactgagttagagatggaaaacgttagggtgccaatccaaagagtggtgcattgatcaattcactctagtaaatcaatcttttacggttggtgttaagccaaagcaccatttcattaccaccgggaattagtagtctcatgctcgcgttggcaactcagtaacgaaagcgcatatagcctagtggttacagtgacctaagtagtacccaaaggtcctaagttcaaatctcctatggagcgaattttagattgggttgtttgcggggctaaattccctatctcaatggccgtatatatccggttggatatggaaaccgggtagaaaatacccttctctaaaaaaaaattattcttccctgataagagaggctaacaccttgtcacgcgttggtaacattgcttaattaataaaactatatgattcaattgataaagaaatacggaaacacggggtataagaatatgaagacataatattcttggtaataaaaaaaacatcttcaaagaatcagataaatcctgcatttcaaatgatgaaatgagacataaaaacagcatataaacaacgaaaattatgaataggactatgctctacgctgcgactcccaccaggcacattattttacctgaacatagattccagatttttcttttctattcttttctctaataaatgtatcaaactatccttacaactattcgcctatgcctcttagcatttagcagcagaacgaatgttactgaaatatgagatgtctgcacaactcaatgttcgtgacttcagagtcaacaggttgagtatgttggttatccgaaagcagttaaatgaactagcatattcaagaagcatcagtgtcccctgtagatttcttgtactcaggcttgagctcatgcgttccctggtttggtcctcgtttgttgtaaaaacacagatcattcagaatctccttcaggaattgctgcataaaacgaagcacaaacaatcacaaagcaaccattgagagtaatgaataaaatatttgttgttcataggaacaccacaaataaagtatcttaaccaatgtttttttcacttaaaaatagagacgccaaataaatcaagaatatacctctggctggtcagtttcttgcaccagcgcctttagtgcccaattgggctgtctttcaaaaagcttgaatataatattttccagttccctgcgatccctacgtattctttttgcatcagatggtttggttggtgtttgcttcttcttctcctgaagagcacaaaattaaatgtgttatgagaaactttaactgatgatgagtagttcaagatgaagaggccgaccacatgattggcatttggcaacatggtaaagataaaaaaaaaagtagaggaaatcaagtactgaactcattttataagccataatcagag

SEQ ID NO: 86072 - DNA, 4974 bp, Oryza sativa
gcggaggtccggaggaaggtggacgaggacgcgcacgtggtgatggggcgcgacgtgttcgtgctgtggttgcgcgccgggttcgacgccgcgttcgccatggggatcgtgctcgttctcgaccggatcaccggcgacgagctcaacggcgacctgagcgaggacctcgccgtcgccagttcgccggtgtaaaagctttcggtgatcggatcaatgggttcatgcttagagatgtgtaaaatatgtatcatcttgcaaattcttttttgtatgttttcttgtcgaagtttgaatattttgccttgtgaattgagcttgtagctttgagcgaaatgcaagttactcctaattacgttagcctttgacagtagtaataactatagttaattattttgcttgttctttcatgccttttggattatttttgtctctgaatagtactagcagtttatagtttggtgatctaacttaactacgtttagaaaaaaggtttattttggagtcaacaaggtggaaaccaagtggtatccatgtgtggcagcgaagtgaagctgtcgttttcataccaagaaaatggggaggtctttttttttttcgtgggtagtaatgtataactactaattcacataatcgatttaatatccctttcactttcggtgtgaattttcaaaacaatgacactttcagagctggatttgcacaatggaaacatcaacataccccaacaaatgggcaagcgaaacttctgacgttgggctgcatgaaagaggagagtcacatcactactagaagagtcttagatatgcataattgcactccagattgattcctatacagatatatactggcactgccagatgttatcacaactctaacccatataggattattattaccttattaaaatcccagcacatttggataagaaaaacattatcttcccagttgccatgctctttaggccactatggcccaggacccatgtacggatgcataacaccaagttagtgaagacacttgtcaggatgaaaaagacatacctttctccacttaactgtaatacgacacattgacagaccatcatgaatgatgtatttttctcatttctatataaaagaataagatcatgagaagcgtcaaattttccacatctcacagggtttgctgttcgtgcatgtctatcttatggcccatctgttcaatctccaaacaggagaaaatacaaaaggcacacatctcaactgtacagcttccgaatgctggcacaaacatgcaaatgatttcggtggcatgtttggaacacccactgggtctactgatctaggggtctgccagaagtcacaagttagaaccaccggcttatgtcagcactagttgaaatggaaaaaagaagggtttgtgtccatcttatggcaaagaatcaatttgagtgccaaactgccaattctatgctatgtgaatcctctgtattcataatctatgaaccgccaccactgttgataccgaagtagatcgtcttgcgactgaaggcattcatagcatagtcgactcggatttgaccaaggtctgtgttaaagtggattccatatccaaatccaacaccaaatcccggttttccttgtcgaagagctggattacctgccaattttacgatgaatgatcactgctgaacagtagtgtacaacagaaaaggaaagatccacacattatcacagaagtaaacatatgtggggtgagaacaaagttaaacgcaacttgacattaggatatcaagcattcaagaccccacgttttcatgaatagggatgagtgtactcattcgtaaggttgtttaactaatctactatgattctgattctatatctgtgctgtatagtacagtaacatcgggagcaatcaaatcatttttctgtcgatggtctaatgtgttaaccttattagtttactctcgtcaagtttcattaagatggattggtcacagttacatcctaacatctcggctaagaaatatttccataaattccactggggacatacatcataatacagtagtaggctagtagctggctggtggctgtaagcgaaatccctcatttactttatggattatacagttcatttattggacaaggctgttttaagcactaatttagtatatcaacctcattttctacttaagtaaaacagaaattagtgcataggaaaacagagggagtgaagcacttaccagggacatgacaagcagatcctaagtcactgccgcagtccatgaaaatagaaccctccagatgctttgccttcacagaaacagatagttcaaatttttatgtttaatctgaatgtataatattacaacgcaaatagctagagtactatgaatactggacacttcgcactaatcatcacaaaaatataggcacaatatgaagctgaatgatttttcagttgtgtaagctccaaagcaccttcagggaaaattttaagcaacagcgctagcttacactgaatcgccagcaatgatctccatatctactagaaccctcagatgaccattatttccctctagtaacagcactagtttcttttggttcgtggctcagcttgaatttcatctctaaccaaccctacccaaaattgcttcagagtaaaggttgttggtgtcatcgtcgttgttgtgttgctgtagtgtttggttgctatcttaaatattttctaaatgatcaatgttacaccactttaaacattaagtaaaacctcaggcatctattcaataaattgccttcaattataaattccatgtttgggctcaatttctctatggcattccaagttttagttacgagctgaaatagtgtttcatacataccaaaggaaccgtatattcacagttagcaattaggcacagtcttcctgcaccaactgcaccctcaccataaccccgtacgctaccaagtccgcctattgcaaatgcttgatatggcgccatgtcccccacaatggaaccacctgtcaagctgtgagataggaaaagattaattacttctgctgaggagtttggcactttgctggagaacagtaggtgcatgcattacctagtaaccaaaaatgttggccccaatttcatgcctttcgaaactgcacattttactctgttgaaggtcagagattttggtacaagtggcaatccttgttccatttggaggttaacctgtcaataagatctatatgataaagtagatcttacagtaaatatgttaaaatatagtaaacacaaacatacttttaagaagctattatcattaacatctgcataaccagactcttgcttcaagataatcatgttatcatggaggttaccactgcatgataaagaaaacaacagacaattataagcaccttttgagtatattaaagttcttgaattgtaaaatactttagcacctgcatgttagaggaaagccatcatggtccctggctatggagcgtccctcgttattaacaggccggatatgctggacaaaaagggcaacagatatgatcaaatgaacttggagaaaagataaaaaaaatataaaaataactaaaggcaagccaacaactggatttgggtagatgtccacctcgaatttaacactggttccggatgtccagtttgatgttgatggttcattaagctcaacaccaagcgacaatcgactaagatttatccctctgctccctgatcgtgtgaagttgtcagccggaaagccatgcaccgctatttccggtgtcattgtgtgctgattgctcaaaccagagcaagtaagaacaagtgtgaacagaagaatcaactaatacaaccaaacaatattttatatgcaaaacataagtaactcttgtatgcaaaacataagtatctcagaagtgcatcaacaatacatacttacataggtttcctagaaaaaaaataaaatagactactagagtatgaaacagcaactagcattctctatggagatagaattaggtgtgacttgtccctaaggttcttctcaatatcctatcagtgcccaagacccactcaactttcatgaaagctaaacatccgcaacaaaagttatgtcacaaattcaagcttcagtccatagtatgagcacatataaagatattatgtttactgattgctctgatattatagcagatactgaccatgtgatgcaacagatcagtatgaagaattataacgcacttgtgctatgtcacttgagcatttctgttcaattccagacaagaaatttacacagatacattgaacagaaagccaacctgaatgacaaatgactgttgtgataaccattcaggccttggccgtctaaaggcaatgacagcatttgattcattgatacccttatccaatatgacatctaacttctcgctcctcccaaataggcttggatgtttgagtgatatcctgtggacacgaattcttaaaatcacagtgccaaatgcaaaaagaagtggaaagacataaacagcaattcagaggcgcagcacatgtgtgcgcccatggaaggcccaaagatcaggcaaaattcaggggcgcttgagcactgagcagctatagaaacacaactatgcgagagcaagcatgcagaacatgtttgacacaaacacggacacaccaaggcacaggcacaagcagaggaacacatgaatacaacctgtctgcgagtgcgcaatgtctggtgcacgtatacaaaaatgaaatttaccaacgagatgcaaaccaacatgcttaccttccgacgatttgcgagaaggtggcgccagagttcctgaaaacaacccaagaacacaacacgcaaacacaaagtcaagtcagacatccaagtgccaccgaaacacctctaataggcaaaagaccgagcacctcatgggcggcagcaggagcgcctcgcagagcatgtgggtgaggtcgacgtgcacatccacctt

SEQ ID NO: 86073 - DNA, 2489 bp, Oryza sativa
cccatgtccatccattaacacatatacggaggaggacactgagaacaaagctaagtgtctttattttcctttttatgtaatattttccattgagcaattttttatatctgctcatgctaactactcgtccagcgccggacgcctagttttatcattatttatcatattgatttttaatctcagattaatctcttgctattttttgttgttgttcgcatataattacgcggcactattgaggcgattaatgctggtcatggagtcgaggcgtctcagctttccggtcgatcgggcgcgagtccactctgtcggcttgtcttcgccaccgccattgctgataacaacaacgacttcaccgccggcctgcctccgtcgccgccgagtggtgcctccgcctacacggctggcctattatgccgccgctgttgggcgtctacgacttcaccgccggcttgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccaccgctgttgggcgtctacgacttcaccgccggcctgcctccgtcgccgccgagtggtgtcctcgcctatacggtaggttggtcacaccaccgttcatgggcgtctacgacttcaccgccggcctgcctccgtcgccgccgagtggtgcctccgcctacacggctggcctattatgccaccgctgttgggcgtctacgacttcaccgccggcctgcctccgtcgccgccgactggtgtcctcgcttatacggttggttggtcacaccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatatttttcataatatttatcttgattgcttgcgacataatctgagtacaaaagtacctatcgagttatggagttctatcttcctatactttccgtttggtttgccaatgaatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaactccgatccgtgaaactttgttccattaatgacgaactcatgtcactcatatgcatgtttgggaagtgcttagaccgactcccagtgcttggtggctatgactagttgggcagagcgtttaaacgtaatgagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctctaggaatggatcagtcagaacatcaccaccggccgcctcgtccaccgccgactggtgttttaccctgcacaattggcctattatgccaccgttgttgggcgtgtacgtcttcaccgtacggcttaccttccccgccgccgactggggtttcagcctgcacggctggccttttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctattatgctgccgttgttgggcgtctacgtcgtcaccgaccggcttgccttcgccgccgccgactggtgtttccgcctgcacggctggcct

SEQ ID NO: 86074 - DNA, 3205 bp, Oryza sativa
tttttgtctgtaataaattaagtggataaatcgcaataagcaaatatatgacttataattaataaaaattccaatatatatatatacttagcatatatatgaatgatattattatattggtaaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttgatacttttaaaaattctctagtcaattataattagcatatgaatgatagtaaattaaatgttaaaaactataattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacactataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaacgagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatacgtcattatattgaaaaatgaaggtggaaatatcaactcaaaactgacgagacattgcaccacttcattctgaagggcttctaatctatccgaatcgatgactttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagctaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgttgcgatgtttaggcttcgtacggtggtcggccttatgttcgaagtgcttgcctttcttctgtaccgggtggtttgctgcaaggaatcgacgatgacccatgtatacaaccttcctacattgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcgacatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctctccaaattctttaaattttctgtcaatgtttccccactgcgaaccatcggcggggtgtctcagcatcccgtcctgttgatgctcttcagcgtgccatcgca

SEQ ID NO: 86075 - DNA, 1093 bp, Oryza sativa
aaactcatttaaaccctagactataggttaatatgataatgtggaataagtaccaccgctctggtgttggttaaataaaatgaatcacatggtgggcttgtgggtgcaaggttttgctagtcgcgcccatagcaattaaggacccggttcgcgggaaaccctgaaagaatttatcgtgcttaccacaagccagcgtggccaacggctgggcttgtagtgtagcttttctctagctgacgcatccaggcaagggtgggcgtgatggagcagggcgggccctgcgacggcctctgtcgctttcggattcacctaggcacgagaggggactgccagttgcccgctgggaacgggggtgaaacctgaggtgtggtgtgcttggctagagggggttatgcgaagggtcctgtcacgacctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagactcaccttagtttagtctaatgaaattggatggtataggtggatggttgggcctgttgcaacgtggtgtagcgttggacagtggatgtttaatactgcttaattattacaactgttttcgcattcaattcctgtttataaatgccagtatttatgcaaatgaacctgcttagctatcccttgttgaatccctgcatcatacccccattccggtatgacttgctgagtacagtgggtagtactcagccttgctctatttcccccccccccaatcccagagctcgagtatgtgtccgatggcgggttctccgaggagtaggcttcgtccgtgccgtcgaggatgcctgtggagtggtgttcccgctgcagttcaagtcaaggcttagctcttgttgtctttcttttcttccgctgcatttatgtaagacttttatgatgtttgtaagacgtggatctgaatgtcaacattgtcgtttgtgtaccccggccggtcctggacggggattttaatgcacattctgcttga

SEQ ID NO: 86076 - DNA, 834 bp, Oryza sativa
ttttttgaggcagggctacggtttccctgcaacgtgttgttgccggagatccttcgcctcttccaggtggaacttccgcagctgagcccgttggcgcttgtttggatcgctatcttcgactaggcgtgccggatttccaggtttcagcctaacgccgagctcttcggcgccatatttttcgccaccgtgaactcgaagacggtgcgtcccagctggaacgaagaagacagtgttcgggagcgtgaactttaacgttcgtcccgagcggtccgatctctggccggtaaacgctgccatgtcgaagtgggactgccattggatggctaggtggttctatcacaccatccccttcgaggctggcactgactcggcgaatgcccaccgttgccgacgtagggcgatcgcgcctaaccggaaacccaagatcaccgtggacggcgctatggaggcgcggttcgttctgctgcggaaggtttgctcccgccttagctgccgtgacttattggaggaattctgtatgcttcgcatctttcccctctcccagtcatggcaagtcagagttgatcaaggcgaagaggttgacggtttgccgaacctggttcttcctgaggggacgaacagtaagactgttctcgtgctatacactgttgtgctttgttatcttgccttatctgactgttaacatagctacacactttacttttgcagcgttgaccctcgaccaggctgaaaacgaggcccgcaggatgatcggcgacgtgtcggtcatcgagtatagccagttgctaacacgacaagaggctgggcgggcgaaccgggtttacaacggcgaat

SEQ ID NO: 86077 - DNA, 3952 bp, Oryza sativa
agaaaaaaaaacaataataaagtcattcggataatatgctggctgatgtgatccctgccatctatttcatcataaatggaaaagattggtatatataacatgtgtaaaaaccgctacaatgacactgagccatacacaacattagcaactgctatattctcaaccgtacaagcagttataatacttgaaatgaaataaattgatattaatgttgagatatcgaccgtaccacacaatattctgccagctcagtttccctttgatgctctcaacctactgacaattctgaacttttactccaagaaaacgtgtgtcatgtccatttttgctatttatggaggaccaaatatttatgacaaagttaattaaggtttatgttaacacaacttaccaaaccttgtggtttaagataaatatttacactggaggtatgggtcgccaaataaagggctattgtttttattgttataaaagcaaaaaatataataatacgctaaacatgttggttatttttcgaattatacctgcttggactaaaaagaagagtgactcaacttgctaatacttgattccgaattttgaaatttttaaaacactaaaaagagtccatgatatttttcgatcgcttgttttctttaatgcaaactcccaacatgttttcggtgatgataatccacgtcatcagtggatataatccctccgtttgcatattacaggacgtcgatcggtttgttctaagtgaaagttcttcatgctagaccaaatttgaaaaagaactagtaacatctgtatttataacggtccatattccacaaggcaatttccaaatttttggtccacctgcaatttttggtaaataatttactgttttgaattagcaattttgtttctttagaacatcaattttgttcaaaattacccgatatgtgttcaactattaagtgttccgtctcaaatgttgggcccatccatcctcctgaaatgtttgcaattttgaaatataaaactctggcatgaatgagaacggggttaagattaggcatatttactatcactgccacagacctccttatcaccaacggttcaaagttgccatttgtaataggcaaattttaatgtaggccaatgagattttgtggttttacctcctacacatgacaacactacaagaaacctgttaatccatgacggattcttgttgacggattctaagactgtcactggtaggcgcgatctgtgatggttatcttattttcgtcatagatgtgcactagtggatattctcggcccgctaactcgtgacggttttatttggaccgtcacagtttatgattttaaattcgtcatactctagttagcccaaagcaataaaaaataaaacatatttagcgcaaagaaaaataaaaaatgtgattgcaagaagaatcaaacccaaaatacgatttgttaaatttgaacaaaataattttgttaatttgttacatgtatatgatgcataatatggcaaactaaaaaaatatggtgcgcatgggtaaaatctgcagcatgtgggatttggacccacaacttagctggaaggtaggaacgtgtcttaccatttgaaccacttgttctagatgtcccaatgtgcacttaaatatttttatttgtcccaatgtcactcgagagttggcgtttcaaaaatgaaaagagaactcgaattggtaaattacccatgacctcttgttgaagataacccatcctaccactgcgctagttgtctggtgtgttacggtaggattctataatttattatagttgaagcaaacgtcatagatttatatattgcattactagaaaaaatatattaaaggtttaaacaatttaatcaagtgaattaacgaggaaactaaaatttttctttaaaaatcattgccgcaattttttttaatattctacgtggtctaaatttttttctgaaattttccataaattttcggagcgcaataactaattttaataccataaagtttatttaacttattaaaataaataaaaaacaaattaaaatccctctctatgtccttgggcctttttcagcccaagtgttactcactccctcccatagtccgtatcccctctctctccttgggccggcttccccttcccctccaccttttcgggccaccggcccagcccatttgctcatctctcgctaagaagtctatttttcctccctcctctcaattaatttcaaaatattaaaacttcgaatcgatttttatggcactaaatcaactcgtataaaccagcaagaaaatcaactggattaatcgataaacaatttagttgacattatgtccttacaaccttcatttggaagtatagctgtctgcacttgcaaggaagtacggttatgaagaacgaaaatttagtttattttagactgaagattcaagagagaccagagttcatagagtcgaatggagaatgatcaagagcttggccgagttaatcataacgagtttgatcttgattaattagtctggtccaaaaaatgggcgaattgcgttgagagcaaatcaggaacaacgccagctatgcataaaggtaaaatatgacacgtaccaaagaacatgaacaagctgacctcgaacaaaagtacagaaggacgactattaagtggggatttttgcaccattcaaaatcagaaactcaaattcaactttagggcaacaaatttcagccaatttaccaattaattaaaaaaatatccaacttttaaataggagtggcagtgtggcacctcgcaaatgaatacattttcaacttgattctttcgtagggatatttgtgtatgactgcacctgccagaattcaaactcagtatcctggttagtgtaaaggctgaaagttcgcgaaatgaaaatttttaggtgtcacatcggatgtttgaccggatatcggaaggggtttttagacacgaataagaaaaataatttcataactcgcctggaaaccacgagacgaatcttttaagcgtaattaatccatcattagcacatgtaggttattgtagcacttatggctactcatgaactaattaggctcaaaagattcgtctcacaatttcccctctaactgtgctattagtttttcttttaatctatatttaatgctccatacatgtgtctaaagattcgatgtgatgtttttgaaaaaacttttgggatctaaatggggccttatactatttcctgtgtccaagaagttactcaatagacatttttcagaactatagaatatgatatttgccaagcaaagaaaaatgacctctggtgttccaataaaacagaggttgcaaggcatcagtcacacatctatctataatctatcatctatttataactatctaattaggcactttctacgagctcccatgttaattagaaagatcttatcgttaattagatagatcattttatcaccaccgttagattgaatatattatattaaataaggcatacaattaaataaattatgggctcattagtttaatgtcaccaagttaatagtgttgttttataatctcacgtatttcactggtgcggctgatttgggcgccgatctcaggattcggccagaagaaaattaaaaaaaaaggaagtctaacatggatccgatctaatatatctactccgtctgttctgttcgctaatgatggaaaaaactgcgaccatggcgccaccacaccgtgatttttcacttttgtgggctgttttaaaagcctgtcaaatcttatgtccaagggcacacatcaataatctatcttagatctatcttggagagtattaaccaatcagccaggcaaataaaatatggggacacgaggccacaagtggaacgagattgatttttccgtcaatcaaagattgatttttgtctgagacgacacagatcagaattcatccag

SEQ ID NO: 86078 - DNA, 1464 bp, Oryza sativa
acgtcctttcttgttcattattattgccagaatgaaggtgcacacttcgcctctgatagcggggggttgatggatgagatcttgaggccagctctacctttctgtttaataaacaagatgttagcacgttttgaatagcaatgttggtattgaaatgagcttattcgccattagcaacaacctcagggtcaaaatctttcacctctcttagaagtgttgacatgctgtggcacacgtgaaaaccacattggtctccgatctgttgtgcgcatgcgaacttggtgtcatggtaaagttcgtccttgccctccttgtgcctaccacccttttccacatatgggccccaagccatatttaaggccttggtgatttcagtgaaatcataatctttggacttattggagttaaggtaggtaaccctactccacttaggtacaatgactaggagaatccaatgtcgcctgcgcagtggttatgtagcattagtactaagaaccttaacttcaaaaatagtatacacgaagggtattggcctcttactcttggttgtgtgcgcacatgatgtactccttgtcttgatgggcccataaacaccttagtgaagctctgttgtaaattaacctcgttcaccatggaaggatcaaagaacccaacctgattaccaaggcgacgactcttgatccaacacaaccttaaaacatttacgtattagaactaatttaattaggagatatagtccaatcatatcacaagtatagaaggtatgcacttacaaggtgtagcattttagaagaccagtgtccaactttcggatcctgaaaaggtcaaagaggtcatcaaagcctatagttatataggcaggcgacgataggaacggctggtggtcgtgatgtccaactatggatgactccctcattttccgcttgccattgcttagctccatgtattgcttatgtagctctcggcaagcaatacccatcatggctaacacattgtcctccaccaatggcatgcctagctcaaattgggctggcgccctcacggccttccccgctttgctcagcggcatcgacgttgcagccttgcccctttttggctccggcgccaactccccgaccttccccttgccgcgttcacgcttcttgcctttgacaagtggtggggagctatcggcctttcttgtggtctttattggagccaagctttgagctatatttgccaagtccatatcagctccaccaggagaatgaggtactgacaatgccggtccacggggagcctcaattgatagcttagacttgggaggtgtaagctccgtcggtcgacttggacgaggagtcatcttcacaactatgtcttctttgggccattgtatgaacgtcttgcgcgcatcgcccaaagtcatgatttcatcattggggggcacgggcagcggatagcctgaacaggtgtcctttactgtat

SEQ ID NO: 86079 - DNA, 1381 bp, Oryza sativa
atggttttgagagtcgtgctcatcacaattaaggaccggttctcgagctactattgtgaaacattaaccgtgccacccacaagccagcgtgggcaccggctttaccttttgtatagcatggttcattgcggagcaccagactgagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccacggttatgggcgggttgagcaatgtttttcgtgattagtctcacacctctcacaataattatggatgttatagctggtaataatttgcttagctcctggtttggagttagttctgtacagccgggtatggttgttcaggatggttgggcctgtgcagcatgggtgtgttgattaaaatttctgattaattactccactgttttacttctcttaaatgttttgctaaatgctgcttttgcaaacgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttattccgctgctgttttcttttcttttgtaagtgtgtaacgttattattatgatggatttgtatattaaattgtcagtttgtgtacctcggctgattcctagacgaggattttatgcacaaattagttcggaaattattagtgaatttccgggcgtgacaggggagctgttcgactctaccccagtcttgttgtgactgggacttggggtaggagtgtagccgggggtgtcgacgcggtcttcgatcgcctcgtccgcggccttatcagccacggcctcctcctctttctcctctccttcctcctcgccgtcgcgttcttcggcgtcgtcctcgtcgttggcgtcggagtccgacgaagcaggaacccttcgcttcctaggagcaagcttcacttgtccacgcattcgctttcgcgaaggccctgcatcatcgtcagctttgtgggggtttggccgaggaggcaattcgccgtgtaaacccggttcgcccgcccagacctcttggcgtgttagcaactggctatactcgacgaccgacacgtcggcgatcat

SEQ ID NO: 86080 - DNA, 3362 bp, Oryza sativa
  unsure (1)..(3362): unsure at all n locations
ctgttttgtaccatcaacgattatccggcccttggcaacctttctggccaaactgtgaaagggaaatgggcgtgttcggagtgtatggaggaaacaagaagcaaatggttgaagcattcacacaagacggtctatatgggtcacaggagatttctcccaaggtatcacccgtataggaatatgagaaagaatttcaatggacacagagatacagccggacccccggcagagctaacagggatagaggtgcacaacttagtgatgggaataaccaacgagtttggaaaaaagaggaaagttggaaagacaaaagagaagagcacatcgaaggaaaaaacagaggagcatgtggaaaaaacaaaagacaaaagagaggagcatgtggaaaaagaagtcaatattttggagactaccatactagatggattttgaagttcgccactgcataggtttgatgcatgtcgagaagaatgtatgcgagagtttaatgggattactgcttaacccaggtactacaaaggatggtctcaatgcctgacgagatttggaagaaatgggtgttcgctcggcactacatcccataaccacggaatccggcagggtttaccttcctccagcctgctacactctctcgaaagaagagaagattgatttgctaacatgtttgagtggtataaaggttccatctggttactcattgagaatcagtaggctcgtttcactacaagatcttaagttggtaggaatgaagtcgcatgattgccacgttctctaatatgttcgcaatgatcaatagtatattgctgatgaaatagtcaaataaaaaaattaagtgaagcacccactagaagtgaaataaaataattaaattagtataaccattggaaataaaataaaaaattagtaaaataatgaagtgcaattactactgttagtgaaataaaataattaagtataacaaaaatatatagtgtatgtggaaatatgttaaggaaaataaaagaactaagtgaaataaaataaaataaaattgctgtaggcaaactcacctatgacgggctctaactgtggggccgtcacaggtgaactcacctgtgacggcccatagtttgggcccgtcacaggtgagtttgactagggttgacctagggttggacatcttctagatatcgatccagatccggcacccactctcactcactctctcaaccaccgcctcgcctctctctctctcaatccagatccgccgccctcctttccaccaccgcctcgacctattcaccggcaccctctccgccatctccggcgtcctccccaccgacaccataaactctccaccgccctcctcgacgtcgtcctcttaaccgatgcctcgacctctccaccgccgccgtccatctnccgacgcctctctgacttcatctccgccctctccaccgccgctgccctctctctacggccactgggacctcctctcagtcgccacaccaggaccgtcgtcgccgccaccgggatctcctctccgtctcctcctcagcgccgccgtgccaagaagcctgccgccgcgccaccgtgccgagaagccatgcgctgtgctcctccactgatcgtcgtctcctctccaggtaccgctctctctctgatgccgatgaatgaataaatgatgcaatggaatggatgaatgaatgatgaactttggatgaatgatgaactttggatgaacgatgaacgatgacttttggatgaatagattgttgcaactgttagttataacttgaatgtgtagctagtttgcaacttgaatgtggatttaagtgccattttgacatgtaaccattcatggagtgtgtactgctatatatgttgttttattcccttttgctagacctattaaattttgtggatcatgtttacatttagctgaaaaaggatggattgatagattggcaacagtgtttctagctaggtagggtagctagctagaaatagtttgtctagctagctagttagggctaatgtagttccgaggttatcaaaccatcacaaaatacaaaatgcatggggaattttggtggattggtcaatgtaatccatggaaggaaccgacctagacaccaaaattctccacgcattttgttttctgtcattctttgatgattaaggaactttgcagattatctaaacttgttgatttatatacccatttgttgaatgcattttgtagatgaataccctcatatacaaaatgcattttgtagttcctttgttgatttatgttcctctttttatcccttcatgcaaatgattgtaattgatgcatatttctgagcaaaactgaggccatatctttcatagtataccccgtattacattggatctaatgctatttagtataatggtaggaaatttataagctttttcgccaaaattagaccatgacaacgcccggcgcaaacccgcctccccaacacctgcgaggatccaggaagaagcaaacccagccacggagacagttgccgaaggtcatccctcgacaacggtggtcgaacaacccgaaattcatggtaatttataggacaaattttcaccacatgaccacataaattttagctagcaccccttagcaaatgttgccttctgtttgtgctgcagaattgccgcaggaacaacataaatcgatgttgggcgggacaagtgcaagtaggtcgagtagaaatccccggtcacaaaatatatggccgaccacagtgcaagttataagagaggttgacgctagtggtaggcccacggcgcccaagactgtcattggaagatggtctaactactgcgggctggcggcacgtgagaactttgggatcctccataaagatatcggcaaggtcacaaaagccgagaaagagcgagcttggacagcaacggagaaatggttcacatttccggctgaagcaaaggataggctcaagtggaaggcattccataagatgggtaaagcttggaagaattagaagtcgaagctcttcaccgagtttgtcaacccgcccggcaatcatatgtcgttcgatgaataccctcaaataaccgaggcggtgtgggaggaattttgctctctcaaaaacacccaagagtttagggaatcaagcgagacacatcgccaactgcaacaacgaaatgagcacccacatcggttgggcaccgcagggtacatcggcaaggaggcaatatgggcccaagaagatgcagccgctgcagcagcgaatgtccctgccccgttttcagacatccctgaacaaggagctcgcaactggtcgcgggcaaggggtaaggtcaacccggacggctctgtcacatttgagaacaaaagt

SEQ ID NO: 86081 - DNA, 3213 bp, Oryza sativa
tgattgccccaaggggttcgacttcaatccatcgagagaaatattccacagctacaattgcgaatttatacccgtttcgccccatcgggaagggcctaatgatgtccagtccccatctggcgaagggccatattggcgcaatgggctgcagatcatactggggcgcggcttggcttcggccatgacgctggcaactttcgcacttcttgatttgctcaacacagactttcaacacagtgggccaataaactccttgtctaaatactttggaggccactgttcttgcagcctggtgcgcgccacatagcccctggtgtgtctcctttgccatttcttcaccttcggaaaaagagatgcaacgaagtaagggttgaagtaccccggagcggtaaagctgacccgagaccatcttatacttcgtggctctgagttgcaaacgcttcgcttctgcttcgtctaccggaagccagccagtttgaaggtgtttcacaaatggggtttgccagtcatatgagtcttcgcccagtttctcctggtcgattaccatgacttccgagctgtccatgggcacacttggagcatgtaggacttcgaaaaagatgccaggcgaatgtgggccaccacaagcagcggatttcgccaaggcgtctgcttcctcgttctggtctctaggcaagtgttcgaccgttatgccggtgaagcatttttgcatggaccgaacaacctccagatacctcttcattccctcttcttttgcctcgaaggatttgtcaacatggcctgctaccaatttggagtcagtttgaattagcaggcgctggactccctgtgctttcgcctttcttaggcccaggagaacggcttcgtattctcctgcattgttggttgtgtcgaactgcagtcttgctgcgtaccgaatcggcacaccattcggcgaacataggactgccgcaatgcctgctcccctgtgcgaccacgagccgtcagagcacatcacccagaattgttcggtgggctcagggtcgggggcaagtaccggtgtccattcagctacgaagtcggctagcacttgagacttgatagcagagcgtgcaacaaaatgtaagtcgaacggggatagctctgtcgcccacttgctgagccggccagtgacttccttgcctcggagtatttcgctcaaggggtactgtgatgggactatgactttgtgggcctggaagtagtgcttaagcttgcgcgaagccatcactagggcgtaagcgagcttttccatttcaatgtaccttgtcttcgctccatgcagtgcttcggagacgaagtagaccggtttttgtccgaacccttttcgcctcccgccctgtttaccgcactttgctgcgggtacggtgtggcgaaggccaaaatcgcagcttgtgcgtgaggttgggccatggcattcgactgcccggctccaactggacgtacttgctgagccgccatggatgggtcaaaaattggctgcgaccacgtcgtggcagcttggattggtgcttggtttgttccgaagcttggagttcgttgccgaacggttggtgcctgagcagcattgacgaagtcaaactgcagtccttgattccatggcgaaactcccaggcccggctgaatcggtggcaaccaattaggcgcaccttgacttgtattcccctccgggtgggccgatggggttgtgcttgaaatgcagtggggttagttgagttgctgaaggaaagcttggagttgcgcctgcagagccgaagccccttccgccactgtttgtggcgcttggccaggtggttgatggtgtacttgggcagcgactggttgagcttgcagttgcatgtgacgggccggatgcactgctgcggccgattgctgcccggtgaagtacactggcacctgtgcggcttgtggcggaatgggctgggtcgtcacttgcggatggacttgaggtgtgacataacctgccgaatactgaaggattggagccgacgtggccttggtccgccttgccgcctcgtatgcttgttgttgttcttgcatttggcgaagcatgtcttggagccatgtcatgttctgtcgcatggcttccatgtcggcttcggcttgtgtttcggggtcagggctgacttgggcctgcacaacggcgagcgcagttggggctgctgccggctgcgatggagtggcttggggcaccaccagttggcttgtcgaaaggatctccgccctaatctggagtgcccttgccgccgcagccgccttcgccacgtcggccacgttcggcccctgcaccggacctcccttcgccgccttgcccgaggagaatgcaactagggccttcgccccttccaaatccttctgtcgaaggggggatgtcacatcctgatttttgtttcaggatttataaattatttaataaattattattagaatttatattaaatgttctttaattttcatgtgaagttaaatgtgggaaataaaatttcctaaatataaagcatggatggatttaatttttattaaattctccatggttaattatactctctggaatattctcggatttttcggagctcaattcctaaatgatacaaagaacagttcagtaattagttaatcaattaatgatctaattataattgttaagagcttttcttgtttaaaaatccttaaattgttgtttaaaaggaattattagaattgatcttaaaagcctaaaagagaagatctaattttaatttgctaaatctcaatataaaattgggctagacaaaattttgttaaatacttctcttgaatctttagttcctagatttttctgggatttatttgagccaagaaagtatttttaataaatggaattgcatttcatgaataatttaaattgaaaaaggtttttaaaagtctcttttggctttgggccgaaagccggcccaaaacctctctctttctctctccctccccggccgagtcggcccagtccgccgcgcccctccctcctctctctcagccgctgacaggcgggacccacctgtcggggtcgtcgtcctcctcgagccacccggccgaaccctagccaagccgcgccgccgccgctgcccttccaaattccgtcgcccctctctatttccggtcaaattgattgagggcaaatgatccttgagatctcctcttccttttctcttttggaaacat

SEQ ID NO: 86082 - DNA, 2710 bp, Oryza sativa
tcctgcagcccaatgtcacgctgcatcagcatcagtaccatatccatgtcacatacatggggccgtcttggcgtgacaggccgggttcgaaccaaatggcacggcctaccttgggagtttctcataaggataattctaccgtcttaagaagatatcagaggtattatatttttatataaaatttaatacctttaaatactaaacttttttaagtataaaaaatttttagtgtaaaatctcgatacctttagatattttctcaagtacataaaatttcttttgtcaaaagggttgggagttttcttctccaaaaccccctttccccctcatgcatgcgcctctccggagcaccgccgcatgctttcagcccctcatctacggcggctgtaaccaaacgaacaccctaccacgaggccacctcctctctacttctctagcacacgagaagaggaagcacctgtttggcatggtgaccccagccgtcggcgactgataacgaaatcgctagttagtgactagtcgcgcgcccttcttcccgcgcggatggacgcgtggcgcgcgtaggaggggagggggcgcggcggccgcgcttagtgggggtccacattggtttttttcgccgttttttggggggtttcatacgggtccttttttatgttttttcttttttttccgtactttcagttttcagttttctttttttttctgtttttcctttctatgtttttttagtttttttaaggaaaaagtacgaattaccccccccccccccggaactattccggtagtacgatttacctcctaaactacaataccggacatttgacaccccaaacacttaaaaccggataaattacaaccctaactcgattcgaaacggttttcagcctacgtggcacacacgtggcggtacagtcagcaaaaaaaaacaaataaaacaggtggggcccacctgtcagcatttctttttcactcctctctccccctctctctcggtgaacacagcaggcggcgggcgggcgaggagccgaccgccgacgccgacgggcggtcggcggcggggatggcggcggccggcgggcgagcgaggatccgacgccgacgggcggccaacggcggggatgactgcgggcggcaggcgagcaaggagccgacgccgacgggcggtcggcggcatggatggctgcgggcgggcgaggagccgacgccgacgtgcggccggcagcggggatgggccggatggctgcgggtggcgggctagcgaggagccgacgatgacgggcggccggcggtggggatggctgcgggcggcgggcgggcgaggagccgacgccgacgtgcggccggcggctgcgggcggcggacgaggagacgaggccggaggcgggcgggcgcggagggggctgtgagcagcggtagatgaggttggcgctcgatgaggttgcggcggtagagctcgaggatgctggccatggcggcctcccgctcctcggtctcctcgtcgttcgtgtcgagctccttcaccgcgaacgttgtcctgtgcatgttcctccccatcacgatctccctcctcgtcggcgacccctcccctccctcctcccccgtctgcccaagcgagccgtcgtcctcgcccctgtccgccgtcgtcgccgcatgccacgccccgctggctctgtgtctgtcacgcccagaaattcacaaataatttccgaacttatttgtgcatgaaatcatcgtccaggaatcagccgaggtacacaaactgacaatttaatatacaaatctatcataataataacgttacatacttacaaaagaaaagaaaaacagcagcggaataacggtctagcgatggcttcagctccgctcccacaggcggctcaactggggtataagccaaacgtcttctccttctggatcctttttcttcaactgaggtttgattgattattgcaaggtgagcatataacatactcaacaagccacacagcaaatatgcaagtgcacaaggataccaaaaaatggcataatatagggctcatttgcaaaaacagcatttagcaaacatttgagaattgtaaaacagtagagtaattaatcatcaattttaatcaacaccgaacaacacacccatgctgctcaggcccaaccatcctgaacaaccatacccggctgtacagatctatctccaaaccaggaatgtaccattccaaaccaggagctaatcaaattagcagttatagcattatttattatggtgagaagtgtgggactaatcacaaaagacattgttagacccgcccataaccgcgggcacggctattcgaatagttttactctggccagaggtgtaccactgtatccacaagacacagccccacaacatgtcaccatgcgcctcaataccaccacggtacctcagaaaggagctgtgacagtacccctcgcacaacacaatccaccacagcgcaccattcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgattaatgttttacaaccgaaactcgtgaaccggtccttaattttcacaagcatgaccatcaaaaccatgtgctcacaaccca

SEQ ID NO: 86083 - DNA, 2320 bp, Oryza sativa
atgccatacatcaattgatttatatggataatcaatacatccaaaatagtttacatcgtgtacacaataattacggcatgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtctgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccaaacggtcccctcgccaggaaggcaagttgttggttgatcgactcgttacccatgagatgttgtcgtagccacgcggggaaagtatcaatgtgatgccatgtaatccatgcatcggacttaccgatgttcctggcgcgaactagagccaagtgctcctcgatgtaaggagctaccaatgaagagtgttgcagaatagtgaaatgggctttacggaataaattgttgtctatcgtcgttattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctgaacgagcacggttacgaacatacttcttcagaacgcccatgtacctctcgaaagaaaacatgttgtgtaggtacataggcccgagaatacggatctctttcccaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctttatatgctggcttccaggcccctttccgaacactactttaagatctttaaccatagcaaacactgttttcccgctgcgatgtttaggcttcgtacagtggtcggccttatgttcgaagtgcttgcctttcttccgtaccgggtggtttgttgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcattaccaggttgcttggggccttgaataataatcggcatcattatgtacttcctcttcatgcatagccagggggggaggttgtagatacacatcgtaacgggccaagtgctatg

SEQ ID NO: 86084 - DNA, 2073 bp, Oryza sativa
ttactctcacgtgcaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggattactggctgaccatcctgccgatggtgttcgacattttcgttgagcctcactgcccgcagcgtgtgatgagacagttcggacttaggcaggtgtttccgggcaacgtgcagccgaccgtccccccttccgaccactcgtgagttcggattgttcatttcgaaatttttatgataattacatcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttccaacaattatttcatttatcttgcataatataggacaactactgaattttttattgagaaaattccctatctagcatcaaaaaaagttgctcttccccctgtagcatccaaacttcaaaagttccctatctagacaccctcaaaatttttattccctatctgacacatctgttgctcccattacctccaccgtcaaaacaagcttggacccacatcaaaattttttgacctcgctctttctggatcggtcccatccccaactccacgctgctgctcctcaactccacgccgccgcaaccctagatcgccggcccatggccggcagcgcggatggcgaccccctgggcggtgaggacggcgattccgcaggctcaggcaccgtttccccatgcgcgcccctgcaggtagtggcgccggcgacacgggaggctaggttgtcgcgggaggtcgggaaggcgaggcggcggtcgttcccggcgacggcgagcgggggggggagcgcttcttggcgatggcgacggcgacggcggtggagacgccgagctcccgcatggcgagggcctcctgcacggcactgaggcagacggctaggtcgtcgcgggaggccagcgccctgccagcacgggcggccaacccccggcctgctcggccggctaatcccaggcggtcgcaggcagccaggacccttccactctctccgctcgccaggttggttggttggtcgtagcatcttgtgaaacttgtttctttctgttctgctacacgccattagtggttcttgctctgtttgtgttcgatcgattgagcactactatgtgttcttcgttagatgctcagtttttgtgtttacggagatttgcttgatcggtgcaggtgatgagggcgatctctgcgtcgaggagggaggccatggcggcggaggaggagaaccgtgcactctcggaggcaaggatcgcgtcgctgtcgctgcagctcgacgagcggctgctgctgcgcgccgcggacgccaggctgagcggcttcaatggcttccgcggcctgctacgcgctgcacaacgccagctcgctgctgctcctcgtcctcacctccggcgccgtctcctgtgccgccgccgccaccgcggcgggccgtgctccgcggagggcgccgcggacaccggcgggttcatggcatccattgcaatgctgcagcagaggatggtggaggaaaaaacagtgaacagaggaaggggaaaaaacgcctaaattaccaaagaagggcaaaaccgtcttttgtcctacttgttaacaccgttaccctcaaaactaacggaagtgctagattgggaacaaaaattttgagggtgcttagatagagaacttttgaagtttgggtgctatagaaggaagagcaactttttttgatgctagatagggaattt

SEQ ID NO: 86085 - DNA, 1038 bp, Oryza sativa
ctggcgccgtcctcctgccaccgtggcgcacgcgaaccgacgtggcaggaggaggctggcgccgccccaaggaggagggcgccagcatggctggcgccgccgcctccattcctgtttctctgtatggagttgcaacggtgtcatttttattttattttttcggatgttttttcacactcaggatcacgatacaaccaaccacaaaaaaaatttaaactcgaactaccacttagctaagtttgaaaatatctagcataccacttagtctactttgcaccttcactaaaattagaccataactcctttagtaaaaccctttgatcagcatgttaaacataatgcactctaccactatatgaaattacttaatctaattcaaaatataaccatatgaaatgacatatataagttaaacagtacgtagagatgcaattttttatttttatttcatttttttgatatttttttcacacttaggagaacataggaaccaactgtataaaaaataaactcaaacagacaaaatatgtgacatgtagaattttccaaaactctaccgaaacggacaaaatatgccatctattaaaataggcataactttctcatacggactcggaatcaggcaaataatatatgcacggacatctatagaaaaagttacatccgattctcccccgctttgccgggttcgacgatattaaaacctccaaattccgcttgcaagattgtgttttcgaggaaagaagtttttcggtggagctttggaaaattccacatgccacatatttcgtccgtttgagtttattttttacatggttggttcctgtgagttcctaagtgtgaaaaaaatatcaacaaaataaaataaaaataaaaaagttgcacatctctctcctctgcactagttcggaaagagaggagaggagaggaaaaattatacatgtcacatattacgtccatttaagttcaatttttctatggttggttcttgtgtgtccctaagcgtgaaaaaaatatcaaacaaataaaacaaaaata

SEQ ID NO: 86086 - DNA, 1296 bp, Oryza sativa
ttcaaacggtcagactggcagatcaatctcggtcagaccgatctccgtcgaatttgagggtaacttttatttccgctaaaagttttcggtttttgggtataccgaccattcaccccccccctcaggttggcttagttcttgtgtttcaatcctacaatatcattgtgatgaaccctgagttcctcttgacactcaaggctgttgttggcccaatctttcagtgagttgtgataactacgatttgggagaaacgttgacgatccgactacaaccatacgagacgttgtgttgcgccttagcgatcaatacacctctccgtgggttgttgatcttgccggtgcagatcaaccctattcctgcaagcaaatcgaagaaacaagcaagaataagataaaagcaatctgatattgcaaataggaatttaatacaaatgataagttggggttccgaagaacaagcagacgggcgatctagccaacacgcgcgctgcaagcaagtagcaatggctaaactttaatctatcaaaacccgactaaccctggaggggttactagctatttaagggatggaggaggtcagaagggcgtcctccctctgtttggggcgcagccccccttgggccccacttgggccagagtctcagacgaagttacaggcccataggcccattacagacaatgcagccccttgtttcttcaattgcggttactgagatggaatatcacaatgaggatggattcgttggaaagaggactccgagagctttccatcaagtactcacgggccgaaaacagagctcggatggagatttggcagccgtttgaagtcagcagtgtagctggtggccgaatcggattccagcacctggaggacttgatcttgatatcttcttgttcatccatgatgtgaacaatggttgtatccgtagtagccatggtcacatcacatcgtcatgacatagagtaattgcatatgcaaacattatacctgcaccaaagcttctcacaaataagctagccggatattcagtataacatgaacataatgtaaagtaggtaatcatatactcggaaagtatttcaataccataaatgtatttagaagagtattctaataaaagtacaaagcttacaaaagagaagagaaatgctactagagccatacccgaactcttccgaaggcttctggactcctgatttctactatattcctattccaccagctagatactactaaactaaacttgagagaaatgagagagctattgcttgaggtgtgtgagtgaagtgagaagag

SEQ ID NO: 86087 - DNA, 1888 bp, Oryza sativa
tgcatcagccttctcctcattcgcgagtgatggaagtgacatctcaaacatatcgttcttctcattttggggactgttctgaacttcctgcaaaatatcagtgataggaggcacaagcatagcttgttgctccattgggttttccaaaattttgcgctcaacattgcaagcaagcatgaacaattggcctatatgattatatgtcacattaacaagcccagcctgaatattggaattaagccctctgaaaaatctagtcattgtgttctcattagattcttgtaaaccactataagtgatacaaattttaaaatcatgaaagtactccctaacagttttgtcaccttgttttagatgttcaaatttttcaaagagagcacgtctatagtatgaaaatacaaatctttttctcatcagtattttgtattcatcccaagtgtcaagcttatttcccacagtatgccacaaaaaagatgcagaaccggtacacttattactagcagccttaatcatttgagcattagaaaaatcatactcatcaaattgtttgtctactgctagctcccaattaacgtaagcggcagaatcatacttaccatcaaaaactggcaaattagattctacccttgcaagatcattatcatgtaccttatatgcgccatgtggatcacctgccatttgttgtcgaagatgaacaagtcgatgatctgttattcccttgcgcaatcctgtcatggttagtagcaaacaagaaatacacaagaatatgcacgctcctatcaactactaggtagtggtagctgaaatatcacacacactcaagcttttcaccaagctcttacaagttcttactaaagcaagcggaatggtgacgtacaccgactcaaccaagcaccccaatggaggttggatgtatcgatgccttggcaaacacttgctgtacagctgcaatcaaatctgtggagctctaggtaggcttaaatatgtagcaaaggaatagcaaatgctcaatgcagagaatgcaaagttgaatgatcgttcaaagtcatgtaccgtgctggtcctaggctagaacgtactagagacgcgagcctagacacaaacgataccacaagatataaacactaaagcacaactctgatatatgaaagcaaactcaaagatacaactgatttttctcttttccttctttcttctttcttttttttctttgttttcgttttcttttcttttttttggtgcggcttttcttttctttgtttctatgcacctttctgcctttttctctttcttttttttgattttttttacaaaaacagacttaaggacctcaacgtaaggttagagggactcaaatgcaaaagagaaaacccataaataaaattaaaactatacaaaaatagagtgctctcgtcccataggctccatttttgcaaacagatttccaatccgatactccaacaattttcacatagctatgtgagaagtcacggtgtagatcaaaaccgagagaaaaaaagagggagggagtcagactcgggagagggggagggaagccacacgcaggggggtgggaatcagctaaaaatctgcaaatcacgcatggaaggaaacaaagtccaaaaaccgatctgctatcatttctttctccttaaccgcgcgcaacagatcttcgtcctcacatgaacagaacaagcacggccgaatgcagacggcaaaccccatatgcaacttcagcaactacaagaccgaccgacaaaaacttctgaaaactagaaaaatgaaaccctgacaacaagacgattccgttttcctaggtcccggcgacaacaaacacacggcggtggcggcgacagtggtacgaaacctgaccagaacttgaaactct

SEQ ID NO: 86088 - DNA, 5210 bp, Oryza sativa
aaacaatttgatgagtatgatttttctaatgctcaaatgattaaggctgctagtaataagtgtaccggttctgcatcttttttgtggcatactgtgggaaataagcttgacacttgggatgaatacaaaatactgatgagaaaaagatttgtattttcatactatagacgtgctctctttgaaaaatttgaacatctaaaacaaggtgacaaaactgttagggagtactttcatgattttaaaatttgtatcacttatagtggtttacaagaatctaatgagaacacaatgactagatttttcagagggcttaattccaatattcaggctgggcttgttaatgtgacatataatcatataggccaattgttcatgcttgcttgcaatgttgagcgcaaaattttggaaaacccaatggagcaacaagctatgcttgtgcctcctatcactgatattttgcaggaagttcagaacagtccccaaaatgagaagaacgatatgtttgagatgtcacttccatcactcgcgaatgaggagaaggctgatgcacctacattatctgaagagggcataaaaggtaaattaaatggtgcagaaattactcaaggtgagtatgcttctgatgaattacatttttctacttttcatactagagaagagcaaccattagtggaaccaattgctgagatgcctttgtcacaagttgatttacttgctgttccttgtgatagagtagaggtgtgtgataatgcttcacttatatccatgccacaactagtgaatgaacatgctatttctagtatttctttgtgtgctgattttaagcatgttgttcacattgctaatgaagtaaaggaacgtgaattgctatcttctttaaatactttgggctatgttcagtttgatgatttttgtgagctcgataatttggaggagaaattatttgctaagactgatttgccatgtccaactaatgctatttttcatatcattggcgaatatgatgatagaggaatatgtttggtgcatagagtttatatatgttccgatttagaacctcctgtacatgtggataaaactggcaagctagagagggatgtaatttctaatcatattacttccagtttgtcttgttttgattggatgaaataggttgttttaaatcgaccacgcgatgagcaccatatggaaaaaccgaggacggttttccgtgaagaaagggaggatgatgtgaccatggctactacggatacaaccattgttcacatcatggatgaacaagaagatatcaaggtcaagtcctccaagtgctggaatccgattcggccacctactacactgctgacttcaaacggccgccaaatctccattcgagctccgttttcggcccatgagtacttgatggaaagctctcggagtcctctttccaacggatccagcctcattgtgatattccatctcagttatctgcaattgaagaaacaatgggctgcattgtctgtaatgggcctgtgggcttgtaacttcgtctgggaccccggcccaaggggggctgcgccgcaaacagagggacgacacccttctgacctcctccatcccttaaatagctagtaacccctccagggttagtcgggttttgatagattaaagtttagccattgctacttgcttgcagcgcgcgtgttggctagatcgcccgtctgcttgttcttcggaaccccaacttatcatttgtattaaattcctatttgcaatatcagattgcttttatcttattcttgcttgtttcttcgatttgcttgcaggaatagggttgatctgcaccggcaagatcaacaacccacggagaggtgtattgatcgctaaggcgcaacacaacgtctcgtatggttgtagtcggatcgtcaacgtttctcccaaatcgtagttatcacaactcactgaaagattgggccaacaacagccttgagtgtcaagaggaactcagggttcatcacaatgatattgtaggattgaaacacaagaactaagccaacctgagggggggggtgaatggtcggtatacccaaaaaccgaaaacttttagcggaaataaaagttaccctcaaattcgacggagatcggtctgaccgagattgatctgccagtctgaccgtttgaatgctgtcattctaaccagtatagatagatcggaccgaccgccgaaattgcctgccgcgcctgttgccgccgccggtctgaccgcctcgcccccgccggtctgaccgctggtgtgtcaccggtctgaccgccggtgtgtcgccggtctgaccgccgaaacccggtgaaacacaaatcggagaactcttaaaatagatgacaactttattgcttctctctgtgtttacaaagtgcaccaatagcactccttacaaaaatttcgactaaactcgaaaccctaacttaactctcagctcaattgctctcaaaagcgataccgggaagcctcacgctcccccactatttatacccgaggtaggcagcctaaagccacgaaccaaattcacactagaagtcctaaacaccttaggaaaccctctagtacaagaaacaaactttacataaccactcataccaaatttagacactttccaaattcgcctccgcatcccatacgcacacaatacctccatcgtatgccatatggaatcttcacaaaccacgtgtattgaactatagccttagtgtcccgcaagatctctgactaccacggacgtcgtcttatccctaagtcgactcctggtccatcaccgcaaatactctcccgaggcatcgagtcacctacacatgaaataaacaaagaaaccatatttcgagaacaagctatctccaacttgactcattagtagcaaacaacagtattacatacgtatagtatccttctagaagccataatcatgaaacaatcacggatatccaaacaaacaaaccaaaaccgaaaccgacacagagtcggccggtcagaccgcgggctgcgccggtctgaccgcgtgatacacgccggtttaaccgacaacacatgcccggtctaaccggaccagatccagcagtacctatagatttacctgtgaaatccaatcatctccaaaaccacttcgtgaataaattccaaatatcaaaaccaataatctccaatgccaattgttcatcacagaataacaatcaaaaacacctttgattttacaatctcccccttgaggaacacgttggcaaacccatcaaaaatgttttggtgtttggaaaaataaaaacaaaagtggtaaaaagcacacttcgtacaaatgtacacatcgtgcttgaaaatccaaaagaaaacttctctcacttttgaagagaaagaaattccaatcgaaccaaaaacaacatgttcttctcaacacttttgcttctccaaaaattttcaccttgcttctcccccttttgacaaagatttcatcaagcacaggaattatgttcattaatgtataagagtttagcatacatatagcatatcatgtcttgtgttgcgataaaaagaagatgaacctatctataatatagcaagcatgcaataaagtataaacatgaaccaaagattttacaattaagcttgaatcaacaatcaaaattcatgatttcaaatgatttataatgaaacatcttaacaagcacataggttgaagaataaacactaaacacatataacacatatacctattgcatttatcactctttctcaaataacctttagcacaaaacaaccaagaaaattttttaaccttttcttttcttgagcctttttgctcatatttttatcttttattccgggtacgtccctgtcgtcaagactgtttctatggattcggcacccattattttgctcacatcgaatacgtccttgtcgtcaagactgtttccaagcattcggtattcatttttttcatatttttattctcttttcacaatgagcaattaaagtgatttcaggaataacaattcaataaagcatatatatagagcatttagaaatcaaaccacatgctagcatcaacattgcatatttacttaattcaagtatggaatttaagtgtcatgcatcatctcccttaaaagcaaaatctaaatctcatgcaaagactagaatacatacaagctatgctagagacaaataaaccttcaaagtattgctagtatgcacaagaaaataccacatgtataaacaaagctctcttttctcaatttttctcattgacatatttttgctagataaaaccatgaggtacaaactccccctcaaaacatgccaaaaggatgaattattcccaatccaccacgaagaaaagcaaaacgattagaatccaaaggtttagtgaaaatatcagtaagttgcaactttgtgtccaaaaactgcaattcaacatctcccttctcaacatgatccctcaaaaagtgaaagcgaatatcaatatgctttgtgcgtgagtgttgaacaggattcttagcaatgttaatagcactagtattatcacaaaagagaggtactttcttaaaattaagaccataatctttcaaagtagataaaagccatagaatatgtgaacaacaactagcaacagcaacatattcagattcagcagttgattgaggaacactagattgtttcctagaagaccatgcaatcaataatataccaagaaaatgacatgttccactagtacttttcctatcaattctacaaccaccaaaatcagcatcggaatatccacttaagcatatagaagatgaagtagaataacaaattccaaactcaagtatatgattcaaatacctcattattcgcttgacggcttgacgatgtgaagcacgaggagaagcttgaaagcgtgcacacaaacacacagcaaattgtatgtctggcctagaagcagttagatacaacaaagatccaatcatacttctatactccttttgatcaacagcttcaccatcttcatcaggatccaacatagctgtagaaccaattggtgttgaaattggcttacaattctccatcttgaaccgtctcaaaagatcctttgtgtacttcgtttgatgcacaaatataacttgaggtgtttcttaatttgcaatcccaaaaagtacgataactcacccatcatgctcatctcaaattccctgcgcatagtctcagc

SEQ ID NO: 86089 - DNA, 17863 bp, Oryza sativa
cacaagacggaatgtatgcataccaaagaatgtcgtttgggttgtgcaatgcacccgcgtcatttcaaagacgcatgatgtctattttctctaacatgatcaaggatatcgtggaagtcttcatggatgttccacgaaattatcttcccttgttttggaactccgcggatggtgataagtgacggagggtctcatttcatcgataagaccttccgaaactttttacaagaacttggggctcagcataacattgccactccgtatcatccccagacaagtggacaagcagaaacaagcaacaaacaaatcaagaatattctacagaaaactgtcgatgagatggggaagtcatggaagaacaagctacctgatgcactttgggcatataggactgcttataagacgcccatcggcatgtcaccataccaacttgtctacaggaagacttgtcaccttccggtagagttagaacacatggcacactgggctatccagacttggaacatggatctaaaggaagccagacagcacaggaagatgcagctctttgagctagaggaatggagggacaaggcctaccacaatgccaagatttataaggacagaaccaaaaaatggcatgagaagcggattaagcccaaggagttcaaagcaggggacaaggtcttgcagttcaactcacgagtaaagcttttcggacatggaaaacttcgaagtaaatggatgggtccatgtaccgtcatcgacgcttcatcacatggagccgttacactgtgcaacaacgaaggtaacatctttaaggtaaatggccatcgtttaaaagttttccttgatccgttagaagttgatcgtgacttagatgttgtgaatctagtctcttttagcttctacccggagtctttaggtcccccttgatccgttagttttcaatgccatgagtccttaggcctccctctagttatcttaggtctagctttcatggataaaataaaataaaataaaataaagttggctccttggtcttccaaccaagtgagtccttttttgcgtcactctggtctttgtttttgttttttgtgtccaataaagcttcccagatacaaagacaagtgtggggtggtcttgcaagatcaccccagaagtgatgagccatgacaaactatacaaggaaaattgatgcagtcagacccaatgaggggtcagccaaacctccagttcggctgaaccacctctaccatgaatcgtcctctgttttatacagagcgcaggtttgcacaatttttcctttggacatccattctatcttgagcttaatttcattatcaattctaaaatatcgaacataattaaactcaagctagggatggtacaattagagttcatggtctacttgaaaataatatgcatgcctattattcttagctcattacttgttgctggtggtgatatatccaatagggaccccatgttatctaggtaattgatgaatgagatatagtctgatgatagaaatcctactcttcatgttgcacacttgggaattttataaaaagaaaaaaatatatataacgatgataaactcctcattgatatttctattcctactagagccataggttgatcagtcatgattagcttgctacatacgctgcttgtcattacattgagcattgtcaagttttgtgacccttgtgaaatgcgtttcatactttcatggtcaagatcacatgcattccacatacacgcacatatgcttgacttctacactggaagttagcatttctcatttaccgttcatttcatccatagttcacaaaataaatactccttgttatttatgcctcttcttccaaagttctttcaaaaaaaaaagagagatggcatggctatgcaaaaaagaaagaaaaaaaagtgctcatacaagtatggagcatgatgatgaaaaaaatagaaagaaagaaaaagaaaaaaagagatagccatgcactctccaaaatttcaaaagagaaaagaaatagaggaggaggtatacaaaaggagttatttttattttcctttttccactcacaaattcatcatacacatacacatgcacattcttgaccagaaagtatgtcttgcatttccgtggatcctttatttgactttgcaatatatgtgatacaagtaatgctctactcttttccataccctaagctctacataaaccttattagatggtaggaaaagaaaaggcacagtcatatgcctttgtaaggaatcatacactttgagtgatcaagagaatctattgaggagcaaagtaaagttataattttatgttacttgaaaaaacccaagttgttcttcatgaaaagttagggtgacttgagtcaagatgattccatttctcgattgtccaagattgcatggtcgacactacaaagatccacaagtacaaattgactccccgcaaaaaaaatgatccacaagtacaggtatgactttgaataatttgtttgcatgattattagtaaggaagtcataactttgttgtagagtccatagccttcactcgggacgagcaaatgttaagtgtggggatgttgttgacggtccttaaatcataatatctgactgtcaatacctacatataatgaaataaaacatggtatccaacgtagtggtaggtattattactaatcatttccactagtattggtgaaatatgtgtatgcgagtattttgagaagaaaacacatccgtcaagcgacaaactgcaccaccgtgcatttaggacacatttacacggattggaggccccataagtcaattaaataactccaaataggcacaactatcatgccaatgggctgagggcctcaaaattagtgtccatgatgaaaaacgggccgaacggagccgtcccgggttcggccgaacctccagttcggccgaaccattttggtggccgttgatcgccaaatttcacgtggacggtcctgatcacatcttaatggtggttctggggtagtttggtcatttcgcataggctgtaaccgtcatacctgcctataaaaggagcagctcactctcatttccaacacacaactttgagctgaattacaagaggctctattgtatcttttgtacattagaataaggtagagagtgaggggaagctctggaggagtgcccggaagcttggcgctcatccgacttctacctcaacgagtttagcttcctaggaggaattctagaggagtaccggagctgtcggtatactctgcttcgggttcggagaacttcttttataaagtaagcattcgtgtttctttcttctgttatttaattactttgtctaagtaagatagatttctatctttgcaggtttattgtttagtatttatactaagtgctctagtaccaggactccggataaagaaggaagttcctgtgcaagtattagagtagtaattaataacttagacgtggtgtctaggttagagattacctttgtttgttgtgtatcgcatggatttgtcagaggtaggtggcatgtggtgacagccttgaatcccttcctagtaatcctccacgttcggatacatcatagagctatagccggaaccacgctggcagaccagcaggggtcggtgctagaagcaatagataggaaattacctttacttagcaaaggtaattaaaaacacatagagagtcttctctagcctgcctaccatcagttgttgtccttggatagtctcagccttaggtagattacacacgttccctaagttcgatatccttttggggtcacccgaatgtgaagtgctacagcggtattccgtgcgcttgcagatttatctgtggtcgtaagaaatatctacatttggtttatttactccttgactatatgtttagtttgttcaactaaccacatagttaggggctacacctattaggtgcatttagtcgatgcacctaagtttacatttaattatttttcagccctctacactcttcagatctggtaaaagtactcgggagaccatagcgaagatgattgaaacacttagctttggagtaatctagttcgagagaagattatctttttgactgtgaaggtctcaggggctactgtgtatattgtgggtaactcctacccacacggcaaggttatctgactaattataagggatagcttagatctatggaatatgtaacggatcataacttgaatattacgtttccttgtatattacggaacggcctaaagtcctggtttgataatagatttaggaaacccttaccgtatttgttaaggtttttgtcgtgtaatcctatccccccaccccggtgctatataaggcaggcaggaggccctctacggcatgatttcacaaccagatcgtcagatcaatactacaccaggtggattcaaatccccaaacaggagtagggtattacctctcattgagagggccagaacctgtctaaatctgttgtctctgcattcatccagttttaggtctcatgcgctaccccctttatattgctgaaatcttgtttcgacactaaagatactgcaattctgagtccgtgaagtagtgcttcatactcagccacattatgggaagctaaaaaatgaatctacaaaacatagctaagtcgttctccagtcggggaaatcaatacaaccccagcacctgtgcctaatattctcttcgacccatcaaaatgcatagtctagtactccaattttcgaaggcgtgtcttactagcacttggtccactcggcaacaaaatctggcaaggcttgaggcttgattgaagtgggtggcttgaatgatatgtccaaagacatcaactccaaagcgcactttgcaatacgactagtcgcctcacgattgtgaagatatctccgagtggaaaagatgtgaacaccatgactaagtgactttgaaagtaaagggccaacttcctaatggtattagaacaccatataacaacttttgtacctgaggatatcttgtcttggaatcggccaaaacttcactaacgaagtagattggtcgttaaactttttgaacatggccctcttcctctcgctcaatgacaagcaccgaactcactacctaagatgttgccgacacgtattgaacgcgctgatgaagcctgaaggggggaggggtgaataggctgtccctgaaaacttaaaaacaaatcgcagcggtaaaattcaaatagacccggaacttcctggtaaggaactccagaacttccggcctaccaggcccggaacttccggtgttcttaggacaggaactttcgggttacagaaggaagatgaaattcaaattttgaaactggagactaagttaatcttcacaagatggtgaacatgtattctaagcagaggatagatcacagaatcatccacagaaacatcatagaaagagacaagagcgatttttttcccgaagttcggatcttgcgatcctactctcctttgaggagctccaaagagctgggtctcgattaaccccttgcctcacttgtgcaaaaaccccagagaaaatccacagccttcaaccccaaatacccctaggcaaatttctagaattgaatgaccaccaagatataactcaacctatttctagaaatccgccacaagtgtgggttgctctagttggaaagcctctagaatctcagcacaagaacttaattaacttacctcgttccctttcggaggagaggagatccttcacaaacttatccgggacatcgacaatatgcaatggattctcacgggcgacacctaactgtcacgcccagaaattcccgagtaggattccaagcagaatgtgcattaaaacccccgtccaggaccggccagggtacacaaacgacaaagttgacatatagatccacgtcttacaaacatcataaagtcttacataaatgcagcggaaaattaaaagataactggagctaagccttgacttggaccgcagcgggatcaccactccacaggcatcctcgacggcacggctaagcctactcctcggagaagccaccatctgacgcatactcaaactctggggtttggggaaaatagagcaagactgagtactacccactgtactcagcaagtcataccggaataggggtatgatgcagggaattatcaagggatagctacagaggttcgtttgcataaagcgagcatttataaacagtagttggaagcagtaaaacaattgtaacaattaatcaatattaatcttccactgtccaacgctacaccatgttgcaacaggcccaaccatccacctagactactcaaattcaatagactagactagggtgaaactaatcatggtgaatctggttgaccgcccataaccgcgggcacggctattcgaatagttttactctgatcagaggtgtacaactgtacccacaagacacagccccacgacacgcttccgtgcaacgacatgccaccacgacataccggatagaggccgtgacaggacccttcgcataaccccctctaaccaagcacaccacacctcaggtttcacccccactcctcgcaaggcagcggacagtcccctctcgtgcctaggtgaatccggaagccgcataggccgtcgcagggcctggatgcgtcagctagaggaaagctacactacaagcccagccgttgcccacgttggcttgtggtaagtacgaggaattcttccagggtttcccacaaaccggtccttaagtgccatgggcgcgactagcaaaaccatccacccacaacccaccatttaacatattttaatgaagcgacaccaggatggtggctctaatccaacatcaacactagaacctgaagtctatacattaatatgatttcccccattgtgtgctagttgaactaagcatggctaagcaatccctagtccaatatctagtcatgttatatcccaagctaacaaaggaacatggaacaaaatagcatggctataatagtaggtaaacatcccacggtaacagtataaaataatgtagtatttgaaagaaaacaatagagcatttgcaatataggatcaacatgttcaagtgacaagcatgacttgccttgctctgctgctggaggaacctcggcgactatttcaaagtacaccggagcgtcgggagagccggaatctaagcggcatacaaagcaaacaatataaactggctataagactactgaaacaaagaacaaaaccctttttaatggattctatgcatttttcttgatttactgagacttgaatgggcttaaagggagctcggatgaatcagatatgaattttagaagattcactgtgtttttactataacagaaaaaatccttaattgatttattgagcaataaataaatcccgggagagagaggggcggtgccgacatgcgggccccacatggcagtggctgcgagcgctggtccaggggaaaaggggcgacgcaccacgtggtgacatgtggcgccgacgtggcacgcacgtggcggcctcgtggcagccacgcgggcggcgggatcggatggccccgatctaccgcctggtagatcggacggcggatgcagctcgcggccggcgcgcacgggcacggctcaagccggcccggcggccatggcgcgcggcggcgaacggccggcggcggaggacggcggtgtcgtggcgacgcgggcggcgatagcgacggctaagcggctaggcggtggcgcggcggctaagcggcacgggagagagggagaaaggggaggaggggcctcaccgacgacgatcgacgatggcgagcgatggagggcgatggcgacggcgagacgagctccgggaccacctaagggatcaaaagggatgagttagagagggagagggaaaccatggatggctagggcggtgaccgaaggcgccggccatggcgaagctcaccggcgcacggcgcgtgcggggttccggcggcggattactacggaggaggggtggatgggacggcccgcacgacggcgaacgcgacgacgtcgacgacgcggctcggcacggcggctagcggcggcggcggcggcggcggcggcggagaggaggtcgatgacggtagggtggtggagtgcacgggagcgggcgattgcaaaacgaaaaagagagaggaaggaacgggggtgctttatatagacacacgagggttgatcgtggccgggagaccgcgatttcgccggaggagtggggagaggtggggaggagaaagaggcgggattcaaaaattgaatcctggccgtgtcgagcgctggcgcgggttggagagagggggagtgggcgcggggacgtgggcgcgagggcgacatgggcgacgtggcccggaagacgtggttgcagggcgcggcggtgccggctggaggtgggagacgggcccgacaggtgggccccacctgttggcgacccggggagagaggaggggggctcgggcggctggctggtccgtgtcctgcggccggcccagcagggagggagagagaagagagaatgggcctgtggcccattcgaaagagaaaaagggaaaaagaaaaagaaaaagaaggaaatgaatttttcccgggattaaatattgcttgtgctcaattttaattggttaaaattatttctggagctctaaaaattccactaaaaatcttgttagcgtatttcgacatgtagaactcaagaaaaaaaattccacatgccaattctgattattatttgcattgatttattagggtttactcttgcttttacaccggtattttcttgagaccatttataacttgaatttaggcttgggaaagaacttcagggtgtgacaaacctacccccccttaaacggaatctcgaccccgagattcggaagagctggtgaagaggtgcagatgggcggcctttaactcatcttccctttcccaggttgcttcttcttctgagtggtggctccactgaaccctgcagaacctagtgaccttgtttctagtccttctttcactagtctcaaggatacaaactggcttctccacataagttagatcttcttggatgtcaatatgctccgaatcggcttgttcttcgggtaccctcaagcacttctttaactgggacatatggaacatgtcatggatgccgatcatgttggatggaagttctagctgataggcgacttctcctcttcgttccaagattttgtatggtcccacgaagcgtggtgtcaacttgcctttcgtctggaaacggtgcactccccggagtggagtaacatggaggtacacataatcccctgcttcaaaagtcgtccttgtgcttggtcttgattacaacattgtccatgtaagcttccacgttgcagctaatatggcttgaaaaacatctctgaatcatgcattgataagttgccccatcgttcttcaaaccaaacggcatagtgatatagaaataagcaccaaatggtgtgataaatgaagtcttcaagcagtcagactctttcaggctatctggtgatatcccgagtagtaaaccaaaaagctgagtagctcgcagccggctattgaatcaactacctagtcaatgtgaggcagcccaaaaggatctttagggcatgacttgttgagatccgtgaaatcaacacacatacgccattttcctgttttcttcagaactagaactgggttggccaaccagtcgggatgaaagacttctttcatgaagcctgctgctaatagcttggtcaattcttccttgattgcatccttcatgtcctgtgcgaattggcggagtcgttgcttggtatgattaccgtattatttaacatttaaggagtgctcaatcacctttctaggaataccaagcatatcagatggtttccacgtaaagaaatctttattagcttgtagaaaggtgatgagtatgctttcatatttacaatcaatctctgtgcctattacagcagttttggtaggatcagatggatcaagggggattttcattgtctttgcatcgccttctccagtcttgggtagcttggtagcaggttcttcaccctcagctgatgttgatgcaactagtcggatctcctaaggagcgagtgctgtctcacaggtttgggccatctcacagctctccttatcgaaggtgatggcttgcttgttgtcgcttcgcagagatatgactccgcgttgtactggcatcttcatcatcatgtaggtgtagtgtgggacagccataaatttagctaacgccgggtgtccaagtatagcgtgataagccgtttcgaaatcagcaacttcaaaactgacgttctctgtacggaagttttcccgagtgctgaaggtaaccggcaaagtaatctggccaagaggtgtggatgacaaccccgggatgactccatgaaagggcgcaatactcggcttcaactcagttcttgggatttgcatctcgtctagagtcttggcgaagaggatgttcagtgcatcgccaccatcaatgagagaacgcttgagcttgattgtcggcccctagttttacaacacaggaaatcggatgcattttgttgaaaccaactccctggatcggtaggttggtacacacatcatacatcacatggtacaacagagtctgcacgattaagtcttacaatacttattgatacacgggttgcccaagtgggtcccgaataggccttatatggccgagtacaataccaaaaagtagagaaggggaaaaaggtgagcgtaagagaagctgcggcggtcctacgtctccacaagcatcgactggggatcactcctatggcgcctcctggggttcactgtcttctgggatgctctcaaacagttccgcagcgtcggtcaggtctaggagggttttcagaaagcaagagtgagtaccaaccgtactcagcaagccactaccacaacatgcatttagtgcactcaggaatacaaggaaggctaggttcatttgcataaagttaatttgcacaactcttttcacaaacctatgacttagcatttttaactaaaaacaacattaggttggagttatcattcaatctacgagggttcatcccctttccccaaagcctcgcttggtccggctttaccctcgcatgcagttttccctattcccatcattatcatgaccttcccgcccatcgggcaaggtcacaccactttccttatctaagcaagattaaaaactatgaggctagtcaagcatagtacaagtcccgatgctcattaaccgcaagcacgtctattcgaatagatttgatttactcacactgtagtggatgtatgcttttaatcctgcactccgcggcttgccaaacacataagtctagtcccaacacatgagacttgccacggcccagtttttcagtcatcctagcgtttcggcacccgctccaaggactattcacccccattgcacccccggcacaaaacaacacctcgagccggcggtgaggagagtcctggcgctcccgatatctcaatgggttaaattacatataggttaggtgcgttttagttttcccgggtaccatacatcacatcccttcaccttaactcacaacatacttcagaaccaccatgacaggggtgccgccccacgaggatttcttagtccaccaggtctatacccactcgagaagtgcagtcatactcttattgtttcctgcccaacttcttgactcagtctttaattgaccagggacggcggctagccatttctaggaccaccaatattctatccatgccgccccagtcgaaaacattttgttccattaggtttttggtttttgcaaagctttttgtgctgcgggtggtgcacatgtctccacccgccttctggcaatcactctcgatgagtgaccaccaccaacacatccatatccaactactatggagtgtataatcgtctatgaataagcaatattaagcaatgtcaataattgaccacgcataaataatagactcaggcaacaaggatataataaaggtaacaatatcaaggatggttcatacacaaatttaggtacgcattttataattagcatgcaactttatttataaacaaaacatttataaaatgggttcaacatgctcaaggaggggagcgtagtgacttgccttgttcagtcagtagttcggcttcgacaaactcgtatccgtcctcacacacgtagcctgatttgatcgggaaacggagaatcacagtctattctaagactagcggaaaaaagaggaaaaacaaataaaatagcagaaaaagaaaatgctaacccaagctcattccgaagggtttgggataagaagaattttagcgaaaggttcttcaaaattcgacttgagatgaacaagtggtggcccctaaaagatttggaaaggaattacaaaccacaggagagacagaggacccacatgtcagcccatgtggtcttttaacagccctaggcccatctgtcagccttgctttagtggcgcagctaaaccggagtgaggtggtgcatgtgggtcccatggattagtattaaatcggtaattagggatgaaaggaatgggtggtccccacctatcggccgctcaggcacctcccccttcttcctccttcctcctcggccttgcgcacgcatgagcggcatcgccactagggctgaaccatgccggcaacgaggggtttggaagatagggcggacagtcagggcgggtcctatgtgtcacatcctgatttttgtttcaggatttataaattatttaataaattattattagaatttatattaaatgttcattaatttacaagtgaagttaaatgtgggaaataaaatttcctaaatataaagcatggatggatttaatttttattaaattctccatgattaattatactctctggaattttctcggatttttcggagctcaattcctaattttaatcatacaaagagcatttcagtaattacccacatattaaattaatcattaaatggtctaattataattttgttaagtactttgagtgtccaagtattttcaggatttttcttggaattatttgagcattggaagtatttttaacaattgaaaggtcatctcattggttaatttatttggaaaagtaaataaaagtcctcttcatcagcttgggccgaattcagcccattccctcccttcctctcagccggctgaaaagtctagtttgcctcccttgcactacagtgctccttcttccagctctggacagagccagagccgtgccgtgcctgttgccgccgatccccttccaaaatccaacctctccgttgctcttatttccgaattggttgcgggaatggaatcctctcaatctcctcttcctagtccccaagaaatccccaaaagtttatatggaaatcctttccaatttcgcggttcaacctttcctttttccggcgaagatctaaactttcccgagtttttcccgtcgttgtgggctcgatcccggcctcccatggctatataaaggaccccctagtcgtcctctactcatcccctcaagtcccgtcttccgccgtcgccggaaacgctctccccacgctctccctctctctccacctccggccgccgctccagccgccattcgccgtcgccccggccgtcgccggtcagcgccaccacctctccgcaaagtcgagctctaccccagccacccgttcttttgcgccgaacccctccagaagtcgccgtcaccgtgaaggccgaaccgttgccatgttttgatctccggcgaagctttgccgtcgactccgtggtcgccggacctcgccgtatccactgtcggcatcgcagcagtgaggagaaacccggcagccacctccgcgaagacgcaagccatcggagcaccgtcgtcaccgtgaagccgatctgttccatcttcagtcgcgccgtttgtcgtcgtccgtcgtcgccctctgtcgccgtcgactccattgggttcgcaggagcaaggtgaagcccggccatcggttttttcttcgccgaagattgctgaaacgtcgccgccatcgctgacccgaccccgtcgccgcctctacctcgctgccggccgtctgccgtcatcttccatcgtcgcgccacccctcagtgagctttcctctctccgatgtcgttcaccggtgtagtttatccatagggtcttgatctaatctaatctatttcgcaggttgctttaatcttttatctcggttataaattatttgtaaattgtttaattaatttagaatagtcttttctttaataggtttaattggaattaaattttgtaaaattcgtaactaattcatatgaagtcagaatgaggctgttcaagtctcataattcatctaaaatcatgatttacatgtttgtttactttatatgtattgtttatttggtttttattagtctttttcctcgttttgcgtgttagcttgtcgtttccgtcgtttcgaaggttcgtgagtgcgtcgggagtgttcagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttcttatggccaatttgcattgcttaccctatttcttgattacctcgggttataatttgactagttggatttatatattggttcaactagatgttagatataattgcttagccatgcttagaaacattagcacactattgggataacttatgactcactattatttaatgatggcttaatgatagttcacgagggtcaatcgtgattggttaattaattaaattggtaattaaaatatgattaatggtgggttatgaggacatggttttgaaggtcgtgctcatagcaattaaggaccggttcgcgagctactgttgtgaaacattaaccatgccaaccacaagccagcgtgggcaacggctttaccttttgtatagcatggttcattgcggagcaccagactgagaagtggcggagataagcccacgggggtcgctgggtaatccatgccttgttttataagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacctctcacaataattattgatgctataactggtaataatttgtttagctcctggtttggagttagatctgtgcagccgggtatggttgttcaggatggttgggcctgtgcagcatgggtgtgctgttcagtgttgattaaaatttctgattaattactccactgttttacttctcttaaatgttttgttaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggattcagaaggagaagacgtttggcttataccccagttgagctgcctgtgggagtggagctgaagccatcgctagaccattattccgctgctgttttcttttcttttgtaagtatgtaatgttattattatgatggatttgtatattaaattgtcagtttgtgtacctcggctgattcctggacgaagattttatgcacaaataagttcggaaattactagtgaatttccgggcgtgacactatggaacctcccccgtgtgtgggtggcggcgtgtgggttatggtgctccgaggcgaccgcaatgcttgggtgcggcggcggcctatgcacacgcatcctggacaccaactcggcgacgatggtggggtgcgtgggtgatggtctgggggtcgggggaggtggtcagggactcgacggagtgtgccgaggttgagaggggatagcggggacgcccggaacgagctcgcaccgttctcacgctcaatgcggcggtggtggaatccggctcgtcgacgataggttgcaagggtggagaggaggtggcggggggatttgtgtgagtttggtggaggttggtggatggttatcccggggtcgggatgaccggtaatgaagagcaggtgactagccacgacagcgcgcatggccgaccggcggcatggcgagggtgccggcgaggggttacattaggtgccaaatgctgaggggtttatcgacgacgcgtggtaagtgtcctctggcacgcttacgtggttcgggacagcttggacggcggtagccgtttggtccgggccacgcatgtcacgaacagagccatggagcgcggcgcgtgcacatgcgtgtcccagtggcacggtcgaaccgacgaccagggaaacgccatgggctcagagggtaaggcgctggggacctaatgtccagccgctacggccagcaaaatggcagccattgagagttgcgggggtggcgtttcacccactagtggcgccacgccgcggcagcagcgacatcacaggaaaaaacgcggttgagcaagggaagggaagggaagggtgctcaccgcgcgacaaccaggaagcggcacaccgacgaggtaccggtcggtgtaggtcgagcgcgcatttcgtcctcgcgccccaaatgttcgaccggtgctagtcggtgttcgtcctggttcaagagaggttcgagggtgttcgagcaattagattgcaagttttaggtgattaattagcgttcaatcgttcgtccagttcatagcgcagctccctaccccccccatcttgctcaacctaagcttcggccggaggcgagctgaggcgaagcaagcggagcggcggtagcccaagcgcaaggagtgatagtggagaagaacgagagctagaggagacagagatagagatggattggggcgcatggcgcggagaggtatttatagagcatgggcatgtgccgagcggatgatggcgcattgaatatggcctccgagtgctgggctgtcgccgttgcagaggaatgttggggaggcggtggcaatgggatggcctccctgtgcagcagggcacgtggcggcgaggtgcttgaccgcgcggggacaaagcgacgcgattcacgtgacgccgtcgcccggggtagatgagccgccgtcgccaccaacctacaccggccggttgcgttgcattgatggtcgcggttgccccctctctccgtgccgttgagtggagcaccgagccgggcggtgtctttgccagagctgggtgtcacggcggcggcaagccaagaagagcttggggaagggcaagggcgagcccgccggcgagatgggcgtggtaggcgtcggaagggatggtggggctgggagcgtggcgccatgtgtgaccgcgtggcaaggcgttgcgcggagaaggggatcgagccccgtcctcttgtggtgtcggctcggctcggctgagctagggcttccaagccagcctcaaaaagaggggaaagaaaaggagagaaaagaagagagggaggagggaaactagactttttctgtgcagggagggctgagggaccagaaacagacttcactgatggtccttagatgaattgggtcagtaacagggggaggaaaggtagaggatggtggaaggtgaggggaaagttt

SEQ ID NO: 86090 - DNA, 11210 bp, Oryza sativa
cccttccccggcgattctttctccacgctcaccaacgaggtcattgatggctgccattaacatagttactcccggtgtctgttacgcgaaatcatcgtcgtcgttcccttattatgatgtgccttcaatccacaaaagctcagctccttcgttcttctccgccatctttgtttcatccgagttttcgcctctacgagattgtgcgttctcccacggggtccataggtactactcaaaatgcttccagttattatttgattggtagagtgctatagattcttcttagattcattttcatctcttcgttttttatatgtccagaacggtattccttgatgtgtcaccaacggccttcctcttgactgtattttgctgctcctgtcgatattcaatctgcagagataattctggtatgttacacttccagcatttcttacttcccccctttttttttactgttcagtttatattcagttcaagcaatttcctttgtgtgaatatgaataccttatatgtccacctgaatatacactttagttataccccctggatggtcactatatcccctatgtttgctctatcctctttgtctgggaaaaatccaatgattttgtatccctggttatagggattctttgtttgtgctgccgggtagaatggataatgcaccaggtacttctcatcctattgtacgccgtcgtggtcggccacgccgaagtgcctttattactcccatgccacagcctaacccaactgctgctgctgagtctcggcgcaggcataggcaagttatcgatgcaaataggaacagaggttggttagaatatcataattccttgaaattaatttatgcataatggccaagtagctcgcattataaatctcttcctttttatctagcatcaacctctgcagatcaacgtccagtgcgccaacggttcattggagaatcctctatttctaatcttacagagcaaaatgaaccccatattcatattggttccattccatcaaatcaatcattcaatcacagacgtaaggtttttttgggctcctcagatcttactgtcatgaatcattttatctttaaaaaaatcattacatttatgcaaacctttcaggcactatatatgaaccattaaaccttggtggcccacaccattcttgcgtgcactgcggtgccttcttttggtatgaagaacgcatacgtagagagaggcacacttcaaatccttcatgtaatttgtgttgtaagggtggaagtatcttgctgccaccataccaacctcctccacaaccattattgaatttgttgacttcacaggacggaactctttctaaccacttctttgatcatattcgtcaatataatagcatgtttgcaatgacatctatgggagctaaagtaaatgagtccataaatgatggaagggcaccgtatgttttcaagataagtggtcaggtctgtcatagaatgggctctttgctgcctttagagggtcgtcgcccagaatatgcacaattatatatttttgacacggaacatgaggtctcaaaccgaatcaacgttgcttcatcttcctgttctccctttcatgcaaaccaagaaattgttgccaacttgatagaaatgttcaatacaaataatccaattgttcagctattcaggacagcacgtgagcgattatctgtagacacatctaatcagattcagataagattatttggcaaaagggatgcacatggagatatttacagtgctccggttgcttctgaagttgttggtctaattgtgggtgatattggatcaactgatataggacgggatataataatacaagaccgttcttcaaatttgcagcagataaatgaaaaccattgcaagtttatgtcaatgcaatatcctcttttattcccatatggagaggatggttatcatgagaaactgacctacaatacaacagcacgtagtcaagccattaaacgcaccaaaatgaccccattggagtactttgcatataggctacatgatagaccaagagacttcaatactccattaaggtgcaaaaggctaactcaatcttatgtggtagattcttactgttgtgttgaagggagccacatatcacattatcgcaatccaagcttccagtctaaatacatatcatcgccattcaactcattgattaattctgtctcaagaggtcttacatccggttcttctgttggtcaaagggtaatattgccggcttcatttaccggtgggcctcggtatttgtatcaaaattatcaagattccattgctatttgtagaaagtatggttgtcctgatctatttgtcacattcacatcaaatccggcttggcctgaggtcagggaggctttagcacgaattccaggtcagaaaccatctgaccgtgctgatattgtcaatagggttttcaaaatgaagctcaatattttaatagatgatattaaaaaacgtgaattctttggccctattaatgctggtaatacttttctccctttgtttttttccaaacaataattttcccttaaacttccctgtgcaacactaatcatgccttacatgtcccttcaaatttttctttttacacagttatctacacaattgaatttcagaaacgtggtttacctcatgtccacatcatcatatggctggccaaaaaagaacccctagatgcaaaaaaggtcgatagctatattttagctcagtttccggaccctgcagttgacaagattggttatgatgctgtttgtaactttatggtgcatggcccttgtggtcctcacaacccttcctcagtatgcatgtctgaaggaaaatgcaccaaattctaccccaaagaattctgtgaggaaactactatattagaaaatggttttacacagtatgcacggccaaacaatggaataacttttaaaagaaatgaggtagaaattgacaacagatttgtggttcctcataatgtcgacttagttgtcaaatttcaggctcacataaatgtggaaaaagttaattatgatggtatgcataaatatcttttcaagtatgttacaaaaggatttgattgctcaagagttggattccactctaattcatcaaactcagaatcatcaagtgaaactataaatgaaataaataattatttggaatgccgttgtgtcactccaaatgatgctgcttggcgattgcagcaatttgacattcaccacacagatccctctatagaacgcctccctgtacatcttcccttcaagaataatgttgttttcacagaagatgatgatcttgaagaggtcattgatgatccaaacaactctaaatcaaagctgactgcatggttagaagccaatatggagaacccttcagcccgacaactaacatatatagaatttcctgaatattggacatggcacaataaagaaaaatattgggatggccgtcgtggtgcttctcgcagaattggccgcattgctcatgtcagcccttcacaaggagaagcttactacctacagaagctactgcacattgttaggggcccaagatcctttgctgaaatcagaactgtatcaggtgttgaatatcctacattttgagcagcatgtgaagcattaggtctccttggtgatgaccaagaatggtcaaatgctataaaggatgcagctcaatgggccttaccattccaactacgccagctttttgttacaatgttactcttttgtgaggtaacaaatcctactagacttttcaatgaacatatgtcatgtatgagtgaggacatagcatatcgtacaacccgtaacacttctcaggccagcagctccaacaatacttttgttacatcttctctccttcttgagttagacaagctgctaagagacgctgggtatagtttatctcattttaatttgccaatgccagatgatattgcaagtgtgtctgcacagaataggcttctactagatgagcttagctatgatgtttgtaacatgggatacaccatagatgaagaagtgtcatgtttaaataatagccagaaggaagttttcaatgctatctataattctgtggtcaataatgaagggaaaacattttttgtttatggatatggaggaactgggaaaacattcttatggactactttgctcaattctataagaaggcaaggaaagatagcattggctgttgcatcctcaggaattgcatccttgctgcttccaggtggacgcacacctcattcgcgtttcaaaatccctttggagattttacaaaattcaatgtgcagtataaagaaaaatacaaatcttgctgaattgatccaaaaaacatccctcattatttgggatgagtctcctgttaatcataagtactgctttgaagcattagaccggactctacgggatatattatctgataccagcccacattcaacacacaagcaatttggtggtataacagtagttcttggtggagattttcgccaaacacttccagtcatccaaaatgcaacaaagcaaaagattttgaaatcttgcattgttaattcttatttatggaatcagtgcatactacttcatttaactgaaaatatgagacttaactctgcatgtctttctgcatcggaaagagaagacctcaaaaattttgctgaatggcttttgagagtaggcaatggtgcagaaccttatgttgatgtcccagaccaaccaaagggcatgtttatagagatccctcagtctctccttctatctccagattgtaggaatttggatgggttgatttcttttgtgtacgactcaggttgtcaaacaacagatcttagatcgtacttatgcgagcgtgcaattttagcacctacaaatgatgtagtttcagaaataaacaacaaaatgattgctcagctagcaaccactgaaatgtcatactatagctcagattcaattgatgatagctgttccaaccataccactttagaggcactatatccaacagagtttctaaacacaatttcaataaatggacttctagaacatgtgttacacttgaaaattggtgtgcctataatgctcttgcgtaatcttgatgcatcaagaggactttgcaatggaactaggctgattgtcacacagctaacaaatcgtgttattgagggagagataatcacaggaaaggcaaaaggtacaaaagcatatattcctcgcatcattacaacatcagctcagtccaagtggcccttcaaattgagacgccggcaattccaatacgtctttcatatgctatgacaataaacaagagccaagggcagaccttgagcagagttggtctgtatttgccttctcctgttttctcccatggtcaattatatgttgcattctcaagagttacttcccccaagggtttgaaagttctaatagaaaatagccctgcttcttatgaaaactgcacacaaaatgtggtatatgctgaggtattcagccaaatatctagacacaggaactaaatatctaggtatattgtgcatgccctatcttatacaatgttttgtttcattctacttttatctacatattctgctcaataaaaataataacttagttatctaatattatttgttattgtttcagatttatttcgatggcaagctcagctacagcactcaaagatgtaactattggccagcaaaactgcaaggtttttggccgtctaataagattatgggatgctctaaacatgagatcaaaatcagcagatccattgatcagcattgatggaatcctattagatgaacatgtgtgtcaatctcttttgtcttacaccaaatattaaccattcatttacatttcgttggtctactcaatattaaccataacaatcttatgcatcacaatcttgcagggttccatggcacaaatcagtgtaccaaaaaagcttgaaaaacaatttcgccccttgctaaatgaaggatcagtctacctgattactaatactactgctgttgatgctagaagaaagacttatatctatcagcaccaaagctacatgatccagttcaaacacgaaacaaaagtgaatcatctggaatctagaggatcaaccataccaaaattctctttcagcttttgcccatttgatcaaattccaggaaaaaccatcacctctaaacccctcttaggtaatccttgctttttaatttacccctaaacacttcctattatacttgacattcttttaactttttccttcagatttaattggggtagtcagccgtattggtccatatgatttcgcgagcccaacatcagacaaaaaactcagaagaattcaaattcagaaccaagagtatatgtctttttcaaacattaaactgataattcaatatttcactaattgtttttatgctctacctttgtagagaacagactcaagaagtacttctatggggacaatacggagaatcatttaatgaagctgtaacacttgaaaaatcaaaggaaggaattgtagtagtcatctttgctggtcttactgcaggcaattttgcaggttcattccatgaaaagaatatgcctcctcacataacatacctacaaaatttaaacttatcatttaccacatacaattgtaggtaaaacagaagcatcttcaagctccgctactcaaattcatattgacctcgatataccacaggtggaacaatttcgctccaggtaatttcaatttaatcccttaaaactacttaaagttcaagtttcctgttcaatagttttctttttcgtatcaattatgatgccaacctatattgttgcaattttaagctataaactgggatctccaagccttcaacaacagctccctaagattgtacgtttatccccagttcaagcagcaggaaaaatttacaacttagaagaaatatctgttatgcctgtttcagcttttcaggtaaaactgaacacataaacaaccatctatattcttattggaattccatatttttcttcagacaacatataactcttataattttcttcacttaagggaggagttacttatagtgcaattgcaaaagtgtcttcaatactgtcatcaattaagtggtactacataggatgtcatcgttgtgacaaagggtacaacaatagttctgactccccaagatgtgactgtgcggtttcattccccaaaccaatgtcagcttctcaccttacattccaacaattaaaaataatatgatataaataacatatatgccactgactattttacaatgctttaggtataaactccccgtgacaatcacagataaatcagggagtttagatgcagtggcattttcttttgttgctgaagatttagttgagcttgatgcagcccaagcttctcagaacatgaagatagactcagttgaacatccagtaactcttaataaagccattggaaaaacaagactttttactataggaatgaatactgattcatcttctaagttccctatcagctatgtgctcaaaaggagtttctcaattgatgatactatgccaaatcctctgctgacatctgaaaaggttagtaaatatcatctgaagatgctatttatcattggttcaatatttcaactgaattagcttgaactatctaactaattcagttctccaagaacaaagatcaactccaactcccacggtcccaccacctatgacatatacaagtagcccaatgtttactgttctctcaattttttctattcatcatatccatataaaactatacttactaactgctaatggcaaattcatttcagcacaactattgataatacaggattatccaaagatagtacacctccagaatcatctgcagctgtcaacatatccacagaaaagaacatgtcagaattacatattctaactacttaattaaatacatgcatttattcattaaatctattatatatttcagcagcacatctacaaaacgaagcattgatttcagtgaggactccactgacaaaactaaaaggtatacctctactgcacatagctcatttagttatttaaatttctcagttacagtttatcccttgcaataattttcttcttcatggcagtatcaaacaacttgatatacctgctgtcaaacgtcagaaggaagagtacgtacttctaacccaccttccaaattgcaaagttaaactataatgctaattccaatttcttatgaaccatttcaaacagcaaaaagctccaaccagcaaagaaggataagctcacacagaaatctacatgatatgcatggtacttgctctttacagtacttcagatacaatacatcatcatacaagcaaatcttactatgattcattctaatacattgtccaacaaaatttgcaggtcaatacatcgtatacaacttaaagcctgcagatgcttccaaataatcatctctgttggttactatttccgcaatcatcatctattgtaatttgttttcgttgtcagactatatccaaactaaatactctaagtgcttccaaataatcatatacattgattactgctttcttaatattgatccatcccagtttcctttcattctaacaaaactttcgtgtaccctatcatataatcaaagtaatattcacatattgtcttactttaaagtccttttgctttcactacaaactattcttctaaattttttctacaaggttccgcagcaacgtgcggggtaccttctagtaatactatacaagtgatccccacttagtgtagttattaggattttgctgagttctggtgaagccacgtcacccttttaatctcagtcgttcgatcagttgctacagacggtccgatgtattccatccttccctaagcgtcgcctccctcctccaccgagcgcggattctccgccgccgccgccgggcgcgctcctctccccgcgtgcgctcctctcctttccccaccagcccccgcgcgcaactcctcccttccccacatcgcgcgcgcgccaggcgcgggcccggcgccgactgctcttgctcctttccccaatcgcgcgcacgcgtcaggcgcgggcccgccgccggccgctctcgcatccccgcgccgcttctcctccaaccctctccccccggcgcttcttctccaatccacccccctctagcgcttctcctccccctccccccccaatctttgtttcatccgagctttcacttctgcgaggttgtgtgttcttctacgggattctctccccggcgattctctggccgcttctcctccctccgtatatctattgagtcgagtgatggatgccacaggcgatttgtgttcttgcttcctatcttcagtccctgcatgtatcgatcaaaattgaggagtttctatcaggctgtctgctcctgctgctgcagaaacgagtgtaaggtaaatttctccatccaatacgtatctctgtttgataaaatgcccacatgtatcctgtatttcaggtagacaagtagcatcagccactaggcatcatgattcacttttgagtttccatttttatggtgatcttctgcaaacgacttttgaatatatatagttgtccaaagatgcagcctatggatacatgttaagacattaaggtaacaagtgatatgagcaatgtttgtctccctaaatcagtattcatgcatcgttctagggtgggggatatttgccaataatttctttgtaacataaaacctcaggattataagttttagcctgtattttcctaacattgctactaatattggatgcaagatatagtatgattcaacacgtcaaatttgagtcaattcatggtatttatttggtttccactaaccctgttcatggtatataaatcaaatttacaactttgctgtagctataatttgttgtgtttataaatttatattgcagttcattcccattcctattgtctactatcattgtagcagcagctatgggctatcactgaggtcagtctccataacattcccatccaaagcagcggcttatctggtttctccatatgagttctctatcaagaaaatatcccaatatatttggtaccacatattcgttcatggtcaccgactttccagatattataatacaaccatcctatgatatcttctttgtaagaggtactaagcaattttctcctttgctgtgccattatcctctcacttcaggtagccgatatcatcttttatattttactcattcattcatttatttgttctttttatctcttgctagattgttagctcaggttaatctttgttctcccccctccccctcctataaacaaataaccaaaagtttgtttggaagattcagtatcttcggtaagcagaggtggtcaaagttacattctacctggatggccactcgaggaaaattggcctcccctttgatgctaaataatatatccttacaagtttgtgatcccctacctctctaccttcccatttcatctgtttgtcactaatgaaaattatgatggtgatttcagaacattcaagggatttgatctatttcacatttctttcagatcaatataactccttttcatcgtaatgatataatggcatcaagtgatttgatcaagcacaagaaagagtgctactgctacagtgcggagttacatatttgatttttggcatgttcagaacttcttttgaccaatttctatgttctcagaattttgttaccatcattcacttagtatggttactgttcttgatgaataccttgtgaaaaaaaaaccatggattaagccttttaccttacggatttcatgcatcaaatattgcataatttttttatttcatcgaaaagatataagctctactacgataaattcgtcagttcagccgatgaagtttgcaatattgcagtatgaggtaaaatggatgtttcagtggattcagtcactgaatttcacttccttttgctaaaaagtaatttgaatacaacattttttaaaccatataatacaatattaatgttttccttgcctcataaatattagaattatcatatatttgtttatctattttcatatcattttgcagtgccacgtcctatataggttggctttgcgcaaccttttacatcgttgctcgattcgtcatcacattgttagctgggggagctagactaatcttatg

SEQ ID NO: 86091 - DNA, 646 bp, Oryza sativa
cgacgacgatgccggccggcgtcgtcagggagaagaagagcgccatcgtcaccactgacttgacacggaactttgcctgcagaaacaagaaagaacaggttatattataagttattttaacttttttcttaatcaaacttatttaagtttacctaaatttatagaaagattaaggagtattaagaaaaccgcagtaagttttttgagtgaaaaattttcagatataactataatataattgaagtgaaattacatcgtaaccacactgcaactgcgctgtaactgtaatataacttatataaaacttatattctactatgttttggttagcatcaagttcttacgcgtgagatgggtgaaaatttctttctaccaattattttccttcatgcacaaatctcaatgcgatctgatggccacaaatctgaaagttttttgggggcaaaaaaaaacttgcggaagttttctagcaattccgaaaaattattaacatctacaatacgaaattaatttcattaaaattaacataaaatatattttgataatatatttgttttgggttaaaatgttgttatatttttctataaacttagtcaaattttaaaaagaaagttaaaacgattaataataatataaaatagaagga

SEQ ID NO: 86092 - DNA, 702 bp, Oryza sativa
tctggcttgtctgccctctctccactccgtggcagttggttccaggactagtggccgtcttccagggcctgcttacctgagcacctccgcgacagcttcgactccctagtgctcctggtctcttggtgtctatggaaggagcggaactctagggttttcgactccgctctctcttcggtcacagtggttttggagtccgtccatgtggagggccatctgtggtctttagctggcgtcgctgcttttggggatttgttgggagtttagcatggcttagccccttcccgctgcttggagtctgttttagccaccgtaatttctgtaagcttcaggttttttttcttcttttactttttcttccttcccttagcataagccagtctggctgattgcgtttgtttaactaaaactcttttccttctaatatactagcaaaaatgcccgtgtgttgcaacgggtgaaaaaaattctaatgataatatacgtttttcatgcataatcatgtcaatgacaatgtttgtattttaatgagcgacatgcttttttataaacgatgtttttttctcttgcgcgattttctcaaaccatttttcaaaaatggcgcatttctttctaacattttttttcctagcatgttctttttgctttttttttactgacgacgaaaaccatatttgggtaccgagctcgaattcgccctat

SEQ ID NO: 86093 - DNA, 1551 bp, Oryza sativa
cctttcgccaaccgcccactcgtcctttcgcttctcgaaccctaatattctcgccacctcacactgtctcgtgctccacgctctccatcacctcttcgccggttgccatggcccaagacaccggcgacgcagtgctcccttcctcttgcatcacggcagacaggcaccttagccttccttgcaagatcatgccgggcggtgccgtcgtgcgggcgggagagtcgaggccgtggccgcgatatccggagcgatccgtgcacctcttgtccttcgccatggtaggcttgatcccgctgttctccagattcttccatgaagttctggatttctacgaaattcacgccttgcatctcgcacctaatgccgtgatgacgctggccatcttcgcggatttgtgcgagatgttcattggggtgcgaccgacgatttggtggttccaggccttctttatcccgcagctgctgcaaggcgtagaggtggggggatgctacttccagccccgaccgggcacagcgggccagtacatcgagagccacctccacaagaaatgggaggactagaagaaagactggttctacaccgcgttgccggaccatccgcgacttcgagttcccgctggccctcccgaaaggtctgccgcatggttggcgacgtcggagttgggcgaggaatacgacgcggtgtgggatcgcctcaggggcctgcggagcctaggcctcacgggggcgatggtctttggcgattacttccgccgccgcatcgcacccctccaggaatgatcccgtggagcgtgggaatacactggtcccaacgaccccatgcggacgcatgtgggcgagcgctgggactggggtgaggaggacacgaagagggtgattcggcgggtgctgggcctagactccaccgagccaacactaatccctgatgggattcttcccctctgctgcgaccgctggtgagagctcactagtgaactgggtaccgttgtctgtaatgatacggttgggcactccgaatcgagacgtgatgcccctgatgaacttaagagcagaatgcttgtcgattttgacgactgggtaggcctcgggccacttggtgaatttatcaatggcgacgtacaagtgctgatacccgccttgagccgccttgaacggtctaaggatgtctagcccccagactgcgaaaggccaagatagtggaatgacctgtaagatttgggccggctggtgggtctgcttggcgtggaactggcatgccttgcaccgctggacccattcttgggcatcttgtaatgcagtcggccaataaaaaccttgccggaaggcttttccgaccaaagttcgtgaggccgaatgggctccgcactcaccctgatgggcgtcggctatgagctcgatgccctgctctcgagaaatgcacttcaagagtatcccattcgcggcacgccggtagagggccccctctacgaggacgtaccgcttggagatgcgcgcgagcttttcagcttccacgcgtttctcagtagggtaccgagctcgaattcgccctata

SEQ ID NO: 86094 - DNA, 2178 bp, Oryza sativa
cactttcacaccggagaagggccacccaaacgccttcgccttcgtcaacggcatcgaggttttctcctcccccgacctctttggcagctccaacccgatggaggtcaccggcgacggcagcggcacgcctttcccgatcgacgccggtactgctatgcagaccatgtaccggctcaacgtcggcggcaacgcgatctccccctccaaggacacgggcgggtatcggtcatgggaagatgacacgccatacataccctttgcgtcattcggggtgagctacgcgaatgacaccaatgttcccataaattaccctgacagtattccgcagtatgtggcgccggcagatgtctactctacggcgcggtcgatggggcctgacaacaatgtgaatttgcaatacaatctcacctgggcaatgcaggtggatgctggttatcagtatctcgtgaggctccatttctgtgaaatacagtctgggatcagtaagatcaatcaacggacatttgacatctacatcaacaaccagactgcttttagtggcgctgatgtgattgcgtggtctactgggcttggcattccagtgtacaaggattttgtggtgttccccatgggttcagggcctatggatttgtgggtggatctacatccaaatgtcaaaaacaagccacagtactataatgctatcctcaatgggatggaggtttttaagttgcagcttactaatgggagccttgctgggctcaaccctgtccctagtattgtaccaacagcgtcgggtggaaattctgggaagaagtcaagtgttggtccaattattggaggagtgattggaggtctggtagttcttgcacttggatgttgctgcttctttgtgatctgcaagcgtcggcagagagcaggtaaggattcaggaatgagtgatgggcattctggttggttgccgctctcactttatggcaactcacacacttccagctcagccaagtcacacactactgggagccatgcttcgtctttgccatccaacctgtgccgccatttctcatttgtggagatcaaggctgcgacaaacaactttgatgagtccctcctccttggcgtgggtggttttggtaaagtttaccgtggagagattgacggaggagcaaccaaggtggctatcaagcgtggaaacccattgtctgagcagggtgtgcatgagttccaaacagagatcgagatgttgtcgaagctccgccaccgacatcttgtgtcgcttattggttactgcgaggagaagaatgagatgatcctggtctatgactatatggctcacggaactcttcgtgagcacctgtacaagacccaaaatgcaccactttcttggaggcagcgcttggatatctgcattggtgcagctcgtgggcttcactacctacacactggtgcaaagcacaccatcatccaccgtgatgtgaagacgacaaacatcctcctcgatgagaagtgggtagccaaggtttcagattttggtttgtccaagactggtccaacaatggatcatacgcatgtgagcacagttgtcaagggcagttttggttatcttgatcctgagtacttccgcaggcagcagcttactgacaaatctgatgtctattcttttggtgttgtactgtttgaggtcctatgtgctcggcctgccttgaatcccactcttgcaaaggaagaagttagcttggctgagtgggcattacactgccagaagaagggtattcttgatcagattgttgatccccacctgaagggaaagattgctccacaatgtttcaagaagtttgcagaaacagctgagaagtgtgtttctgatcagggcattgaccgtccttcgatgggagatgtgctgtggaacttggaatttgcccttcaaatgcaggaaagtgcagaggagagcggaagccttggatgtgggatgtcagacgacagcactccccttgtgatagttggaaagaaggatcccaatgatccatctatcgagtcaagcaccacgacaacgacaactacctcgataagcatgggtgagcagagtgttgcaagtattgactcggatgggctgacgcctagtgctgtcttctcgcagatcatgaaccccaagggacggtgaggtaacaatgtctcggcttgttaccctgcaggcataat

SEQ ID NO: 86095 - DNA, 10221 bp, Oryza sativa
acacaaatataatggattgtagagtactacttgcccattcaaccatccctcatgtaattttcacccaatcttacttccaaccacctctcatttaataaagagcatcacagtcttttcccttcatccttaaaatctctccaaaataacctagaatcccttatatcatggacggaggagtggttatagctgaactatcaatcgatacttatcagtaaacaaatctatgctgatttaagctcaccatattagcagggagttactatacattatctttcttcatgctgcagttataagtgagaatgcttgtttttatgttcttttcatttctactatttggtcatttagtgtagaagtttcattttttgtctcatgcaggtacacgaaaagagaagtccataatcttgcaaggttcatctctgttatcaagcctatcccactgagttggaggatggcacatccttatctgctagtcgatagatttgaagatgtaactcctccagaaagtgtgcgcttgaacagaaagtgtgacaggaaaataacattgtatggctaccttcgtggctgtaacatgaaaagagggacaaaggtgttcttcatcatctctggaacttaatgttaaactaacccagattctactttgtagcagatagatgttatttaacttgttactttacttaatgttagtacatgattttgggtccctagttgatcttatttgaacagccttagtaaatatgacaaaattgagggtgaagataatgacatcttattttacaggaagcatgaatttactgccaatgaacctgatgaatcttcaaaaattttttaattttgaaaaattagctaacagaatgtgtggcactatctacattaattatgcttcagtctggttggcaaaactgaagctaattacttttcctttctgtgaggagaaattctaagttctttcatgtctgactatagtgccctaaacttttggatagtaaaacacacaattatctgtgcaggtacatatcacaggggcaggtgattttagcttgtctggggtaacaagtttggcagatccttgcccattgccatcagctgcaaagaagagaggactacgtgacaaggaaaagctgttctacgcgccaatgtctggccttggtgatctactgtatgacacagatgcagtttatataaacatcaatcctcatcttgttcagttctcaaagactggtgagaatgatgcatctaaaaagcaaggtatgtttaaagtataaaccattcataatgatactaggcacctcattccttcatcctctttgcatttgaagtttcttgaagtatgttgtttaggacgataaggtcctgaggactgtgcaatgcacaaacatactttaatagacaagacccatcaagttgaaaactcactttacttatgttttcttgtctatttatttctttggtagagtggtgtgcaacctgaaagaatgttttggcgttgaaagtttttcagtgttttctgagcttggattgcaaagcaaggcacacactgttactgttacacctgttccttgtgcctggaagagattttagcaaataaaagaaaatctaagagttagatctttaacagattatttgtctatttacctttatagtatctgtccggtttcatatattcacatttatcatgcaattttagcttgccatcaaaacacaagtaggaatatgtatcagatctatcatagaagaacttcctacaatagatgcacgcttgtgcttgaatggaagtaattttagttttgttggctagaatcctgctctagctttttttttgtcttctttatgtatggccatcctttgttgtttgctagattactgacttatcatcatacagggaaaggacaggatgttggtgtaaccctagtaaaaacacttcagaaccccagatattcccttaatgaaaagttggatcagagttttataaatttatttggtagaaagcctgctgctcagtccgaagacatctctggcaaccagaatgatcagggagatgctaatattttggaagaagcagatggtaataacatatgcaacgcaaacacattggagagcaatgatcattcttattctgagtgctccagcgatagtgaacatgataatgatgaagcaactcagcaaaatgaccatgaagttggcttgagagaagaggtggaattttgcaatggaaggatgaggagaaaagctgtatcagctaattttaaagatgatgacgatgatgaggtttttaccattttcctttgttcttattaattaatagttctcttgctctcacattcttttttttttcttgctctcttactcttaagttccctgtttagttttgttttgcccgatgtaatccatccaggaaacacatggctttgcatcactactccagaccaagaaatttgacataaaacactatgcagctgaataacattatgttagcacagctattggccattcctaagtcaccagttgtagttcatgtctcaacatcatttgaagtgtagaacaatgatattttttgaatacttatcatacataaatattaatgttaaatatttacgttaatatttaacactaaatatttacttacaatatctagtttgttttagcaccgtattaacataaatatttgcaatgtgtactttgatttctagtacaactcactaatattacttacagatacatatttggaatagttagaagaacacgttttattgtaacccttgacttctagcacagcttctattcgcctggtatacttccaaattacctcattgcgatgaaccatgaaccatgatgtggtactttgcttttaattcttttacatgtctacagattttcaatttcaagcttttaaaggtatttcaaccttggtctaccttgtagggtgcggaagaagatgacgttgacagtgaaaattctggtgatgaccagttatctgaaggttccgcagatgacagtgaagaatcacttgattcaggtactactttgcacacacgcacgcacttactcacttggtgtaacatcttttcgttgatggggagcaaatagagtcttgctactgttaatttagcatatacatgggatcccataggcaccacctatatctgtacccatcacctgtgatccactcgacctgcacataaaatcatgttgctattttatttgctgaagtagttagctctgcaactgaagagcatttgtgtttttcaaatctaaaactcttttcttttggtattctagatgatgaaactgagaacaattcaaagtggaaagagtccttgcttgctagaacactgtccagacggagtgccaatctaatgcaacttgtatatggccaagcttcaaagaagctggatgaaggaaatgacagtagtgcagaagagagttcagatgaagaattttttgtaccaaaaggacaaaagaaggtaatgatgtgctaatacagaattgaaggagaagttatcctgcactttgactgcaatacacactactcatggcatttatagttaagatacatacaggacaggatatgattttacccttcctttgctgtataggctaacattgtatattcccttatctatggtcaaaggaactgaaattagctaggtgcattgttaggtttcagatcatctttgttctttcttgtactacctccatttcaggttataagactttctagcgttgcccacattcacatagatgttaatgaatctaggcacatatatatgtctagattcattaacatatatatgaatgtgggcaatgctagaaagtcttataatatgaaacgaaggaagtaataatctgccttttaacttttttttacaaaggtgggtagactgcttggtagttaataagaccacagagccctcctagttttttttatctgaaataataaaggactgctttctatccttacagcaagcaaagaatgaatcaacaagctttgatgatatggatgctgaggattactccaagttttttaaaactgagctaagagattggtctgacgaagatctcatcaagagcattcgtgaccgtttcgtgactggaaattggtcaaaagcagctctaagaggacaggaaataaatgaaaacgatgtggatgacgaagaagtcgatggagattttgaagatctggagactggtgaggtgcatacaagcaaggcatatgaaaatacttcaggaaatggaggtactcacaagcaagatgaccttgctatggaagaaagaagactcaagaagctcgcacttaaggcaaaatttgatgcagaatatcctttcttacatttttgaatgttttttttcttttgtttgttgtcaaataatttgctatcatttaaaaggggaattgcttttatggtccactctgcactgcatgtttaattcttcttttgctgccccttagacttggttttttttgtctccgtggcctgttttcttttccaggttatctagtctaagttctcatttgcttttttgagcgtacttcactgcgtgcacttactttctgattccttaacttaaacctacatatgatggatctgatctctccggtgaggaagttgataatgacacaaagaaatcgaaacgagaagaaactaatggagggggctatttcgataaggtatgtcatagaatcttttgcttttgttttgttggaactcttgtattacctggttattgaaccatcacattttgtaccttttcagttaaaggaggaaattgaaattcgcaagcaaatgaatatttccgaactcaatgatttagatgaagataccagggtagaaattgaagggtttaggactggttcttacatcagattagaggtacatggtgtgccgtttgagctagttgaatattttgatccttgccatcccattctcgttggaggcattggccttggtgaggagaatactggatatatgcaggtcagctattttaattttcctctcctatttgctgtatgaaaaagttcagtgttcagtaattgtaggaaataatggatgcagcagtgcaacatacatgcatcgccattcagtgttagatcagacaatttttgcttgatagtttaagtggttatgacattctgggattttaaaatgatgcatcatataggagtacatccttacttctagctgtcaatatgtaatttaactatgaaataatgttcttgggcactccctccggttccatattaattgacgttttggacaaggttaaggtcaaacttttttaactttgaccatcaaactttaaaaatatttagtttaaaagaactagaacgacatatatagatttttcttttaaagcactataataaaagtaaacatgcatttatttattatatatattatagtagaaaaataaggtcaaagatatatcttgtagaccgtgtcattgtccgaaacgtcaattaaaatgaaaccggagggagtaccttgttgcttctaagctagatattcccatgtgaattggaaggaaaatttaaaaaacaatctctagaccacttatttggtggacccagaataaaacagtttatgtgtaacatattgataaaatataccaagtataacagtgtttctttgaacgttatgataattcaagtggatattatgttgccagtggattgcatttaccttttttcacacttcatacaggctagcctgaaacgacacaggtggcacaggaaagtactgaagacaaaagacccaattattgtctctattggttggaggcgtttccaaacaactcctgtatatgcaatagaggatcgaaatggtcggcaccgcatgctcaaatatacacctgagcatatgcattgctttgctatgttttggggaccgcttgctccaccaaaaagtggtgtactggcagtccagcatctctccaacagtcaggtgggttcaataatttatattcatttgtccatatattttcagtgctgctgcttctgagcaaacatcataattgatggcgctgtcagactagcatcttttaggacttgcttagattcatctagatgcagaacctccctagaatggatattaaccttattcttccatttaccttgtagcattcacatttactctattaaagtgtttgcgctgacattctctttcccaatccttgcacatcaggtaccatttagaattactgcaacaggctttgttcaagaattcaacaatactgcccgaatcatgaagaaaatcaagctcacaggtgtaccgtgcaagatatttaagaaaactgccctagtcaaaggcatgttcacatctgacttagaggttgctaggtttgagggtgcaactattcggacagtaagtggaatccgagggcaagttaaaaaggtaatacatgagatcctatgctctttttctttaacaatgcatgccaacaatgaatcaatgcttgtacatcaacaataagtcccaaccatatgaaattaagtattatttctcaggttcacttctttggccttctattgaggccttgtttagttcccaaaaaattttgcccaaaaacatcacatcgaatctttggacacatacatggagcattaaatatagataaaaaaactaattgcacagtttgcatggaaatcgcgagacaaatcttttgagcctaattagtccatgattagccataagtgctacagtaatccatatgtgctaatgacggattaattaggcttaataaattcgtctcgcagtttctaggcgaattatgaaattagttttttcattcgtgtccgaaagcccctttcgacatccggtcaaacgtccgatgtgatacccaaaaattttctttccgcgaactaaacacaccttgagtacaatatgtacggtataattctgaaaataagtaacaaaaggactccatgagagctatgagttgataattgatttgaatctgtaaacagattattgataataataaaatatacagttgccattttgccatgaaagcacccccccctctttgcagtatatgcatgttagcagaatggattttatttagtcaatgtgtgctcaagtaattattttgggtgttaggtcaaggaaaacgaaagctcgatatggatcataaactctgaagcgtatgtatcgataaatttgggtaattcaagtgtgcgcattaaaacaaatcttccttttattacaggcagcaaagattgaaccaggagatatgccaaggagaaaaggggaaagtatagacgggattgcaaggtgcacatttgaagacagaattcttatgagtgacattgtcttcatgcgtgcatgggtcaatgttgaagttcccacctactgtaaccttgtgacaactgctcttcaaccccaagatgagacttggcaaggcatgagaactactgctgagctgcggagggcacataatattcctataccgcacaacacagattcagtttataaggttctctgagcgtcgaaatcttttgtgtttatttttcttaatatcatgctcatatcatgttatctccaaatggcagcccattgagcggaaagtgcggaagtttaatcctatagagatccctgcaaaactgcagcatctacttccttttaaatctaaaccgaaggatacgcccaagcatagaaaaacaccagtggagaacagggtccctgtccttatgcagcccagtgagaagaagacacatgcagccattcaacagttaaggctgctaaaacatgagaaggtattggtcatgctacagcagcttgttctgatgtcaatcgctgatataatgtgtgctcattatttgcccgatttttccaggcaaggaagaagaaattgcaggatgagaagaagaagaaagcatatgaggcggagaaagcaaagtctgaacttctaacgaagaagcggcagagagaggagaggcgtgtgaggtaccgagaggaagataagcaaaagaagcgagcccgcagataactgaaaatagtaagagacctgcaggcataatgagtcccagaaatctcctgaggcacatcatccagagcatatggttgcttcaaactagctcaagttgccgcctccagaaaaaagaggctcggattgacagcagacgaggtctgatgcctcggcatatcaagctggagatgcagaacaacttggtataatctgggccggattcaactagtagcgtcttttttatgtagctaaccagttttgctccaccatgctgctacgaaaattttgtcatccatgtaactgatgatttgtagctcccaggtgaagtgggagtgaatatgttaaattatcaatcttaggacataacagttgcccattttcaggcctattataattctagagctaggggacactgagttgtcagcattggatttattggtactactgtatgacaaggacgtgattttgataaatttggttcccgttctgctcgcaactacatcctgtacagtttggcaacactacaaaagcagagaagaatttcttctgtgtagctaacagtaatggatcggagggtactggtagagatcatgtgtagttgtgctcctaatcctatcgctcatctgtcattttcgtccctttgggctaggagttccacggatgtcaaaagcgacccaactcggatacgagagacgggaaggtagtgacggtgcgtgtcacgcttcctaacgttcccaatgcatgttagtcggacccacgcggcggccactaccttcccctccgcgtcgatcggccgctttggacggccctgattacgcccatcccggaacattttagcggagctggtggagcccatctcctcgctggttggctagattcggctggctcacagctttgcattcggcagctaacgccacgcccactgactcgtgggcccgggatattggccccacctgtcacagactatcgcgcttgacaccactgtccacgcaataataaacggaactgtccacgttaccagcccgcattgaataacgctttgtcctaggtacgccgtgcgcggctgggcaacactcactgacacgaggcccccacccccaatagccctcaatagccctcgcacatgtacgcgaccgcgccgccgaggaaaagctttacaaaaattccaagctggaggaaaacccgcagccgagcgcacaccactgctagttgcacacaccgcgcggtgcgagctgtcgtccacagtccacacccaccaccgtcaccgcggtagcaaaccccccgagccactgctcacgtgggcccgtggcgtccccagacccaccggccagtgggcacgcggtagcgagacggctccagcacgacgcggtaagcgagcgagcacgagcagtagggcggagtaggtcgccgttgccgttgctggtggcctctcccacttaatgccgcggccgtaatcccgaagcctcacatcacacccccccccccccctttcctcacgcgagctccccctccaccaccgccgccgccgccgcggctgccactctcggttcctcttcctccccaccgagctccaccccccacgaatcttagcctcccactcctcttcacgccgcgccgctaagagcgatcgagccgggggtttccgtcagagacgccgcgaaaatcgccccagatcggtggatgggcgatctgtgagccgcggcagggggagagagagagagagagaggaagctgaagccatgatggtgagttctaggtttgtggccgtgcttcttctggtggcgctggcgccggcggcgcgggggcagggaggaggagggggcaactcgagcgccccggcggcgtcgccgccggggccgttcgtgccgcgggacaacatcctgctcgactgcggcgcgacggggcaggccaacgacacggacgggcggctctggaccgggaacacgggctccaagtacctgccggcgaacctcgccgccgcggccgccaccgcgcaggacccttctgtgccgcaggtgccgtacctcaccgcgcgcttctccgcggcgcccttcacctactcgttcccggtcggcgccgggcgcaagttcctcaggctccacttctacccggcgaactactccaaccgcaacgccgccgacgcgcttttctccgtctccatccccgaccccaacatcacgcttctctccaacttcagcgcctaccagaccgccttcgccttcaacttcgactacctcgtccgcgaattctccgtcaatg

SEQ ID NO: 86096 - DNA, 12941 bp, Oryza sativa
  unsure (1)..(12941): unsure at all n locations
cacatacagatcgctgtatatgccgccaggtatctgtcgccacggcatggacctctcccccctcgccgttgccatcgccgccgccaggtcatcgccgccgccaggtcgtccccgccgtcgctcggtaacatttacttttaaaaaaagaaatgtgaaatgtgcaattgtggattgtggattgtttaattgtgcatcgtggattgtgatatgtgcaattgtggattgtttaattttgagaatgtttaattgtggattgttaaatggagatttatgtttaaattgggacttatgtttaaattgggacttatgttaaattgggatttatgtataattgggactttgttaaattgagatttatgtataattgggacttttgttaaattggcagctatgttaaaatgtgacttatgtttaagttgagacttatgttatattgggatttatgtataattgtgatttttgttaaactgagatttatgtataattgtgacttatgttaaattggcacctatgtcaaatggagatttctgtttaattgtgacttatgctaaattgggacctatgttaatttgagatttatgtataattgggacttatgttaaattgagatttatgtataattcggacttatgttaaattgggacttatgtcaaattgagacttatgtgaaattgcgttaaattgggacttacgtaaaattgggacttatgtcaaatttttttacgtcaagttggaagatgtcgaacgaaaaggttccatcgaacgcaccaatagcgcctcaagaaggtaacgctcctcaaaattccggtagcaataagcatccaggcgcttctagtgaagaaacgtggcgcacaccaagtgacccgtttccaatggaaataacacaagtcgccccccgcgatgatgatccggactacatacctatcgaacaggccgtaagtgatgaaaatcgttagccatgtattattccctaactatgatgtgacatgaacctaatggtgtatagagttacctattctgtgcagatggtagtccgacgccgctcgaaacgtaaagccgggaggaacaggacagagcaagaagttgagatggacaccgctacgtctgcacctgaacgtacggagacatctacaagtgcaggcgggagtgggaaaaaaagacgtggtgagagaagcaagaataaattacccaaggaaacttacaacgtgattgctctcgatcaggatgggaagcccatcgagccaccgatagtgcggtccaagttcagcaacgcctgtggcactctagtcaggacgcgttgtcccattaatgtcaagttgtgggaaacagtggacgacaacatcaagacacttctctggaatgagttgcagaagtattttgtgttccctcctggatcagaggtcagggggagagattacgcacttaaaaagatgggagatcgatggcgacagtggaagtccgatctaaatcgggattatgttcagaagaatctcccaccgtttacggattatggacatatatcgcaggctgactgggacacgtttgttgcggatcgtacaacagctgaagcattggctttgaggaaaaaaatgtccgagctcgcgaagaagaacaaatatccccatagattggggtcgagcggatacgctggtcacgtcgatcaatggcgggagatcgagcaaagatttgccgcggccggtaagcccctgctggtagaccccatggttgaacgtagcaagaactgggtttgggcgcgcagcacaggtcaagtctcggatgagggagacatactattcgagactccagacatagaagaagtgactactaatttgcagcagatagtcgagaaagaaagatcaggacagttcgtcccacggagggagagagatcagcttactgcggcgttggggacggctgaacactctggacgtgtaaggggtttgtcctcaaagacaagttggaaggtcgggtttccacaagacgcaccaagttataagaagagagacaaatacaaagaacaactatcggacaagatctatgcgcaagtgaaggaacacttctactcgttggcagctgaaaacccgacagcatttccaaggttattccctgatagccagcaacccacacaatccgcacagcaaacaactaatgtacccagcagtgtaggctcagtgcagacaagtaccttccctgtggatagtataactggaccaactccgtgcagtctcgtcgtaccaatcggccgcgctggaaagactaaggaggttgcaacgggtttagcgatacccggacgtcaattccacaacacggcaatccctgaggattacgcaagggtacaggtcgccaaggtccatagcgaccacgtttccttggaactagacatacctgcacctgaggggattgaacttctcggtgatgcagtgaatcagtttatcttgtggcaccgcagagacataatcctgagcgcggccgttcttgcagcaggatcttcaaccccatcctcatcgcaggcaatgactgctgccgctcctgcaccaccgtcgcctcctgaaccaccgtcacctcgacatccgccgtcaccaccaccgcttaggtcaccgccttgccaacctacaccaccacccttcccttctcaacaaccgcctctcccgaccccgcaaccagttcaagcctctcccacctccccaactaaacagcatgctcccccggctccgccctcagttcaaacctctccacctacaccccaatcttctctggtagaagaagtgcacataccagatggtactacatccgaaccaaagtctaatactttggaacctcgtcgtataattccaaagttgatatcgacatacgacccaaaggagattgacaaggacaaggagaagttcatgttttcagctttcaggaattctgagaagagaaaagaacttgctcacgtcttgtcagactcccagaagtcagtactagcggcccaagatgaagtgcaatcctggttatctgccgatgtgcctgaaacttatgagtatggcaagccattcttgccaacttatcttatgaacaagctaccatgggaaatgagggtaatgcacgaatggtatatgaaggcatctaggaaaggtctcggtttcataagcgtcgccgtcccggaaggcgctttcatgagtggtcctaatgggatattttttatctctttccaagacctttacgccctctacaagctagataaaatggacgttaatctcgttgcggctttctgtctgtaagtctaaactctttattacatgttgcacgtttcattcgaaacaaataaaccaaatctcatttcttctttattcattgtacagtatgcaattccacgaagctgatagaactggagcaaaggttggatacgtcgatccaacaagaatatgcaaaacacaacacaccgtagagctgagacaggactgcgagcaattggttggcaagaccccggaagaaaaggaagaatatgtgaagacattgcacaagaggaagaagctagaagtagcaacatacttggcaatagcaatgttggcgcacgccgacaaagatgtcttaatggtcccctaccagttcacgtaagctctctcttctttttgtttaattaatttatcttcttcggaattttctgtctccaataagcctatcttatatgtagagaccactacatattattccttgtatatccgaaagaccaattgatcatatcattggaccccgcacactatgacaaggagacatttatggaattcctcactattttgaatttgtaagtgataaacatttcattactataaattgtttaggtcgatcaccagtcttctaactactaataaaacaattgtttccttcaaacagagcacacaagtactaccgcaaaagaggtggaccagtacatattccatcccagaagaagttatccgtcaggactggctggccggtactatcaaatttataccaatacaactaattatcgaatagtacatatatactaaatatatctactgagatcggtccccataattatatcgcagtgctacaaacaaccaccaggaaccaacttgtgtggttattacgtgtgcgagatgctcagagtaaatgggaggtacaaaacaaccagtaaccgagtaggtcatcgaactcttctctacaaagaaacccatctcgcacacacttctcactgagtaccgttttattttcctttctgtgtgcagatccccgaaatcccatatattgcacaacgattcaaccacactactatcttgaacgtggccgctgacctctgccgattcatccgtcgcgatgtctgcaacgcaagaggtctcttctacgacaaccagagtgaactcgcaatggacgacaaatttaaacctctcagagagtgggagaaagaacatatgcaataacatgtacactacttatacatatgatgaaaaaactgtgccacttgtattatatatttgtatgtaaattacgattgaattaatggttatgtattacatgtttgttactgcggcacttgtcgtatcttatatgcttactactccgaaatacgataataaatctctcaataatttcatattaattacgaatcaccaaaatgcttgaataaagccgtcttaagtgaccgcatgcgaagatcaatcttcgcatgcggctgcgacggccgcatgcgcaaatggtgatctttgcagaccatttcgcgcatgcgggccggccaaccgcatgtgaagatcgattccgcccgtatgcaaaaacgctttctgtagtagtgcgagatgcactatgcactatgttatataccacagagatttctgaccaaatttgttccggcgtacaactatgttgtcttcctaacacgtcgacaccatcattgaaatgctggatgggattagcttcggctgagcggcgttggcgtggtcggggcgcaagacgtggccgctagcgctgcgtgcgtggcgcattgcaacgactgcgaacatagaaaaaataattaatagggacccaatacttaactcaccacccgtgcatgtaaaacggaccgatgtattttcttataactaattaagtatttattttttaaaaaaaatagattaacatgatttttaaaattaagcaactttcatatagaaaatttttaaaaaaaacgcatcgtttaatagtttgaaaaacgtgctcttatataagaagagaatgagttggaaaatgttgaggaaagaacgccaagccctattcgatctctcaggtgagagtattttttcagcatacgcaaaacgtgaaaactcattcgtatataatttattattaataaagtattaattatttaaaatttaatttttaaacaactcccatatagaaacactttaggtaaaaacaaattatttaacaatttgaaaagtgtgcttgaaattgagagtacgaggaaaagaactgaacctaatatgtatacgagatagttagctaggatttaatagtttcccaggaatcgtgggatccgatcgaggaaacatagggtgtgtttggatcctcgcatccctttatcctggctcatctctttcatctaggctgagtttagtctggctgagaggatacatatataggtgtttgtttatttgtattgatttaaccagggtagcatgagatattggtttggtttactgtaccggacggttcaaaagagatcttgtttgattgattgtatgaatgatgaattgatttttttttctttcagggtgagattcctacctagaactcactatttccaccgctaaattcatatgataatttttagagaaatttatgacggagcaaaagtacaataaaaatatcacagtgcttattactgtgtaaccaatggacgaaggaataaacataattcctcaatgcattcgtcggttcctcgtggtgcttattactgtcgatggagaaagaaagaaaaaaaaatcctcgatgcattcagaccctgcttggatacaggcactaatttttacccccgtcggatggaatatttggatactaattaaaagtattaaacataaactaataataaaatatatttcataaccctggactaattcacgagaaaaatgtgttgagcctaattaatccatgattagtccatgtgatgctacagtaaacatatgctaattatagattaattagacttaaaaaatttgtctcacgaataagctctcatttatgtaattattttttattattaatctacatttaatacttctaattaatatccaaacatccgatatgacagggactaaattttagtccggatctaaacaccacctcaatcggctcctcgcggaagaaaactcgccacttaggcggagtaatctcgccggctgttgcgccaggaaactcgacgcccaccacccaacgctccttcaccctcgctgctcaccaaggaatgtcgctcgctgctcgctagtcctcctcccacgtcgctcactgcccaaattgacgccgccgccccaacactctatctgctcctttgtggctggtggagcagagctcggagccactggatctggggccagcgagctcactgccgccggatttggcggtggcgcctcttgcagccgtggaagaaagagaggagcagcggtggccggggaaagtggaggccatcactcatcgcccctcgtcttcctgccgccctattatttgctgcagtcgtcggacctcgtggccaacatatccagttcgttggagttcaagaaggagggcggcagtggcaggcgaggaagatggcggcggcagcgtcagagagtagaggaagacgatggcatggttgagcctcaccaaaccctcgtttttgctctttgagaaagtaatgacgaggggcgaaccgaccccgacgcccgtccgttgcacgtgtgggtgcagcctgttgcacgcgcctggccaggctgagttgtgaagctcgatttgagcgtttccgctcagcctggctgagttgctctttcactagctagtacttaaatgatttttctggacggggacacttataaacgattggaagatctgcatgcgaaaatcgattttgaccgcataagaaaatcgctatttatgcgtgcgggtggtacgcgaaaaatctgattttcacgtgcggggtggttatggccctgtttctttcagcttgggattattataatccagattattggaagtaagttgaaagaaacagacaacttattgaagtagcttattataatctggagcccagcttattataatctgataagctcatttaggtgagctttttccagattattgggtgaaaaattacccaccatgccaccccactctctctttagacttgcaaacccaataatctaggctctaataatctaggaaagaaacaactaactgcttattctactacagattataacaatctagcttatagtaatctaactcaataatctagattataataatcttaagctgaaagaaacaggccaatgtcgccgcatgcaaaaataaaaaaccaaaaaaaatccaaaaaaaccccttactcgcagtcgccgtcgtcgtcgccgtcacggtctctgtcgtcgctgtcgcggtcgtcgtcatcatcgcggtctccatcgtcgtcgccgttgctgtctccgtcgtcatcgccgtcgcggtctccgtcttcgccgtcaccttcgccgtcgtggtctccgccggatccgggcaggctactcgtgtttttgcatgggtggagccaggctgggaaggccgtgggacagctccattgtcgtcgtcgtctttcgtcatcaagcagcagaatagaccaatctcatcgtcggcctcttgcttcagcggcgccacggcctccttcggtgtcacctcgcgctccagccgtccgcgtggagacgagacctgcagcccttgccgctgcctgcgccaccccacacgaccccgtgtgggcgtgtggcatcgcgtcgactctccagacggtaccatcgcgaggcgacctgaccaaggcctacagcctgatcggatgggcaacgaagatgcatggttttgattcgtgtgcctccatggcgtgcatgcatggcttcatccaattagcgcgtcaggagacacgaaggagctgggacagtgctgctgccgttttttcttttttccctcttccgatgagagatcggtttgcgtcgcccacgccgccgttcggtttcaccgagatcaaggatgttgctgttttgctacaacgacattgtccgacatcactgtctaccggcatcaccaacgtcttcgcgccgtgatcaccatagtgtttttatttaagttctttttctttattttttttcttttggtcgtcgtgttttgttggcttttcgcatgcacccgcgcactctcgcacctggcaccacgatccctgccatgaaccgcaaccgcacactattatgtgacttgtgctgcatcgagatctgcaacgagtggctactacaactacgacaacttcatctccactacatcgactatggcacgtagggctatcatcgtgttgagtacccttaccagttttttctccagttcaactgaccgcgttgctcacgcttggactgtgggggatgttagagtatatggtagttagagtcatattaggataggattagtttatgtggactccttccatatctataatcctaccttatctcctcctcatatactcctatatataccagcccctgaggctcaatacaatctatccacgttatgcagtatatctctcctccctgtactatccaacacgactaacctttataaaaagtggtatcagagactagctagtccaacatctctggcctgaggaacatagtgtgtgaaggcttaatggaccgtggctgactgcgggaaacggtgaaggggcggtgagcagctaagggacaccaatgtatgaagggggatatatctcttgttgaatagtcccacattgattgtagaagggtaatggacctaatatataagtggggagcccctcacctcattggctagcttttgggatgggaaaggccctttacgatcctacaaattggtaccagagcctggctagtaccgatggttttggttctactaaggaagtacgtggagtagcacgatgcacagcacgatgcactgccccacgacgttgacgacgacacgcagcatccgaacgtaaaggagggatgagccatgatggacgaacagttagcagtcacacgaagcgcttcccgaaaactttattagcgcgttgttctggtgcggaacatcataagctagcgaaggttccgaagaactactctcccgatcagcggtgtactggatggcacacaaattatgcagcaaaacaaagccgtaaatgtaagccgtgtcatttgcaattttaaactgtttatgattttttttaaaaaaaatagaacttttatattgttatttcttttatgtttcccaattttatattttaaacaacaatataaaattttcagaaaaattaaaataaaatctcacagataggaaggtagtattagaacgatataaaagttctcaaaaacattttaaaaatctcagaaatagatgagataatattaaacaaccatgcaaagttctacgaataaacttaacttccatcactataaaagggtttttgcagacggctagatccagttttcgcatgtggttgacctgcccgtgtacgagaaaaggtctgaaaaaatcactattttcatatacgggtgcttatgtgagccgcatgcaaaaataaaaatccaaaataaaaaaatataatcagaaaaaaaatcacgccgtctacttccaccgccagccccccgtatggggccgggctcctcccgccgctgccgccggatccgtgcggggccgggtgagggagaaccaccgcccgccgtcgtgcccacccctgcggccacccgccggctgaagaggagaatatagtagaggaggtgcagagtataagaggtgagagagagacagaggggggtagaaggtaaggttcagtttgaaaatttttgaagtgttgagagggaaataggacacaagttagtcttctagcggctccttaagaggtccgtttgcgaaattgatttctgcatgcggatctcttaacgagctgcatgtccgcgtgcaaaaatcgatttttgcaagcgggcctcttaagaagtcgtatgtgaaaatggaagtcaatttttgcagacgcggtcagttatgatttatctacaatctaacaaggggctcgtctggaaaaatcattttttatagtgttcatttgtgagacataaaattgagaaacattaaaaaaataaaaataggagtattgttatttgttaattctatatcttattaacaaagttgattttgtttatacaattttatggggttatttatttacatattaccaacaagtgtgagttttttcagattttttgctaacttctgtacaaaaaaagttctcatgttttcacctaaggtatcatttacatcgtatatatacattcccagtatatagttacactcaagttacaatatcaaaagttatacatctcccatctatccccgccattaaccccacctatcagcacatcaggataacagcacaataatcaataatgcaaggtcacaacagtcaagactttaggaaggagacgagaatgacagttgtccaatctgtcacatgttcatttggtggatgcggtcgcgcatagtgcttcaatgtagatgctatcaagaatagcatccacaactcttcaatgtagatgctatcaactggatgctaagtacaacgacatccaccttattttcacaccttacaaatcactatatatcttaaaactcaacatgtaaacatacaacatcatctttcatcttaaaactcaacatgtaaactcaattactcttttcgtaaaaataacattttttacatgttttccaaaatatctacatggaaatctatgtatgttttgaaaagctggtagaaagcattaaattttggaactgaaggagtattatattttaaatataatacaatcatatcatatcatcttaaatttattatattatagagcttaaaagtgacggggctagacttttgactatggggtttagaggctttcaacttaagtagaacagttggtaaacattgacaatcattgatcaactaacaaactatggtaagtatttattgaagttcaaatataataaaactagaaaataccatgcgcgttgcggcaggatatttgggaaacaatcgtagctagtttgttgaatgacactttggggaaagaaaaataaaaaagcaaaggcaacctagaaggattaatatttttttacacatcagcacctctatatactaattaaggatgaacttctgcaaaatgattaactcacatgtgaaactactacccaagccaaagtttgtactactgtacatattgagttttctgcgattttctcaataggaacaaagaaatatgaaattaatatggaattgagccttaaaaaatagcaaaacttcatgggaatttcgagaaatttagaaggtctcactcaaatatttattggcaacagacccatgtaaattacaattagcacgttcattgcatactataaaattacagaggaggatcgtcttttttttttaaggatctgatgactgcaaagcctcggtacctcgcggtaccgcgtctccggagaggaggtaccgagagattttcgatggtgggagggtataactgtactttcgcatatcaaattggaggggaaacgccacctccatccaccgtgctaggcgctgtccccgctgcaaatcaagcaagaaactgatgcggtagatgcggcggcctcccaggcggttcgtggtccaatccctatcgctggctcgagtactacccgatctcctccctcctcctcgatgctagtacagtggaggcggcagccgtggtggcaggcgtcggctgcggagacctcttggatggcgggggcggtggtcaggtgacggcgtctacttcagggcaacctcagggaattgttgtggttatgcaaggaagagaggaggcggtcactgccctgccctgcatcatggtacgaagttgaggccaacagaagacaatagctccacgtctaggatgaggcgatggagagatgaatgttctgaatgattgaaaattcttgttgagactggagaggtgacactggtggagaaaccatctttcgtcggtcggccgatttccacaatagtcccggatgcaataaaaaccggggctaaagatgatctttagtcccggttcaaaagggtaacgggcgtatttgatctttagtcccggtttgtgttaccaaccgggactaaagatcatctttagtcccggttcgaatgctgtcagggcctgtcaggcccccccgggatctttagtcccgggttgtaacaccaaccgggactaaagatcgtaactttagtcccggttggnnnnnnncnnncgggncnnnngnnncnggnggggnnngncnggcncnggnggcnnnnngncccgggccnnnggnnnnncccccnccccgggncgcgccgcccccccgggggcgcngggcccggcccgcccgcgccccngnggggccgggcgccgggcccccccccggccccgggncgncnggcccccggccccccgcggcgcnccgccggccggcgncgggggcgccccnccccgggcccccccggcgggccngccggggggggcgcgcccccggccggccgcgggccggcccgcgcgccgcggccgcggcggcgggcgcgcgcgccccggcgcggcccccgggcgccgccccgcggcgcgcccnncgcggccggcccgcccgccgggcgccgcgcgccgggcgngccccccgggcccgccgcccgggcgcgccccggcccgccgcccgcggcgcgcccc

SEQ ID NO: 86097 - DNA, 11146 bp, Oryza sativa
tacgagtgctcgctggctccccgggcgggcaccgccagagagaggagggaggcatagagacgcacgagagagagggacagagacgcgagagagagaggtggataaggcacagtcgttgtggccacgagtaaagaacgacgcggtgcgctgcgctcgtagatgggcttggctcgtaggctcggctcaaagttataggtgtcggttttttaaaaaagaaccgatacgtataatatattataggtgccagttgttttaaaaaaccgacacctatagtataagtgtcggcttttttcactagaaccggcacctatagtgttttatataggtgccggttgttttaaaaactgacacctataatataaatgccggttttttcgctagaaccgacagatatagtgtttaaaggcgtcggttttttatttttccatcacagggtggtgggaaaagctctataggtgccggttctaagtgaaccggcacctatagatcgttccctttgagggtttttatagtagtggatctggaagggagggaggggagcgtcgccagctctcctcccactcgccacgtgcctccgcgctgccggtggcctctgccaccgccttcctagcatcctgatctgcgagggagggaggggaggggagagccagtggctagttgcacgctcaccgtcggccgtggccaccgccctccgcgccgctggttaccgccgccgcctccgcgctcagcaccgttggctgtggccgccgcctccgccctacgtgccgtagtgagggagtggatctaggaggaaggagtgaaggagtgaagggaggggaagagagtgcagctgggagggaggagtgaagggaggggaagggagtagatagagataaggggttggtggcggataatacgaggtcggatggtttttttttttttttcctttcaggcggaggatctaaaggttccatctcagacagatatcttaagaggtccgcattaaaaaataaaggtatttttgcaggtaaatctctttaggtctgccttcaaaacataaaggtattttgctgtgaaaatttttcgcaggtagacaataatcttgccccattgttattttcgtaggcgggccaattagatccgagaggcctatccatctaaaaaaaatatgccatcatgtgaaaagatggtttttctagccgtgactcacgaattgtgtatctctcgtgcggccatggttggttcgtcccaagcaatcggactaaacctgtaccaatatacacaggatgaatgacaaggcgggtgaagggtgtgtgcatccatttattcttcggtgttcatgatacaaattaaagagagaagcgaagggtgtgtgcatccattttgctattatgttcactaccaaatccggtgtgtatatcgaatccagcaaaatcagtgtgctaagaagtggatctcgtgttccacgaaattacaagcacaacttgatcaacctttgaatcgatgccaatcggcacaaatgcaagcataagtttttcaatcgataccaacacaagcttatcttttgaactgatacctctcagcataatacaagcacgttgtccaagactactccaggtccactaccctccctccccataaatagccagaaccagactcgccaccactcttgcgccgctccttcctcgccttgttccccgtggctccggccttccacgaggtatgcccgtctcctcctactcctactgtcgtcacgtcggtcgatagttctataagtgttgtaattgcgcttttgatcatattttaaagcctaactaccgtgactatctattatctatcttctattatatactaaaagtccattaaactttctacaaacgctctcatgccgccacatggcgctctaaaaacgctctcaagctgccacatggcgttctaataaaatagagaaaatcctagaaattctgaaaaaaaaatctagccctcaattttcatttaagttggtggacccattagtttacaccattagattagatccattataaatagtaatctatcctatagaggccaaaaggctcgaggcccgatggcccggcccatggcacggtattttggcccagcccaagtacggcacagcccaacggaggtcgtgcctgggaccctccaccggcacgttgggccagcagccaggcccgataaaaaaaataggggagtcaaaatagacatattatatgccatggacgaaagaatagggatgtaaaatagacttattttagcgatacttatgtcagcccaaagaggagggatggaaaatagacttattctagctatacatatgtaacagcccaaagaggagggataaaaaatagacttattttgaaaaaggcccgatgggccacctgtgccttcgggccggcacggcatggctcgacagctgatgggccgtgcctgggcgggaggtgcagcccatggccggcacggcccggcatgaagtgccgatcgggccgtgccggcccgatggctggtgggccgagccgggccaatgagattgaatgtagcctaagtaggagatatattagattatttactataaaattaaaaattaaagaatcaagttaactacattattaaaaaaatcattactttggatcatatatttttaagaaaaaagcaaataagttttgttgtctcctcgctatttcttagctattaaactaaaacaaaaacaatcaacaatattggattttttgtttagaaacacagcacgcgcacctcctgcacctttgagttcctccaaaagactgagtcgacacattttgagattgccgatgtcaccacaggcgtctcgctgtcgattggtacgtcacctaccactgaaagaataattagccgtaaatgcgagcacccgtgtcaagtctaggacttgaaccaggtgggcaagttacaccacaagaaacctaaccaattgagttgcgctcacttcacaatagcgctggatattaaaataaccataatttttaagctatattattgggatacttctatgtcttttaaaccggtgaactattagttataaccgttagatctatcttatatcttatataaaagataagcatgtattcatggtacatgacatttccaaaatattactgcgcaattatatttcgtcattatcgtattcatgttaggttgcatgtagcctatcacccaccctacatgaaatgttcatacatggatcactcaaactacatcactcatattagcctatataaacccatacatttagtggagcttcatatcacattcaattcatcctttaatgaactattataataaatatgcaattaaaaataccttattttactttcattgacatgttttctaaagaaaaataagactaccttattttcgaatgataaagaagactataaataattacttgtagatattacttaaatatgatatactataaaactaataggttagaaacttattaagcaattaatgctgatgaaaataattgatggataaatcatggcagatgttctccatttaatatttcgcttttatacttatctcaaactcacaaatcgtggcagatgttctctatttaatatttcgctcttatacttatcttaaactcagcgtacgacacatgcccgcgcgaatgcgcggactaccttccttgtttttttaaagtttgcttatttgatctttttttttttcaaaattgaatttgatctgactctattacataaaagcagtataatagagctaacttatagaaaaatacaatttatgcccttctcattagaaagagggccgggagagcaaagaggtatagtggaacgaaaatctggactggtatattcaaccaaaattcagagagctttccaatagggaatgcacaagagtcgacctgcaggcatgccagatatcagtacaattgctaagttcaactagaaaatctcagaacatgaactaaatcctaaatccactagcttgaactgctctcttcaccaaaagaattctgaactagagagatagagatcagataaaagaaaactctgaagccggcggccaaaaaacatgtgggattccactggaatgtgagcagctggtcactgtccaaggagatccgggaccgggtgtcctaggagagcacgcttgacaccaacgaggcaggtcacctgcgcctacaacgtcgccgtcgcgtccacctgtcacttcgaccgcgccgggagcagatgacgatgagtggggctgcctcctgcgatgtgagccgcacgacgacgatgacgtccgcaagtggccgtacgatgcatcctgcggccatccacgcgccgccactcgtccccgtctcggcacaggtccgtgcgtggtgcgtggtggcattcttatcattttgacatagatgaaatgaagccctaacggtatggagaaaataaggtgtcccttcgattttgaaaaataaggtcaaaataaataaactaagaaaattaagattaaaatgatagtaaggttttgcaacaggttaaaatgagtaattatccttttatattaaggatttttacggtacaatatactgctagtatatactacaagtatatatgatctaacgttgtagattgatttaattttttatttaattagattgcagtataaagtttgaaagtgtaattttgtcttttcttcgttattctatcatcaaatcgtgctatcgtcacgtgctttgtcatcaaatggcgctcaggatgctcctcccctagtgcacgataagatccaggaccaggtactctcaattaaattcaatttgaaccaaaaattactaaagtgttgtattattttctatcaaattcctaatattcccttttatatactgccagtatatactggtagtatattgtaccgtaaaagttctcttttatcttactatggagctttcccgagttgggaaattcatctgaactggcaaacagcgtgtgtagttgtgtagtctggagatttcagttactcttgacagtttcttgatctccgaagtgatttgtatttgattgaggtcatcaatgattagtcagcgcagagtagtttgaagtattgcatcgcaatgaacaaacggccaggtttgaatcagatcaaaagaagttgtaaataagtgatcgaattgactaaagatatgggaatcttggctcccatcaaaaatcatgtggaatttttagattttttgcttctcaggagatcaatcagacattgggtactgtcagtaacttggttcaattattatcttggttttggtgtttttcaccactgccgcttccatcttatttttggctttgtttgtttctatccgttcatttttgcatattgtaaattttaaaatattgtcttctctttcgatcgcaggtttttcaaacatggccgactcaattcagaatggctctggtgatattacacgggttttattctgtggaccctattggcctgctgctactatctacaccaaggattatttggagagctatccatttattcaggctagttgcactttttacatagcttatgtttgatgagaagtgaattagctgaaacatcaaagttagattagtgtggactaaaaggcttttaactggtttagaacttttcaactcataatgaaaggctattatgatataggtttcttcttccttatattttttttccggcacacacatgcataagagttatatattattacatcctatcttactacaaaattacaacccactaaatcctaaagctcaacatgtaaagattgcacgtcatcatccactaacaattattaaatcttaaacatcatgccaacatattatattatctgtaattctattatttattaaactagaaaggtagcccgcgcacttgcacgagtaccttattgtataatgtgagtgaaattttattatgaatatttaagtgcgggtggatttttattaaaatatcttgtattttgttctaaactaaaattaaacttattttttgtgtgttgaaagctgattatatttttataattgcccttgcaacatataaattctaaagtaaaattacttgagatcatacagttttgaattatatgagaaaatattgtgttgaaacaatggaggtagttcctatgagaaaatttaggatactttaacttgccagaaggatatcttacaacctcaaaagaaatccaataatatcattttttgttgtattttaaaattatatatattttttcattataacagtccttgtaaaatgtttgaatttttctatcaagtattggttttaaatccagcaacatgtgttcaattttcaatttcatgtccatttttattttttttcttttggatagtttcattctctgaatcatctttgaaatgatttaatctttgcaattcgggacggaaatataagaacatgtaacctagcatgaggtaaaggcatacgttctaaattttctttcctgaaatattgaactaatggtcataatgtatttagcgacgaatcatcactaaagtgtattgtcttataacaaatacatgcttctacattgttctacgtcaagactttacaatgtattgtagcaagtttaataaaaaataaaggacatggtcattaattcctatctggaactgacttgatttattgctaaaggcattgcaaggttgttccactattaagatccttaggtacaactcacatgcttatcggtatgatgttttaccaaccacacctttattttcaccctattgtctatattgctagatgaatacctactatgattagtgacttgctagatcatatgtgtaattcggacgctatgatcatctttttaaaaaatatttacttatgtcctaaaaacatcattttaaaagtaccaaggtcaatttgtataggcatatcaagagaaattaattaagttggtagaaagtcgttaaatgtctaacgggatataagtaatagatggaggtacatatatgttttttttacctatatagataattttaattttaattgtcaatgagataaaaaaacagagaaaaaagaatggcacgcgatgtacatgggtagggagagggagagaggattgggatgtttttcaaaatgattaatctaacaacctaaaataatgggtcagatgtttatgttgaaaccgatggtaagatgttttgttttcttgtcagaattttattaggattttatttgatttaagagaacgacgtaacatcttaacaacatttataaaatgtgtaatggacttttaacaccgtatgccgcaaaggagggagggaagaaggtttagggtgttcttttaaaaaaagatataatgacctaaaataatgtgtcaattaattcatcgatttatgtcatatctaatgattgggtgtttttttttccaacatttctaagatttttctctaatttaagaatgtcatagaggtatttatcaaataattagtggattttaacaccgcacgaggatggggagggagggagagagtttgggttttttcttattaaaaaactaacaaattgatagccgaatgttttgttgtttttaagattttctagtattttctttaatttaatagcaccatgttgcagtttagaagtatttgtaggatattttaagatgcatagcgagagctgctagacctaataggtggaggtctctttgtggtttttttaatgtaaaaataattttgattttaatttctcatgaatatacctcgttggtacatacgtgacgggagattccgaatgtgtgctttttttataaaaaaatatctaacctcctaatataaaaataatggatccaccgattttaataaaaatcgatggttggattagaatgccacttggcaacttaggagtgtttgtaaggtaccacttggtggcttaagagtatttgtaggatgtttaatgaatatttagatataattgtctttttttttgaaatttctaagattttctttaatttaattatgttatatagtggattttaacgctgcatgggggtggggagggagggaaagaggtttgggattttttttattaaaaatatctaacaacctaaatccatcaatttaagtagaaatcgatggtctgttgctttgtattttttaagattttctagtaatttctctaatttaataataattggtctatttgtgatttttttacctgtaaaagaaattttgattttattttctcattaaatagaaaataacacataaatgaaaatatggaaggacaaaagggaagtacttacagtacatacgtacattggttccgtatgttggttccggatgttctattttctttacaaaatagatctaaccattcaaaacaatgggtccaccaatttaagtaaaaatagatggttagatttcttttatttattatggttccacttggcgacttgagagtatttatagggtgccacttggcggttcgggagcgtttgtaagaagtttaatggacttttagtatataactaggaaggtagcccgcgcattcgcgcgcgcatgcatgtatcataggctatgtttcaaacaatgtaaggacaaaatataaaatggaggatattttcagaatataaatcggaaagaaaacccgcacatatgcacgggcatcttatttgttgttcaagaaaaagaatgctaaaataaatcatatcttagtatatacattaatacatataccttgtaagggaatgtagattaccctaaataaaaaaacaaatatatttgccgtaaaatagaaggtatagattactaaatgtgatagaatgtctattagatttaagtaaaaatccctttgtcctggtcatatataaactcgtcttttatcaccactacttattatcattgtttttgaaagttaggtgcacttttaataaaagaaactgtatttgtaccactaaaataaatgatacattatttatacacaaaaaatatcatctacactgcataacccggtatgcataacttattttcacatctatgtataaattgtctaaaaatatcatatctactagataatacgataacaccgttaaaaatattcatgaatgattttctaacagatgaagtcgaccgtagcagccaacctaggctttcttacataatgccttgaaacacgggtctcgcatcgatgtaaccgtgcccctaaataccatcttaaagtacaattttaacactcaattcaccattggcacacacaaatgattgcattggtaagtatgtcattttagttacattggttatggtggccttttagacaccaccttaactcaaccatttacatgtctctacaatatttatgatggcatagcaagtaatacacccaacattgaaggacagatatatacagaaaggaagaggtggcgaaaacaatattatttttaagttttgagtcgatttaaagtaatgaattgacaaaattgggttcagaggtgtataacattcgtacatcaattatactcagtatatagaatttatagttttatatgtgttttacggattgttcatgtttgccaatactacttggcaaagaaaaaacatacatggataatcataattctcatgatgaattaaggattgtattgtagcaaaataactgcctaattcttatttgtttatttgtttatttacatctatctatgatgtatgcttctctctcctcaaatagcaatcaaaaaaattcgaaaaatttcagattcttaaaatctcaatgtcacccaaaataaacataaaatgatccacttaaaaaccaaagctaaattgtagttttattatcgcaaaaccactgtctaaaatttaatttaatttttctcatctatctattatttgtgcttctcactcatcaaataagaataaaaaagttttgaacaaatccaaatattttgagaatctgatctccaaaattaaataacccaaaacagatgtacttaaaacacaatgttaggttttgtcagacagttgctttgacattttatctattagagattaagtttaatgtgcatatctgtgtagtgttatttttaataaaataatagtttaaaggatgttgacaacacatcagtgtgaattttcacgattagtatttctttccgattctatgtacgtttgcatgttttcttttatttatttggttttatctgttttatttatcgtatatggtgtaggtatttaagttttatttttttaggatggagacgatcgtacgacgtacgcacattatgtttttttttccagatagagattagcagcatgggatttttaatatatctaaactaatatttaaaataacgggtcctccaatttaagtaaaaattaaaggatcatatgcttttcttttttctctgaatttctaggatttctctaatttattatagcacggcgtgacggcgtaatagtttttgcaggatgtttaatgcatttttagtatataaataaatttctaggatttctctaatttattagagagacacgtagcggcgtaaaagcattcgtcgtatgtttaacatactttagtatatatatagttgatagatagtagatagatttataagatgttttaaagaacattgattggatatttataatagatcttaatttgactaaatatatttatatttgtgaagtaaatatattttatctttatactgtagaaaatcatattttaaataaataccgtaacattgggaaagttttattattttattttcaatacgtacctaatgttctgtatcgtatataaactctatggctgaacagtaccgtttctatgttatataatatatgaggaagttattattttttaataatagatctaatttaatggtataaaataacgggtctaccaatttaagtgaaaatcgacggtaagattagatagtgccacgtggtggcttaagagcgtttgtaggagtgccacgtggcggcttaagagcgtttgtaggaagtttaatggacttttagtatgtaatagatagatgacatattttgtccatttcggtagagctttagaaaattttacaagtcacatattttgccccgccacggtggcaggaggacggcgctagccactttggcgccccaaaaaggaccatttctagaataagtttttctagaggtctatt

SEQ ID NO: 86098 - DNA, 2923 bp, Oryza sativa
agttggggtagactgatcaatactaaaatgtgacttgagtaaggggcattatgaatcatttattcttctactgtgtcagggtcaacttgttacttatatttattaggcagctgccaagcttatcacaacaatctcctttactgtggtttctgaaacatagtatgatgataaaacctatctatttcaggagagaaagagtataagaccaccattttctgcagagcgtatatttggtggagtattgctggctatgtgtacaaatgattttatttgcttccatgactgggcagagggcaggatgatacgcagaattgatgtcaatgtgaaagtgagtaattttgttcctggatttaaatttttttttgcgtgtcatttggaatattatgatgctaaataggatctgctttcttatttgtagaatctctattgggccgatagtggtgatttagtgacaattgcaagtgacacctcattctacattttgaagtacaatgtaagtttttctgcattttgttggctctgtagttcaatgatgtaacatctacttgatgtaactataacacaacaattataccttccagagggatgtagtttcttctcatttggatggagggggttcagttggcgaggaaggtgtggaagatgcctttgaactacttcatgagatcaatgaacgcatccgaactggcctatgggttggtgattgttttatctacaacaattcttcgtcacggcttaattactgtgtaggaggagaggtaagtattttcattatatcaaaaatacattgtcacatatgatttggttagacccttaattttcaggggtagtataactattcgatgtattacaggtcacaaccttatttcacttggatcggcaaatgtatttactgggatatcttgctaaccaaagccgtgtctatcttattgacaagcaatttaagtgagtcttggttgtctggtattgtatcatattctgaagccacaatgaacttctgaggttaacttgttttcttactgcagtgttgtggggtatactttactccttaccatgattgagtataaaacacttgtaatgcgtggagacttcgatcgtgcaaacgctcttttaccatctataccaaaagaacaacatgacaggtgccccctgttctgctaattattgtactctgcaactcaggcctcagaatctgaagataacccttttattttcagtgtggcacgtttcttggaatcacggggcatgttggaagaagcccttgagatagcaacagactctaattacagatttgacttggccgtgcagcttggtcggcttgaagttgcaaaggcacagatgattaatttatttatcacatttccaagaatgtttttgtctttgttcaaatgttgttaactatttgcttttcaggcaattgccattgaggcacaaagtgagtccaagtggaggcagttaggagagttagctatgtcaaccggaaaggtacagctgttggatgtattagttactatcttctatgagtagtcaatatatattgtgctaatgaagtgggactgttctgccatggcattttagtttcttgattattagtaccagtataccgtgtaacttaataattatgagcacacaaataaatccctccgtccaacaatataagcacttgaagcatttgaattttgtccatgaatataagcatttctacaatacatatgtaaaatcaatcgcctcatttaaatttcttcccatcttacgcccaactactcttcaaccccaaccttctcattaaatgagggcactaaagtactttctcctcaactttaatctttgctcaacagtctagaaatgtttatattgttggacagaagaagtatataattcaacaatggcatttgtgaagagataatattgcagttttgatgggaagtagctttggtcgttgctatgatgcttgaattatgaacctaagaagttattttgccttcgcttttgctctttccatcttttgtactacctctatttcattttataagtcgttttgacttttttctaagtcagacttctttagctttgacgaaatctatagaaaaatatagcaatatttttaacacaaaagaaaaaaactattcaaatatattcaatgttagatgtaatgaaaccaacttggtgctataagtgttgctatattttttctataaacttggttaaacattcaagaagtttgatttttttaaagaaagtcaaaacgacttattatatgaaacggaaggagtagttgtttttaaaagtagaattatgcgtgcaaaacaatagttttgcctgatggcagagttctgtgtgtaaaaaaataacttatcatcttagttttaagtagaattcttgcaatttaataactttgccatgttatgtttcagcgccttgccagatacaaaactggctaaaagagtgcactcatattctaacatgtcaagtgtcaattacaattctgcagcttgatatggcagaggagtgtcttctacatgctatggatctcagtggtttattacttctgtattcatcccttggtgatgctgaagggctaacaaaattaacatctatggctaaagaacaagggaagaacaatgttgctttcctttgtttcttcatgcttggaaaactggaagaatgtcttcaattgttaatcgaaaggtattgccatttgccaagactatcctatttaatagtacaatgcttattcagaaaatgtattttttattttatggtgatcacgttatattctctatacagtaatcgtataccagaagcagcattgatgtcgagatcttatcttccgagcaaagtccctgagattgtaacattatggaaaaaggatctccaaaaggtaccatctgtctcttttttccccctccaaaaggtacccagt

SEQ ID NO: 86099 - DNA, 1095 bp, Oryza sativa
taaattttggtcctaccaaaattcgcaccaagataaaaagtgcaaaccctgcaataacttaatttgtatttcacattatgaatagcagagcacatatacgacatcgtcaaaataatagccagcactggtatatggataatggtcagaattattgcaggacattaagaactccatcttctatatgtgcgcttgaaatgaaaaaccttcgacatgaaaaaatagttaacctttaacctagtacagatcaattaccaaaatatttgatttttactatctagacagactcaagttcctcaaaaagctaagatgatgtgctgcttggttgctgactcagtgactctagtagtctagtttcatacaacagtagcagagctcataaaaaacaacacagtaaaacaatatgccaagacactaaaatggattggaaaacaagaagatgtagaggaggggctgcaagaagttaccaatgaaactgatcttgctaatctggcaatccccaagcagacctgctttgtggctgaccatgtcgttaattcacattcactgccttgcaaagcgtgggcaccactatggctgcaacagtcatggtcgtcccttgggagcagggacagctgggccctgccgacggcgccggcaccccttgcagcggccaagcctgcagtaccagccgatgccctcgccagcacaggaagaccatgcgagcagcccatattcgtggagttgaacggtacaaaagctccctgcagtcctgaacctagggacgaacatggagttgagcaagctgactaattatgtttcaattaagcccgagcaaaactataaaacaaaaccacactgcaatatgagaaaaaactacagagttaagcgtagaagtatcaagcggcgtgcctatgttatgtttccagggatcctttgggaccctggctaaattattaaattctagctaaagtacgccatgttaactactataccggtaaatagttacataattcgtatgtattggactcttggtattttttgttctgagttcatcactgaaaatatctattagcacaatgcgagcacgtggaaactgtcggcactacatgacgacca

SEQ ID NO: 86100 - DNA, 9206 bp, Oryza sativa
cttcatgctaggaaaacttgaagaatgccttcagttgttaatcgaaaggtattgccatttgccaagactatcctatttaatagtacaatgcttattcagaaaatatattttttattttatggtgatcacgttatattctctatacagtaatcgtataccagaagcagcattgatgtcgagatcttatcttccgagcaaagtccctgagattgtaacattatggaaaaaggatctccaaaaggtaccatctgccctatcccctataatatttctttgtttttttctacctattctcatgcttaatcttttgcacacctgtattagatcgtgctcagttgctcacattttagcgtgacttgtctcttcaacctaagttacatattcaagcatgaaatttctgttcggcattactgatgatttttagtgatgtttagtgatgtttcagtcctttctggtggtaatactgatggtttttagtgatgtttcagtcctaacaggcagaatgccccatctaatttttgtgtacctgataaatcaagggcattttgtctattatctaagctagcatgaaaaaaccaaccaaaagacatgcttgttatcttgtgctagagtattgttcttattttcagacttacgcgacactgtttaatttgtaggagctatgtgttttattatctcaccatgccttttttccttctcatgccattatctttataggtaaaccccaaagcagcagaatcattggcagatcctgacgagtacccaaacttgtttgaagactggcaaattgctctcaatgtagaagctaatgtcgcgcccaaaaggtatgttcgtaaaagtaaaaactatgttcttttgtgaaagttttaccagttctctcttccatgcatgggacaagtcgtcaaggtttgctttcctcttctctttaattgaaagcatctgatgaaataagaatgatgtcctctaccatgtacaggatgtggggttggaatatcatatttagcttcaattgaacacatatagtgaaataaatagaagtaatgtcggtgctcatttgtattgtttttctttattgttctgatgaaatcctgtttgaataggggtatttatccaccagctgaggagtacattatccatgctgagaggcccaatgagactctggtggaagctttcaaaagtatgcatatacatctagaggaggtgctgccagatgaaaatggagatgacactcacgaggtatcactcctacggaaagagttgtaaaaaaatattgttaaatagtgggtagctatttgaagatgttaaattacttctactaaactgatctcttttttttttggcatgcgatgtcctatatttatcaccaatcttttaaagtgatcattatttcaataaaatcacattttttgctattcattatattttcttttctccttgctttaagttgtaatatagtaatatcaatctggtccaccaggctatcgaggaaaatggagtagaagagagccaagaagatgctgttgaggttgatgttgaagctgatggttcgactgacggtactgtccttgtgaacggaaatgataccgaggaacagtggggtacgaacaatgaagaatcattagcataaaagctgtagttgagcaagtgtacagtcctaaaacctttttttcgtcctagtttctcctcccagggcaccaatgatcatagtgaaaacttgctgctggtgtcctcaaaaagaaaagaaagaaagaaagaaaacctacctgcttctggatacaagtgtttattctgggctatatcctttagtttaatctgtccgggataatttaattttggtattcgagttaatctgttggtctgaccagttttcttagacagtttgaacatgagagcaaaatttgtgcttgctatacatgagttgttgatgttttctaacgactatcttgccttttgcagtattgactcctgaccaatagtgaatcagcgggacagcaacctgatacactgattcagcttgtaaaggtgaagtgtttttccatctatacaattagcgacagttgttaacaactattcatttattatagctaattattttttgacaggttgctgactcctactgaaactatgtgaaggccgttttcctccacttgtataatcattgggcgtgctttaagatcggcatatccgacgataaaacccacagaaattagtcatcgctttgtccttgtttgagatagaaaattttgtacctttttacacacataggtccttactgtgggttctcaggatgctttatatatacgagggatgttcccttcttgttgaggttgaatttgattagctaaaccggatccatattttacacaaagtacatagggtaaaatgttaaaccagccgaacattacctttttttttttctgtttcatgttacacgaaccagctcccatgaagccatgatacaggtaattcactaaagagcacccctaaacaaaaaaaatagtataccagaaaaatgggggactaggaagagagagaccgcgagtaggaattaattacaagaaacagtataaaacaaaaatagagatcatgattcatgaagaacagcgacagtggctaggaggaaagaataggaggaacaagcccatgcaacttcatctgttaagttggatccctgcctttgctgctaccgccgctgctgcagcctgcagaccagtgtgtacataggagatgcgacaagctcagggaactagggaaaaatgagagggaggtgcggggagcgtttttataggctcgggagggtgaaagggagctggggcgaggcggatttgggcggcgacgacatgggcgaagtggagctcgattaggcgccagaatttggggaaatgtggagaagaggtgtagtagtgtgcgacgaccgggcccgcatgagagagggcgcgaggaggcgcggaagaagcggcagcgtggggcgggtgcagtgaccatggcggtttcggcccgaggagaccggaggtaggaggaggagctgacaggtggcgtcaccggtcccacctgtcggcgagggagggagagaggagaccgagagaggaacgtgaaatggacagcccaaagaggaaggaggagaggagggcggcccgatagggaaaagaggaaggaggggcgggcgggccaagggaggagatgaagcctttgggccggaagcggcccaaagtgcaggaagagattttaaatggttttctatttaatttaattgattaattgatgtttgtactattataattactttttgagctctgaaaattcacgggaaatttcagagagtaaattagaacatagagaattttacaaaaatattttcggccatgatttttaaagaaaatttttaattccctcaataattcacttgattaaattgctttaacttttaatataatttctagaaatgatttatttaatgatttttaatcccgaacgaaaatcagggcgcgacacgacagcttatcatcgtctagagaagttgtttgcttggactgggcttaaaactgatgttaactttattaagcagtgtcaagtatgtcagcatgccaagagtgaacattgcaagttgccaggcttgctggtacctcttcatgttcccaaagaggcttggatggatatctcaatggactttgtggagggtttgcctaaatctgatggctattcagtaattctggtagttgtgaatcggttcactaaatatgcttatttcattcctttgaggtatccttttacagcctctcaagtggctacaactatggatcgttctgtgtttaaaacatatggtattcctcacttgattgtctctgatcgggatatgatatttacaagcaaattctggggagatttgttcaaagtttggaacacacagttgcaaatgagtactgcgtatcatccacaaaccgatgggcaaaccgagcgtgtgaatcaatgtttggagatatatcttcgttgtgtatgactcaggcttctcctcacaagtggcatcattggctccatcttgccgaatattgatataacacttcttctcacacctccatgggctgttcaccatataaagcattctttggtactaatccccactccaatcagattcctgttctttgtcttcaactcatcatgctgtggatggatttagtatttgaatgtgatcagctctcagcttttcttcaggagcaattgcaaagagctcagttacgtatgaaacacaaagctgacaagggtcgttctgaacgtgctttttcagttggggaatctgtctttctgaaactctagccgtatgttcagtcatcgatggtcaatcgtccatatcccaaattggcgttcaagttctttgggccttccaagattctagagaaggttggcactgctgcttatcgtcttggtttgcctgatcacagtttggtgcatccggttttccatgtgtctcagttgaagccccatgtgccggctcacacacctgttttcggtagtctgcctactcttgtggttctggatgcagttgaagttgtacctgcagagatccttaatcgtcggcttgttaagaaggggaatgctgctcgaatgctgctcatgtgcaagtgttgatcaagtggacctcgctgccagccgatcatgcaacttgggaagactatgacgtactccctatttgtcaagattaatagccaaaagttgttatattttggggtggagatagtactgaagaatcccttcccttgtgcgccagcttggggacaagctgatactttggcgggtggtactgttactgttacgagtgtatgagatatagactttcatgtgtgagtgggcctgcgagcccaggaggatttaggcctgtgcgccaacaactagtatataagcaaacagaaatgagaaatacatctctcctcccccgacaactctgttctaacttcttcttcctcagttcctctgcttctcgatcttgagcgatttcgaagatactactctcttcctcaactccgatcagatctagcctgattccggcggtgaacggcggcggaggttgtgtaacagccgcgtccccgccgtagccggccgtcgcgggcgtcacaatggtacgtgactcccctctctctctcgctctcgccttcccccaggctcgcgctgcttaggtttcgccgcgagtggggatcggtacggcgagggcgaaccgtttgacggccgcgccgcgccgcgcggtgccgtgccgtgccgtgccgagatccggtggctggagcgtcgaattccgcgtggatctggggtttttttttgtttgttgcgtactgacgtgattgccttctcgttcgtgctttcgtgtgattttttttttctctggcggcgaaatggcgatggctgtgatgttggcagccgctcaggttggatatcaaggtaaccactgcgcctctccctcggatctgcttagcttagtttggtttgttttggtgtgtttagctgaatgtgtttggtggttggatcagaggaagctcgcgcagaggtcggagagggccaagtccgtggatctgcatccgaccgagccatggtgagtgggcaagtttgtgtgtgtgacatgatttttgggttttggggtgctagtgatgtaatgattatgttgttcaaagtcacatgaataacttcctccggtgtaatgcaggattttgtcgagtctgtattcagggagcgtttgcatctggaactaccagacgcaggtacatgactgttcacagtagcttaattcgtcattttctgctggtttcatggattttatgaaatgatgattatctactaccagcacgctgagcttttgtactgcaaaatggatattcccatccatatgtaaaattcaagatacattggatttagtgtgcttgtagtagtaaactttgacgatatgcgctcatagtaagttgtaccagagcccggaaagaaaacaaagaaaaagaggggggggggggtcaaacatagcgatgaatgatgaattcttaaaacctagcgaggaagtcttcgatgcattgtagaaaggaatatggtcaaaatagaagtaacaaggagtcaatgaacttctagatggttgtttcagatgtgtgagtgttagctacataattgggacttcttaataggtttgcaaactatttagagcaaaacaggaggaggtaaaacataaaagtaaaatctagaaatcgatggacggaaaaagaaacatacatattttcagcatagttactcttaaagttaaactgattataatatattcatctatcctcagacgatggtgaaatcatttgaagtcacagagttaccaggtatgctttcccacctcatcgcttacttctgtttgatataccatcttgctaatataatcatccccatttcagttcggtcatctaaatttatcacacggaaacaatgggtagttgctggtgccgacgatatgttcatacgtgtgtacaattacaatacgatggataaggtcaaggtttttgaagctcatacggattacatcaggtgtgtggctgttcacccaacccagccttttgtgctgtcatcatctgatgacatgctgatcaagctttgggattgggataagggttggatgtgcactcaaatcttcgaggggcattctcactatgttatgcaagtcacatttaacccgaaagataccaatacttttgctagtgcttcacttgatcgcacagtaaaggtttgcgattttgttccttacatttgcttggcatagtttttgcatttctaacatttcttggtctggatttgaatgtggtgcccttatttaatttcaggtatggagtcttggttcccctgatcctaatttcacattagatggccattcaaaaggtgtcaattgtgttgattactttactggtggtgatcgcccatacttaattacaggctctgatgatcagaccgcgaaggtatgccatctgcagtgaattatcttgtgagtatattggacattgttacgagacacttcgttgaatcaggtttgggactatcaaacgaagagctgtgttcaaacgcttgaaggacatgcacataatgtctctgctgtttgtttccatccggagttacctataatacttactggctctgaggatgggacagttcgcttgtggcactctactacctacaggttctctcgctctctccccctatgatacaactcataggatacttcatgcatagtttgaattttgagataaattcatgtactcgttactctcgtgggtgtgttgttctattgatggcaataaaaactctgttcggtggcataaaatctggttcttaaataatcattggtgtgtcatatctattgatgaccttacaagcatagtttctggtcttcatgtccttgtttctttacgaattagtttgtgcatttagtaatttattatttagccatgtaattttgattgatgcagcattacattctttaatctaaatataaatttttgagtgaaagtgttacatttactcctatagcataagtttgtattacaactcagtcctattttagtaacaatatagagcaatttatagcttgaagtacgactagctaagaggaatattttctattaaacctgtcctgattggcatcagagctggtagtgatggttagggtcaaactaagagaaatatgcaactataccacttcctaacaattggtgacctctgaagtgaagcactgtgtccagagaatttgaagctaccattttcctgtggtgttgaaaataaggagattctcttgccatattttgaaactagcattctacaccaggatatagataaacaattttggggggtgcgaccaggatgcacatcacgcccatgccacaaacattcacttacgcgtagctactatgcttgttagttacatgaattacactgtcttcaataagtattataggttactatatatgcatatgcttagttggcacctggcaagatgttcttatctctgtgcattggtttgttcttctcttttttttgaagactgctttggttgttccatttttgtcaatcattgttttggatccttttaatcttactgtagactggaataacacgttgcttgtttcttacaggcttgagaacactcttaactatggccttgagcgagtgtgggctttaggatacatgaagggttcaagaaggtattggaaatattacactcttactattcggatgctatggacttacggttaatgtcaagtaccatgatactaaatatcacctattcatgtggtattgaagttccccacacccaaaatgaatcaaagtataaagatttgattagtttagcgtatatgttctctgctccatagttctctcccaatgtagcaataacatttttcgttgtctgctaaacagtttattccacaatttgctcttcacagaaacccttttcttttcatgttttcattaacttcttccttttcaagttaatttagtgatacgggaaaaaacttgacttgtgcagggttgtgatcggatatgatgaagggacaataatgataaaaattggccgtgaagttcctgttgctagcatggacagcagtggaaaaatcatatggtcaaaacataatgaaatccaaactgttaatatcaagactattggtgcagacaatgaggttttcttgttcaccatgctaatatgttgaaaacttgtatactttcttatacgtcttgtttactaacctgttccatttttcagattgcagatggtgagcgcttacccttggctgtgaaggagttgggaacctgtgatctttatccacaagtatgttcatattttctatttaaatgaatgcatcattcgcatagtgatcaagtgatgttttccaccagaaccaacttgatgcttgcaaatgagtcccaaatttctgcttgagtttctttttcctattcattacatgagtcacatgtatacaccatttgaccatgcatgttgaaatatttttaatatgttaatttatttgacatttgcactggtgagttgttttatttaaacacaccttggagattctgttgttgtagtaaaattaaattaatctcaaatctagtatagtgtaattatagtgtatgttagtaattatagtaattatagtgtattcatttcagagcttaaggcacaatccgaatgggagatttgttgttgt

SEQ ID NO: 86101 - DNA, 883 bp, Oryza sativa
cggaaagcataggaggatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggaggcataataggtcagccgtgtaagcggaaacaccagtcgacggcaacgaaggtgagccaacggtgaggatgtagacattcaacaacggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcgaaggcaccactcggcggcgacggaggcaggccggcggtgaagtcgttgacgcccaacagcggcggcataataggccagccgtgtaggcagaggtaccactcggcggcgacggaggcaggccggcggtgaagtcgtagacgcccaacagtggcggcataataggccagccgtgcaggcggaagcaccactcggcggcgacggaggcaggccggcggtgaagtcgtagacgcccaacagcggcgggtaccgag

SEQ ID NO: 86102 - DNA, 704 bp, Oryza sativa
ccggcccggcgcgcgcgcgcgcgcgtgccaatccgacccccacctcaactggtcaacagggagcctccaataattccctatttatgttgagatattcctcgcttaaatcctgaggtggtattattatccttaacacttattatgggcctttgagatttaataggataagttgggcctaacccaattattctaacaatccccaccaaatttcaaggctcataagaaatgttctcaatgttgtgcctgtttgatataccagggttttggtggagactgttaagttgaacttccacctaggaaatgagctacatcagaccacaactgaacaatggactatgccttgaattgtcagttttgtgttatcaggtttcactcagaaccttgactggtactgggctgccgttcgcatcccctctgtttggagcatataagtcaaactccaggcctttcataaatatctagagattgtccaaacctcatagactgtgactagcagtcgaactcatataggtgtgttccttctaagatgttctgcaggtcaacatctctgcttggaaaagccactcggatcacattaaggcatgagccatcctaccatgcaggaaagaagagaagcacattatgaaaatgagcccttttcaagggtctcttctctcagtcacacaatagtttgtttcgctatccaaattcacgggatctccgat

SEQ ID NO: 86103 - DNA, 1608 bp, Oryza sativa
catctctcatttattgcttgctgatatggttttattctttcagtcctaccttcaaaataatttaacaactcaatgagctaggaaaacttaatcctaacactgacctcttccagtttcctttttcttccctagttgacatgcttcaatatccatgatgtttcaaagttgcacaacagtagtataagaactaagaagcctttcttagcaaatcagcagccaagacaacatgttccaacaggagcctactatagttgattcatagtacattgtgtgtgtgggtaccacataaaccaagaatgtagtgtgacattgctgccttaagcgcttccaattttttttaattaatggaaagcaaagctacatttggtcaaaatattttgtaaaaactatatgaacagcaaatgagatggttctcttcaaaagaatcttaggttccagtcaaccaaagaaataactagcaagcatccacaggaacatcaatacatcattgatcttcattatcaatatggaactaaaattgatattgactgaattgtacatatgtacaacatgccaacctctaaaccaaataacaagtctaagaggtgcacaaagttaaaaagtaagtcaaattgtatgtaaatgcctatagaaattgtgggaaaagacccaagttaatcaaattgacagttaaaaggtcaaatggaagggacaagaagaggcacatacttgtgatctgctactaacaattcatcctctgcaacctttagcaaataccatggaaatgctattgaatctgcaacaacttttttcactcaagcctagtttatcaacaatcaaactccagatgcctctaacatcctccttcccaatcccagatctgcttttctaacagtgcggtctctgcagaagaatcagacatgagggtttgaatctgatgcattagtacatgaccgttctgggtagctgtaaattttctcaagtactaaaaggcagggaaagaaggaaaatgtatgattatatgcacgcaaaacatatgaacatatagtacgcttataaatcacaaaatctattgctagtgaaaaggtcatacttcctttccaaaacaaaagaaagggatagacccttttatggttaattacctctgatcttcagcagcattataaatgacgcattagtgcttaagaacttgacagattcaaattaaccatcttcaaagcaaatgaattatcaaatctgcaaaagaaaattctgattatcatcccgcatggattgaggcctacagcgaacaaagataagcttcaaaatttaaacacaacagaaacagaaagccatacatcaattatgaccctatggtggttactgtatgagatgaaactgtgatctccatcttcatcaaccaatacgcaagctgaagcacatgatgagcgcacaacataggttcaatagaacaggaaatttagagatgcaagatacaatttatagcattacaaatatagatacagcatgtttaatcatcacaaaatcacaatccccaaatgattggggttttttttctttgcggggaatccacaaatgattaaaacaacttgtaaattttgcgcaagctagaaatcaccaagcttgcat

SEQ ID NO: 86104 - DNA, 4118 bp, Oryza sativa
gctaagtgtagtggaatttgcattcgtgactgttcaatatgccgttgaagctacccttgcggtgaaaatgttagggggggcatctgttttcactggtagagtgactgcttggactactggaaatgatgaagatgaaatagttctctatgacagtgaagttgcagacactcggacagagattacagctgatggatctgttcagctaaatcgtggtttagtagttgtcccattggataaggagctggtgctcaatatttgtgtgtttgagggtgaagatgaagctcaaagctttgagttcattctagggcactatgatgaagaatttacctgcaagcaaggctgttatgagtttcaagttaatattatttggacggcagtaaagactcggcgacggcccaatatgtggaagcgcattggttgcattgtactgttactttgaaggctgtaaaaagggtgcacttatcagagtcatatatgatcggtgcactcaaaacatatctatctatccataaaatttcctaagaatattctcttagatatgtattgctagtctcagtctgtaaatgatgatcacgcttatcttaattagacacatgcatgcgtggtattccctccgtttcaggttataagacgttttaactttggtcgaagtcaaactgctttaaatttggtcaagcttgtagaaaaaaaatagtgacattttcaactcaagataaatttattataaaaatgtattcaattattgattcgatgaaactaatttagtattataaatattattatatttatttataaacctagttaaacttgaaataatttgactttgaccatagtcaaaacgtcttatgacctaaaacagagagattaatatctgagatgcagtgacagttgccaccctcctgccctgaacctaatccagcggccatacaattgctacgtcgtctctcgagtcaagaagttcaccataggaactggatggcattgcgcacgctctctatctaagcctgtttttttttaactacttcactgcagagtatatatttttgttataaaaagaaatcttatattagattgcttaaactaattgttttcagcatggcagacaggtcaaagcctgctgccctctgaagttttcgtttgccatcccaacacaaaaagcgaactcatgcaatttgaatcagatttgataaggaagttaaagtgaactttttatttttaaattttacaaataaactctctcaaaaacttatttccacgaacttttggtcacgccagacagactatcttaacccaacgtggcaatattgtttcaccacgccatcttaactggggtgccaaaacaaaatgctgttttaccacgttagacggggtttggcgtagtgaaaaagatttattttttggaaacaaattttacgagagtttattttaaaaattaaaaaaatcaaaaaatcaaaaaatgataacaaattgtctcacgagtgatccgatccaaccaagtagtttagtccgttatgttcttccgccacatcacaataattatattaccctagttttcctttccctctctctgcgggcggcggccacatctccctggtacgcgcgcgcacatcgatcccctctttttttttttttttgacgctgcatcgatcccctcttcttccgaattcgatgcaatcgcctcttcttctttttttgttcatttatctccatcatatcgcgcatcagcagcaacgctcgcagatggcggagggcggcaacgacggttcggttgcgggggatcggctcatggttgcaacaatcaagcgcaagcgggagcttgccgaataagatggagattcttcttccccttgtagcgctaatcgatccctcgacatggaggtagtggaggagaaattgtattgctcttatggtgagtactagtgtacattattattattccataattaattcgtcaatatatctatcattcagataactcagacattacaattagtatatgtgtattgattatgtgagcagcctgatatatatgtatagtttaccctgtttgattcctgattacttgcttggttgctgctggatggatgtaacatatataagataataagaattacaaattataagataaacacatcaccttgagcgcgcggcacatgtcgttctaacctgagctgcagcgacgacgacgacagagagacaattgaaacaatgttcaaggaacttccaattggaaaccccaccataagcatggatgaggatgtggtttacttgctctctataactagccccatgaaaacggataggttagaagttgtgtttgctgtcccccgcaaaaaaaaaaaaaaagaagaagttgtgtttgctgttgatgtgaggaagggtatgcttcaaggattagctaagcttgatgttcgcccgaagaacttggctatcatggtcactttatggaccagtgagatttgtaggtatctagtctgaggaatattattacaggtaacttaattctctacgctggtaattaactttattgtgtgtttttatgcgtgatcaatatgtgtgagtatgaatgccatgcttgccatttttaagatctagggaattgttgtgttggtaattttctggtttcagtagggtctagagcttaattcagaagccatggcttgatgacagtgttatgccacaaaaagattgaatccatctcaaaatacaccaatccgttacaaaaagattgaatcttgttggctacattgttcttgattagtgagacagtctgatgtgcagatgcacaataatgttctctcatttgaagaaaagaacaaatcatgtactttactcgcttggaaccattagttgagttgtattttctatttatgcaaacccaactttgatggtaaaatacttaaaattattatatgtacgtagtatgtgctccctttataaatatttaatgcagttgattttgatcataaagtttgatcatttatcatatttaaaagtttagtgtaaaaatatgcaaaaatatcatgtttaaagtacctttaacaataaaacaagtcaaaaaaaataattgtatttttttaataagataaattatcaaattttgttgtcaaagtcaactgcgttatgaccagaggaaagtacccgaatctcttaacatacagttggcattgtcttaattgtattggacttgtcgagtttggtgttttttgcgggcatttctgacatgattttccctaatctatttacaggaggaaccattaactttgacaggacctaataatcgagtacttggtacactatacagaattgagttacatttaaagattagagacgatggtggtgttgaccaagatttctgcgagaaggcgagaacacaatgcatcagctataaatttttagtgaaagtagccacaaaatgtccggaccagtatgtgaacaagtataatcgagtggcaaattgatcttctgtatctgctataaaattatgtagctctgtgatggaaagcttgaaggagctcacaattccagtcaaatttctagtaaaaaaagaaaaggaaaactaaaaaaaaagtttaaactcaaagcccactagtaaatactactaatacaactaaggcccatattgggccgcccatcacggcccacgaacagcaacctaatcctcgcgctggaagagacgagacaatacgccacgcgccgcctgagccctcgcgtcgcgacaccgctcgccgcggcggcgctgctcctctccggcgaccacgcgaggagggagaagaggaggaagaaggcgagaagggagcgagctggaagagcgggagagggggacatctaggtcgtcgacggcctcatcaatggggtggggcatgccgacgcggccaccggcgacgtcgacgccgtcgcgggtgcaggcgctgtacgagctctgcaagcgcaccttcccatcgccgtcctccgtcgccgcgtcctcctcaccgtcgtccccgccgcccgaccacgccatccgcgccatctcctctctgatgggtaggtgacctgacctgacctgacccgccgcccaatcttgtttttgttcttggttcagagttcggactgcaaattgattgctctttcctctgcaa

SEQ ID NO: 86105 - DNA, 953 bp, Oryza sativa
taaaaaaaagttttaaactcaaagcccgttagtaaatactactaatacaactaaggcccatattgggccgcccatcacggcccacgaacagcaacctaatcctcgcgctggaagagacgagacaatacgccacgcgccgcctgagccctcgcgtcgcgacaccgctcgccgcggcggcgctgctcctctccggcgaccacgcgaggagggagaagaggaggaagaaggcgagaagggagcgagctggaagagcgggagagggggacatctaggtcgtcgacggcctcatcaatggggtggggcatgccgacgcggccaccggcgacgtcgacgccgtcgcgggtgcaggcgctgtacgagctctgcaagcgcaccttcccatcgccgtcctccgtcgccgcgtcctcctcaccgtcgtccccgccgcccgaccacgccatccgcgccatctcctctctgatgggtaggtgacctgacctgacctgacccgccgcccaatcttgtttttgttcttggttcagagttcggactgcaaattgattgctctttcctctgcaaaatcgttcgtatgctgatgtattgaggaattggatgtgatttttgtgttcagatacaataactcctgttgatgttggactcagagatgataatctcgaggatggaagagggtttgggttctttgaatcaaacttcctgaagaattcagcgagggttgctagatgggcgcaacccatcacttatctgcatgtctacgagtgtgacgccttctctgtatgtggatgctcaacttggtcatcttcttgtattgtaacacttctgtgaaagagtagaatttaatgaatacttgtatatcttctctgctaacctgcaattgtttcctgtatgttccatagattggaatattctgcttaccaacgtcggcggtcattcctctccatgatcatccgggaatg

SEQ ID NO: 86106 - DNA, 3429 bp, Oryza sativa
ccgttggctcaccttcgttgccgtcgactggtgtttccgcttacacggctgacctattatgcctccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcctcctatgctttccgtttggtttgccaatggatggttgcctttgggccgattcctagcacccgggggctcgttggatggaccgagtaacgcaaggtgctaagtattattcggaataaatcaaaagcatagagacgagataaatttattttctgctcttaataattgcaaaagtacccgagtagtaaattctgatccgtgaaactttgttccattaatgacgaactcatgtcactcatatgcatgtttgggaagtgcctaggccgactcccggtgcttgatggttatgactagtcggacagagtgtttaaacgtacagagtcatctgctcggggaaatcaaaattgacaagaggagaaatacatatttataaatattttaaaatacttgattttttctcaagtattatatttatatcagatactactcatcctatatgtttgttctgcaggatccagatccagatatgcataaaagggattcatggctttaagcttatctcttacgctccaggaatggatcagtcagaacatcaccgaccggccgcctcgcccgccgccgactggtgcttccgcctgcacggctggcctttatgccgccgttgttgggcgtctacgtcttcaccgaccggcttgccttcgccgccgccgactggtgtttccgcctgcacggctggcctttatgccgccgttgttgggcgtctatgtcttcaccgaccggcttgccttcgccgccgccgactggtgtttccgcctgcacggctggcctttatgccgccgttgttgggcgtctacgtcttcgccgaccggccgcctcgtccgccgccgactggtgcttccgcctgcacggctgacttattatgccgccgttgttgggcgtctacgtcttcaccgaccggccgcttcgcccgccgccgactggtgtttccgcctgcacggctagcctattatgctgccgttgttgggcgtctacgtcttcaccgaccggccgcttcgaccgccgtcgactggtgtttccgcctgcacggctagcctattatgctgccgttgttgggcgtctacgtcttcaccgaccggccgccgcatccgccgctgactggtatcaccgcctgcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggccttaccatcttcatcgccggtcgtctcgtctgctgctgactagtgccctcgcctctacatctggtttatacagctaccactactgatggacatcatcatcttccgtcgccgactgattatgccgccgccgactggtgcttttatcttcacaactgcgcgtcttcgctaccggtttgcttctgttgccgccgactcgtgttcacttcatcacggcaacacaactttgtcatcatggtggagcgacttcatctttattatcttcggtaccagcaaactctattgctgctacttcacaagttttgctacatcaccaaccatgacgttgttgtgaatctcgacatctcggcaggcgatgccgtgttattttactacaacaagtggctctccaacattcatgatttctacttggacatcttcaacacatatcttaaatcaagcaataactattcgacgacaagatgctacagttctcgactctatgttcagttgtttcccaactaatcaaagagtcgggggctacacaaatacaaggctcaaaatttgacaaattttatgtcaagctgaagaaattaattcatcaaccaacgagtcaactccaggagtcattatcttcatctttgattcagagcagacattctacttcaacaacttgaaatattttggtttggacgagttggacaacaacatcaactctcctccaagtgaagcatctacaatagctataacattaatttgatggactattgtcactgacatcatcaccagcacttctgcttcatcgaccctgacatctctgctgttgctaatggatgattatgttttcgccgacttattatttcaccttcacggttgacctactatgcaaatgctgatgagcgtctttgtcattatcattggttgctacactgctattggctggatcaccgacatcgtcatcttcatcatgtcggttgcgtttgtcgtcgtcaactacacaactttatcgctgagcgccttcatattcattgctggctgatctgactgctgccgactggtttcttcgcctccacggctgtgcaacttcatcacttttgattggtaccactatcttcactaccaccaatatttttgccacctctgctggtcaatattatctctgtatttgtcgtcttgtctctatgccaattgcgtcagctaccatcaatgaacaattgtgactacgtgctcaggggcttactagctcagacacaagtatcataccttcaatttggacttgctctggatatatgcaatatgaattcgtgattatgggtctattttctatgctcaaagactggactatttattattccccgtaagggttatcaactgaatacttgcgccagtcgggattcaattgttacatctattttggagtatcccataagggataatcactcagatcagaagcgattgatatgagctatacttggtctatatcacccgttccaaatttattactcggaagcatgttacatgcgtcatcctttaaagggtgtcgaaggcatattttttggcctaggcctaatatgtctgcagcccatattttcaggtgtggcctgtcacgttcttatagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatataactggcccgctgacttttttatata

SEQ ID NO: 86107 - DNA, 2477 bp, Oryza sativa
aaatgggggggcggggaggacgctgtgtcggcgacgcggtgggggaggacggcgatgggcgacgcggtggaggaggtcggcgatggcggcactggggttgacggcgtggtgggggagcgacggcgatggcggcgctggggtcggcggcgtggtgggggagcgacgcggtgggggagcgacggcaatggcggcgctgtatcggcgacgcggtgggggaggacggggatgggcgacggcggtggatgcgatggatgcggccgcggcggtggatgcgatggatgcgggcgctaccccccgatgcgtgaggatgagccgaggagttgggtggggaacgttgcgccgttggatttagcgatccgatggctcgtactccgcgtatctgccagggttggagtcaccgccaccgatacgaaattttaaaatagtagagatatagtaatatttttgacccaaaacaaaaaatattaaaatatatttaatgttacatttaatgaaaccagtttagcgttatagatagtgttattttttttctaaaactttattaaaaataatagatgcttgaaaagaatttaaagtgtcttgcaatacgaaacagtgggaataaataagttggaccgggcatgaatcggcttaatattatcatcaattctctggtgtaaactctcaatcctcttccctcaaggtaccaaacaagccataggcagactttacagcctccacgacacctcgacggcggcacgtggtacaccgtctccaccctcgatctccggccaccggtgcacgctaccggcggcgagctcgtcagctgggaattcgacctccacctctacaaatccacctcccattccaacgggtggatcaccaagcggttatgtctaaaggagttcgtcagagacaaggctatccctctacccaaatccgtcgacaggctgtaccacgagaccggcaagagaccatcgccgtcggcggcgaggccggcaccgtcgcgtttatgatctctctggcgcggcgtcttcctcgtcgacgagctccccgtgctctgggacatcccgctgacggcgccggcgaaggggaattggaataacttcctctaccaattcgatcctactccctccgtttcatactataagactttctagtattgtccacattcatataaatgctaatgaatatgggcaatgctagaaagtcttataatatgaaacggaggaagtagctatttccgcgacgtcaccgtgtctcgaaacagacaagtatgttgagatggaaatctggtcacgaacagagccaatgaataataatcctaccccagtttcttacgtggattgggtgcgcgatctcaataaaccgaagaaattcaaagaaatcgatcgtggatggaaggctacaacatatagcatgccaatgccggtgaattgttcttcttcgtgctgctgtgatgatgattggcagattgactgtgaaatcgatgataattaaacacatcagcttaagcgacagctgtcgttctaatctgagctgcagcgacgacgacgaaaacagagagacaattgaaacaatattcaaaaaacttccaattggaaaccccaccataattaagcatggatgaagatgtgattttcttgctttctataactagccccatgaaaacggataggttggaagttgtgtttgctgttgatgtgaggaagggcatgcttcaaggattagcaaagcttgatgttcgaccgaagaacttggctatcatggtcaccttatgcaccagcgagatttgcaggtatctagcctgatgaatattattacaggtaacttaattctctacgctggtaattaactttattgtgtgtttttatgcgtgatcaatatgtgtgattatgaatgccatgcttgccaattaagatctagggaattattgtgttggtaattttctggtttcagtagggtctagagcttaattcagaagccatggcttgatgacagtgttatgccacaaaaagattgtatctgtctcgaagtacaccaatccgttacattctgtttgcccccttaattaacaatcctcttttgttggctacattgttcttaattagtgagacagtctgatgtgcagatgcacaataatgttctctcatttgaagaaaagaacaataatgcacaataatgctactttactcgcttggatccattttagttgagttgtatttactatttatgcaaacccaactttgatggtaaaatacctaaaattattatatgtacgtagtatgtgccccctccagttataaatatttaatgcagttgattttgatcataaagcttgatcatttatcatatttaaaagtttagtgtaaaaatatgcaaaaatatcatgtttaaagtacctttaacaataaaataagtcataaaaaaattagtgtactttttttaataagacaaattatcaaattttgttgtcaaagtcaactgcggtatgacca

SEQ ID NO: 86108 - DNA, 3884 bp, Oryza sativa
aaccatgccgtgtgggtatggggtacccataatctccacagtagcccctgagaccttcacagtcggaaagataaccttctctcgaactagattactccaaagtcgagtgcttcaatcatcttcgccatgatctcccgagtacttttaccaaatctgaagactgtggagggctgaaaaatatagtcaggtgtatcgactagatgcacctaataggtgtaacccccgactatgtggttaatcgaacaaaccaaacatatagtcaaggaatagataatccaaccaaccgagtggttttgataattatagtcaaccaagcgacttaatatcaatatatagcatatgcggtgtgaatcctccaaattacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatccgaataaataaactcataaaggatttaccaaccgcctagaaaatgaccacaatatataatcagcctaagccataatattggtcaataaaaatgcacacttacgtggcaaaaagcaatgatattgtatccaatcaattgcttaaaaacccaaacagcaccttgacttatatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtgacatgctcccgagtaacaaatcttctgggtaatatagaccaagtgtagctcatatgaatagcttctgatctgaatgactatcccttatgggatactccaaaataaatataataattgaatcccgactggcgcaagtattcagttgatagcctttacggggaataataattggtccagtctttgagcatagaagatagactcatgactatgaatccatgtggaatgtatccggaacaagtcccaattggagatataatcctcacgcttgagttgatgagcccctgagcatatagtttgtccttctgtcatagtcaaaattgtctattggcaatagctgacgcagtcggcatggagatgaaatgaccaacatgaagacgaaattgctcatcagaagtaacggaagatgtcagtggtagtaaaaaacagtgacaccaatcaaaggtaatgaagttgcataaccatggaggcgaagaaacagtcggtgatgacaaaagcaaaccgacgatgaagacgtagacgcgcatcaacagtgatggcgaaatccaccaatcatgaagatgaagaaaatagttgacgacgacaaacgcaaccgacatgatgaagatgacgatgtcggtgatccagccaatagcagtgtagcaaccaatgataatgacaaagacgctcatcagcatttgcatagtaggtcaaccgtcaaggtgaaataataagtcggcgaaaacataatcatccattagcaacagcagagatgtcagggtcgatgaagcagaggtgctggtgatgatgtcagtgacaataatccatcaaattggtgttatagctgttgcagatgcttcacttggaggaaagtagatgatgttgtccaactcgtcgaaactgagctgattggttgataactctgctctaaagcaaagacgaagataatgactcctggaattgactcgttggctgattaattgattgcttcatcttgtcgaattttgagagtcttgtatttgtgtagcccccgactctttggttagttgggaaacaactgaacatagagtcgagaattatagcttcttgtcgtcgagtaatcattgcttgattgaagatatgtgttgaagatgtccaagtagaaatccggtagtgaagacgcgcagttgtgaagataaaagcaccagtcggcggcggcataatcagtcggcgacggaagatgatgatgtccatcagtagtggtagctgtataaaccagatgtagaggcgagggcactagtcagcagcagacgagacgaccggcgatgaagatggtaaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcggccggtcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggtggtgaagtcgacgatgcccatcaacggtggtgtgaccaaccgaccgtataggcggggacaccagtcggcggcgacggaggcaggccggtggtgaagtcgtagacgcccaacagcggcggcataataggccagccgtgtaggcggaggcaccaatcggcggcgacggaggcaggccggcggtgaagtcgtagacgctcaacagcggcggcctaataggccagccgtgtaggcggcggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgcagacgcccaacagcggcggcataataggccagccgtgtaggcggaggcaccactcggcggcgacggaggcaggccggcggtgaagtcgtagacgcccaacagcggcggcataataggccagccgtgtagcggaggcacaccaggcatgcacggaggcaggccggcggtgaggggatcctctagagtcgacctgcaggc

SEQ ID NO: 86109 - DNA, 935 bp, Oryza sativa
atttattgcggtttggacgagcgcgtcacgccgcatgtaacgcagtgcagcgcgctcgtttatccggtctgtgaccagtcacagaccgatcagatcgtgggttaggtggcgacaggcggtctgacgcacgcctcgccccatcccgtcaggacgagagcctccaagcactcgtccctagccagagccggcgtgttagctcctggagatggcacgttggttccggtcagatatatgccaggcttcatcctaaccattacaggcaagatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggcggaagtggaggtaggtatgggccttcccatcagaaggtcattcggacggcagccatacaaatctccgtccattaatgaagagaagtcaagttggagggaagagaggatgagtccccacaaaaaagaaagagatggtgcatgtggtatccccttgaggtataaaaggaggaccttgcccacttagaagggatggatgatttttggagagaagaacgatcccagaacgatcgggggctggctggcactttgtagcttcttcatacacagatccaccaaaacacaggagtagggtattacgcttctcagcggcccgaacctgtatacatcgcccgtgtcttgtgtgtttccactctcgcgaactttccacaaaccaagagcttagaacctcacccagggcccccggccgaaccggcaaaggggggcctgcgcggtctcccggtgaggagccccacgctccgtcaagaaggcaggctagagattgatattctaagcacgacttaatagatcaaactcaactgatgcaacattaagtat

SEQ ID NO: 86110 - DNA, 1097 bp, Oryza sativa
tgcaagaactccagagtggtatccaactttttgtgccccttctcgcaacctgggtacaacgacgttctgtggtcctctaacatcttgtccaatttatgggcccccttttcactttcgcagtcctccttggcatcctgcaacatttgaccaagatcattcgcaacgtcgttataatcagcatctatgtcctcctcgcccgtttgatttccatcaaatccaacgtactgagcaaagtctggaatattgttgtcttccacttcatcttcttccatttcaaccccttgctctccgtgggatgtccaacaattatagctcggcatgaaccccgactcaaacaagtggaaatgaatagtcctggatgcagaatactccttctgattcttacacttatttgttggacaacaaataaaacccttctgcttgttagcttcggccactctcaaaaaataatgcacgccgtcaataaactctttggaccgctggtcagcgtacatccattgccgatccatctacatgaaatgaaaaaaaaatcgtacacaaataatcattcgtacaataatgacagtcatacaataatgataaaataatcacaaactctttcaacagtcatacaataatgacatatcattattcatacaaaaattataaaatattccaccaaataattcttatttattatttttaagttttaaattcttttaatttttaatttagtttgttttcttttatttaagattaactttcgctatattttcctactcaactattttataaaaccttatttagcaaataaacaaaatttcaatatattctttcttttcccacacaaattttctctctcatcaacttacaacaaaattttggagataaaaaagtgtgcaaaacatagctccaaatgtaatatgaccaaaaaaaacattggaggatgaagttgctaaccttttaggcacctccgatttgtatataatcatcaaagtaaattcactataaattttggcatgacctcccctcttttttgaagaaattttgaagtttgctctcgggctggaggaggaagaaggcatatataaagaggggggaactttagtcccggttgg

SEQ ID NO: 86111 - DNA, 8623 bp, Oryza sativa
cgacgggggaggcggcggcggtggcgagagcggagcggaagcgcaggcggacgcggcggcatgaggcgagcataggatggggggcagttcctaccagctgcgatgtgatgttcgattcatgaggaggacggtgatgccggaggcggaggtggtggtggtggttgggcggcgccgccgacgcgcgggctgtggaggagcggtggcggcgccgacggtggcggagggaggcaggaagcggcgtgtggaggaggaggcggcggcgccgcgtcgcgcgtcggcgtgtgggcgtggaggaggcggactggcggttgctgggctggatggttaggtttttcggttaattgtctaattgatgggctgaatgggccagtatagtgtgtcttatggccgaataaaatggaataagttcatcataggtcccttaaccgaatccgattttcgtccttcaactggaaaaccagatcgggtccctcaactatcacacccggtgcagatgaggtccctcagcgttttagatggcggttttggcagacgtgacgcttagtggctagtttgtctctgtcttcatctgacgtgacgcttacgtggcaattcgaaccggaaaagtaataaaactcgtgggacccacggatcagtttcacacataaactaataaaaaatagtgagccccacatgtcatcctcactcccttcttccctctatcccctctctctcttcttccctacaatgtggactggggcggcgggcggacgagcgcaaccgcggccgaagcagcagcgcacgaagccgacggggcggtggcaatcctccgccgacgccgatatccacagcagaggtgcgcgtcctcctcctccttaaacccgtcaccatcggtggccgtcccccctgggcctccgcccgcggctcctctccttccgtcggccggcaagcaagatacacaaacaattagcagaaaggccgaccctatcggcatcggcaagcattccccgatccaagctagcttctaccaaacatcgactcagtggatctcaaggatgtgtccgaccagccagattttacttaggcctccatccaaacagtctctaaaaccaccttctacctatggcctgtttggcacagctccagctccacccctcctggagctagagctcagccaaacagttttagctccaccaaaactgagagtggagctaggtggagctctctcacaaaatgaactagagttgttgagctgggtttaggcagctccacaactttactccagacccaacttctagagctaaatttaggagttggagctaaattgagggcttgttaaatttgtttggtttaaataattaaaaatgtcaaatgtctggtcgtgtaattcggatcaggagcgaatccagaaaatgaatggtaggagggcttgtctcattcctcctctaagggcatctccaacagcttccccaaatcgaactctccaaacactcatatagccaactctccatctgatttagctagtcaaattagatactcactccaacagactctctattaatcctctccaaaataaaaatagaccctcagcctctaccatcttctttctctctctccccccaccttccttctctttccttctttttccccttttccttccttcccgtcgaccacgttgatgccgacggtggctgacacatgacgcgcggtggtgcagcaacgcggggaggcggaaggcggtgcggggaggcggcgctcgctgaggtgctctccctctccctttgcggcgacgaggcgacggcggcggagctcggagcgggatggcgatggcggcggcggagctcggggtggggatggcaaaggcggcggctctccacaacgacgacttggcgaggcgacgacgacggcgaggaagatgcagccacgacagcacatgggcagggatggcactggaggcacatggcggccacggcgacggagtcgagggagaggcgcgggaagccgcaaggggtggccctctgctcctcgccggccttgcctggtcctccgccgccttgtcgccgtggctccgctggttccgggaggcaggggcgagagagaggagggagggagtgaggtggagcgcggggactcggttccaggcgatggtggaagggggacggcaggggaggcagggcaaaagaggcgctcgcgcctccggtccatttcggcggagggcggcgatggaagcagccgaggcagcgttgaagagtttggggacagagagaatgcgagatgtgggaagaaaaatatggttgtgggtcccacaatcccacagttggagagccagttttggctggccaagtttagccacctagggagcccctttggccaaccaaatagcttcgagagtaggatagccagtatgttggagctcgttttttttttcaaaatttctaaattttagtttggggagtgaaatagctatgctgttagagatgctctaagcccctactctttttctccctcttcttcctcctcccatatctccctttctcttaatggtcattcagcggggtagggggcttgagctcctagcacctacgctggatccacctctattcagaccgttacaatctctacggcaatagttaaggggcataatttagactttttctatatttttatcctagttctaggttagaacttagaaccaagcaagccctaaccatgcacgttattattcacgggtaaatcgtaatcgtactctcagctaccaaaacagttaacgtgcagggcaatacaggttcaagaatcaagagagagaagactaggaaatatccgcacaaattttttaacgcgagcgatgcggagttaggccaagtaatccacgatctccacgaaacagattgagcataaatatgggttattatttgcgaccgcgttcgttgaaaccctacaacgatcttaattaggagtggtacgtaggagtagcgcgctaacctcttctcatcccatgcagcacgccgacgacgacatgccaacccaccggcggtgggccgacctccacgccggcctcgtctcgcgcgtcgccgacctctgcgcgctccggggctacgcctcctgccgcgccgtctgcgcctcgtggcgcgcggcgctcccgccgccgacctcgcggccgctcgcccccgtcgccgacacggcgagccgccacgggccactgtcgctggccgtctgctccgtccacgcgcagcgctggtcccgcctcctcggcctccgccagccgtcggggctagccaacgccaccggcgccagccgctgcgtcggcgcgcgcgacgggtgggtcgtcctcgccgccgccaacgcgaagggcgccgccgccgccgccgcgagcgtcgtcctgctgttcaacccggtcaccggagtggagatcccgctgcacgcgtcgctgtacgatcccaactgcgagcgcgcgccggcggcgtcgacgtcgccggcgccgaaggtcgtgttctcgccgtgccccacagcgcgtgacctcgccgcggtgagcatctgccggccgaacaggctcgccgtccagaggacaaccgacgggcactcctccgccctcgtcctggacaccgccgcgctcatggacagcgacgacctcgccgacgtcgccttcgacggcaacggcagggtggcgtactgcctgacgaggcacggcgccgtgcacgtgctccgcctcaaccgccgccgccaccgcggcaggctgcgacccatcgagatcgagccactcgtggccggcgccgtcttcccctcgccgtacgacaccatcgcccggttcacggacgccaagaacctggtgctctgcggcggcgcgctgtaccaggtgtggaggcggccgagcggcgcgggctccgccgtcgcgccggccgggatctgcgaccagcagctgctcctcatcccggagggcgccgtcttcgtcctgaggtacgagccgccggcgtcggcggcggcgggggggagccgccggccgccgtgctggtcggagtcgaaggatctcggcggccacgcggtgttcctcggggcgaacgacgccgcggcggcggcgcgctgcggcgacggcgcggcggagctgatgagaggcgactgcttgtactactgggccagccgcgcagagggggactacgaggccttcgtgtacagcatggcggacaggatgtccacgcggttgccgccggcgaccggtggcgtgtcgagcccgctttggtacttcttgccggccggcgcggcgaacgtgcaagcaacgacgacgaccgctatggaagctgcatcagaggaagtgagcgtcgcagttattacagtataatttcatggttcatatcacaccggtctctctatataggagtatgtgctagtactagctactatcttagcttagtagcttgttaggatgggtggtttgatcattaattagccaagagttctttgttttttttggtgcgaactatgctagtatatatactatttatattaagcttcatgttgtcattttgggttcgatttactgtatgcttgctcaaaagtatgcgtgagcacgggaagagtttatcccgtacgtcctcgagggaactttctcgtgtttttctatgtcgcccaaaaaatcgtcaaaaaaaattaaaatgatttagtaagatagattagtatagtgtgtatggcttcataaacattcaagtcatatttaacatatacaagtagacaaaaatatgacaaatttgaccctaaatataacacataattcatggttaaatttattattttgcttgatcaaccttatcattttttttcaaattcttttgatattcttttagatagcatgcataaaatagggagcgtcctctcgagggacaaaaatcaatctccacacgagcatattaattgtcatgttgttagtttcgaggtcgattaatatattcttttcttatataaaaaggcatactattagttcacatgggatacccttacaagcatcgcatagatggcgtgatgctgagcgtagtgctacaaccaaaggcatatcactttcgatggtaatactgaaagcaacttaggtgttccaaaaaagggaacgggaacatcgtcttctcgctattgttctttgtgttcctaaaagggaacataaagcaatgcctctctttacgggcttaaggtaatgaggagtgtgcgaaggtagacaccaaaggcagttaagagtgctaaagtgtttaggagtgttgttagtggcacacaattctcgatatatagaatcaattattctctatccacctttgaaactaataaaaattcactgaccattattggtgggaatatctttacaattttgatgactatgatttgaactttacttgtagatccagtgagttgggcttctctagttgaggcatggattagggcatgttggttgcagccctggtggttttgtctgacctgatatgcaagcctgaggtccgcctatagcttgtttggttgacctcctggtgcactcgctcagttgtctaacttgacaaccggtccatgttgattagcctggctcaggccaccaaattgcaacgcctcactcatgcaactaaggaggcaagggagataaaggtgatttggtagctatgggtccaattataattgctttcttactgatctcctcgagcatatgtcttgaaccaaacaatctcaggcaacaagtcagggatctatcttcaatttctcctgctagcttcaggcgttggttttcgttaggcatttctcttaggtcagcaaccaaacatgccattagttttgaacccgtgatacctctttttttttaaaaaaaaaaaaactctggttttggtcttcactagttgaagtcggtcatggcatcaacctaatcaatattttcttcttgaaggcatcacacatgagaattggtaggtaaaaaacttgattttaactctattgattggatcgggcagtgacgatgcaaattatatacttttaaaatgcatttcatgaaaccgagacttcaaatacctctttgttgcgatcttactttccgcttacacttggtgttgagattatagacatataatgatttaatctattccataaataaatcatgacattacagatgaaaactagcatgaacacatcattagatctatacatgtaaactacacagtataacatgaacagatcaaatatgcacaacatattgaacacgtaccgaggtgacggaaagaccggttgcttggtcgaaacttttcgccggtgtctacgaagacacgaaacacgcaagcgaagaggaaggcgagccgtcgcgaacaaacagggagcagtcgcgcgaagcgctttccaaataccttattgccgccttctcccggtgcaggacgtcgaaggcagaggttccggagacctgctctcccgatcgccggtgcacgccggcgagcgggatggagtagtctacgagcgacggcgcagtacagagtaggaggcaaaccctagattgatttcgcttatgttgcgtgaagacggcaggtcggtttatatagagaagggtcgcttgatcagggcgcccgcacgatctctactgcgcgtaaccgaaccggataagtcgcgcgtaactatccggactccacgccgtttgcacgcaccggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgcacgcgcgccgcctgccctgccaggcgaggcgagcgagcgcgcgcgtatgtttcccctcttctctccaccacacatgcttcaagtggctaggagggcatcctcccttttaaggaggtccccctctcctagaataagtaaggtggtactaaactccacatgcatgccatcccatgaggtgggcttttgtgattttccaaagaattaatctttgagtgggctaaggcccattcattaattccaacacttggtttcctattggttgcgatggctgatgacaaggctatatattttctttcttttcaagaccggccataactttcggtgttagtgtttatagttagtaatggtgtaacctgtaatgcatgtgtatttgtacttgatgaaccctttttttattttttttatgatgttggttagttttttttagataatagaatataatatcccggtctttacttaaaaagagttacagtcaattattataaagtagcactctagaaaagagtgtagttcaaataaaatagaacgcacaaaacacacaaaagagtgaatcaaaccaaaataagaagaacacatttattctagcctatttgtgaatcaccatctatagttggtaaaaggttgcataacagtcgtctccatcttgcgacatgcaacttttagaaactcccaatcattatcacacctttgtaactgtgcccacaaccggagccagtgtgttgccctgaaaattacctgcatataggtgatagatgttgatttgtcaaaaaccatatcatttctactcaaccatagagcccaacaaattgcagaagctccaacaagtatcagttttttcttttccttgtcaacacccaaaagccaccctaaaaaatataagatatacttgtaggaagattaaaaccaaaagaaaactgaactgctctccatatgaactttgcataatgacaataaaaaaagagatgttgagtagagatatacttgtaggaagattaaaaccaaaaaaaaaaccgaactgctcttcatatgaactttgcataatgacaatccaaaaagagatgctgaatagactcatttttcataaaaaaaacaacacctcaagctgccattccgattccgtctcaccaaattatctttagttaacacaactcctttaagtaactatcacacaaagattttaatcaatggtaaatattttgaatgggagggatcggagtagatgacgagtttataactcccttatatagaaaacaagtttctttgaggtcaatttctgtaacttgcaaaagtatttgatatgcgtacgtgtttcttgtttttatgtacataaccttgctctgacgagttagcttcagctcagtctgcttagataagcatatcgttgctacgacagctgcaattgcagccacaaacagctggaataatattttaagatgcgttgctaaaataacctcttatatatatgcttatcttgcttctaaccaagaaaataagttatgaagaacaaataccaagtcggtttgacttacattagccaaattgtaagaaagtttaacccaaatcaaacaagcaacttttctattagtattttgcaaataaatgtcactcttacatgacaggaaaaaaaaaactatcttataaccgacgttgtcaatatgactttgattttttttcaccttaattaaaagttactactcacttatagactaaatactcctgaagcatttcttattactccttaagggcctgttcacttttggcatgttcactttgataccatttttaagcttaccaaattttggtaaagttgctaaaaaagtggctacatttagtttgctgctaaattttgataactatataagaaatc

SEQ ID NO: 86112 - DNA, 3166 bp, Oryza sativa
gatcaaatagttagaggaggcagtgtggcaatcaaagtgaatgacgaaatcagaaatttctttcaaacaaaaaaaggactaaggcagggggacacgttatcaccaattctctttaatttggtggctggcatgttggcaattttgattaaaagggcaaatgaacaaggtagctttcatggggtagttccacacctaatagataatggtctatctatcctccaatatgcggatgatacgatcctttttatggaacatgatatagaagaggccaagaatctcaaacttgtactaagtacattcgagagattatcgggtctaaagatcaactttcataaaagggaattgttttgttatggtaaggctaaggaggtggagaaagattatatcttaatgtttgggtgtaattccggtaagtatccttttaggtacttaggaattccaatgcaccacaaaaaactgtcaaacaaagattggttctcaattgaggaaaggtttcaaaagaagctgaatagttggaaagggaagcatctctcggtaggtggtaggcttgtgttgataaattcagtgctcagcagcttggctatgtttatgctctccttttttgaggtacctaaaggtattcttgaaaagctagactattataggtctagattcttttggcaaagtgaagagcataaaaagaagtacaggttggccaaatggagcattttgtgcaaaccaaaggaatgcgggggtctcgggattcaaaatcttgaattacaaaataaatgtctgttaagcaaatggttatataagcttatgaatgaggaaggagtgtggcaaaatctcttgagaaacaaatacctatgaaagaaaactctgactcatgtcgaaaaaaaaccaggggattctcactttttgtccggtctaatgacagttaaaaataccttcctttcatgtggatctttaagggtctacaacgggactcaggttagattttgggaagaccgatggagtgggattagtccttttgctacacgttttcctgagttgtatagcatagtgaggaacaagaatgagtcagtagcaggtgttatgagtacaagacctttaaatgtttcctttcggagggctatagtgggaaagtatctaaaagattggttaaaggtagttgcagaggttattttagtaagtttaacaaatcagaacgatagcttcgtgtgggaggcacaaaaaatgggctcttttctgttaactcgatgtataaatctatcatgtacagctcatgtacagggacgtcattccaaaaaatgacatgatctggaaactcaaggtaccgctgaaaattaatttttttttgtggtacttaagaagtagagtaatcctaacaaaagacaatttggtcaagagaaaatggaaagggaagggtaaatgcctgttttgggaatcctaaggatccattccaccttcttgcttttgttggccctctgcacgatttatgtggaatgttgtcttcatttcttttggaattcatccgcctaggaatgttgctagcttattgggtaattggctaagggggggttcaacctaagctaaaaactcaagtctttgtaggggtcgcagcgttgtgctgggcggtatggttgtgcagaaatgatgtagtctttaatggctccaatactaatttcttgttgcaggtgatttttagggggactttttgggcaaaacaatggtcttcgctgcttaaggaggaagatggccaaagagtaaaagatggttggatgatattggagaagagagtttctagtttctttgcaatgagagggtggaacttaagaagaagattggaagtttaatgctctcttttctttgcaccatggtgttttgttgtcttaagtactattttggctaatctctgtcattgtctaagtgtccgtttatggtcactcgaatttacgttaaaccttttgtaagggtgtgagtctaagtgctcgtgtaagagacttttaggctgtgtacatcctttaggtgtagaggccggtttaatccactatctaaaaaaaatgaatcctcacgaaatgtaaaaacaggtgactacttacgacatcattgaaatcattgattggtgaccctgtttgattatttttcttttattgattattatggagctgtagaaaagaggttttgcagtactaacattgtataggatataataccagggccaaacatttgggtggtttgtattagtgctcttctttttctagccattcacttcattcagtttgacaatatgtatatcattttttgtccttaacattcgaatgataatgctttaatgcagccatcttttttacaaaatattctaagcataatttcaccaagattgccttaattaatgaaatgtgactgtcagacatagatgcatgtgcctttttcttgcgttatgaaatgtcagataaatttatttcaagttactacttgcaaagtcgtcaaatcttagttgagcaaaagtcagcagtacacaatctgcacatatacgtatcccactgtccctcaagtatacaggcaccacacgcacatacattatattaggccttcacacagtttgtctcttgaacgagagacgttgaattagtcaaactcttgttggcaactttttgtgacaagttgacaagcacgatcgcagcacctcaagccttgcagtgatcctagagtcgccaaccacctcgatctagcaaggagctaaatgtagatgggttttgataactaaaccggctagcggagccgatttctagataactacccgtctcgtgggcaaaacggaaggttttcgggacaaacctacaaagagatgtcgcactctcgcagcggcggcggacggtttacggcgcaaaccgacaaagatggacaaactaagagaaaactaaaagtaatatgaaaagaacaattcgattgattgatagtagattgatttttacaatgaaccggccttgtcccttatataggggttggtcttgccctctacaggcccttctccatgtccaacttgggatagaaaccaaaggaaacctgaaacatgccttcccgagcaaggaaacctcgaaacccgacgcaacagaatcggactcgagcctgccggtcagactggctgtggccggtctgaccggcctccaaccggcggtctgac

SEQ ID NO: 86113 - DNA, 3299 bp, Oryza sativa
tcctgcagccctgattttgaagataagcaactatggcgtgtctggttcgacaaaaggttttttttcttcgagttcttgcgctttccatcattaaatgaagttccccccatgacatctgctgcataacaaagtttcaagaacgacactaattaaacttatatgaggaaccaacaagataatctgggtcaggaaacatgaaatattaaaaatatcaggtagcgttttataaatattggtgccaccgtgtcaggtcaagttcaacatctgtagtgagacttgaatggcgaccaaactatattgaaacagtgcacagaaaagccaacgagttgatcaaacaaatttggtgtttgttattaccagagcaactctgttgagagactttagacgatttcggatatgtagagctggaaacaacagaagaattctgcagtattgaaagagctgcagcaaaacaaaataggcgtcagactgcaactttaacatactggatgtttaaaacattttattgtgttagcggacatattgtattattaagaaaaatacctgataataactcaataatactgataatgacaccaacaaaagaaagcgaggagcgtttcgggtacaattttctactcatattaagcaaatgggtctgcaagaagcaaaatgagtgtaagagtttatactgcttttcaggaaaaaaagaaaaatgttaagcagaaatacaaagtcacactgtttgcacattttgcacagaacaaatgaggggagaagatggtacagaagaagaaaatgggtactaaactgaaacagaatatataaggaacattaccttgttatcatcgcttagaaatgtggcattttccaatattttcaaacatttcaagaggagagcggcactttgcaaagatgttccttcatttaggtccaaagctgaagttgaggtatcctttatgagattctgatacacaaggtttccaccagaagtatattgttaatttatttattcagtttatcagcgtaatatgattgcattattagttgggggcataaaaagtacacagataggagcaccaagcagtttatctcttaaagggatacgcaatttactccaaagtttatgcaagaacagcaagtatagctggaaaagtaacatccaaatgaataatgtccacttggtgtagatatgtcaagtattattatcgtgggggatataatcatcagaggaatcactgtaagacactaacaccacatgcagaataaaaaagtattaaaaaactattttgcaacatgaaacaacataatttgtgatgcagccaattttccatgtcctgatgaaaatagttactacctcaagcattttccatgtcccaaaatataacaacctttggctatgtatctggacaagcattgctttcatgtggcttcaagcacattaaagctaaaatggcaaaaaggaacaaaacttgcaccatcctttagagttgaacaaaggaagtgtaaaatatgcgatgttagcgagatctcacctccaatgttgaatggcaatccatcataacgtcaaaaatactatcaagaccgcccaactcccttaatgtctctttaaaatttcctccgactctggacacagtgtcagaagtctctgtaacaatcaaatatttgataagggaaaaccttcctagtatgacaatggccataggtgcttctagtgcagtcaattactccaattcagttgtgcaacacggatggaagtcatcaatcaaaggcaggtgaagcaaagggctaagcaaaccacccatgaatattgtaaacaggtgctatgtaacttatggcaactgcttatttggctcataaaaataattataatggtcataaagggaaatcatgaccaagaaatttgattaaaacttaccctccactgaaacagcagacaagcatgccttttccattgtcaacaaagcaagccactttggacacagttctggccttgttgttttcttgtcatctttgtcgagcgacttgatctcttgacagcttaagagaatctcttcaacttttgaaaggatttcctctgaaatgcagtcagaatccttatttgatccattaagcatttgaactttactgattccaagaagtttggaacctatcgatggtgctttggaatcaacaagattcactggaggatttaataatttaagaagaaaatggacacaagattctgaatccaacaaatgattttcttgaacctgaacaacaagaagggagatattggagaataagcacaagtgaagttatgccattaaagaatacgagctgctagcaatattaactgaaatttacaccataaattaaagttcaacttcaaacaaaatgatgaaataaaagcatggactttcttaaataatcttctttgtaatcacatgccaagatattcatggaaaagtggtgaatacttatataactgtactggagaaataaataactttgccatgatgtgattatttttatgggctgttatataaaagaaaacaatcgatatgcgtaaaaaatagaatgaagcatgcacagaagcacaaggatgggattgagaggtactcacatcacttgccaaaacgaatagaagagcagctgcaccaatagtgcagggaggatcatcaatgttcaaaaccaaaattgcatcaataatttgttgcaccaatctataggatataagaaaagaggacacttgtgagtaagaaaacaaaacgcaatgtataataatttcattaacggaatatgtgtttgttgaatggaacaatttcagcaattgaatacatttgaaattcaacaggaaaatggatacaaataggaagtgtgctggtgcgtaacaagttgtacatttttactctcagcaattttatttgtgcacattagcataaatgggtacgaagtaaaataaaaagttgcaagagtccataacagttcaagcaatcaacctcctcacagaaaacatgtcatttgctaacatgaacttccatcaagtgcttcttttattcacagtagattgcgatgtttatacagctcaagtggaaattccacaaaagttttgtgaacattgtagcattgtgcttttggtttataagactctgcctaaggctctggctggcactccttaatctaaagcgattttgaacttttaagaataattttaggtagaactttacctgtctacttagcaatcatgaaaagagagccaggcaccaaaagtaacaaataaaagagattaagtaccaaatagaaactctcctgaaagttcaaaattgactgatctcttg

SEQ ID NO: 86114 - DNA, 1596 bp, Oryza sativa
gaatgatgtgttggacattaatggctgattcatattcatgggcatcatgaagtttggctgatgaggcattgaaggaaacatgaaaggcgcattaggcatcatttgctgtttgtcttgactaccatgctctgattcttggcggactggagtcgccccaggtgcattttcatgagcccagttgtagggccgatcaaatccttgaggcgggttgttctcacttggagtatcccctggtggataagagtgacgaccatggaatgatggtggtcttgatagcatagggggcctctgtggggtctggtctctggaatggtggtagcgagatcggtcatcacgatcttgcacatgagaacttgaagagggtgaaacaccagtccgaggaggagcacgtgcagtagacatttcaggcatctgagattgtctttgatcacccccagaagcacgggaaatgttaggagcatctggctcattacgttcttccctctctggagtattgtgcaggaggttggcatgaacttcaggtatatgagaatcaaattcagatctcttaaggaaagacttgagacacataggtgcagcacagataaaaatcccttccatcattttcacagtttgaatcttctgaatgcgctcatcacaactgaaaaaaataggttaacaaaagtttaaaagtggcaggcgccaaaccaagttgatctgtaacaaaatactagaagataacaatgctagctagtaagatttctcacttttagtgcaatatttcttgaaaaatcttatgagcatgtgcaacatttgattggcgaagagacacaaaaagtagcattccaaggcagacagcaacatgaagtgtatcactgcttacccagtgtccatagctattgatgtaaaagattaacacatcccatgaaagcaataacagaatgcaaacaagccatagtttattagtagtaccaaaccatttgaaattcatgcatactataatactccctccgtttcaggttataagacgttttgactttggtcaaagtcaaactgctttaaatttgactaaatttatagacaaatatagtaatatttataatactaaattagtttcattaaatcaataattgaatatattttcataataaatttgtcttggttgaaaatgttattattttttctacaaacttagttaaacttgaagcagtttgactttgagcaaagtcaaaacatcttataacctgaaacggagggagtatatcttatgatctactcagttgaaactcattttggtagaaaacttaacaactgaaggaaattaacacatcaatcaggaattctcagagatcatacgagaaacttcattccatacagaaagatcactttgttactgcatgttatcctactgagaataagtcaataaactaacaagatcaagttccagaaagttcaggagaatgcttacagatagcagctggaatcacttctagcacaggctaaacagaaagcatgttcacaaggaatctgaaataaataggaaaaaaaaagagatgtcataacactatcgtagggttcaccaaacatatagtaacaaaagaactatataaagttaat

SEQ ID NO: 86115 - DNA, 3056 bp, Oryza sativa
aggtgagcactatgaacactattagcatgctagttcatagcaaaaatatgtattgtgtcattacatggctgtaactggtaatatttttaaaagacataatggacaagtactagcattcaaaacacacattgtgttgcagagtttgccatttaggaagaacaagcattaggatggagggttgatcactggtgagctgctgaactgggagatctcgggatggtgctgagtgattaagttgtgctcgctgaataccatatgatgaaggatgcttgagcggagaatcgttgagtcgctctgtgggaaaaacaaggataatgttaatgctgaaagtacgacaaactatagatgcgatgcaatatgttggaggtttcatacaggtatttgcagtgcctcaatgggctcccgtttaccgtcgtagacctccatgaacttcattatgtataatgcacattaattcatactcaggatagaaataaaaaaacatgtccggaataacagtggtcgaatacttaagaaatgaaagtgttgaccggtgaaaagagagagaatgtgcttaccaccaagcataccacacaagatgctattgacgaccccggattttgtcgccaacatctgagactgtgacttagtgcttggaacactgccttcgaccagtcgatggaagcaacccggtccagatcggcggcaacccaaacgtcgctcttggggatatagaagtcagttgttgggagtaaaagcttggacatgataaccatgacaaagaaacaaactgcagtagggtcgtcctccctgttcttgatcacttcaataagcattttagaagataactgagcattccgttgaatccccaattcttcggtgatcctatcgtgggtgtttcgcaccaccttgttaggtgggataacaatatccttgccgcccaatgggttccccatgacaagatggacagtgcggggggtgatctggatcttcctgtcatcatcaatcaaaatgcacatagagttcggacctgtcctgtccattagccactgtatgagatctggcttctcaaggctctcaagtttcatgcatgccacggcatctaatccaatttcttctaacttttcgtggtgcgtctttgacaacgcacgacaagcctccgacgccaacgcggcgctacaacgtgtcaggttgggtcccttgaccataggatcctgcgaaaaaaattgaaaaatgcatgcaaaggtaagcaaaaaatgaacatccaatagttagaacaccatgatttatgtttgaactcacaaaaacatatggaatgaccacacagttgcacaccacggtattatttgcaaaagatagtcatcaatggtacatacataggaaaaacactataacccatcggtggatcgttgggagagcaaaacgcaaacgatagatactaacgtacacaccatagtcaaaaatccgacagaaaaaagagatgccaccaatttgcctgtaaaatatcaacacattcgcattcccatgttgagatatgctctataaaaaacatcctcatacagagaaaataatgtggcaaatcccaaaataggaaaaatttaacttatactgtaatactcaacagtgacatcactcacaatgttctacaccaggattagtgctgactaaaagccccaatagtgacagagtgagcaaaacctcactccccaaattagttggggttgtaccctagaaaggcaataaaagattgtagccaaaaattaactggcaaaaacgtatgaggaaagtgacaaaaaaaatatgcagaaaagggtgttctcacaatgtcggttgttgcgcccctgcttgctgactaagcccgcctcctcattttggcctcgtctgtgctgtttcatccacggctagtgatgaggaggttgcgccgttggtcatggtctggggcaggacaacctcgcaccctgtttgagaatcggcgaacctgatcctcttcaccttggccgacattttcacagtgatctccatgtgtgcactaatcgaaacaaaaaagatttcgctgagagcaaaccctatgttggggatgatttgggatacagaaacaaaatgagggaaaaataaagaaaaagaaaaggggtagacatttggggggagtgttgcatagcaaaatacctcacacccgctggggagcaacttgcggcggcgccggcgacctccgtttcacaagcgacgatagaagggaagacgaatcaaaatatttaaataaggaagaaaccctaggttgtgggtggtttgggatgtggaatcagaatgagcagcgaagaaagaaataaaaggggaaatggatttgggatgggatgtggaatcagtatagcacgttacctcacagccggtgtgagaggacccccgccaagaagcgccgtgcggcagcgccggcgatctctctttcacgagcagcgagatgagagagggtgctccctgacgatggtgagaaaaaaagaaactaaccggaaaatatgggggagacgatagcgtcgacggtttgaaatgactagtccctaaagattcgctgctgcaaagactgtgactgataaaaaataataaaaaagggttcataattatcaattcatcgtttctcatagttgaaaaataactcagtattattgaagagttggagaatagataggcggagttaaagtttaactactacaattgggtggtgcgttacggtaacagagttaaaacattacttgcaggggttgaatcctgtccaagatgtgttgagtctggacttcgatgacagttaaaaagtaactgagtactcattgtgtgtttgttgacgaaaaaatcgaacacgccggcctgggagatctgcttagctcctgtgtaggtccaaaggttgatgagatgcgggcgtgccagtcagtttgatcctgcaactgacaagatatgcaaatagtagatcaaaacagccgatcggctgataagccgatggagtagttccagccgatagcagataatagccgatgccgataccagccgatagcgatagggtttaagcaatcggctatatgtccaatgta

SEQ ID NO: 86116 - DNA, 3201 bp, Oryza sativa
agtatgaaccaagtcatgaatatcaagttagtatcgccagcaagcaaaaagctttcaagtgaattagtgatttagtgtgcaaagctatttctagaagaagcttaaaaggaagcaaaccagctcataatcatgcaagatttacataaacaaagcaatgaacccatgctaatgtgctaatgcccagttcataaagagtatcaacatgataacaaagcatagaacatgagcttttaatcttttctcatgacttttatttttatgatttttttttaatttctttaaagacaatagcacaatcacgacggtccacctgatcttatcagtcagcaagtgatggttgtgccaaacactgccgtctgacctcaatcaagttttccagctagagttcccattacaggctgtctcagtgctatcttcggcactactcatgcgtaaacgcactcagtagcccggacaaaaacagagataaaacttgtaaagcatgattgatacaaagtatggacgcataagcatgagcattcataagcatgtactgacagttattgcgaaaagaatgtaaacatggcatgagtatgagaaggatacttcaatttaaacaaacttctagagcaagcattgcacattgattgagttcaaatgaatagttaatttaagcaggtttcaacacgcttgaacagcataacatgatcacacaagctacttaagcaaatgaaagctagacaagagatcaaactagcataagagtgatacatccatagcatagtgatgaccaagagataacaagcaaagctcaattgaagagtgtataatacaatgcataaagtaaacatgatgcaatatgttacaaatgcatgcaaaagaaaaacaactccccctcaaatcaagccataggggtggatcacccctaactcactccgcaagaactcaaaacgagagcgatcaagtggttttgtaaaaatgtctgccaattgtttttcagattcaacaaattctagcacaatggtacctttctcaacattgtctcggagaaagtggtaccgtatctcaatgtgcttggtcctggagtgttgaactggattttttgcaatattgattgcacttgtattatcacaaagcagaggaacaccagagaaagacagaccataatctttcagagttgaaatcatccaaagaacttgactacatgcactagcagcagctacgtactcagcctcagctgttgattgagcaacagaagactgcttacgagaggaccaagagaccaaagaagtgccaagaaaatgacaagtgccagaagtacttttgcgatcaatcttacacccagcaaaatcagcatctgaaaaagctcgaactgaaagggcagaagagcaggagtaccaaataccgtactcaagtgtagacttgatgtagcggaacatgcgcttgactgcttggcgatgtgatgttcttggagaagcctgaaacctcgcgcacaggcacacggagaagtggatgtccggccttgacgcagtcaggtagaggagggagccgatcatgcttctgtactcgcgctggtcaacttcttcaccgtcctcatcaggaccaagcgatgaagtagttgccatgggagtggcgattggcttgcagtcggccatgtcgaacttcttcaggagctctttggagtacttggtctgatgtacaaagattccttccttggtttgcttgatttgaagtccaaggaagaaagtcagctctcccatcatgctcatttcaaattccctgctcatcacatcagaaaactgggcaacaagtgcatgagaggagccaccaaatatgatgtcatcaacatatatctggacaagaagaaaatcaataccactatgaagagtaaaaagagttttatcaacagcccccatttcaaaaccattttgaagcaaaaaggttttcaatctttcataccaggctctgggagcttgttttaaaccataaagagctttttcaagtttgaacacatgatttggaaattttggattttcaaaaccaggaggttgtttgacatagacctcttcctcaataactccattcagaaaagcacttttcacatccatttgaaaaagcttgaaaccttttgaagcagcaaaagccaaaagaattcgaatagcttctaatctagcaactggtgcaaaagtttcttcaaagtccaagccctcaacttgggtgaaaccctgtgcaaccagtctggctttgtttcgaacaattgaaccatcttcacctagtttgtttttgaaaacccattttgttccaatcacattaaaacccaagggaggttctaccaaagaccaaactttgtttctttcaaaattttctaactcttcatgcatggcattaacccaattctcatcagataaagcatgacaaacatttttgggctcaaaagaggcaacaaaagctgaattgacaagttcataagaccgatttctagttaccctttcacccaggcctccgatcatcgagtcaggcggatgtcggttctggatgtgtcggggagctgtcggtcctgatgtgccaccatcaatctcctcagctgctgaagatgatgtagttggtgcatctcctgaaggtgatgtagtcgaaggagaaccggtttcttgcactggtggtgtactgtctagaggtggaggaatagaatcatcgtcatcatcatctgaatcctcatccacaaagatgctttcatctggaacacctgaaatttctggtctagctcctgggctagcctcatcaaaagtgacttcacaagtctccacaattttgttggttgaaagaacataaactcgataagcccgagaatgagtagcatagccaaggaaaatgccatccaatgatcgagattcaaacttgtccaaatttccagatttaagaacaaagcatttgcaaccgaagaccctgagatgtgaaacttttggtcgacgaccaaatctgagctcatatggcgtcttgtgcaagatagttctcaaaaacacacgattggaaataaaacaagcagcagaaatagcttcagtccagaattttcttggagtcgtaaactcatcaagcatagttcgtgccatctccacaagggtgcggttcttcctctcaaccaccccattctgttgtgggacatatggcgaagaaaactggtgttcgactccagaagaatcacagaaagattcaaatgcagaattt

SEQ ID NO: 86117 - DNA, 1867 bp, Oryza sativa
cagcgagcgagtagaattatctctcgaacaccaatggaggttggcggtgtgagagattgcgacgtactggttggagaaccagcgagcgagtagagttatctctcggacaccaatggaggttggcggtgcgagagaatgctacgtattagttcgagaaccagcgaacgtgtagagttatctctcgagcaccaatggaggttgcggcgtgagagattgctacgtactggttcgaggaccagcgagcgagtagaattatctctcgaacaccaatggaggttggcggtgcgagagattgctacgtactggttcgagaaccagcgaacgtgtagagttatctctcggacaccaatggaggttgcggtgcgagagattgctacgtgctggttggagaaccagcgagcgagtagagttatctctcggacaccaatggaggttgcggtgcgagagattgctacgtgctggttggagaaccagcgagcgagtagagttatctctcggacaccaatggaggttgcggtgcgagagaaatctacgtactggttcgaggaccagcgaacatgtagagttatctctcgagcaccaatggaggttgcggtgcgagggatgggaacgtactggttggagaaccagcgagcgagtagagttatctctcggacaccaatagaggttggcggtgcaagagattgctacgtactggttcgagaaccagcgaacgtgtagagttatctctcgagcaccaatggaggttgcggtgcgagagattgctctgtgctggttggagaagcagcgagcgagtagagttatttctcgaacatcaatggaggttgcggtgcgagagattgctacgtgctggttggagaaccagcgaacatgtagaattatctctcgaacaccaatggaggcgctagagttgggttatgtgcatctcatgtggccagcatgactcacacacccaacttgtagcatatctggatgtccgttcgcaatcatgtcgggtgaccaagccgacggtgttcgcgaggaattatccgttaacaaccttttctcgagtagtccagccatggccggtgctatgagataggtcgtcggtcttcgttggtaggttgggcgcgacaactctgcatttgttgagatcgttctcgataatgcggtgtacttgaccacaacctactcgagtgctcaattgttcctgaaaaatattttctagaagacaagacatatagcagataatatcgagtatgtactcaaaaactgcatggatcttctagtattatcaggatataacgagcagatgtaaatgtcagggcattatgtaaaccgtaaacaagcatgatttatacagaaaaagacagagcgagcccccagcgttagatcgtagtcgatttaacatcggggatacccgcgcaacaaatattattgtataaagaacatgctctgggtaaacataataaattatagatctgacaatactgtatgatctgaataggtacgataaattgcagataaaatattgcgtacctttgtagatacatgccggatgtatttacgaaattagtagatcaatttaaaaaaccaatctaccaattaccttgttgcgtactcgttcgatatcatgcgatctgacatcttttggtacgccgcggagcttgaggcttggatgatctcgatagaccaagttgtcgatgacgatgatggctccgatctggttaggttggatctccccctcagctgaagtcgtcgagtagctcgttgtcggagaatccatcttttgaacccatcttgtcgaaatcctgaagcaccaaaatccccctacctggcgcgccactgtcggcgtttgatgtcgcaattctggtatacatggtatgtg

SEQ ID NO: 86118 - DNA, 758 bp, Oryza sativa
aaaaaatatctacattttaggatagaggaagtaatacattatcaacaactgcaaaattaacaccatacgaatgtgctttcgaatgcgaatacgatgatatcatatgcatgccactagatatatatatatatatatatatatatatatatatatatatatatatatatatatatatatatatatatatatagttagttagttagttagtttaattattataaaaatgatgcaaatgttgctttttttcctaatattataggcgccttagaatagagggaatagacactacttttattattaaaatgaccaaaacgtcgaaggagggattttatattagacaaattttgcgacagcacactgctattgtgtggttttagccgtaggacaccgcccgaatatacttttgggagaagacactccataaacgtggtaatttatcaatggacaccgcgccgattagaataataattcctggttgaagagtagacagaaatcacgtgaaagttctaaaatacccttgagtccacatgtcatatatttctaacatctctcttctctctatcccctcccacgcttccatagccgatgcctcaccgatgacgccatgcctcaccaaggacgggggagtcgagcagctcggtggggctgagccccagtgggatggcgaagtaggacgacggcgacactggtggcggcgagagcggcaggcttggtggctgtgcggacttgaacttgggcaccgaccaccagagccaccg

SEQ ID NO: 86119 - DNA, 2617 bp, Oryza sativa
atactcttgtatcaaaattttaaaaaatggatgtaacatttatatgctgcacaaaatcctcataaatttgagatgtgattgagaattcaaaagtcaatgatcaattgggtgtttttgtgaaacttttggaccataaaacctagggttatgtgtcacatgacaaaatccctgtggttttgggtaacttggaccataataataatagggagagtttaataaaatatactcctatttatttgttgtaatacctcaattccaaggttcatgcttttcagatatatgcccattttggttggatgatataacatatttacatatagtttactggagttatatgttatctgggcaagccacaaagttgctgctatgatgcagtccttctagtttatagccttaagagcatttgatcaatttgataaactcgtatgtaaatactacagtgattttggatgaaatgtaactgagaattttactggctggttatcattgtaccacaatttagtcagcacttgcatcagcctctttccaggaaacgcttgtggttcacttggcttgctattgtttcgagtcccggaaatgttgggggtgctttttttatcaatgacatgcttacacttgggcttatgcactatgatgcaacatgtgtataatcggttattgctcaattatgcagcatttagaggagtctcttggtccgttgtcaaaagagagagaaagcttgttgcaagagcatgaagctttgaaggaaaagcttgatcaggagtatcatcagctggcagaaagaaaaagggaattccagcaggaaattgatgcactcgagacacacaatgagcgtatcaaagggtataaaactcatattgctcctgaattttagtttgtccaacttctactatctatgtttactcctgaatccttttaggtacctgaattcaaagaagggcgagaagcttaatgaactacaggaaaaacatactcagttgcagtctgatctacagaaaagtaaggaaagaaaagaagaaaaatcggcggagttaagcaagaacaaagagctattgaagagccaagatcagttgaaaagaaacattgatgacaaccttaactacaggagaacaaaggatgaagtggaacgacttactcatgaaatagaattacttgaggacaaaatactttccattggcagcctgtctactatagaagcggatcttaagcaacattcacaagaaaaagataggcttctttcagaggtattttatatctcatttgaaacaactgacagttgcatctaataagatggcgttcttttatgctctgtttctgtaatcattaacatacaatacgtatggcaatgtatgtatttcttaatgtcatgttcacatgttccagtaatgaatttaaaaggaaattttactcagaagattgtgatcaccctaattctttttggcaacttatgcagtataataggtgtcaaggaacgcagtccgtttatcaaagtaatatttcaaaacacaagcttgaacttaaacagacgcagtacaaggatattgagaagcgatactttaaccaacttcttcaactaagggttgatggcatgaatgtccaggttcattttctttggtttttgatcttgttgcttgatctaatagctgatgtgactgcagacaactgagatggcaaacaaggacttggaccgatactatgctgctttggataagtgagtacgtctcaccatcactatgtgctattatgttctcatttttcttgtagttactccccaagatttaagtaagtgatactgactttctgaacattgttcttttcacttcaataagcaaggtttgaaaaaaagctaagtgagtaagtgatactcatgtggttgcccccctagtattgattatttgattatgcataaccggcaatggaagattgtgtgatctaacctatgtatgccaacaggaagggggcaccagttacatatatatgctctaagaatagaccagtatattgaacactagtaataagaagcatcctttttgttccttgtttaaagatttgccttccttctactatgtattaatagactgaaaatgtcacgtttgtgtcaactgttataaatttccttgtttaaacactgaaattgtttattgccgtatctgttatatcagatttgtcccttataaactgaaaacattgaaatcccatagtcttctctctgccaagaaaattgcgttgctgtcttatgaatctgttttttttttctaattttattagcatgaaattcttatgtagtactccttccgttccatattgatcatgatgtaaccaaaaaacagaaattccaaattgatcatcatataaccctgaccctttcgtttgacgtgtagtattattattgtatttatgcatgcaaattgagtttgcatacagggcatttgggggtggtaaagttcctgtttcttgtgtatgggggaagttaaagtctgcatgtttcttgattttctcccatcatatactcacattaaatgaaatacaaggaagttaatgcttctcttggtcttgatgaaaatacttatgtgatgatcaatatggaatggagggaatacattctatgatgaacata

SEQ ID NO: 86120 - DNA, 1593 bp, Oryza sativa
ctagtaaaagaaaggatatcataaaagagtactccctccatcccataatataaggcacccacgcatttcaagattccacattcaaaacattttgaccaacatttagtacaatatgaatcgaattttacttgctaaaaattgtataatcggattgacatttgaatttactttcatatggctataattttgttactacaaaccttataatatttgagaaattataagacaaagattagttttggggaccgtgtcaagtttgaccatgccttatatcatgggatagagggagtacctacctaatctattaggattagcagttttacttcctttctgaataagatttgcattaagggtataaatacccaataggaggtcataaaaagtttagccaaaccaagtgagaagcatttgcagtcgagtggcttccttccattcggtgctggtcgctaagaagcatttgcagtgttcacccatctgtagaatctagatcaactgtggttattttcactgctagttggtccgatggtgccgtcgacactgttgacccgtcatgcttctacttctctaccacatagtgttgcacactagttggcatgggtccaaggactgagggttgggcgtgccttgattgatcagctatgctgccactaacgttctgagctctggttgataggcgaggagaatagagaacctttgtttattctttgcttcaataattctgagagatgtgttcccttctaaaagagcagcttacaaccaccgagcaaaccagatgagacacgagtatcttcttcaagagagagctagcaaagtatctcgtttcctaaataatggactttgtacttccttggtgcaaagggtcaggggtcagccagcattaccagttcactcctgctgcggcagcaaatgcatgcatcttgtccctttcttttgcttcttccttggtccaagactgttgcccacatggtgcacaaagcccatagcatgtacctacagcttgttgtatgaattattttgaattgcatcctttattttttgtgtaggccttgtatgttgacacatgattagtggagtaggggcttacatcttgggatgactgtgataatagaatatgctcagatgtttgtttttctgctaggaagtttcacccaacttgcattttacaattttgtgtttatattttctgctagggctcttatgcggttccacaccatgaaaatggaggagataaacaaaataatcaaggaactgtggcaacagacatataggggccaagatatcgactatataagcattaattctgactctgagggtgctggcactcgatcatacagctatcgtgtaagttaaattagctaacccttgattaactttcttggattgttcgtcagggttcacttgttttcaacttccttttaggttgtcatgcaaacaggtgatgctgagctggaaatgcgagggcgctgcagtgccggccagaaggtaaattttggcgatgtttatttttcactggtaattcagtcaatttattgacaggtttgctgtcttcttttaagcagtacacctgttggataagtgctagaattattttgt

SEQ ID NO: 86121 - DNA, 21318 bp, Oryza sativa
  unsure (1)..(21318): unsure at all n locations
aggcaggcggcgcgggcgcggcctcctttctccccctctcctgccggcaccattgcgtcgtccgcctcctctcctccttcttcccctgcgggctcgctgcgccatccgccgcgcctacccctctcttgccggcgccatcaccgtccgcctcatctctcccttctccgccgtgggctcgctgtgccatccgccgcgcctgcccctctcccgccggcgccatcgccttccatctcctctcccctttctcccccgcggtctcgctgcgccgtccgccgcgcctgcccctctcccgccggcgccatcgcgttgtctgccttctctcccccttcttccgcgcgtgcttgatgcgccggccgccgcgcctgctcgagagaagcaaggaaaggagaggagagaagtgaagagaaaaataaaagaaagatgagatatggggcccacatcattttgtctcacttacatgtgggctccacatgtttatttattttattttgctgactcgaacgtcacgtcagcgaaaccaggcatctatactgtaatgggatctaaattggacggttttgtacagtttaagagtgaagatttctggttttgcggttaagggacgtcgaaaaaaaatctcgctgttaagtttgagggatctccggtggacttattccgcgtactgaaccttccgactcaacggggctcgaaggcccaaaacgccgctcaaaacggggctccaaggccaaaaattccgcggagagcagctggcggccgtccccgttcgcgtcgcatcgcagcgcagcgtacgcgtgcgtggtgtgtgccgtgccctggtggtggtggagccagccagaattcaagctcgagggcgaggggcgaatcaatccgccacaccgcaccgcatagtgccgcgtcgcgccgcggccgcggggctccagatccggagccgtacgtataacccccctcactcacaacacaacacaccctctcctctctactgttccgccacaagaccccagggcgccgccgccaccgccaccaactcactgggtgagccgccgcggccctaaaccctagcccagcgcgcgcctctcctcctcctcctactccccccatggccgcgccgcaggcttccccgtcgccctccgcgcaagtggtaagctgcttcggtcccctgtctctctgtggttgcgagatttggaggggggtttttctcgccgtggttccgtgctgatctgcaatggcgggggggactgggtgctctctctgcaggtgggcaacgcgttcgtgcagcagtactaccagatcctgcaccagtcgccggatctggtgtaccggttctaccaggacgccagccgcctcggccgcccgcccgccgaccgctacggcgacatggtctccgtcaccaccatggaggtcagcccccgccgcctccagatctggcgccgccgcgaggcggaggcctccatttctgacgatttttttttaattttctggttgggatggtgacacgaagatgggggggtttttggtgtggttccgcaggcgatcaacgagaagatcatggccatggacatgtcgcgggcggagatcaagacggtggattcgcaggagtcgctcggcggcggcgtcaccgtgcttgtcaccggccacctcaccgtccgcgacggcgtgtgccgtgaattctcccagtccttcttcctggcgccgcaggagaagggctactttgtgctcaacgacatgttccgctacgtcggggacggccctacccctgctgctgctgctgctgcggaggtgcagcccgaggcagatgccgtggctccacccctggctaatggtacagctactgctcctctgcagcctgctgctcctgactatggtgtgtttggtgaaacccttaaactctatatagctttttgggggaattagattgtgatatcgatttgttttcccccgttttgtagatgctatgccgcacgaggagccggatgttgtggagaatgtggcggtgcctcctgaggaggaggaggaggtttataatccgcctctggaggaggtggagggtggggctgtggaagaggaacaatcagttcctgaggtgattaatgaagtcccaaataatgtggtgcccgttgtagctcctgcagatgctccggtgtcacacgaggaggcgccaaagaagtcatatgcctcaattgtaggtttcacaaaagcaactttctcaaatttcgagctgtattttgcttataaatttatatctaatcatgaatggtgttttaactgttttattccatatgatttgcaattgtgaaatgcacactgctactctgtaagctactccactccaaatgtgtagttatgcacaaacttttactccctccgggctgataatacttgtcgttttggacaagggtgaagtcaaactttagaatatttgattatgaatcatttttaaaatatttatctttcaaatatggtgactacatgtatagattagtcttaaaaagtactttaataagatcatatatttgctaacaattttatacatattataatgaaaaataattgtcaaagttgttttttgaagaccgtgcccttgtccnaaacgacaagtattatcaacccggagggagtagtagcttagcgtaccactgcactaaatattctgtagtcttatgaggtgcttcttattgacaagtttttatgtgatgtcatccatacactagatctagactgattttgtgcattataatgttttgtcttgatgtcgcacaatctgggagcattaatctattgatggttgaccaggaagaggcagtgctaaagttgaaaaattattgtgcttttttaagtgtagtgcttcaaataaatattagtgacagctttcaaataatttgagtagctttttactgttggccatgatggttgtcatcttgtttggtagcaggtgattggattgaaccattgctcaaatcaaatttttgttctgcattctttgttaatggtatcgtattttttcctgtgctgcaggtcaaagtcatgaaagaagctccagtgccagcccctattcctgctactaggcctgcacctgctgctagacctgcacctcccaaacccgagaagcaatctcctgcccctccggctcctgctccagttgcagatgctactccttttagttctaatgctgagagcagcaatacgcatgagccagaaggtattttctacaatcctatgctttgatcaatactctagatatgtcaattctgttagcttctctgaactttggtctttattttgaagttgatgcacatgcgatatacgtgaggagtctaccattaaatgccactacgacacaactggaggatgagttcaagaagtttggcaccataaaacctgatgggattcaagtcagaagccataaggtacttgtttttttccccttcctctggactttggaaaactatctatgttattctgtctctgaaagtgttgtcaatattttccaatgtaaatgcagattcaagggttctgttatggctttgttgaattcgaggaagctactgcagtccaaagtgctatagaggtagtctttcttagttttgatcattccattttgtcaggttgtttggtgatagtatcaatttgttcatcacacactaattttgatccaatactgtgagcattgttagttcattatcactgcgtgcttttctttagctaccaacagctcttgttgcttgacattatctggtgatgactgcattacatatcatatcttctctaattttgagtaacttgtttttttgttgttgagtggacaccatttatctttacgctgttctgaaaaaaaccattcttttttttttgttccacaactggtctgaaccatgaagcactggtcattgaagagcttagatatgggcaaatttttgtatatgcctgcatgacaacgtaaaatattggatctttccctgagaaactataggtctggctatcactacaacacattgggctgtttaagtattaaacataatattaactcagcaggtaggagagtgcgtgtgaaatggctacctttcacatacacatgtaaaaaaactctccatctgttgctcccattgtaaccaaggttccaaatactgctttgtctggaattatcggtccctggtgaaatctgtactgtatataccagacaaaagttcaagtgctggccagaaaatttctaaatttaaaattttatgtatgagtttgaatcacagccatccagccagtaaccaatcaccccctggttctggaccagtttctggccagcttttggaaccttgggaacaactggaaaatattgctgtggctaaaactattttagaatcccatctgctaactttttgagaaattgctggaattattctgaatatccaattaaggagataaaattgcttattttggctaatgaatggttaattgtgatttgtgggataacagttatttttaacttaaaatcatttatttggaacccttaatttatatttttattggagtttttttcatatttctttactagattaataatccaggtgtaattagggatgtgtgggatcttctctttccaaagaactggtgagcattttttttaaaaaaaatgttttcatgtgttgtggcaaatgaattccatttttggagagctgaaccaaagttttggtgtattgtcaatcccaacattatagttattgtcattgttagcttcgtagatattgctctacgttacataatgtttccactgcattccacccaatggatcagaattatttgttgtgaattctgtaattttgttctcagttcccgatgttgtctggatcctactctgagtttgtattgttcaggttgagctaatcatatcaattcaattgcttccatgatttgctttcaagtttccttaacccttcaacaaaggatatcacttgttatgtgcagtcatgctctgttgccagtatcattgtgtggtgactttgatgtggtttacctttttttacttggtcactgagtattatatacatgcatcaaattctaattgtttttaacttcacacaggcttctcctgtaatgattggtggacgccaatgttttgtcgaggagaagagaacacctggttcacgaggtcagtgtaacagaacactacatgtttatttcttttttcgagttattgtaagtgtagcattggagcatacttaaatgtctgactagtctaaacaccagtagtaatggaataatggtctgcagtagtaattgaaagaaaaagaaaataaaatgaataaatagaaaaaggagaaagtcatcatagttggaaattatcattggaatgtcttcttaatcataggacatgttggatgggctaatttatgttgtcatgagaagcgtgactgcacattttgtgagttcttcaaatggactgcaaagtcatttttgagggatctcaacactctatatctagctgtctagcaaacctcatataatggtagttagaatgttggcacctgaagaattatttccactatatatgagctcaacttgttccaagttctcatcttactgatacgttgcctcaggatccagcagaggaggaaggtttgcaccaggaagaggtaataacaacttcagagctgacgggatgagaggccgtggcaattatagtggaggaaggagctacggaaggggtgatttcagttacagatctgattatggtggcagaggtggtggcagaggtggctctgcgcgtggacctgatgttggctaccagagggttgacggtggtcgtggtggccgtacatcagcaggccctggtgcccctgcaaaatgaggggcgaagtagcttgtgtctctagtattatcattccatggtccttggaatgtccagattcaacataggcttcatcaattgattgcatgctggaattgtcaagcccaatttacaaattatgaggttctatttttgaaggcggcaaaaggggttaaattggttgctaattgtagaatatacacctattcacatgtagtcttagcttggtctttgatgatcagctgatgtgttattttttttctttttgtgttaattttgtcccgtttaagtttggagcattcatttgttgtgtccatttgattttatagttactacgaactgctgaaaatttgattttatagttactacgaactgctgaaataattgatagtttagactctagagtagctggtaaagtagtaattaggagagattttgtcttgttcttgtgatgtcttgaggcgaaggacactcttattgatactagtttgatactggtttatttaattttcgaggaatttaccctgtgcgctttggtcttgttggcactgctattccctcgattgcaattttgctggaggactggtagcgaaccaagtaaatatgcagtcgttgacagtctatcgagttgattagaagatattggttctctgtttggagggtgcaagctatctaaatgaaatggtcgattagaagatactggttcgaggtctgatttgaaggtgccaaggtagtaattccgatcatagcttttgttttatgaattactactgtctaaatgagatctctttggcaggtgccaaggtagatactaggaattttgggatctaagcaaagcccagcggatgaatgattggacaccatgtcaccatgtaatgtcttcactctgcacctccgttcatctcatcaactttgcctaccatttaacttgctacctcgtctcctctaagtcaggcttcctaatcctaggttccatgaggtcataagcatggttttctgtaaaagggaaatattttaagacaggtgttctattgttttcttaaaaaaaagactcatggatggtttagtacaaagtaggtttatctactcattagtttggtgaaaaaacctactcacataaaagaacgagcatcaatgggctctaaggaggagttgaagataaggttatcaaaatcttgtatctattatacgactttataatcctgattaaggtgcttgtttttataattttatataagtagaattacgattctatgtttctaatcctaactacaacctcggattcggattcaggtcgcgattttaatgaccatggttggagaaaaagaaatcatatacctccatgctattagaaaagtgatggaagatactaaggtaacaaataaattaacctaagtatcattattgtgaaccattatttcaaaaaaatagcatgcattggtgaacattaaaaaaaaatcaaatcctatatgatgctgtcttattagttttgtttaatttttctttcacaaaacatgctcctttgaccaatattgatactaatgttgcgttcggcagctgaagaaagtgagtgagtttgtttcgatttctgagcgcacgcttcccaaactactaaacggtgtattttttgtaaaaattttctataggaaagttgctttaaaaaatcatattaatctatttttaaatttaaaatagttaatacttaattaatcatgcgctaatggctcaccttgttttgcgcatcttcccaatcttctcaatctcctcctcctcaaactcaccctaagtgcattcacaatgcaggctacgtattcgagagacccaagacagtagtttgatctagaaccattgtagaaaataggctccacactgcatgtggtcttaaataggacccaaacaaatatcaaaatcctcttaaaatgaacttaaatagaacccaaacaaatatcaaaatactctcaaaaggaacttagcctacaacggtggtgtcccagtcaaagggtcaacaacaaattggatcaaattcccccaactaccccgcttctcattaagtcttttccgcttcctaccacgcttctcatcaagttttctccacttcctccgcccacatcgctcatcgccgttggggcaggagccgctgtgctagttgctagtcaccgcggcagtaagactaagggagtggatagagttggagtccaagaggcgcgggtacggcacgagagccatgacctgcttccccttctctctcttttcctctacgccatcatcgccattccctctggatcctcctcttatccttctcgattgctccacctccatagtaggcggcaacatcacgacggtggaggggaagctatcggagctctccaccaataacagcatcgataaggttatccacaggaaggtcaagataagctgtattcagttccctcccctcatgtgccacttcatgcatttttcccatggctacaccattgcttgtgatttgtggaatggttgtgattgagcgacggtgaatctccgtacaagcaatctccccctccctgatggtgacgagcaaagcggcgcaggaggggggaaacctggtgcacgggaggggctattggggaaacgcttgctttgcatgggcaaaaccacgattcgacgaagctccgacctccacaacgtggtgccacgctcctcttcttgctctgcacatccttgttcagcttgaacaatatgtgaccaatttcggttacgcggtcttcatggggctccgcggcttgaagagatggcgacaaatacctggttcctagcacttgggccaaacgacaatcggcgcatcatgagcaccctaatacaaccatgtttctagtagtgagtgaaaaatatgttagggtgttagtattgtgttgggacttaaatgaaggtggggtgctaaaagcaatcattttctagttttttcgtgttttagcttccaaatttaacaccgctacattcgtttaaaaaaaaattctaaaaaaaaagagagatggaagtgtaaaaccctaaacccaaaaccagaggaagcgacgccactctttccaccttttccgtcccttctccccaacgtttcctcctccgcccctctcccattccatccatggcggagcaagagcaagagcaacagatggattgggaatagaatcaatcgctcgcagcaacaacgcgatcgccgattccaagtttccactcccggaggaggaggaggaggaggaggcggcgattccaatctagattgcgagggggctggtcagcagcaggaggagtagggggagggcaagatgagcacggtggacaagatgctgatcaaggggatccggagcttcgatccggagaacaagaacgtcatcaccttcttcaagcccctcaccctcatcgttggccccaacggcgccggcaaaaccgtgagcgccccaatccaatctctttcccctagcatctgtagtgtgcgcgtgtactgatttttattttttgggtttttttgcttggtttctgtcctccctgcagacgatcatcgagtgcctgaagctctcctgcaccggcgagctgcccccgaactcccgctccggccacaccttcgtgcacgaccccaaggtgagacacacgcgcggcttcagtgttcgtcctcaccatgggctcggggttgagtcgtaggggttttgctgcatttcgggaacaatggtgtgattaatcttgttagtaaggtctattgggggtacccagttcacggtggtttgatagcagtcgtatcgaacaggggttgatgcttttatgatttgtatcttggtggagcgatggattgatgcaattgagggatctcgaatgcctatggaggtgcagtgtgctgtgctattgtgccagggaatgggcttgaaatgaatgatggttattgtggactgaagctgcttcaaggttgttggcataattttctgccaggagttcttttacattacttgtttctgtgggatgtgcaggtggcaggtgagacggaaacaaaagggcagattaagctgcggtttaagacagcagcaggaaaggatgtggtgtgcatccgctccttccagcttacccagaaggcatcaaaaatggagtttaaagcaattgagagcgtcctccagactataaatccacacacgggcgaggtcctcagacttattgtttccccttttgcttccaagttgtttaatatggggccatgcctttgagatttatttatttgattatattgaggcatgggtgtgtttgtttagttacaaaagattcttgaaactccaactgggaaaaataactttgccagcatgtcattggatgatcttgatttggttcagaacacctgtaacccgaaaatgatttctcatgtctattgttgtttgtaactcaaggttcattacaaagctaatattattacatatatcaatcatatgctgtagtttctgttgctatacatgtctctgcctgtaggactttcttgtagtaaatactgtccccatggttgcatacaaagacgtccattattttccttgcactttgtattgtccgtgtcaggtaaacccttgtctcaaatttgagttaagtagatcttagctatgagtctgtggtggttataaatgttttcataaactagaatagccggaagtgcatagttatgtgggaaattttctctcaatttccctttgtattgcataccgattgatattttaattaatagaacaatcagattgcccttatgaaccatgcaacacttctcaaatacatttgatttctttcatttttgatctatttttgtggtcgtagaaaattttcttaggacaccttgtactttctgtgaccacaggtacttagtgtgacattgttgcacataaaaatttgatccatgtgaatctagatgatgggaatttcacacttgtttggttggttctaaataataaatttaaacaaggcaacgggtttgtatcactatggcttcatttggggttgaggtggattatgataaatctcgtttggtaaactgttcttattcaatctaagttggaagcgataatattattgtgttctataaaaatgaaacaattgtgagagatacgatgattgcataacatatttttctaaccattatttgattttttttaaaatagaatgattcttacatttctactacaaatttaaaataagcacagtataatacagcacagccaccacaaattgcgcctaaaggagtactgtatctgttgaacattttaggttacaatgtatattcacagcctaatttgtttttgttattgctgaattcagaaagtctgcctcagctacagatgtgctgatatggatagggagattccagctttaatgggtgtatcaaaggctatactggagaatgttatattcgtgcaccaagatgagtccaattggcctttgcaggatccatcgacacttaagaagaagtttgacgatatcttttctgcgacccggtacttgaatgttttactatttcgtgtttgcttcggaagctctggtcaagagcataaccgttattagttgaaacatgacaatattttgagataaattattctctagagtaatcatcgttattccttgaaatgtcgttatgactagcattggactaccttaatttctgtattgcatgtgcagctataccaaagctctcgaagtcataaaaaaacttcacaaggatcaagcacaggaaatcaagacttttaggttaaagttggagaaccttcagactctaaaagaccaagcatatagggtactctaatcttctgttcaatcattcctgctagactgccattgtatgaaacttttgagttatggtatcgagagttgagttcaacttgtcattgcggaagcacctttgttatttgcttatttgccatgggttgggctatcattttgttctggatctttgaaatgctacaatgtttttctttttttttaaatgattactgatcaactaaaagaaattgaagggattgtatcgttctgtcctgcatttgtgccagaatatatggctaatcagcatattttacctttaattatttgtcataagatgtctgatttatcaacatggtgtcctgctgactttaatgatgttattggtgaagaatgcagaaacaatgtaaatatttggcaattaatgaagtaatttgacagcagacaccattgtaacacatttggtattacttttcacatcaatcacctcccattcaaacttctccccatcttactacgaaccactcccccactccatacatatccttatttaatgggaggcattttgtcttttttctctataattaatttacctcaaataacctagaatcccttgtatttggggatggagggagtatatacatcaagttagatactagttattgtttctatgtgccattcaaagttgtgagaaccagcttttgcatgttcacctgacatccgtagaccctgaaattatttcttaatctattattatatgctacttatgtctcactaacaattgtgtccttgacccacatgtcagcgagacaatgagtgctatataagggatagagtaattgtccatgacccacatgtctcactaacgtaccttttatttttactttaactctcactaattttgacagctccgtgacaatattgctcaagatcaagagaagtcagatgccttaaaaattcaaatggaggaactgagaacaaacgttcaaggtgttgaagacaaaattcgtcgtactgaaaaaagtttagctgacttgaggaggcttcaacaggaaattaactccagtacatctgctagaactacatattttacacttcagcagcaacagtatgctgctctttctgaggaaaacgaaggtaagtgactccttggtgtgtcactgtgccttcaggcttcagcccattagttctcaccattacaacaattgactctgtctttgtttagataccgatgatgaactaaaggagtggcaaacgaaatttgaagaaagaatggcattgctgcaaaataagatcagtaaactagaaagagatgtggatgatgaaaatacaacaagctccttcctttccaaggccataaatgatttgatgcgagaaacaggaaggctccaggcagaagctgacgtaatgttatcatcttttatatcttctttttatgattttatcagtcattattaactatagtggacattgttttatggcgttaaaagtttaaagtaacatccaaatatgtggttttcaggctcacatgtcagtgaaacacgaacgggattcagcaatcagaaagatcttcaccaaacataatcttgggccaatacctgatgctcctttaactgatgctgctgccatgcaccttacaaacataactaaagcaaaactgtcaaatcttaatgatgatttgcaggataagaaggtgagaatactgattctatgtattctggaatttaattgctaaagtatacacttttatttttaacttccgctgattataagcttcaaaatcatttccaaaatcaatatgcgtatggagtttagtcatatagcaaatgtgctctattctgcatccacctcataattgtcctgttttggtgtggcatctcagtggacgtatgagttatgtattaaacagtttttgttggaggaagaatgttactgaatctactcaaatcatttgctcaagtaggcagtgaattttatctagttaatattgaacccacctgttcttaaaaagtatgtgctctgacaatgaaaattccgctttatgaccagaaatctaatgaggcacagaaacagtttctgtggggacgctatcttgaagtaaatactcgctactctgaagttgttggccagatagaatctaaggttgcctccaaggttagtcatggaaagaacattggacaagcacaaatatgatcttctgcaactatctcagaagaaattgtatttcttcacatatcaataacttttcagaaaggtatttcaaggcgcatgaaagataaagagagtgaacgcgatgccgcggaaatggacctttcaaagtacaatcttccccgtattgatgaaaaggagagacatctggtactttcctgatccaattatctttagttcttggaaacatccatatatgtggctgcacttttcttgttacatttttatcagaagtagaaataaatgtcacaggctcacagcattagacagtttgagcattgcacccttaggcgttggctcatatttttctccacatgctttgatgtcttaaagtatgccatcattcttaattctgatgaaagtattttttttgagaataataactgattcatcccatcttaattttggatagcaaattgaagttgaaaggaaagcacttgcgctgggagaaaggaactatgattcaattgtaaatcagaagcgcacagagatatttagcttggaccagaagataaaaacacttcagtgggaaaaagacagcattattagtgattccaatgacagggtactactagacgtgaagaaggatgaattggaagaaagcaagaagaaacttaaaaagatgcatgtttcttcctctctccttttataaccctacttattttatgattcacttttttatatttcccaatcttaaatcttgctgtgtgagaagttcaagtagcacatactgtgtaaaatgcagatttgatgagcataaggacaaaatcagaattgtgtttaaagggaggactccttctgagaaggaagtcaagaaggaacttagtcaagcctttgggtatgtgctactctgtttttcttatatttgtttcaaccagcgatcagtgattcctttgttggttgctgtgatcagttcagttcacctgtgtcatttgtcaagctgtagtttgaaaaagttatctcttccatcaattgacctcatttctgcatttttatcagtgggctactgatagctagtagtagtaatagcagtatctgactatctgtagtcatgcatattttgatcaatcatgcacaccatgagctgatgtacattcaatgcaagtgcagtagcgtacatgataattttaaacataaccgtgtagttgtatgtatatggctgttcattaatgctgggatgattagtcctgtgcacacgaactatcatgtttatgccaattcatcctaatagtagatgtgagaataatacatatgaagtcctctagttgttatttatgcatttagtaatggtacaaaactctgcttggctcaggtctgtagacagagaatacaatgatttgaactcaaaatcccaggaagcagcgcaagagctgaaactggtacagatgaaaatacttgatgctaggagccacttgtcaaagcttcaaaaggaattggatggtaaattcagatattactaccgtacatttatacttacgtaatggcgtgattttatgtgaaatattttgatatctaaaagatccactatggtgtgggatttgaacaaataactttggagaggagtcggttatacgtctccttgaattttcaagtgcaaatgtaccatatttttctcattgctatttttaaacaatggcggatttcctacgaactatgtatattgcatgcatttgatatttatttttttatctttaggctaacctagcacattcctatccaaataaaggaaaatatgtgaaaaatactgataaatttaattagtggaacttaggatgttacaatcataaactaacggagttagattacttttgatcagattggcctgttgttatgggcagaactcagcccctctcattattagataaggttgttaggctttattagataaggctgtaggaggtttgttaggttttattagataaggttgttaggatgtttgttaggagccggctctatataaggagaggcaccagtcatgtggaattaatcaagaaagaagttaaacctatctctagtctcccctcttctctgttcgacctcacccaaactctggggcggcaaggctgcaggcctcgccttcccgttgagcaccccaattcattcctccacataacatccaccccaccacgccattcaccatgcctgccatccatgacctccacatgctgcgccaatcctccagggccatgcagacctccatcacggagatcacagctgggctcgacaaggtgacagaattggtgttggcactccgtgcgggttttgaggccaagggggtggcgttggaaactacgacgacgacgccctctccgccactcgcgacggcaccgccttctctgccatcgtccctgttcgcggctgcggtggaggaaccggtgatgacgatgccctcttcaccgccatcggtccaatcggcggaggtgctgcagcccctggctgtagtgccattttctcagttgtcgttcgcatccgaggctgcggcagtgctgtcacacctcacaacagtccggtcggcgctcgctggggcaccatcaactcagccatcgccatggaagaccatcgtgtcgcgtcgtcaccgttcccttctgcgaccacagcagcagcgagggatcttccagcagcttcctcgagcggcggctgcgattacgctgagcgttgctcgacgacggggagcatcacgtgcggcgccaacggcgtgggatccaggcgggccacgcgcgccgggaaagggggcgcagctgctgcagcacagcgtgagcaacacgcgtgtcaacctcctgggggtggcgccgtctacatgagcagcaggtgtgccacgagagtcggcgcaggaggcagctggttcctcgcgaccccacggcgtcagcccttctcacatgcggctggtgcgcatagccggtacggcgcgtcctcatgcagtgattgcggcatgcacggcgcaagagatgtgacttctggtggcggcgtgagatatgggaacggttcctcgttcgtccctgctgttcggtgggtcaactggaccgtgtctttttggctggtcacgtgatcctctgttgagaagacaagatccatacaacatgtcttgggccaggggctattggagtgggctgcagttgtctaggcaccacacagctttggtctcctttggcaaacatgacagcaagcaggacatttgtggtttttggaacacacagtcacattggtatggcgtccttcctctatgttcttctggatggggcccacctgagcttggcagcagaagaatggcatggaacaccaaaataattttagatttattctttccaaataatgttaggagccgagatgtaaaaggcttaataataggacatcatgtgaagacaagcttgcagctcgcgggcgagctgcttccgaaggaggagggaaaggggactaggatgacatgggtgatcggcacccctcaacctttaggcatggcttccaccgcagctcgaggacgagctgtctcgaaggagggatggagatgttatgggcagaactcagcccctctcattattagataaggttgtaggaggtttgttaggccttttgttaggatgtttgttaggagctggctctatgtaaggagaggcaccacagtcatgtggaattaattaagaaagaagttaaacctatctctagtctcccctcttctctgtttgaccttacccaagctctggggcggcgaggcctgcagcctcgccttcccgttgagcaccccaattcatccctccacataacacctgtgaccatgcaaacatgtgaaatgcaatcgctgttaggattcacatcatttttgcagctcttggcctccattgaggtgagatagtatcagattcttctctcccttggtctctcctcttaacacttggcatagctagctgtggcagtatagctgcagtactgtagttgcagctgcagctagtactagcgagctaggccatggtgtccccattgtgcatgattgctccctgattatgtggtctgcttccttgctgctaccatgatgccagacaaggcaatactggtctatgcagcacttagctcgctctaatcgtctaattaattgcatgtcggatcaaactgggtgtctaggtgttccttccacagatcggtggatgcagttcatgctatgtactcgctctctcttctttagctgtttgtgctcactgaatgtttctttaagtaactgcctttgaccccaaatgagattgatttgtttggttgcatttttgattggatagccaaattggcaggtagttcatgtgattagccttgctgggacattgccttgtactccctccgtttcacaatgtaggactttctagcattgcccacatacatatagatgttaatgaatctaaacacatgcatatgtctagattcattaacatctaaatgaatataggcaatgctagaaagttttacattgtgaaacgaaggaagtaggagataactcatgcattgaggaaatattgttgttgtacatagcgcctttgtggaaggtgtccaagcatctggtagctgccgtgcctcattctttagtactcctatgttagtgcggcggaatttggttggtcatacctgtctaatttactcttttaattgccatcatgttcaaagccaaattgtcctttagactcatcatagttcgttgaataaagctgggactagttctgatctatgcttcacctgaatcatgggtaaatttcttctcaatttgatgacaagaactaatttgattgttttgtctgggcagaaatttagcacactgtacctatatcatcttccaaggttctctcagagatgataataaattaatgttttctcatactgtaaagagaatacaaatattgtcatggaaattaataaagtttttctatggaactaatgaaaggactgctcattcgttttatcttttaagactgtgataagatccattgacacatgtttttctacagcaaagagaagctatgtggagtccaaacttcaatccattacgaagatgtctgctgacattaacatgtttcccaaacatctgaaagatgccatggatgaaagagagaaacaaaaaaagttgatatccataattttagccatttaatttggtctatatatctccttgtgatgtgctaaattcaatgcttcctgcttatatgcagcaatttaagttacgcgaagggaatgcggcaaatgtatgagccttttgaaaatttggctcgtgagctccacatgtgcccttgctgtcaacgtgctttcacacctgatgaagaggatgaatttgtaaagaaggtgcctgatctaataattgatataacatgctgccttttactttgttagagttactttattcatatgagtttttcctaatgtgtctgttgtacctttcagcaaaggacaacgtgtgaaagtactgcagatcgcatgaacaagatctcattggaatgctcaaatgctgaagactttttccagcaattgaataaactcaatgcaacttatgaggaatttgtgaagctgggaaaagaggctatacctctagcagagaagaacttgaaacaacttttggcggatgaaagtgagaaggcacaaacatttgatgatgttagtttcctgttattaacacacaactctgttttagttcccagacataaaagaaatagcagacagtataacctcatgacttaaatgaacttgacttctctggttcaatccaaactgaatatccttgagcttgtatttcgttcctcgtgcccaactcgggcacaattatatcatcccttgccacctcgtgcagtactaaatcagtatatttaatttctttaaaacaaggagttgatctcatactaattgcgactagcctacagcatgctactccctctgtccacaaatataaatgatttggttatatacctggacaagcactcgttcagttacgtagccaaaatcctttatatttgtggacggagagagcatatcttgtttagatggtctgtagttatgtgttgccacctcttctaggccacattggcataaggcttgttttggtgttcttaagctcttcttgattgggcactgtaggatggagtctctcaatgaaatctataaaacacatgtagtttgtggttagctcatgtcatagtcttgtatttaaataagtacttacctttgagaaaatattttaatcatagtatatctgtggtctcatgtgaaatcataactttctttcaattagttacctatgcagataatattgttattgacgaagataatttattatgtataacctatttcgctttgtcttgtttgcattttgatggctttgatctttggagagatgtagttttgtttacagtttccatatgtgatccttcattgcagtttgtcagtgttcttgctcaagttaaaatggacaaggatgcagtgcaggtattgctacagccagttgaaacgattgataggcacgtacaagaaatacagcagttaggaccacaagttgaaaatcttgaatataagcttgatgttcgtggccaaggtgttaaatctttggagcaaatccagttggagttgaactctgtgcagaggacaaggtatttaattctcagaacggagcaaatttgttaagggtaatttggaaccatggaacaaatggcctaaaaaatttatactctgttgatctgttcggaaatttagaaaagagttctcgaaggaattaatcaacaggatattttatgcatgatcagttattggggtcttgaaaaattctagtgcttaagcttttcagggtcgatatgtcacatacactgctctagctatggcaatcaaattaaatgcttacagagctaactgatgcccttaatttgtgggagtaccaaataatgctttagtgaaggatgcacccatccagacttttctgctcatagacagcgcttttctgctctgagacagctatctgtcacatactagttgtagagttccctttttcacttggtactgatagaaataagcgcacaaactggttattggagatctttaggtgctttggctttcaatatgctgtaactatgttgagatactactatatataatatattttctattaccatcttttaagcagtttatttgacctctttattttcttcacgactccacttggaagctggaagcttcactttgtttgatactcttatctattgaacagggacacattgaacaatgaagtggatgatctaagggatcaacaaagaacacttaccgatggtctgactaatgctcagatgcgatggcatgatattagggaagagaagctaaaagcttcaggtgcagtgcacaaatttcaaaaagctgaagaggatttgggacatctagctgaggagaaagaaaaactaacattagaagagaaggtactcctgcttgccttctgtgcacaattttttcttgagtaaatttcataaaaccccacctattatggtccaagttacacaaaaccacagatattttgacatgtggcaagtaaccctggatattatggt

SEQ ID NO: 86122 - DNA, 2662 bp, Oryza sativa
tcaacaacttaatccccaagcttttcgcaaactgaacaaattcatccgaaacaaaaattgatccctggtcggttgtaatagtctgaggaactccaaatcaattgataatatgttttttgacaaactgaattgcatccccagaatcaactttcttcaaaggaattacctcaacccacttcatgaaataatcggttgccaccaaaatatacttatgtcctttactcgaaggtggattaatctggccgatcatatcaatcccccaacctctaaacggccatggcttgataatcggattcataaccgatgctggtgctctttgaattgctccaaacttctaacaatcttggcatcccttgtaatatctaaaacaatcttccaacatcatcggccaaaaatatccaactctgcgaagcaaccacttcatcttttgagttgattggtgagtactacatatgccttcatgcacttctcccatctcaaccttagcttgattggtactcaaacacttgaacaacactccatcaatcgctcgataatacaactcataatccaacaaaaaaaatcgcaaggccttatattttaacttccttgcagccgattgagaaggatttttgagataattgtatacatcatacctccaatcatcagctgtaatggtagcaacttcaatttcaatatctttaaccatcggtttgtatcccgatgccccctgtgccaaatcatttgtctgcatattttgctctcgagaaacattcttcaaagtcaccagccgaaaactatccatcaactcacagcacttctcattgtatatcatcaatgtatccttcttgcattcatattccctagctaatcggctaatagctaacagagaatcacctatgatttcaatggcatcggcttcaacctccttcaaaagttgcaaacccttgagaactgcttcatactcggcttgattgttagtagcataaagcttgatagtacaagcaaactcaaaacttgctccccttggtgaaattatgactaaaccgataccacaccaggagtgcaaacagatccatcaaaaaataatgtccaaggcataatatcaaccgagccgattgagtcatcatgatgctcaacaataaaatcggctaaagcttgccccttgcctgccttgggtgactcatacctaagatcaaattcggtcaaggcaaaaatccacttttcaactctccctttcaacactggagccgatagcatatacttcaccacatcggtcttgcaaactatggtgcactcattggataacagataatgcctcaactttgtgcatgaaaaatacaggcataagcataatttctccacagctgaatacctggtctctggatcaagaagcctcctactgagataaaatattgctctttcctttccttcaaattcttggatcaagactgagccgattgacttctcatcggctgacaagtacaacttgaaagccactcccttctgtggaggaattaaaactggaggagaactcaaatattccttgatattgtccaaagccttctactattctgccccccataagaattcttggtcggccttcaatctgagtaaaggtgtaaaaggcgccatcttcccagataagttagaaataaatcttctgataaaattaatcttcccgaccaatgattgcaatttcttcttgtcctctggaggttcaatgttcttgattgcattaatgcttctctgtgtaacttcaatgcctctctcatgaataagaaatcccaagaattgtccacccaatacgccaaaagcacacttggtagggtttatctaaatgccatattttcttgttctctcaaataccttcctcaaatcggctatatgatcagcaatctccttggatttgacaactacatcatcgatatagatttcaaccagtaagccgattagatcatgaaagatgtaattcatagctaattgatatgtagctccagcgctcttcaatccaagtcattacaacacactcgtacaagccgattgcaccaggccaatgaaaagcagtgtcatgaatatcttcttcggccataaaaatttgattatatccagcattgccatccataaaacttataatcttatgtcctgaagcagcatctaccaattgatcagcaatcggcattgggtattcatccttaggggtagccttgtttaaaccttgaaaatcaatacaaaccctaagtttaccgtttttcttgattactagaactatattagagacccactcagcatatcggcatggccgaataaaaccaacatcataaaaacgtttaatttcagctttgatagcatcatacatatcggctttacatcttctaggtggttgtttatacggctgatatcctagtttgataggcagccgatgttcaacaatcgatcggctaattcctggcatctcaaaatactcccaagcaaagcaatccctgtattgagtaaagtccatcaccggtccctaaacttataccgctgtgtcttcccggtccctaaactcacaaatcgtatgttcaggtcctcaaacttgttcaactgtgtcatcccggtccctaaacttgcagatcactcgtttaggtcctccaacttgttcagttgtgtcaccccggtccctaaacaggatggtctaaaa

SEQ ID NO: 86123 - DNA, 3031 bp, Oryza sativa
aagaaatatctatcgaccatttgaacgcatccggtgtgcttccataatttcatgtaattaaatatgttagggagaaaacacgcatgtgttcttggtaatgtgaaaatattgtacgtttcgtacgcgtttttactgcacatatttttaagtcacatgtaaagagaaaatatactccctccgtattttaatatattacgccgttatctttttaaccaacgtttgatcattcattttattcaattttttttgcaaacatgaaaatatttatgtcatgcttaaagaacatttgatgatgaatcaaatcacaataaaataaatgataattacataaattttttgaataagacgaatggtcaaacgttggataaaaagtcaacggtgttatatattaaaatatggaggtagtaattatcaatctgacgggagacgctcctgtacttaagcaagcacttagacaaacacttgaacaaaatgttttgtgctaccagaactgtgcagcttttcttagtttttcttctcttatttaacagcaagcaagaacaggaaatctgtggaaatgcaacatgatcctccgcgacgcgggccatgcatcccacgcatgaggaacaccacaaacacaaagggcgctgcaccgacaagcccggccatgcgcttgaccaacacaaggaataataagagaaacatgaaacaggtaaatgaatgaataaacacagaatgtacggtattatactgaaattagcaagaaataatccaaagatcacaaattcacaatctggccatgccagttttattttggcttactgatctcagccaccatgcttaacgtcctcttctctggctgtgttccaaatgccgtgcattggcgtgcatgtgcacaccatgatccgcccccagcatttagtatatttgacaggcttaattacttcctgatcaacaaaacagaatcaacatgagtaacagtataatcaccgtagagcataacttttcaaataaaaaaaaaagaaatggaggagcacacatggactttacattgaacatgtatggatgcttataaatgcttgtttggaatgtgcttgatcttttgccagttttcataaccaattgtttggcacgaactcgtgagcacgtcgctgcagcgataaagtcgaaacgtcttaagagacaggggtagcactggaagcagcaagatttgagggcaaagaaatagctctagtttctcgagtgacttgagacgctccatgttatctggtaaggagtcccagctgcaacaccaaatcacgagcgaacgaagatcagtgaacagctcgctttgttgaggaatagatcccaatgggctgcatctgttgagtttcagttggttcaggagcttggggccattgttcaggttcagcagctgacccacaagcctcccatctgtaatcttttgtgcttgtacatcagtacattaaaaaaacatagattaagcttaggttcatgctgtcacaagtgcggaaaaaaaaagacaaaccatgtgacttcaagctcccgctcaagtgctcatcatttcatcaagtgatgtatatatatagcatatatgaagcactctaggaaaaaaaaggagatttggagggagaggtgtccctccatgcatttttaaagaagaaattccatgtgacttcatgctcctgctcaagtgctcatggtttcatcaagtggtgggtcctgtcaagattcaatcaactactattagatatgtggtatccataaccctgatatatatatatatatacatatatacatatatatacatatatacatatatatatatatatatatatatatatatatttatagacacggtcgcgctacacggcacgacacataggcgctgtgcgccaggaaaactccatggtgcgacacacagcgacaaaccccccaccaccgaggcatccaaaccacccgtgtagttaaaatataacttagatagagttgagtggtggggggcgatgacatcgttgaggagttaatattatgcattaattcagttggtttgagttaaaatttaacttaaacacagttgggtggtgcgatacgatgacatggttttggagttaaaaatttagttgttgttgaattttgaacgatatgtgattgaacctggtcactgctgagttaaaaattaactcgtgacaccccatgaccgagacaaccaacccgtctcgcggagttaaaatttaaccgagatacagttgtgtggtagggtgcgatgatatcgttgtagagttgacatttttctttaattcagaggattgttcgcattgttttgtaatttgttgttatcaaaaaatacatcccaacacgtataagttttcacgtattcattacaaaaccgtattttacacgggatgcagctgaataaggttaaaaacattggagggcgggctaagtaaaaaattaacttggtatccttactaagtaaaaaattaacttggtatgacaataaaagttttactcaacatatacatcctcacaatttatgagcaaaagttaaaattttgtttacacttgctccggacatcgacggcggcgtgtcgtggaggtggcaccactggtcttgcctatccatcggagtccgagctcgccaccacggaggtcgccgccgtgcgcatggaggcggcgtggaggccggatccatcaccgcctcgcctcccgccccagtcgcccgtcacagccgcgccggctatgccccaccgcggctggatccgcgcgcgtggggtgtggagcagcggccagatgcgccgcatcctcgcctcccgctcgccgtcgcccatcacagcctcgcccgcagccatgccgcgccggatctgctgacaccgcgccagccgcagctcggtggtggaggtggagccgccgcgtctccccgtgcaggatcagtgccggatccgccgtcgcaccgcatcctcgcctcccgctcatcgttgcccgtcaccgcctcgcccgcagccgtgccgtgccggatccgccgacgctacgctagcctcccagtgccaga

SEQ ID NO: 86124 - DNA, 1303 bp, Oryza sativa
caaatgaaggctacacgagctgcggcccggtagtcgagatgtcatggcacagggccggtgtcctgctgctaggggctcagtcctgcctacctgtcccgggggttccgcccgtaggtggggttgggtcggtactcttgtctatggctaggatgggttggaaactatgtcacgtctcccgtccgtataccgtggtggtatgtggcacgtgattacacgtgagaaagatgtgtcttgtgggtaaagatgtacacctctgatcagagtataatctattcgaatagccgcgccctcggttatgggcaagcctagcaatgtacccaagttagtggtttaattcttaaaacttgcttaacaactaaaatgtggaatggttgcttgggttggcttgggacgagctgggacctaggtcgggttgctagttcggtctgaatcatcgtaggccttgggttaaggcaggttcgtgtgggttcgcggccttgattaataatattatgtagccctaggatcgtgcttgtaaaatggctttgagcgactaagtgtcttttaaatgctgtttactgcaaaatctaacccctattattatccccttgtacccccttgcattaatcatgcatctcccggtgtggcttgctgagtactgtcgttgtactcattcttgctctatcttccccccctcagtaagagaagctttggagaagaagtcctaggtggagtcctggcttataccccagttgagctcctgtgaagatggagccgtaggcccgctagtccgctgttgtttattttttattgtcagacctgaagtgcctttgtaataatgcaaatattatcgatataataaagatgtgtcctttatatcatgtttatgtggtgtaccccggcttatcgtgggacggggattaatacactagtgttcgagaaaaggtaatttttccgggcgtgacacacaaccatgagtgcaaaccgatcgagtcatcacgatgttcaacaataaaatcggctatagcctgccccttgactgccttgggtgactcatatctaagatcatatattattaaagcataaatccacttcccaactctccctttcaaaactggagccgatagcatgtacttgatcacgtcggctttatatactatagtgcactcattggacagcaaataatgccttaactttataaacataagcacaacttctccactggagaataccttgtttctgcatccaaaagtctgtagcttaaataaaaaataatcctctcttttcctgccacttcttggattaaaactgaaccgattgattt

SEQ ID NO: 86125 - DNA, 4956 bp, Oryza sativa
tgccccttaattactgtacaggagaacatcttcagttcttcacttgatcatgggttaatcaaagtaagagagttcagactttcagagagatgagtacgtagtatatgtgtgtgtatgtgcatctctttgattatttcagtgtgtgcgcgcgcaagaatatatatatgcgtgagaacaaagtttttttttcccttaaatataatgaacacttgcgctgtctcgagcttagtcaaaattaaagtaattaaagaggattttcattatttcatgtgtagacgtttccctactcttttcccctcgtgaatttctgtgtcatagaactaaataatccctccatcccaaattaaatgactttttttaaaaaaataaactcggcaacttttaagtattaatcatattaattatatctatactaaatattatgtatattatattattagatttatattttaaatcacatgtgttagtttcatattcgttgggaacataatgtgaaatgaattaacggtacaaatatatcgttgaaaaccatataaaatatataggtcttataatttgggacggagtaagtatgagctatatatatggtcaacaacatggttacatgtattaatcagaacagtttgggcaaataataagtccatgacaaattggatgcacaaggctaataaggaaatgacatgtcatttaatactgtgctcaatacataaccaatgaattgaaaacatttaataaacaaattaagccaaatttttgcgtgcgtgcatatcatgtatagcaatgaacacgccattgcctgctcatagttcaccattagtctttaaaaaaggcagaagttcaatattatttccaggacatgctccgtaggtctgcactttggctcgtccgggccctactagcttatgtaacataagtctacataatgaactatgtacatatctggcttttttattttttaagacaacacaaattaactttctttgacaaggctctgatcaatgatgtcaggaatttcctagccttgtcaacgaaagcagactagtaataataagtaagtttgcaatacattatatactaaggctgtgtttagatccaaactttggatccaaacttccaactttttccatcacatcaacctgtcatacacacacaacttttcagtcacatcgtaccaatttcaacccaaacttttaactttggaaggaactaaacacagcctaagcttacgtttaatgtgattcgtggccttaataatgccgtattacgttgcatgctgcttgatcgattagatattagacgtcggcacaagtgaataatctgtatacgtcttcatgctattattgtaacgttgttgctgtactgctatgtattgcagcaggcggaatgtgtgtatagaggatcaatatatatattcatgcctgaatgctgatctatcagccgatattttagttatatatggaggaaattgtattcctctgaacatattccgcatgccatgcttgtttcaactcagcaaacagatctcagttgtgagctatatacctgcatatgaatgatcatattgcttcctatatatccatttggcacaaactcactccccatttctctcctgttttagctcctgaactatatattatcatctgtagtgtaattaataaacatgcatgttactagtaattgaagaatatgttcagaagcttcgagaagaacaattgaagaaaagagaagagagaaacttctcacctagattttctgtcaaggaggaagtcagctaagctttcttccaatacctgcagtggcaggtgctgcgtgcacacaaatgaaaccagctactacgagccagcagttttgttcactttttagtgcatgatgaagtagacttaattatagtttagttccgtagtgcaagcttcctaattcccatcctgatgctcgttggtcgacatgactttttcaccactatgcttctcttccattggagctagcttctactgattgttaattaattactgtcaaattagctatagtttactttgcaaatcctacgctgacttcgagagatgctgcctttattagtggcagatggcagtagttcaactgctatgcaattgccactgtccttgtgagaggacatgaaagcatatatgcaatcagaaagtaataaggttgtggaagtctctgcagtctgtacctaagctactgtataaaatttcttaatgaggctgaagagtagaagctacattctcctaggttctttctgtattgtcattctgcactaaccagctttgatgcatggcatctttcagaatattagttaacatgtctcttaagcatgccgtgaaatattttcaattccattttaattgaggcagtgacagattgaaagttccatgatcattcatcactcttctgcttgacaactgaataattaagattctgtcaatcttactacttaacctcattgcatcgtttgatccctgcctttgcatggattcttcactaaagcttggaatcagtcgagttctgcataacttcgtcgtgagattgtcaagtggatggcattcattgaaccaacacgacagaatcacagaaccttatctttgcctatgtaatagctagctcgccttattttctggtctcctgatggatacacagcatgtcaggatgtcaccccaagactttgctggaattttggatagatgtgtatctgcttgtctgattcctgtgtcaccttggaaacaaacagggcatgtcctaccatgtaggacaagcttcatttcattgagtgcattgcatatttgcatatcagatgatgaacaaactacagagcgtggtgattctttgtccctcccttgcttgtttgtgtgagtgagcgatttgctatgcaactggagacctggttgcatgagcacacatttttctcatccttaaaacgtgtgcttgtgttgtggacttgtggtaccatgagcttcagtttctcattcacagtcctctcctatgagcaatgcaaggcagagacatgaacatccctgctgcacctgcaacagttaacatattgcagatgcaggcacttgctctcagtgtatgtattcgtgcaaatgttgaccatattaacatgatacatgtccaaaacttaattaatccatgctaatgttccaaatctgttcagagtaaagccagccgggcggtaaaaaaggatgaaaactgaaatgcagataggagaaaaggacacctctgctctgccattgctatcatcttttttaccatggcgcgcacacacacatacagagagagcatcgcaatgatggaagggaggacgcccagatagcaaatgtgcacacccaccaatccatgcaccccatcacagccagattcacaggtgatatgcagcaagaagagatgagatgagagccatctctcccattcttttgaggcgaaatcaagcgtgcctcttcatcacaacaatgacacaatctacgaaggaagaggcaagcagggccccatctttttcatgctctgttcatcactgtgcagcatctcagcatcactagctaaactctcttcctcctcctctgctgccgctgctgctgcctttttttggtgaacacttgagcctttccaagaccacagaagcaaaatggatccatccatccatccatcaccttgagcaatgcaagttgggatccatgcattggccccagcaacacaatgaactaataattggattagggcagtagtacagtggtacacactgccttgcctttgcaatgaggagaccccacaaatggggtttgaatcaggggaggattttgaccaccctacagtgccacacaaccacaacactaacatttgacacaaaccaccccagaatgcagctgttgtcaccaatggcactctcctattctacctaattcagatgtagcttatcagtttataagctcaaaagatcatatgtgtacttagaagatagtgatactagttcagtagtggcatgtaggagggctcagtaaaagtgggcaaaaagattctgagtctgtacaccagatgaaaacaaatgtcaggaggattggtttaccctagtagaatgcactgcaagttgctagtttggtgagtttgaggcagcttttttttcacttcttttcctctctaccttggctggatgtgtgtgtcactgtctcatttcacaaatatcctgagataaattggctgtcacaatttcatgtggttctctccagccacgaagtccatggttcttgggtactgaaatgatgaggaagattccctacacatctttcagagagaagagagaaaagagagtgagagagagagagagagagagagagagagagagagaaagctcaagcttgggatcaggtaaaatagaatactccccacaagatcaaatgcctcttgtgcaaagataatgcaaacaatcaaattgccagagtttttttttttttgaagtgaaataaagatgaggcggggggggggggggggggggcaagaattgattcaatcttgtcctgttgtgctactatcttaactagactccttgttttcttctcctcatcaccttttgtgtgtttgtgtagtggctgtcacctgtgtgtgcatgcatgcatagcaatagcattacattgcaatattgcatttgcacaagatgggagcatgcagtgcagtgcagccccctcctgctgtagatctgtgcaaaacattgatgcctttattactacatatctttctgagctaggaggagccccaatcatgtgcttgtcctagcatgacagcaacttggccggccttctgcacaatcacattgtgtagttgtagttctgcaggtttgcaacgcattaataaacggcgtttggcccattgtttaactcaaacctaacctgccactttgctgataaattgttgttcatccatcatcctagtgcctcgtgagcactggattgg

SEQ ID NO: 86126 - DNA, 8951 bp, Oryza sativa
tcgtttgctctgccatcaactcgaaatcacaaaatactcgaactaaatctctttcttccttcttccattcgagttttggtgctttgcttgatttcttcctttctcactacacaacatggggaaaaacaagaaaactgcggaaaagtcgaagtccaagaaatcaaaaagccacgaagatacttcttgtggtattggtgcctcttcgattaaggaaaaaaacttaaacgatcttgttgatgttggttggatatctggtcgaaacgttgtaattcgaccagtgggagaatcaaggccttctcccaagctgggatacactcttgtgtttgaggatttcttctacgccgggtttaaattcccatgcagcacttttttggttgaggtcctgaaattgttcagacttgagtttcctcaattgactccaaatgctttagttcgaattgggcttttcgaatggatgattcgaagctgcggtgggacccctcgagctgaagactttgcatacttccattgtactcggcactacaccaaacagaactcgaagtttgggtgtgtaaactttgctcctcatcccaagcgcggaagtccatggccagctgtgtctgctattcgagcaaaatgggggaacaagtggcaatcgaagtggttttatcatcaaatccctctcagcctgctgaatgataaggattgtcctttttcgttctctgggaagaaaccgaaaactgtctccgagccatcagtctctttgtcgccggagttcactgccatacaacctcgaatcgaagaacttgtttcgaaatttagctgccgagacctggtggaagagtttgttcttctcaaaattagacctctttcgagcggctgggatatcactctcggagaaatccccgaaaattgcccttccagtcttcctccatttgtggtttcgtctgatcgtaagtttccttttcgaactgcaaaccttgtttgtcttgaaaaagtgatttagttaagaagatttattttctccctttgttatcttcttccttgtagttgtgattccagaggatatggtccgcccagttcgaaaatttcttggcccttataccaaggatgagcatttgaaatttttgacacttcaaaatgagaaaaggcaaaatcgggtcttcgcctctctaggctccgatatccctgtccgcgttcatcctgaaattgtccccaaactaaagaaaaagaaatctgtgaagccctcttcctctgatgatgatgatgatgttgaagtggaagatattgacgaagaaattggggaagaaaatgctgaagaagaagaaggcgaggaaggagctgatgaagaagagaacgactcgggtgatgatagcgactcgagtagcagttcgagcgacaactcgagcgacttgtctgaatctggtgatagcaaaacagttcctcctcctactgttttagctgatttgaaaaggaagaaaactgccagcagtcctcctcctgaaccgagttctaaacgagtgcaacttgttattgacagtgatgaagagttggatgaagatgatatccgtattgatctttctgctatccatgtcaccccaattcgagctgatgctagttttgccctttcggcaaaagaagtagcttcactgtatgttgttgccccaaccaccacggttgtcgagaaagattgctcgacccaagtgggtgatactgttgagacaacaaaccctcttcgagctgatcgagacttggttgcaaaaaaggcaaaaacgcccgtcagtgcagccgaaaagtccgaagcagggaagagtgctgctgatggaggtgttcgaactacaggtagttcgaacccaactccacctccgtcaccgccgttcatcgcaaccccttccccagagctgatacaaaacgttcttggtggttttagcgaacgatgcgcaaaagatggacattggcttatgggtcttcctaatttcaacgaactcggggaaagtagccatcatggcccaaacctgtgtttgaatgacctaaagtatcgccaccccctgagttcgattggtgatgaactcgagaaagttctgattactcctgatcttgaaaaggagtttttggaagaaaatgatcttatgtcctcttggacagcacttgatgtatctgctgcacaggtatttttatttatctatttatttatttatttatttatttattattattttctttttaacttaaaacctattttctgatgcgcagactgcgagccttgctcgtcttcaacgtggtgttgctcggaaagctcttcgagctctttgcacgcaacggaagaaatcacttgatcgcatcgctaaactcgaaaaggatcgggattatcttcgctgcaaacttgatcgaatggccgacgagaagaaaatcaccaccgatctcgtgcgcaagttaagcggcgaaaagaaagagctttccgaagaaaagaagttgcttactgaggaaaagaagaaattactcgctcatgtaaaagcattcgagcgaaaaatcatcgagtatcaagacgtcgcacgacaacgcgctgaatcagaagacaagatgaaggagcaagttgaggtcttggagaagaagaataaagaactcgaactcgcctgcaaaaatcaaagcgagaagatatctgctttagagctcgagagcgaaagttgccgccaacttcttctgaaaagttgcgagaccgttcgaatcacgttgcgaagtctaggggctgacatcagcttgctatcggaagaaaataccttagcagctgtgggaaaatggttcgaggaattttccattgggctaaaagatagcgttactccctttgcatctcgctgctcgaagactgctgtggagagcctttcggcctgtctgctttcaaatgggtgtgaacactttaccacccttaaaactgatatacaaggtatacttaatgatgaggccaaatttgcacagcttcgagatgcagctcaacccgtcgtaaaggctttccaagtgctttactggaagaagaaaggatatgaagataccctgaggtctctccgagcatctcttgcctcgagatcaaagtcacaaccggccagttcgagccaacaagataaagacagtagtactccgagctcgagcgcacaggtgtgacgttcgtgaaaagaatagttaaggatgcttcgtatgttcgaaaacaatgctattttgctgcttcaaaaccgttatggttgagagcctttattgtaaaaattcatctcttattgcatgcttttcacggaaattccctttctttgggggggctgcatgttaactcgaatcgaaaacttgtgattcgacgcaacaacactttgcctactcgaaatgtgaagcacttagcatttcgagaccctgcaaagctttcttctaccaggaccgccgtctccgatgacgaactcgaagcctgttatgataatacttgtatatttgcttttaagtttttccgatggcaacgaagccatcgacatgacagtttacgtgactttgtacttgagtttagggaacggcgttcgaacaatactcttgctagtaaagccttttggcaaaacttccaaccatccgaacgccaacgtagaatatggaaaaggcgttattcaatagttccatatacagtaatgccttctcctctcaacattgtttatcccgactcttttctttcttctttgtagagtttgtatgtaacttgttataccttcttaacatcaaataaacccttcctttcttcttttctttataaatgctctttatttcaattgttcaagcacccttaggtaaactacgtcctccttatctttggaagaagttacgaaatcgaaacgtactttatctcgtcacgtgcattttccgccttttgagctcgagcgaggggaaaatagagttcgagcattctttagttggttttttggactaaggcaaaatagttcgaaaaccgccgtcctcctcacctttcgaaggagtgacgaggtcgaaacgtattttatctcgtcacgcggattttccgctttttgagctcgaacgagaatagagttcgagcattcctgagctggtttttaggactaaggcaaaatagttcgaaaaccgccgtcctcctcacctttcgaaggagtgacgaggtcgaaacgtattttacctcgtcacgcggattttctgctttttgagctcgaacgagaatagagttcgagcattcctgagctggtttttaggactaaggcaaaatagttcgaaaaccgccgtcctcctcacctttcgaaggagtgacgaggtcgaaacgtattttatctcgtcacgcggattttccgctttttgagctcgaacgagaatagagttcgagcattcctgagctggtttttaggactaaggcaaaatagttcgaaaaccgccgtcctcctcacctttcgaaggagtgacgaggtcgaaatttgctagtcgaaagtattcgactcctagcgtgaggagttatattttgtcgactttgctagtcgagagtatttgactccgagcgtgcggagttctattttgtcgactttgttagtcgaatgtatttgactccgagcgtgcggagttctattagactttgttagtcgagagtatttgactccgagcgtgcggagttctattttgtcgactttgttagtcgagagtatttgactccgagcgtgcggagttctattttgtcgactttgttagtcgagagtatttgactccgagcgtgaggagttctattgcaatcatacacagaggcatgttttttatacaggttcgggcctccattatggataaaaaccctacgtcctgtttatatacattaacttggatatcattcgtatttacatctgagtgagtatactacaaactcgagctcccgtgttctcctttttctctttctctctctctctcctttttttttaggcataaaatttctttaaagaaatagcattccaagtatgctttaactcatcaccatcaagatatgctaacttgaatgctcccgtttctgtcttctttttgactatgaatggtccttcccactttgactcgagttttccaacagctacctcattgagcactttcttcaagactaaatctccttcttcaatcggccttgtctttactttttggttgtaatagctctttgttccttctgtgtatgatgccatcttctccaaagcttcaacccttatttcatctagcatttcaagagttatgtctcttccttcttcatctttttggtcaaatatcattcttggagaatgtgcccctacttcgcttgaagtcattgcttcatcgccataaaccaatctgaaaggggtcatgccagtcgaccttactaccgtagttcttagtgcccaaagcactgatagcaaatcctccggccattttccttttgctgatccttctaacctcttcttgatagcttccatgattttaccatttgccctttccacagctccatttgtctgaggatggcctatagaggcaaagttgatttgcaaattaaggcctttacacatgtcttgaaattttccagattcgaattgctttccattgtcacatactatttcccttgggattccaaatcgacatattatgttcttccaaacaaacttttgtagtgctgcagaagttattcttgccactgcttctgcctcaatccatcttgaaaagtattcaattgcaacaatgataaagcgcaaatctcccttcgctcttggaagaggacctactatatctattccccatctgtaaaaaggccagactggcggaattggttgcagttctttgggtggtgcttttgtcattgggccgaacttctgacatgctttgcacgtcttgatgtatttctctgtatctttcataattgttggccaatagattccttgtcttatgacttttgaagccactgaccgtggtgcttgatgagctccacacaagccttcatgtatttctaccaccatcttcatgccttcttcccttgttacacactttaacaaaggagcagtaactccacttttatacaactgtccctctaccaccttgtattttttggatgttagttgtattctctttgcttcttcttccttttctggaagttgtgcactggcaaggtatttcaagatcggttctctccaatctccttctctctgtatgcatgctacttctttcttttcgtaacttggctgggtgattatatcgaaaaatgaattttccaatggttgacctgttgcggctgccttagctagctcatcagcttctccattttcttcccttgttatggcttttaccgttattcccaagaaatgtttctcattcagccttgcttcttccagatatttagccatagtttcctcctttgcttcaaaggatttggaaaagtgacctgctaccaactttgagtcagttttgactattaaccgccgagcccctagcgctcttgcctttctcatagccaataaaacgccttcatactctgctgtgttgtttgttgaaggaaaagctaattgaacagaatacttcaacgtttgcttcattggtgttttcacaactgcagcggctcctgctccggcggcattgcatgctccatcagagaatactatccatggtttttcgacttcttcctgttgttctacctcattgggagtccattctgccacaaaatctgctagtacttgtgactttatggctgttcttgatatgtatttcaggtcaaaaggtaagagttccattgcccattttgctattctccccgcgacttccttgtttgttaacacttctcctatcgggtatgccgatggtattgttatgtcatgcgacagaaaataatgcctcaactttcttgaagccatcacaattgcataaatcaacttttctacttctgagtatcgtgttgttggtccttgtaatgcttctgagacaaagtataccggcacttgcctattttcttcttcttgtaccaaaactgcgctaactgtcgctggagttgctgccacatacattaacagaggttgaccttttggcggacttgctaatgttggcatttcatgcaagtatttcttcaagtcctcgaaagcttgttggcattcagcagtccactcgaaggtgtttgcccccctcaaagtcttgaagaagggtaatcccttttctgctgatttagataaaaatctactcaaagatgccattcggcctgtcaatctctgcacttctcttgtgttttttggcggctccatttgatggattgctgcgattttgtcaggatttgcctctattcctcttttggacaccaagaaaccaagtaactttcctgctctaacgccaaaaacacacttttctggattaagcttaactgagcattttctcaggttttcaaatgtttcttgcaaatctttgccatgggtaaatgcttgtttactctttaccacaatgtcatctacgtatgcctcgacattccgtcctaactgcttagccaagacttttcctatcagcctggcaaaagtcgctcctgcattcttcaaaccaaatggcattctgataaaacaataagttccaaatggtgttataaatgatgtcttttcctcatcctccttcaccataaaaacttggtgatagccagagtatgcgtctaagaaactcattagttcgcatccagctgtggcatctaccaactgatctatccgtggcaaaggaaaatcatcttttgggcatgccttgttgaggtctgtaaagtcaatgcacattctccacttgccatttgctttctttactaacactggatttgacagccattctgggtgcatcacttctcttatgactttcgccttcaacaacttttcaagttcaatttttgcagcttgttgtctgtctatagacattcttctcaatttatgttttttgggcgtgtatcgtgacttaatcgctaggttgtgctcaattagacttctatcaactccctgcaactcatctggtgaccatgcaaatacagccatgttttctttcactacctttaagatttcttcctcaacatgtttttccaagttttctcctatcagaatgaactttccagggtcatgttcatccaactgtactttctttgttttcccttcaggaattggcttttgtatttttatgtattctccctgtttttggtcaaccacatgtactcctttcacacttggtgttccttaaagctcatactttcttcctgcaagctgttctcctcggaccgttattactccccttggtcctgggagcttcatacatatgtagttgtggtgtattatggcctcaaaaatattgattgttgaccttccaagaattgcattgtactgatatggcatatcgaccacatcaaatactatctcttcttttctcacattagtgccttttccaaagaccacttgtaaagatatttttccaattgcatgtacttgttgtccaccaaaaccttgtaaaggtactcatgcatttgttaacctatcttctggtatttgcattttcttgaaagcatcataaaacaacacatccgctgaacttcctccatcgattaacactctttgcacttcgcattgtgctatttccactgagaccactaaaggatcttgatgagggaaaagtattccttctgcatcttcaggcccaaaggaaattaccgtttttgagtatactggtggatttgactgatagcttgtcccgacatgatttacctgtctgacatatgcttttctttgcctttttgactcaattcctaacgaagagcccccagttatggcatttatcactctctttggcacttcttcaattgcctctatcttcataacttgcggtgcttctatggcgttttgtcctcgttgatcacgagctccttcatacttgttctcatatcgatttacgtgtttttccaacaagtgagtcatttgcctgcattcttctgtggaatg

SEQ ID NO: 86127 - DNA, 3206 bp, Oryza sativa
ggggaggaggcgctgccgccacgagaagaagcaaatggagctcgagctcggctcgctcgcttgctagctcagctcagctgcgtttgtgggtgtgtggggaagaggagagcgagtaccactcatttatatagggccacacaaggagggggtaaaatggtaaattcataattaaaccctcctaaaaaaattaaattcatctttgcttttgcttaatttgctttttccagtgttgctgctgttagctaatggctcaatgacggcgattccttaatgcaaaaaaagaagggtcgccatggaaggggcagctgctgctgcgggttgtgtgctactctctctgccctgtaaagttaggcagtgtcctccaatggtgaatttgcctttttgtgcaagtgagtgtggtgacgtcctcaaatgtgctgattttatggcttatacaagagatagttggtcactgaaagtgcatcagcttggagtttatagggtgttagaatgaagctccaactggcactgacgcatgcttgattgcctttgagttagggccaatggaaataaatatatggagccactcgcaattagaatggggtaattggttgtccactgttcactggttggctgggagttatacttaaatattcaatctaggccgataaatgcgtgcaaatgtcatagacctataaaggtagaagttttttttttactgtacttaaggttgtgcagtatcaaatcttagctgttgatctagcatcatccaacggtcaaaaatcatccgtacctcgtggtaccgcacctccccattgaaacgataccgtgggtgggaggtgtcacgcccagaaattcccgaataggattccaagcagaatgtgtattaaaacccccgtccaggaccggccgggtacacaaacgacaaagttgacatacagatccacgtcttacaaacatcataaagtcttacataaatgcagcagaaaaattaaaagataactggagctaagccttgacttggaccgcagcgggatcaccactccacaggcatcctcgacagcacgaacgaagcctactcctcggagaagccaccatttgacaaatactcaaactctggggtttggggaaaatagagcaagactgagtactacccaccgtactcagcaagtcatatcaagggatagctatagaggttcgtttgcataaagcgagcatttataaatagtagttgaaagtagtaaaacaattgtaataattaatcaatattaatcatccactgtccaacgctataccacgttgcaacaggcccaaccacccacctatactattcaattccattagactagactagggtgaaactaatcacggtgaatctggttgaccgcccataaccgcgggcacggctattcgaatagatttactctgatcagaagtgtacaactatacccacaagacatagccccacgacacgtttccgtgcgccgacatgccaccacgacataccagatagaggccgtgacaggaccgttcacataaccccctctaaccaagcataccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcagctagaggaaagctacactacaagcccagccgttgcccacgctggcttgtggtaagtacgaggaattcttctagggtttcccgcgaaccgatccttaagtgccatgggcgcgactagcaaaaccatgcacccacagcccaccatttaacatattttaatgaagcgacaccaggacggtggctctaatccaacatcaacactagatcctgaagtctatacattaatataattttccccattgtgtgctagttgaactaagcatggctaagcaatccctagtccaatatctaggcatgttatatcccaagctaacaaaggaccatggtacaaaatagcatggctataacagtaggtaaacatcccatggtaatattataaaacaatgcagtatttgaaggaaaacaatggagcatttgcaatataggatcaacatgttcaagtgacaagaatgacttgccttgctctgctgctggaggaacctcggcgactatttcaaagtacgccggagcgtcgggagagccggaatctaagcgacatacaaagcaaacaatacaaacaggctataagactactgaaacagagaacaaaaccatttttaatggattctatatatatttcttgatttactgagatttgaatgggcttaaacggagctcagatgaattagatatgaattttagaagattcactgtgtttttactaaaaacagaaaaatccttaattgatttattgcgcaataaataaatcccgggagagagaggggcggtgccgacatgtgggctccacatggcagtggctgcgggcgctggtccatggtggatggggtccatggaccgggaaaggggcggcgcaccacgtggtgctgacagggcgccgacgcggcggccacgcggcagccacgcgggcagccgggttggacggccccgatctaccgcccggtagatcggacagcggatgcggctcgcggccggcgcgcgcgggcacggctcaagctggcccggtggccatggcgcgcggcggcgcggcgcgcacgcagcggcgacgcgaggcagcgaccggcggcggagggtggcggcgtcacggcaacgtgggcggcgatagcggcggctaagcggcacgggagagagggagaaaggggaggaggggcctcaccaacgacgatcaacgacggcgagcgacggagggcgatggcgaaggcgagacgagctccgggaccacctaagggatcaaaaggtatgagttagagagggagagggaaaccatggatggctagggcggcgaccgaaggcgttggccacggcgaagctcaccggtgcgcggcgcggacggggttctggcggtggattgctatggaggaggggtggacggaacggcccgcacgacggcgaacatgacgacgtcaatggcgtggctcggcacggtggctagcggcggctagcggcgaccggagcgacggcggcggcggcggagaggaggacgacggcgctagggcggtggagtgcacgggagcgggcggctgcaaaacgaaaaa

SEQ ID NO: 86128 - DNA, 4963 bp, Oryza sativa
atcagctcatgctcagaaataccttttttcttgtaagggttcttttgtttggcatgtgttttcatatcttatctttcttttactgatactccaggattcccagaacattggtagtttataatttatatggctaagatatctcttgtggttaaccgaagtaggacatgcatatgaagatattcttttggttgagttttattgctttttttaactctttaccttcaggtctgaccttaccaaggatgagatggaagccgagttgtcttctcgtgctaaaacactcttttgggctagtgttgttcttggaacaatgtcagtttgcttgctgggctttgcgacttacaggtatcaaactgtgacatttttgcaattgttaatgattttattggttagtattcaattagtatttagttctgaggataatctacagcttgatacttcaatcttactctctttgttagttatttcgtacatcttgtgagttccagatgacttgatgttgtactgatgcaggagctggaagaagatcaaagagcggagggaggcaaggcaagcccaagaggtatttcgacaaactactgatgaagttacagacgatcagtctagcgatgaagaggctggtgaaatgggagacgggcaactatgtgttatatgcttaaggaaaagaaggaaggcagcttttattccttgtggtcaccttgtctgctgctgcaaatgtgcactgattgtggaacgtcagttcgacccattgtgccctatgtgtcggcaagacatccgatacatgataaggatctacgacaattgaggtacgtgacaagttttcttttagccttttggagagggactactcatgatgtttgactcacttaaattgcaacatattacttgggttacactaaggaaaatctgcaagtgtatccttttttggctgttctgtcacaaggaaatgaaattcttgccgatgtgaaaattatttttttggcagacaactcctggttaagctttaagctaaacagtaagtagatgaacagcactgtagatacatgtttaagtgaatttagtttcctgcaataggcataaaatgttaactcttctatggaggagcattaactgttagccgcattagcctgacttatttgatttttagcatctgaaatagtggaatttggagatgacttatttgatatttgttgcaggcttcttgatgttttgctgataacccttcgacactgtatggtcacccagattgtctgcgagcctgaagacctcaactgatcatcctgcgtgcactagtctaagctacttggctaacaaaactatgttacctgaattttgtgtatatatatgacgtgttagtcactcccaggagaactcatatgggcagagatcaccggatacttttcatagtcgcatagaatcctgtagctagccaaactgccagagtcatgagctgacgcctatagttgcaattacagtactaccaagtttttgttggctctcccttctcatgtctgtgcattctgtaaagatggttttgccgctagcaaaagtatgatggttcggatttttattcttgttctgctgatccatgaatttccagttcctggtacgagtttcaggttgtcgtgtttgcaaatttgtttcaggactcgggagtacgcaggagattaccgagtgatagaatttcgccacttaaagagaaagacagctgtgctgggaatctgggacatgaataaaatgaaattgtaaataaagtatctgctatacaatccgcactatgagagcttattcatatgtgtttatatagttgagtgcacacgtatatttgagagtttatgtgcttatacagatgagtgcacatgttatttgagagtttgcgtttgtagtgtatttcgatttttttaaaaaaaagaaatcaataagggagtctaccggtagagaggcgaaaacattgatttttcaccagcgaggagataaaccttgtaaacctttttctctaatccaaaaacaaacttgaattatgtgtacttacttgcgccctgcgaaacctcccgagacttaaacgtaacgcaaacgtttgaacaggctgaccgcaggattaacatcgaacgatcaatactgcaacgcaacaacaaccatcagacaaagatcggacggctaggaaggaaccctagcacccgtgagtgcctatataagagacaatcctctcgccctaatccctcccctctcccatctcaccccgccgccgccgccgccgcagcctcctcaaggctgctcccatcctctccttcgaggtcagctgcagatcttctctcttctgttgtttgcgccggttcatggtagttcgtagccgtagatctgattcgatggagcgaggtttgggtgatttgatgcctgggcatgttgtttttgtccattattagtaactttttctgtgtattcgtctcactgctatgatcttagtttgctgttcgttgacgcgatgatttattgacttgtcggtgaatcatttatgtacgttgaaaattatcggtagaatcggactattaacttgatgtgctgcagaatcatgtacataagttgaaaatcatcggtagaatcagtagaagtatttctatctagaatccgttcgaatatctctgtttttatgttcgaatagatggtgttatcgtctatgcctggttcggtttggtcgattactgcgcgttagcacttataattgatgtcgaagttcatctgatctgtgagcttgcctgtaatattatttggagttagaaattatgcacgcctgttgtttctaatctttgtttcgttctgttttgcagttagcttcctccttattcaaccatgggtaaggagaagacgcacatcaacattgtggtcattggccacgtcgactccggcaagtcgaccaccacgggccatctgatctacaagcttggaggtatcgacaagcgtgtgattgagaggttcgagaaggaagccgctgagatgaacaagaggtccttcaagtacgcgtgggtgcttgacaagctcaaggccgagcgtgagagaggtatcaccatcgatatcgccctgtggaagttcgagtccaccaagtactactgcacggtcatcgatgcccctggtcaccgtgacttcatcaagaacatgatcacgggtacctcccaggctgactgtgccgtgctcatcattgactccaccactggtggttttgaggctggtatctccaaggatggccagacccgtgagcacgctcttcttgctttcactcttggagtgaagcagatgatctgctgctgcaacaaggtatatatctgtagtgtttggtcttttgttatgattgatgagcctagcacttgtttatacatatttgtgatgctattgcagaaacttttggttacataaatgatttactgctatattcagttggaaattggaaatgaacatattcgtgatgctattccagatattcttgttttctgttatgattgatgagcaacttctgtgaatattcatgatgctagtcctgaatactgttgattacatcaatgaagtagcattttcttttattgatttatccctctgtgctagtttttctgactgtctaccttctatgcatctaagactgcaatttaccatgcatctaaggctgctactgttgattgttgcttttgttatgactgtctgtctttatgatgcatctaagattgcaattgttgttggttgctttcctgctactactagctttagtaatttactgctgcaagaaactatacatatcttctgttagatttggttaagttcatttagatatcgtgctgtatgttactttatactagacttgtattgatgttgctgtccacctgtatttcattacatattggttgctattatttcattttttgtatcttatatggtgtttataatatgtttcataccatttgtagttagtaatgtatttgtatgctggtgcctgcccctgatttgttttcctttgttctgttacagatggatgccaccactcccaagtactccaaggcccgttacgatgaaatcgtgaaggaagtctcatcctacctgaagaaggtcggctacaaccctgacaagattcccttcgttcccatctctgggtttgagggtgacaacatgattgagaggtccaccaaccttgactggtacaagggccccaccttgcttgaggctcttgaccagatcaacgagcccaagaggccatcagacaagcccctgcgtcttccccttcaggacgtgtacaagatcggtggtattggcaccgtgcctgtgggtcgtgttgagactggagtcctcaagcctggtatggtggtgacctttggtcccagcggcctgaccactgaggtcaagtcggttgagatgcaccacgaggctctccaggaggctcttcctggtgacaacgtcgggttcaacgtgaagaacgttgcggtgaaggatctgaagcgtgggtacgtggcctccaactccaaggatgaccctgccaaggaggctgccagcttcacctcccaggtgatcatcatgaaccaccctggccagatcggcaacggctacgccccagtgctggactgccacacctcccacattgccgtcaagtttgctgagctggtgaccaagatcgacagacgatctggtaaggagctggagaaggagcccaagttcctcaagaacggtgatgctggtatggttaagatgattcccaccaagcccatggttgtggagaccttctctgagtaccctcctcttggtcgttttgccgtgcgggacatgaggcaaacggtggctgttggcgtcatcaagaacgtggagaagaaggacccaaccggtgccaaggtgaccaaggctgccgccaagaagaaatgagcctcgttcaagtggtgctttccatatctgcatttgagatatctagctcttttagtactcgttaagtttt

SEQ ID NO: 86129 - DNA, 3167 bp, Oryza sativa
acatttatattgatgttaatgaatctagacatatatatctatctagattcattaacatcaatatgtatgcgggaaatgctagaatgacttacattgtgaaacggaggaagcacttttttttttgaaactgaactcagtacttgatgctgaaagggttggtctcgttgcaacgtgtgctttaatttgtttgcagtggcattcctggcttggtagttggtagcgaccgtttttttgacaaattgacccttttggaaaacttacttcgaaactaacccctgccaaaaacttcaaccaaaaataggccgtcgcctcagcgccaaacacattggcgctgacgttggtcgtgtcagcgccaacgggactggcgctgacattgtgccaccgtggcggccgggccgatcccctagctgacgtggcagctacatcagcgccaaccgcttcggcgcggaggtgcccaacctcagcgccaaccggactggcgctgaggtgggacttggccgcaacccccaggcccagaccagcaagcctcctggatggcttgcgggctgggatctcagcgccagccataatggcgctgactgtgggaaactcagcgccagtccacctggcgctgaggtgggacttggccgtttcggccgtggcccagcccagcaagccttctggatggcttgcgggctaggacctcagcgccagccataatggcgctgactgtgggaaactcagcgccagtccatctggcgctgaggtgggacttggccgtttcggccgtggcccagcccagcaagccttctggatggcttgcgggctaggacctcagcgccagccataatggcgctgactgtgggaaactcagcgccagccaacctggcgctgaggtggaacttggccgtttcggccttggcccagcccagcaagccttttggatggcttgcgggctaggacctcagcgccagccataatggcgctgactgtgggaaactcagcgccagtccatctggcgctgaggtgggacttggccgtttcggccgtggcccagcccagcaagccttttggatggctgggctgggacctcagcgccaggtgcactggcgctgagtttggacatgtcagcgccatttagcatggcgctgacgtcccagccctgctaaaacttcagcaaaactttgcacacaacacaggcaaacatcaaatgacagaaatttacaggcagtaatatatccagagacccttacaaaacatacatccatccatcaatcccaacatcattccatacatccatagaatccatcaatacatccatatatgaagtccatacatataagaaataaaaacatcccatcgatcctcgtctatacatccagtcgagtccatacatccagtccatacatccatcgaaccatgcatcaagtccatccatctatccatccatccattgaaccatgcactcacctcctcctacctctagtgcgaggacgaggcacgtcgggggtgtacctccagtcctgcgaaggagcccgccggcgtcgtggtcgagacgggccgggctgcgagatatccggctgtgacgactctggtgcgtcctctagctgcgagggaccgagctcatccgcctcctcttctctgtcctcatcccttcttcctcctcatctccttcctccgcctctttgtcttgctcgccctcctcgtcacccacctccccttcttcatccccctcttggtgggcatgagcatgttcgaccacatcagtcgacctgcagccgagccttgctgccaacttccgacatcgctgccgtagtctctgcataaaaaataagccatgttaagttatcgcttttggaagaaaacaccgtagtttcatctctttccaacgattacctgtagggcgttgcggagggtgccgccctctccttcggagccaggagccgtgcctagcgccactcccgcgtcgttgacggtccgcaagagctctcgagcctgtaggattgaaatgaagtaagtcacaacatatatggcattgaaattgaaataatatacaacattaatgctagaaacgaaccactctgtcgcgaacaggtcccgtctcgaccgtggtacctagacgggtacgagtatcgtactcgttctgctcctcaacatcctcggggtcatccgctatgtcggctagtgtccaagccggacgtaggacaagacagtaggtccaacatgttagcaagaaattgaaatgttatgaaacataacatgcgtgaacttacctgtagcaaccaaacacagcctgctaggttcgcgtccccgccttgccttcggcaagcatcacagagttgccggtacaaccaggctagggcagccgacccccagctgaaggtacccgcctcgtcccagtccgcgagcaacggcagccacatccaagaagccatgtctccaccagagtcagggaacagaatactgccgaagatgtacagcacgtacgccctgcagtatcgctgtactgtagcctcgtctgcctcagcgggacactgaccgaagttggctcgcaaccaactcaaaggaacccctgatgtcttcgtctgcctctgaccatcaggtgccactggaggctccagaccaaggtactcctcgaccctctccctccagttccccgacgctgtgtcaccttgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcatgctgcatgcaacgcagtacagcgcgttcctttatccggtctgtgaccagtcacagaccggtcagatcacgggttaggtggcgactggcggtctgacgcacgccttgccccatcccgtcaagacaaaagtctgtaggcactcgtctcaagccggagctagcgtgttatctcttagagatggcacgttagccctggtcagatttaaaccagggttcatcctaaccattacaggccaggtggta

SEQ ID NO: 86130 - DNA, 706 bp, Oryza sativa
cagtattattcggaataaatcaaaagcatagagatgagataaatttattttctgctcttaataattgcaaaagtacctaagtagtaaattctgatccgtgaaactttgttccgtgatactactcatcctatatgtttgttctgcaggatccaaatccaaatatgcataaaagggattcatggctttaagcttatctcttacgctccaggaatggatcagtcagaacatcaccaccggctcgccgtcgtcgccgccgactggagtcttcacctatacggttggttggaaacaccaccgttgttgggcgtctacgtctttaccgactggccgcttcgtccaccgccgactggtgtcttcgcctatacggttggttggttacaccaccgttgttgggcgtctacgtcttcaccgaccggcttgccttcgtcgccgccgactggtgtctccgcctgcacggctggcctattatgccaccgttgttgggcgtctacgtcttcactgaccggccgcctcgtccgccgccgactggtgtttccgcctgcacggctggcctattatgccgccgttgttgggcgtctacgtcttcaccgaccggccgcctcgtcagccgccgactggtgtttccgcctgcacggctggcctattatgccaccgttgttgggcgtctacatcttcactgaccggccgcctcgttcgccgccgactg

SEQ ID NO: 86131 - DNA, 13292 bp, Oryza sativa
attcctgcagccccaatctaatagctaattcatacttaaaaaatacaatagttaactacaaatatatactacatcattaataattggtcccgcatatcatacacacataatgtatggagttcgtgttgcagctggctacaaatttataagagcaggtacaatagcaggctatatgtcaactataaacacatatcgaggagatgaaagaagacagagatgagcagcggactacagatttgtaaccaactatagcacgagcttcaagacgaaatgtatatatgacaggtgagaccatatattaatagtgtagtatacatttatatgttactattatatgaattgtctgcaggtgatttggagccagttgttggctatactattaaacttgctctaacatgcttctcttctctctctcatctcttatcttctccacataagtttgtagtcgacttgtagtttattattgtacctactctaatggacacttcgttagacgatacagtcgcctgccgccgcactgctgtcaccgctcttttagaagaacaccggcctagaggggcctgcagcgatttttttttattttcccgaacctttctattttatctttaattttaaagaaatcttttaaaatttatttttattttcaacatctgaaccttttagccatactagctgaactagcgtggcaaaacaacactatcacattattctagctaacgtgacatcgttatttagtcacactggtctagttggcgtggcagttttatctaagtgacgtggtaggataaaactatcatagctgttgtatgtggtgcatgagtattgttttgccacgagagagctgacatggccaaaaggttcatatgaagttttggttggatttatatttataactttttaaagttaaaataataaaaaatttgcctgcagcgacaccgtgccactggtgagcatcacgttcacggccggcctctgctccgggttctcctgtacgtagggcagcccgacatggacgcaccgcgcgatcgatctgccaccccgcctacgcttgctcgctcatcggccggtccaccaccgcggcgatgtcccacaaggttcagtgctcccaaatctgcgtcaagtgttcgtagcttcttgagtggtcacagataaagtggcatgtgttaatctatattgaggcgagtggatcgctggggcgctcacgatgcttagcagatcggcggattgcattgctccaagttgtaggagccgctgtttctcttcttcgtcgttacgatctacaggatcaggacgctggggtgaaagtgggacgggttgtggcgccccgcatcgcatcgactgcagaagtcccacgcgggccaacgggcaaccagtcccgcactgaactgcgggaattttctgtcaacgggtgtcgcgggttagtcttagagcagatataatagtcagctataaatatattttaatgagataaaaaataagagagaaaagcagcgggctacagatctgtagccagctgcagcacggactccaagacgcaatatgcgtatgacaggtgggaccatatgttaatagtatagtaagcaactattttattaattggctattagatcagttatagataaattggagttaatagtgggctatactattgaacttgctcttagctagcccgcaacgtgaaatgaacgaacagttcagacagaccaacaatgatccccgatttatttaaatgcaattaagactggcaggaatggaccaggcaggtgcaggaatcgaaccacttggaacaatgcaagccaatcaatcaaatggaaacagcaaacaccaactaatcttcctctggaaaataatacgggaggagctgcggtagcgacggcggcgaccacgccctccagggcgaggaggcgcttgacgaggccctcggcgaggagcgcgtcaacgatctccttgcggccgtagtagccgacgcggagggcgaactccagcgcgagcgtgcggatgcgggggtcggcggagcagagcagggagacgagccgggggagctcgccgcgcgcgtggagctcgtccacgagcgggctgcggatggcggccaaagcccgttcagcggcgcagcagcgccggcgaggctgaggcggacgcggacgcggacccgaccagcgcgccgacggcgcgccccatcagcaccggcccgacgaacacgtccttgttgaagcggaccagcacgagcaccgctgcggcgcagccgtccccgaagccggggtccccgagcttcgcctccaccaccgcgaacacgccgtgccgcagcggcacgcgctgcagccgcgggtcgaaccgctcgccgccggcgctcgcccagccacgcggccacgcccaacgccagcatcacagagaaggacagagaaggggttaatatgacatgtgggccatatgttattttcttttattttttgctgattggatttccacgtcagcgccacgtgtataccacgtaggactaaaaccgcttcgtattgacttaaggggtaattcgtccggtttcaatagtttgaggtttaatgtgtctggttctgtggttccgggggggggggggggggggcaattcgtactggtgcaatagtttaagagggtaattaatactttttccttttttttaataagggaataaaatcccggtttttgttcgaaaggttacagccaagtattacagcaattcaacaaaataaagaaatatacaccaaagaagctgagactaatcaacatagggcctgtgcgctgagactaatcaacatagggcctgttcggcaggcaggtgcagtagctgctgcagccggccgctgctttttttttttttcttgcttcactgtttgtataggctgcagcccttgcagacgaacacacccatagtcatatataagtatatacctattgcctgctttgccaccacacgctagaaatatcgtagcaaactgcagattcacaaagaaaatttggaaaacttaaacaaactggacaacctacaagcagctcaaaccgatagagtggagtgcaaccacgacaatccatgactggtggacagaactggcaaccaccgaaggacttatcacaatattggatgtctggaaggaaataaacaaaaaagtcttccaacataaggagttatccgcaacgttaccccgatacggttgctaacccttgtatcagtatccgatacgcctctggatacggatacgtgcgggatacggccggatactatcccgtacgtatccctcatttttctctttttcagataattaaaataaataccgatactcttctgatacggcgggatacagacccgatacggtggagccctaaatcaagcaggaacataaccgcatatctctccccctcccccacgccgcccctcgctctcgcaactcacgctgtccctctctcttcgcttccctaatccccatcgtggcgccgccgcatatgccatcgctgcatgcgctgcctcgccgccgccgccggccgacgccatgctgccgcctacggctggcaccgcgtcgacggcccccctcctctgtactctcctccgcgactcctccatgaggcgacgcgccgccgcctctgaaccagtcctacgccgctcgctccgaccggccccagcactgttgtcttccttcgatcccgatgttgaggactagaggtaaaagaaaatcccttcaagtttgatctgcaccgtgcatagtgttccagttcactttttattagtattgctgttatctttggtagattcaatggattttagaagtgaaagcttgaatgctagtggtagtgctagcaatctagtggtaatactggttttgatgcggagaaataatatattgcagagaagatgtttgccatcatctactgtgtggttttgcatggtgagatgctgtgaatctatcgtactgagatatataccatacatagatgattggtgcatttgtggtttgatgctgctgtgttccctattttttccgtccatattccacactcaatttttttctatgttttttaattatatatataaatatataagtgtatccccgtatctacgtttttagaaagacggtgtatctcagtatcatcgtatcgcgtatccatatccgtatcggcgtatcggggtaacgtaggttatccgtcacatctctggaagcacagatcaaggaggaagctaatgcttaggtcttagcgagagcaaaacagctagcgcttttaattccttaggcatttctctctttttacagttatttattttctgtacatgtaacttttactcttcctatatccaatgaaattggcatattctgcaccggtttttaaataaaaaacatagaagtataccaaaattgctcaaacaagaaggcagtgagcagcaaacagaatcagagctctcaatgcaagaacgtactccctccgtagaatatatgcatttttatagttggccatagttattaaaaaaataggtaaaagtaaatggtggatggttgtgattggttgagtagtgaagatatgtgggaaaagtgaatggtgaagaattgtgattggttgagaagagaatgttggtggataaattattatattttgagacaaatcttgagggttaaaaattgttatattttaggtcggagcaattacatgctagaaactctctttagcttcctctcccaaatcatccaagatgcaagatgcaataaaaacacaccaagatctgtagctggcgatccataagcatgttcaccgggcaaagaggtgggggaatatccaggggaggaagcgctcgactctgaataaggatccagtgcaactatactagagactgcaacttaagcagttgaaattatttttcaccgttggattgaaacgatcaacggataaaatctgtgacacatcggctctaaacagtagatgctacaatgtttgcgacaggagatatctagctacagtgtttaacaaatagtgcctagggaaatcttgaccgctactttccaatccaacggtgcctatgtgactgtttaagttgcaggggctatagcaactgcaggtgatctcaattcctcgactctcgtggtcggccgaggtggcggagggacgtcgatagacggctgacagggaaggtggcgctggcgcgcgatgaccgacgaattcagatcaggtccagttatagtttgaacggtaaagttaacgactgcatataattttggccgttcgtttttccgatcaacgggccagattcgaggctacagtaatgacgcaactgtactctgtgctacagtaattttgctacggtgttatgaacattacaatgtgcggtataaaccttccaacttacatccaactagtatggtgacctatgcagattatacggctagcatcattatattctctctcatataataacatatatgttttctcaatgtattattcaaatatgttaaaatgacaacataattttaaattttgtactaactttacgaaactactaatgtgtaatatttatattatattttatatacgtgttagttattaattatttttaatatcaaattttagttatttgtaaattatattcctatatgaactctagactcgctttcaatatatttttaaaatttttaattctgaattttcattatctataaattgtatttctatataggctctaggctcttcttccaatattacttatttttaattctgaatttttattatttctaattatatttctacgtggactctaaactcatctttcagtattctttaatttttaatcgaatttcagctacttctaaattgtattcctatattaattttagactcttcttcccatgttttttataaaattttgaattttagttatttgtaaattatatttttataagaactctaaactatattttttaattttattatgtttattccgaattttagttagttttaaattcctatacggactctatactctacttctaatatttcttattttttaattccgtatttctattatttcttaattgtatttttatatggactctatactctacttctaatataccttatttttaattccgaatttttattatttcttaattgtatttctatatggactctagtctcctcttccaatattccttgtttttttaaattccgaatttcaactatttctaaattgtatttctatatggactctatttttccttttctccgattaatatgagaatttctaggctatgagagcgaacatagaggctcctttttctattcctttaataagttaatagatagtgtgcactgctattgctttaagttgactgcagctgatccagatccatgactgatgacggcggggctgcaacaatggagcaagtaggcaatcagcgccatcgacggtgtagtatcgaacaatatcaaacaaacctactagagagagtgaatgctagggaaaaccaaaaacccaaaaatttttaacggaaataaaagttaccctcatatcaatggagatctcgacgtagtcggtctaaccgtcagatcaactccggtctgactgcagtgttgttgctggtctgaccgcctgcacaccgccggtctgaccgacgccttgtcgctggttggaccgccttccagcaactggttgaccgcccgctggttagaccatcgatttgcctccggtcaaactgccgagatccccaaaaacacgcattgatgaaactcttgaaagtagatcaactttgcatcaatatatgtttataaagtgcatctaaagcactcatctctcacgacaaggctaacgggagtcaatcgcccctagcgatcacctcccctcctccacgtggtttccttttttgacaccgcattacttttctattttagtaaatttatacacctaaagtttgtatacctcaagtttacatatctaaagtttagagatccaaagtttataagtcaaaagtttatatatccgattcaaatttgaatttgaattcaaatatttttttatataatatttctatacatataaagtttatacacttaaagtctatggacccaaagtttataagtcaaaagtttatatacccgtttcaaatttgaatgtgaattcaaatattagtttatagatctaaaatttataagtcaaaagtttacatatccgtttcaaatttgaatttgaattcaaatattttttatatatagtatttctatacataaattttccaactttgttttttttattttttttaaatttatggtgtagtaggaagagaagaagaggaggaaaggggagagaagcgtattggggatggggtgtgatcgctgtggacgaccacctgcccattagccacgcccaatctctcaactcatgaactaggattgaaacctcaaagtaaaccctaacttttttctttcaaaaagtcgatataggcaatctacttctagcctcaacccctcatctatttatacccataacgtggcggtccctagccacaaatccaactcatacaagaagtcctaatcccctaggaaaccttcccgtacaaaaaaacaaactttacaaactccaatcttctcaaacttagaatccaatccaaatttgactcctctttccatacgcacacaacactatgtgtatgccatatggaaaccttcacctccatgtgcattgttttctaacctgagcatcctgtgtaatatccttaactgtctagacctcaacttcccctaagcctagtcccgatccatcaccggctatactcccatgacctcaagcaacacctacacatgaacaacaaataaattccatatacaagttcacaccaacttgactcacatcagcacacaatagcatcacatacgaataaaaatcatctagaaatcatatccatgaatcaatctagaaattccaaaaaaacaacccgaaatcgactccctactggagtctgccggtctgaccgtcaggcaacccggtcagactgcccagagccccggacacctccggtttgaccggcggcacccgcctggttagaccggcaacccagtgccaaccaccgcaccgtttaccatccgaaaacatatcacctatttttataaacacttgcctttgacaattgttcatcaccacaattaaaccatcatatgattctacagatgggacttgggagtggtgagtagacccgcactcgcgccgcacgtgggcggtgtgctactgttgcctaccgattctgcgtacagtgttctctagtgccatgtatcttactgtgaaaatatagacactggtaccatatcttctaaaatccactccgacatatagggcatatgatggggaaattgttttcatcccttgaaaagatattcccttattccttgcatgccacctaagggtccattcgttttggaggaaaaccgaaagatttagataaccgaggattaattcctatgagtttcatttggtttatatgaatgtagatataggaaaaccaaaggaaattttcctttcctataagttgtagagagaaaacctaggaaacttttcatccactcaaacctttttgaaaattcctatggattgaagtatgcatgcattactgtccctccacttttcttattcctatgggttagaatttcttcaaaacaaataggcccaaatagttataaaaaatttaaaaattgaaaaaaaaaagagaaggcagattaatacgaaatatatcacttcttaaacatgaaaaattcaaatcaaacctctacaagttgtaacgaaaataacaaatataactacgaatatacattaactatttttaatttaatttattttttttgcaacctatagaagtcaaatttggcctttgcatatttttggaacaatatatttcatgtaaatctatattatcaatttttttttattttttaggtgatatgcaagaaaatgagatgaaatccatctcccatatgatatactactgaatgttcttactatgttccgactggtcgcgtccaaagagcctcgccaaccgaagtccgaaatattggggttaaattggagtctagcatagcgttgcttcacttgcttgtcttgaggtcccggtaaatgatcttcagccgtgattcttcatggagatactgcaaatgccgagcgatcccgtgtatgatcttcagccttcttccccagtctagcaaactactggcatgatctgtcattcaagttgtgaaacatctatgagaggcatgacttgcatgtggaacttgtgttgtacacttgtacagttgtactgctgaaatttttgcaatggaaaatgaaccaaagagaatggtatctaggcttctgttgggcatgtattcatagatgaccatcttatcatgctcctcgaggcaaacatcgacaagccgaacaaggttcttgtgctgaagcttggccaccagaaccagctcatttttcagtctcccttgttcctgaactcagtgagaggcctctttactactgtatattgaccatcaggcagggggatccttacatgatagaattatacactcctaaaaagattgtatatcagttttttttgcgggggaaatggggattatattactcagctaaagagtcctcacaaacaaaatgtgcgatgaaattacatttatcatccgggcagaactcagtcagagattcacaccgggctctattagctagagtatggctaacattattctgattccgctgaatcttcacgatgatcacttccctgtttcctgataacaattcaccaatgcccctgacgatgaatgtaagctcagagcgcccttgcacagctgactctatgaggttcttcaccaccaagcagtctgtctccactatgaatggaaggagagtccactgaagagccaagctaataccttccctgcaggcaagaagctctgcttccaacgggctgctacactgattaacaaaaccacaagcagagaaaattaccatccccatactgttccttagaacgacaccgatgccccatttttcagaatttatatcaatagaaccatctacattcagtttcatccagccctgttttagcttcacccatcgacaattattattcaaagggttttgcttgggtttttggatctttcgctcctcatgatacagagcctgcttccctgtaaccaaatctgcttggggattattcttcacttgttcaagcgagttaacatagctttgtaggaacgtttttgacacctcaattggggtttaccttgtactagtaaacaacaacaaatcctcctccaagttcactactttcagtgaagttctgtgtgctgcaattccaagtgagtcgatactatcgatatgttgttggtgtgaatagctccactggtagtagggttgtcaacgagccgagctcaagtgaactcgcctgcctaggctcgagctcgatacaagctcgagccgagcctataaaatgttcgagctttcaaacaagctcagttcgagtgcgatctagctcgatctcgactactaagcttgatttttaagtagaacaaggtatatttcaaggataaccttttaaaaataattaatttctagttcatcatattaatagaagaagaaaaaagaataaataaatatacaagaccaatacaagacatacaaataatatatttgatatcttaatttattaaataacaacaaaaatcatatattactagactcgttgaaagctcgagctcggctcgaagaagctcgcgagctttgggagaagctcgggctcggctcgtttggagctcgatccgagcttgagcagattgcgagcctcgagcttttttgaatagccctaactggtagcgcattacaagggagaacaatcttatgcgatcaggtctcatgaatgtggggatagacccattagaccaggtctcataggagtaatccatgcgtgtactgttgactatccggcaacagctgtacaatgcatgataggctggcttttgaatgggcggttttgacccatgaatttcactggaatgtctaggatgactattttttcccttttgttaccctatttataactgaatttgctgtttagattacatattgataatgtgtacgattccaatacaaaataaaacaggcaataactgttgttgctgctcttctttagcccctactacctggcagataattgtgtgatggtttgagagtagcgagagctcccatcgaaggaaaatgttggcctagctgcaggagccggtatagagctgctagcattgctgttaagcaaaaccatgatgtccgccattgtaggtcgatttacggggttctcctggaggcacaggaggccgatattgatgcatttcagcacctcggcttcagggtaattttttcccaacgaatggtcgatcatctttgcaactgttccatctgaccagcgcctccacacctaccattggttacaggcatatctcttcagttttcagcggcaccaacatgtatttgtggctacctgcaaacgcaaatagtaccacatagtgctgtatgagctagcagggatactcactgtgcttattatatcttcgttttgttcaaacaaatagggtctgttgttcctctggcctgtcacaatctctatgatgagaacaccaaagctgaacacatcagattttgtcgagtattgtccacgcatgacgtattcgggagacatgtagccactgcttgcaacaacaaatagaatcacatgattagtttgttagctacatataagaacaaatatgtaaagtattggacttaattacaatgtcccgacgatacggttggtgacatctcgagtctgatcctgtccaaagagcctagcgaggccaaaatcaccgatcttagggttcatgtctgtgtctagcaagatgttgcttgccttcatgtcacggtggacaattttctttcgggagtcctggtgaagatactgtagtccgcgagctacgccttctatgattttgaatcgtgtcacccagtctagccctctccttttctctggatctaattaattgacaccagatgaaaaactcattgttataatgtcataccgatgcacatgagaagggtgtatatctagattcagagttaggttgttaatggtaccaaaaagaaagaagtcgaggcttttattgggcatgtattcataaacaagcatcctctctccctcttccaggcaaaaccccacaaggcgaacaaggtttctgtgatgaagtttggccactagaactagctcgttttttagctcttctagcccctggcttgaacccttcgccaacctcttcacggctacttcttgtccagaaagaagtccctaaatgcattgatttagtaattaattaatatcttactttttgcatgatagtaagaacacaaagatactatcttttttcttgagcccataaatgtataagtcctataccctattttggcactcaaaatttccacgttaatcgcagaaatagtaaacggatcaatccaagaatgaaagcgtaattcatatgaagtaaaacttgttaataactcatgatgacttactccatctccttaacaagtttagtaaccagcataataaccctattgctcctacagagagaaaaacataagtggtatgtcacaccccgaagttttcctcccaagccaaaattgtaatttttataaatgaccctaagaaaataccggtgcaaatcaggagtaaaccctaaggaaataatgcaaataataatcggatttgacatgtggaatttttcttgagttctacgtgtcgaaattcattaacatgatttttagtggaattttcagagctctagaaataattttaaccaattaaaattgagcaagcaatattttaattccagggaaaatcctttttcctttttctttttctttttcctctctttttcctccttttttcgaatgggccgtcggcccattctctcctttccttccccctcctccttgctgggccggccgcaggccgaggcccagccaggccgtcccgccgccctcctctccgaggtcgccgacaggtggggcccacctgtcgggtccttcccccacctcccgccgctctcgctcgcgccgccgcgcccgcaaccgccgccgcgcccacgtctccgcctccttcgggccacgtcgaccacgcccgcgcgtgcgccgcgtttcccgcgcccactcccctctctctcccgctcgcgcccgcgcccgagatggccgggattcgattttcgaatcccgcctctctctcctccccctctcccccacg

SEQ ID NO: 86132 - DNA, 9590 bp, Oryza sativa
cggccctcaaccggcggtctgaccgcccaacacacggcggtcagaccggcccactcggaggaaaccggcagacttccaaattttggcaatctttcctattttaattctaggtgccaaatttgggtgtaaacacatgtccccctgcctttttgatgaacaacgtgaatctaaaagcataggacatgtttttggtcttaggacgaacccaattaccggccatagtacctcctaagcgtcttgccaaacactcgggaagtattttttcaagtatttcccgttgattgttcgctgaaaacgctccccttgaagtatctccaaaaagtacacgttccctcgaacaatgccgcacactcgataaggaccctcccaactaggagaccacttaccgaactccttggatcgagtacccaaaggcaaaattatcttccaaaccaagtctccaacttgaaacaattttgctttcaccctcttgttgtacgccttggccaccctcttcttctctttctctatctcttccaatgccttcaagcgcttgtcgatgactttatcaaggttgtctcccatcaacatcttgtaatcttcacttgacaaatcatctcgcttgacataacgaagagagccaagatttacctccaccggtaaaacggcttcttgaccataaaccaactcaaaaggagtaactttagtggcaccatgtttagatattctatgcgcccacaatgcttcaaaaagcacctcatgccacctctttgggtattcctcaatcttcttcttcaccaacttcaacaatgtattattactcgacttggcttgtccattagcctgagtgtagtaaggagaagaactcaacaatttaataccataagattcggtaaaactcttcacttccttagacataaaagaagcaccttgatccgtaattaatgtttgcggaataccgaatctatgaataatatgcttcaaaataaagtcaattacctccgtatgagtcatattcttcaaaggcacggcttcggcccacttggtgaagtaatccgtagcaactagcatgaacctatcccctttgacgacgaaggataaatttgaccaatgaaatccaaagcccatcctcggaacggccatggtttgattatagggttcaacatagcggcgggtgccaattgaacattaccgaaccgttgacaagcctcgcatcctctataatatttgaagcaatcatcaatcatcttcggccaatagaaccccgctctcctaagcaaccaattcatcttgtgggccgattgatgagttccacaaattccttcatgtacctctcccatagacactttagattgatcttcatctaagcacttcaacaagacaccatctatgtttcggcgatacaaatctccatcaagcaacgtatatttgaatgcttgccgccgaactttccgatcaactttaagtgtgggatctttcaaatattgaatcagaggaattctccaatcctattctgtatcctggacacaaatgtccgaattcacaattaattcggcctctaaattgattgaaacgtgccccccagcgttctgcccataaccggtcagaccgaccatgcagggccggtcagaccgctcggggtcgccggtgagaccggcggcatgcggccggtcagaccgcccctggtcaccggtcagaccagccgtgcaacgctggtcagaccgcccctggtcaccaattttgccaatttcgcacaaagatttaaaatcaagcaccggctcttctaatatcagaaataatctcctcttcacattatagccagatgcttgttgtgccaagtcatttgctctagaattatcacgcctaacaatatgcctaatagcaaaattatcaaaattggcaataatatccaaacatgaatcgaggtacctatttagtgatccgtccaagcatttgtatactccggcgacttgttacaccaccaattccgaatcaccaaaagcctccacgtacttagctccaaccatctccataacttgtaagccgaacaataaagcattgtatttggcttgattatttgtacaataatactccaaacgaaccgatgcttcataacacattccattaggtgaaaacaaaactacccctatgccttgaccttctttgcaagaagaaccatcaaaataaatcttccaaggtataacttcaactaagcaaacctctccctcataagcaacatctatatgatggtctactataaaatcacatacagtttggcctttcatagatttcaatggttcataagccaaatcatattctatcaaagcatatgcctacttgccaattctcccacttagaattggcatttgcaacatgtgtttaataacatcggtttgacaagtaactatgcatgtactagataacaaataatgcctcaatttggtacaagcatagtataagcataaacaaagtctctctataaagacatacctcgtttcggcatccaaaagacggcggctcaaatatgtaatgatatattccttgccatcttcctcttgcgtcaaaacggcaccaatgactttgtcctcggaggcaatatataaccgaaaaggctttccggctttaggcgctcgcacaacgggtggagtagacaaatatctcttcaactcttcaaacgcctcttgttgttttgccccccatgtaaaatcggcttcctttttcaagcgaagtataggaacaaaagcatcgattttacccgctaggttagaaataaacctcctcaaataattcaccttacctagcaacttttgaacctctttcttgcatgtcggcgctttgaaatcacgaattttttctatcttcttaggatcaatctcaactcctctctcatgcaccatgaatcctaagaacttccccgctgacacaccaaaagcacatttaagcgggttcatcttcaaaccatactggcgcatcctctcaaaacctaatctcaaatcggctatgtgtcctttcataccatccgatttgacaacaatatcattaatatagatctctaagataatacctagcaaatcatggaagatcaaattcattgtcctttgatatgttgcaccggcattcttcaacccaaaagtcatgacaacccactcaaataaaccaacaaaccccgggcacctaaaagccgtcttgtacatatcctcttccgccataaagatttgattgtagccggcattaccatctagaaagctaatcaccttatgacccgaggcatcattaatcatgatgtcggctataggcataggatactcatctttgggagtggctttatttaaatctctaaaatctatgcaaactctaatcttaccactccccttcttctccaccgggactatgctagaaacccactccgcataacgacatggcctaataaaccccgccttcaacaaccgatcaatctcctctttgactcggtcatatagcacaggattaaaacaacgaggtggttgcttataaggcctaaaacccggtttaattggaagccgatgctcgacgagctcacggctaagacccggcatctcatggtattcccatgcaaagcaatcaacatactctttaagtaactcgattatcttaaccttataatcggctctcatgtttttgtttacaaaagtcggccttggtttagttccatcacttatgtccacttcctccaatggatcggccgatgtaaacccttgtccaagcttctccacttcatcaaaatcttcaacggtttcaccaatatcgttctttgtagaccgatattcttgcacactttttttaaccactctaaattagcctctttactcattatacaaatttatatggcttagccgtgctacactagccgactttacagagataggtacaaatttgccatcagagatactaataaaatcataactagaaagatccctccccgataagcattggatattcccatgatgccactcaaaagtagcatcggccattgcaacctcggccgatgtatccgcttgaacaatttcaacatcatcgccgtcccattgaattaaacattgatgcaaggtagaaggcacacaacaattggcatgaatccaacaacgacccaaaataacattgtagttaccttgcacatcgacgatgaagaaagcggttggtagcgtcttgtttcccacggtgagttccgccgaaaagatacccttcacctccgttggttcaccattaaagccattgagaatcatgttggtcttcttcaactcatcatcctcacacctcaacttcttgaataacgaatacggcatcaagttcacggcggcacctccatctactagcatcctagagaccggcttcccatcaacatggcctttgagatagagaggcttcatgtgacggtttgactcatcgggcttctcaaaaaccgcgtctttaggacctaatgagaattgagcaacctcggcttcatccatagcacaaaactccataggcaacatacataccatgttgatatctatgtcttcttttggagatggttcacttttatcaaccgattgttcttccttttcctctacatcaatcagttttgccttctctatggatttaggccttcaaaccagtgggggtcgcaactcattgaaccttttatctctttgctcttcggcctctttctctcttaactcttgggtccaaagacgttgcaaccttctcttttgagtagccgtcaaatccctaggcatccacctaggattcagctctattccaggaggtaaataatgccctctattaactttgtttgaagatgatgaagtctccacatcgccctttgcaatcctcctgtcaaaccggcgctggagcccggtcagaccggtcgtagaccaccggtcagaccggccagatgcgccggtcagaccgacactgggcgcacggttagaccagcctgaggtgccggtcggaccgctatcgagtcggcggtcagaccggcctaatggcccggtcagaccggccgcacgaccgcggtcagaccggccagaaggcctagtcagaccggccgactgcgaggaactggtaccggcttcggattttctgttcggggacattccaattccatctccagtaggtattggcacatcatgagaccccactttaatagtaatcacttccgaagtcctctcctccaccttgacgcgctttccttccctcttttcttcattagcccgattcttaccataaatcagctattgcttggtgaagacaaacgctcatgaattggcctccgtggtcctccccaccgttggttgaatcacattggaggcatatgattgaatattggcggtgttgccccccatggcataaagcaaggataaggataacccggcggcggcattggataagaaccccatgacatgtcttgtggataatgatacgaaggtgaatgcgaccatcttggtgaatgaccaaatcgctccctaggaggtgatcttggtctcttccctttgttgcgaattttctcaccaccttgcttctcatatttctccaaaagcatatcaaaagtcaccttggtcttcctaggggccttagaagttgaagctccactcctattctccttccaaacgccaacctccggcttctttggcactatcatcttggaccttggttcaccaatgatcacttcctttcccttagcagatttggcttgctccggctgaatcaacaccttcttatcattgaaattaattgtattcaccgaaaaaggatcatgatcaagcttcatcttggagccatcggtgaacttcaatcgtccttcatctatggccgattgaacctgtcgtcgaaacacattgcaatcattagtagagtgagaatgagaatcatgccacttacaatatgctcgacatttcaactcttcttgagaaggtatgacatggcctttaggtaatctaatttgtttctcttgcaaaagataatcaaaaatcttctcacacttggccacgtcaaaactatacttaaccttactttgccgatctttgcgaggagtcggcattaggttagagcaaacaaaaggcttatttttgttagtccatgaccattcggcaacataaatatcatgatcaccctcttcctcactatcactagcctcagggtaatcgaccacattaacattaggctttttgtcaaatggtctagcaagttttctattatccttaacccggctttcttgagccagagccttttgcatgagttgactaacatcaagaaattgttggccatctagtctttctctaagaggagcaactaaaccattaaaagcaagaccagccaaatctctatcatttatattcaaagtataacatcggtttctaacatctctaaatcttttaatataatctatgacagattcattatacttttgcttaaccgatgtcaaatcacataacctaagctcagtttctccagtatagagataatcatgaaatttttcttctaattgagcccaagtatgaatagaatttgccggtaaagaaataaaccatgtaaaagcattaccggataaagataaagaaaacaagcgcaatttaaaagtatcactattagcctcaccacattgcgccaaaaattgacctacatgctcccatgtggtcttaccatcctcactactaaacttggcaaattcgggaactctataatttcgaggaaacggcacattatcataataatcaggatatggctttttgtaagttctagcacgattcctagtttcaatcccgaatctattcctcataatttcactaattatatcctccatattattaggcccttgttgatttagcggtggattcggtggcctaataggttgtgtttatggtgcaatatgattatattggccttgtctagtatcgggaggataccccctagaaacatcgttataagaattaggaacatgtgggggaacttggggactacttgtagcagtagatacaggaggatcaaatgttttaaagtgatacaaataactagcattaatcatcggatctattccctgtatcggaacaattgcaccggtctgaccggcccatggcccagtctgaccggcgtccagatgcgcggtcggactggcctgagacccggtctgaccgccggggtaatacccggtccgaccggccgtttggccggtcggaccgacggctgtgtcgcggtctgaccggccgtcaggcccggtcggaccggtcgtgaacgccgtcccgtcggttttaccacccgtttgatctataggaggttggttagcagtggtagaggctttatcttttaatgtctaatcgtccataagagaaccgaatttattccttaaaaactcatcaaatttacccttaaaaattacatctaactgatctttaaaaacaactataaatgaatctattgtagatgtaatttgttgttggatagattgtgatacttcatcattgcttaccacgtcgggagcgagcttgggacgtggtccgggcttgatggtcacgccttgacgagtcctagtacttgctctcatcaacgcctcccgtgtgagctcgttgatgtactcctccatagctttacgatcttctccttcgaagtcttccaatgcgaccggtatcacattagatggctccacctccgtcttagatagcggcttcgtcatggcgaagtcaaagttgagttgacgatgaacggatctcctccccagcagagtcgccaaaaatcgtgttggcaactttttgtgacaaattgacaagcacgatcatagcaccttaagccttgcggtgattctagagtcgtcaaccacctcgatctagcaaagagctaaacctagatgggttttgataaataaccggctagcggagccgatttctagataactacccgtctcgtgggcaaaacggaaggttttcaggacaaacctataaagtgatgtcgcactctcgcagcggcggcggatggtttacggcgcaaaccgacaaagatggacaaactaagagaaaactaaaagcaatatgaaaaacgattcgattgattgattgtagattggttttttacaatgaaccggccatgtcccttatataggggttggtcttgccctctacaggccctcctccacgtccagctcggggtagaaaccaaaggaaacctgaaacatgccttctcgagcaaggaaacctcgagacccgacgaaacacagtcggactcggacctgccggtcagaccggccacacaccgccggtatgaccggccctcaaccggcggtttgaccgctcaacacacgacggtcagaccggcccactcggaggaaaccggcagacttccaaattttggcaatctttcctattttaatcctaggtgccaaatttgggtgtaaacacatgtctgtggggtatctcatatttattaacctatagcaaaaaaggagttggcattaaatttttatgtaattttaatgatactaataaatcatgtaataaatggaagtagcatacaggtattgcaaggaattttctatcttgcgcttgtggcaggtaattatggtcggacgcatagtgtgaatgacctcctctcatttcttgccttctcctcctttgaaggcctcctcacaagatattcgacttccctcaacttcttttaagtcccctggagatgatggagagaagggattggggacttacatgtgggtcccactattttattatattttaacggattgtaataccatgtagacaccacgttagaaaaaggcagttaacgtgccacgtggatgccacaccagggaaaaccacgctcttaaagaagacgaggggtcattttgcactggaggggccagtagtatacccgattttacggttaattagtgatacgaatcaaatccaacttgtaatcaaattggacctttttccattgagaagcgattcgacttggctacttaagccggtcataatcggtttaacagatatgagcaatccttgggtttaatttgtttcagctagcccaacgtatttgattaatttggacggcggcaatagaaagcccaaaccgaaaccgccaaatatcctaagcgtaactagcccgtattccttcgtcgatctccccgttacgtccttgatcgcgatcgagttcgtctgccaccttcgccgatctccatatctcgccggcgcgcgccgaccggagtccggagaccatgcatgctgctgcttccgccgcatcctcgccggtgagaacaacagtttgttcctagaaaaaattcagaaaaaataattggggttcaaccactgatcaacctcatgcccaatgcccgacaaagaacataccctgttgatgtttgtactgaaatcactccggacactgcaaaaccatggagatcagacagctcagttagctgacgatcgagtgatagattatgaccatcgaattagagacctctgtctatcaaccaggattattactcgtcgtgtaattgcaggatggatgaatgtatggatgccatattgctgacgcttaattacttcctgtgacgtcttagaatccgatcggtgaagaagaggagtcgagagattcgagagatatgcagcgtatgg

SEQ ID NO: 86133 - DNA, 2511 bp, Oryza sativa
tcctgcagcccgaaaaaaaactttagtcccggttggtaacaccaaccgggactaaagatggtagtgctacaatttttagtcccgggttatttcaagcgggactaatgatgggcatctttagtcccgggttgtaacctgtgattaaaggggttgtaaaccaggactaaagatgagttccccagcagacacatgaagaaacaaaattaacaaattttattatttttatttttttacttgtagattagatagaaacttgcatgtttgtgtatagacttatatcatcataattgatgttactaaatttttttaattttttctataataactatttaagtcacatgtaaatgttgggtgtcatgacacctactaggtgtagagaacctagtcgctttcttgtacctttccttttttgctttgaactacactttaagactttgttcttccacggggtaatgaagattggagaaggggaccagttcgaaactgcactgaaagttcaaattcacctatctttgttacgctggttgcttgacaaaacgagagcatagcagcaatgtatccaaagtattctgcaaattgagatctattggtctgaattttagtatacttatatgattattgggatcatgttatacacatttagatcttctagactgaactaaccattctagatctcagccagagatggggatgaattaggacaaaacaatgtttcggtagtaatctatgcagtcattggacagcattagctgaatatcatatgagatctatcaacaatgaacacatgtcttgcaagaggtctcttctgttggtgccttcgatcatttctgttttgttaatatttctgagtttcttacaactccaacatttccaggccctctgtaaggactaggatatcgactgaaaacaagaaaagtatgtaacaaatatcagttagatatatggactgtttgattggattgttggacagaggaaattgtaggaaaagttttctggacaaaataaataaatgcttggaaaatagacagcatcatgtaaactaaacacattgctcacattgccaattaggcagctctctaaagagcaaaccaattgcctcacgagctgtacatatcccttgtaaatgtagaacaagtaaaatgaactaaacatgactaatactcctgtatggagcaattaacgaagatgagtcctccaaaccaacttgtgggtatggataaaaatctaaatatgacaaaaattatctcgctatacaaatcctatgagtgagaaaacttgcaaacctagcgaggtgtgatggacgttagtgtcaaacttgaggacgacaacggctgcccctccgctgaggccatcggcggtgcatatgttggcacgggcatcttagctggtaacacgggtagtggtccattggattggagaactgccatggcagctctgatagatggacgtgcacatcggtccggatgtgcacaccagagtccaacagccatgacacactccatgctagttgtgtcgtattcattgttgagccgctcgtctgctgcattgagaacggctccttggccgtacaggtcccacacccattccaccagtcggaagaggcaattgttctgggtgtcctgcaggctaattggtctcctcccacatgccacttccaatagaacaatgccaaaactataaacatcggactcagcgcttgctttgcccgtgattacgcattcgggatcaagatagcctggtgtccctgaggggtgagtcattgtttgtatcccaacggcatggtcaataagccttgcaaggccgaaatcgcctagcttcgcattgaaggattcatccagcatgacgttgctcggcttgatgtcacggtgaactacacattgatcccactcctcatgtaggtagagtagtgcagatccgagtccatgaacaatgttgatcctgtggcaacatccaagttagcagatgaattgaatttcaaaggtgtcgattgcacataacgaaaattactaaatcaatgagttaattaataaacctcattggccatgtgaggaaggtgccattgccgtggagatggacgtcgaggctacggttggggaatagctcgtagacgaggagcagctcggtgcggccatggcaccagccaatgagctgcaccagattgcggtggcgtagccggcttattaccttgatctctgacttgtactccttcctcccttgcttagaggaatttttggcaaacctctttatggcgacggcgaggccaagctctctgaggtagccccgatacactgcaccgaaaccgccttgcccaagcttctcctccggcgcaaagctcttcgtagcgtcgacgagcttgtggtacgggaaccgccttggtcccatccccatctcaatctccacgatgggctcgccgtcgtcgtcatcgtcactgccgtgccagcctccatctctgcctccctccttttcttgtctgacgtcgtcgtacaaggactgctaccatggcgaagagga

SEQ ID NO: 86134 - DNA, 2049 bp, Oryza sativa
gagctcccgcggcagcagcccgggggcgccgccgcgaagccgctccaccacgcgcaggcgctgatcgagctgctctgcccgccgctcacgctgcaggagatcctcgcgttcgtcgccacgggcccgcactgcggcgtcgtggacggcggcggcggcggcggggcgggcgcgctccttctccgcgtgagctcgccggggccggtggggagcgcgttcgcgctccgcctcgccgcgcgcgtcacggacagctccgtggtgaccgtgtccgtgggcggcgtcccgcgcctcgcgttcgggaccacgcaggcgtcgctcctctccgaggtgccgctcggggtgaccgcgtcgctctccgacgagggccacggcggcgggcgcgccgtcgagggcggggtggtgatcgaggagcggctgctcgagtcgctgctcgccatgaaccacgccgacggcgcgcacaccgacaaccccgtgccgcggaccgtgtccaacctcctcgtgcacgtcctgggaacgcacgtagaccacgtccacgacatcgtcacgcgcctcgagatggagctcgacagcatcgagctgcatctcgacaagggtaggtggaggttgctttcttgactagtaatcgcatataaacataaatcaaattattagggttctaagaacatctccattcgttagacaaagttggtgccctttttttcccttttctggtgatgttgttaggtaggacgaactagcttcttcgttacgtctgttgttcatgattatgcacgagagaaatttattgtgctttgctttgttctatgggctcattggattacactaaactggaagtctaaaaattgggaatttgtcgaaaattatcgattctgttgtgattgtccatccgcattggggcggcaacttgatgaaaaactcctatgattggaaggaggttgctgatgctattgaattgattcttgattgttactgttccatggagaagttccaattccatattcgtgcttaaattgattctgaagcggtgtatttccttttagaggtgatttcgggtgtgtttagttcccaccaaaattggaagtttggttgaaattggaacgatgtgacggaaaagttggaagtttgtatgtgtaggaaagttttgatgtgatggaaaagatggaagtttgaagaaaaactttggaactaaacccagccaataaattataaatttggggtgaagtaaggtcagagaagaaggaaaggtcatcaatttatagtttgttatgtatggtggaatgaaatttctgaatgtcatgttggcagcaaccgtatttcctgaaatgccatgattatattgctagctgtgattccagatgggattcatttcacatgatcagtatgtgcaacagaatattttctgagatggatttctcacgtagtctatggatatctgttctacttctacataggttaatgtcaatggaagtcaatgtgaagtctagtttatttactactagccaaacttatgctcaaatttgttatagcattctgcagatgttattctttctcttaatgggctttgaaggtatttatgatatttctgtgaatcttgcttgcaggtggtcactttatgaggaaacttttgttggatggaaggagattccccaaaatgcatcttgatctacagcgcctgcttcaggtattttctgagatttatctcaaattgctaaaatggagttcaatgtatgagtatgttattgttcactggatcgggaacgcataatagaagtcatgggctttaatgatttcttgcctaggttgtttctcatggtgaccaagtattcccccgtgtaaaggaaaaatgtgcgagcaagagttggtttgcgagtgaagatattgttgctcttgaagatctgataggccgtcttaggaggctgaaggaaaatcttggatttataacgaatagggtgactacacttcaagctagtctagatagctggcaatctgagcagataaacaaaagcttgtactatctttcatttttgtccataatattccttcctctatcca

SEQ ID NO: 86135 - DNA, 3113 bp, Oryza sativa
ttatagttttggccattgtctaatggaagtggcctgcgggagaagaccaattagcttacaggacacccaaaacaattgcctcttccgactggtggaatgggtgtgggatctgtacggccaaggagccgttctcaaggcagccgacgagcggctcaacaatgaatacgacacaactagcatggagtgtgtcatggccgttggactttggtgtgcacatccagaccgatgtgcacgtccgtctatcagagctgtcatggcagttctccaatccaatggaccactacccgtgttaccagctaagatgcccgtgccaacatatgcaccgccgatggcctcagcggaggggcagccctcatcatcgacacgaatgtcgtcctcaagtttgacactaacatccatcacacctcgctaggtttgcaagttttctcactcataggatttatatagcgagacaattattgtcatatatagatttttatccatacccacaagttggtttgaaggactcatcttcgttaattgctccatacaggagtattagtcatgtttagttcattttacttgttctacatttacaaattgacgcttgaatgggatatgtacagctcgtgaggcaattggtttgctctttagagagctgcctaattggcaatgtgagcaatgtgtttagtttacatgacgctttcagttttccaagcatttatttattttgtccagaaaacttttcctacacctctccaacaatccaatcaaacagtccatatctctaactgatatttgttacatacttttcttgttttcagtcgatatcctagtccttatagagggcctggaattgttggagttgtaagaaactcagaaatattaacaaaacagaaatgatcgaaggcaccaacagaagagacctcttgcatgacatgtgttcattgttgatagatctcatatgatattcagctaatgctgtccaatgactgcatagattactactgaaacattgttttgtcctaattcatccccatctctggctgagatctagaatggttagttcagtctagaagatctaaatgtgtataacatgatcacaataatcatataagtatactaaaattcagaacaatagatctcaatttgcagaatactttggatacattgctgctatgctctcgttttgtcaagcaaccagcgtaacaaagataggtgaatttgaactttcagtgcagtttcgaactggtccccttctccaatcttcattaccccgtggaagaacaaagtcttaaagtgtagttcaaagcaaaaaaggaaaggtacaagaaagcgactaggttctctacacctagtaggtgtcatgacacccaacatttacatgtgacttaaatagttattatagaaaaaattaaaaaaatttagtaacatcaattatgatgatataagtctatacacaaacatgcaagtttctatctaatctacaagtaaaaaaataaaaataataaaatttgttaattttgtttcttcatgtgtctgctggggaactcatctttagtcctggtttacaacccctttaatcacaggttacaacccgggactaaagatgcccatcattagtcccgcttgaaataacccgggactaaaaattgtagcactaccatctttagtcccggttggtgttaccaaccgggactaaagttttttttcttttttttcagtgttttttgctgtttgcatattggccttttttttcattgttttttcacagatttaatgaacatcacaaatttatagatcgaatgaacatactcaaattcacatagtgaacatcacagatcaaatggacaccacaaattcacaaaaacatctgaaaaaatgttcatctaattatttttctattttcgaaatttattttatttgttattcgaaattttaattgatcccgtcatgtgttctaaatggtcttttcttttaatagttttaattttttattatgaatttttaaattgttttcctaactgaactcttatttttcttttttttaattaaatattttattttattttttatttagaattttaattcatctcggttggtgttaccggactaaaaattgcagcgctatcccggttggtgttaccaaccgggactaaagttttttttcttttttttcattgttttttgctgtttgcatattggcctttttttcattagttttcacagattgaatgaacatcacagatcaaatggacatcacaaattcacaaaaacatctgaaaaaaatgttcatctaattatttttctattttcggaatttattttatttgttattcgaaattttaattgatctcgtcatgtgttctaaatggtctcttcttttaatagttttaattttttattactatttttaaattgtattcctaactgaactcttatttttctttttctaatttcatattttattttattttctatttagaattttaattaatctcgttttgtgttctatatggactattattttcatattccttatttatttttttcaattttagttgtttcaaaattatatcctacttgaactctcttttttatttttctaatttcagattttattttatttttagtacaaattttaattaatcacaatgtgtttttatatggacttttctttcaatattacttattttaaattcaaatttcagttatttttacattctagcccactaactgccattaccgtgttgcttaacgacttgcccgttgttcctccccttaatcgtcgttgggattctaaaaattgaacctaatcatcttttcggttttgttaatagttttcaccagatgtcccgttaaccgtcaccaccctattgctttataggtctgttgttcctcttctctttattgtcatttgctattattgtattttttaatggactgttcttttaaaattttgtatttttttcattccttttttttgttatttgaaaattttatttctatctgaactcttatttttatttttttattctttggaacttattttattttttctgaattttagttaattaacctcatattctattctacatctactgttctctcaataatcatttttattttaaatt

SEQ ID NO: 86136 - DNA, 2167 bp, Oryza sativa
atgttctcaccaaccgggagtaaagatcttttcctgctatttccaaattctttttaaacccggttagggttaagaaccgggactaaagataatagcactgaattttgaatttcattacatatgtgtttctaaaatagtaaataatacattacaattatttaaagtcgaacaattaatgacaaaaccttcgaaaaattattgttgtatgtcgtagaataagtggataatatataataagcacatgaatgatttaaaattgttaaaaattctaataatcatatatatttagcatatgcatgatattaaattgttaaaaattctaattaacatatgtaaatagcatgcatgatttaaaatttataaaaattctaataatcatatataattagcatatcatgatattaaattgttaaaaattctaattaacatatgtaaataccatgtgcatgatttaaaacttttaaaaattctaataatcatatataactagcatatggattatatcaatttgataaaaattctaataatcatacataattaacatatgccatacaacaattgatttgtatggatattcaatacatccaaaatagtttacatcgtgtacacaacaattacggcaatacatcggcggtgacggttgacagcacgtactttctcctcactattgttccttccttgtgatcgctacgtgagtaaggggtgtcttcatttgataggaggatgctagggtcaatcatcaccgtgaaagggggttgcccatcaaactgattataatcctcgtcagtcttgtcctctactccgacgatttttctttttcctgggagaaccacgtggcgcttcggctcgtcaggccctttgcccttttttcctttgctagacatgtccttgacgtaaaaaacttgcgttacatcattggcaatgacaaaaggttcgtccgagtatcaaaccttgttaaggtcaaccgttgtcatcccactgtcatcaatcgttacgcctccaccagttaacctaacccattggcaccggaacagagggaccttgagaggtccatagtgaagttcccatatgtcctcgatggcaccgtaatacatgccagttgtaccatcgtgtcccatggcactattctggttcgtgctcttcatgtcttgggccctcgtgtagaatgtgtacccattgatttcatatccctggaatgtcgtgatcgagccagatggtcctctcaccaggaaggctagtttttagttaatcgtctcgttacccatgagatgttgtcgcagccacgcggagaaagtattgatgtgatgccgtgtaatccatgcatcggacttaccgatgtttctggcgtgaactagagccaagtgctcctcgatgtagagagccaccaatgaagattgttgcagaaccatgaaatgggctttacggaataaattgttgtctaccgtcattattgctttcgttccgagagtcccctttccccgtagtctcccttcatggcgtgattcaagtaccccgattgggcgaaggtcttcgataaattctacgcagaattcaatgacctcctctgttccataccccttggcgatgcttgcctctggacgagcacggttacgaacatactttttcagaatgcccatgtacctctcgaaaggaaacatgttgtgtaggtacacaggaccgagaacaccgatctctttgacaaggtgacaaagcagatgcgtcattatattgaaaaatgaaggtggaaatatcaactcaaagctgacaagacattgcaccacatcattctgcagggctgctaatctatccggatcaatgaccttctgcgaaattgcgttcatgaaagcacatagctttgttattgttgcccggacattgtctgggaggataccccttattacaactggtagcagctgtgtcatcaacacgtgacagtcatgagactttaggtttgtgaattttttctccttcgtgcttattattcgctttatattcgtggagtatccagacggtaccttgatgctctccaagcattcaaacatactttccttttctgccttaataagagtgtagtggctggactcaagtaatggcttcctttctcaattggttccgggtgaagatagccgggttgttccatatgcttcagaccatgacatgggggatc

SEQ ID NO: 86137 - DNA, 1584 bp, Oryza sativa
cacgcaagcgcgagagccgcgccctgcgcctctccgctctgcccgcgcgcgtgcgcgtgagccgcccgcgcagccgcttggccccgcgagccagcgcgcgtgcccgagccgcgccactccatccgccgcgcctcccgttgcgagccgcgcgcgcgtgccggggtggccgaccgcccggtcgccgccgccgtcagcctctgcacgcgcctgtcaccagtctcgccgctccgctccaaaccgccccgccgtcatcgccgtcgtcatcgcccggccccgccactccgcgcgcaagccgccaagggacggaggcagcatccctcctccctctgccgcgtcgcccccgctcacctcctcctttttcccgaattggcaaaggggcaagccccatatctccccctccttttcccctttttctcctcgccggcgtcatcctccctgtcgccgctttggccgcgaccgccgagcgccagctcgcgcccttgaccgcgcaagtccgttcccaaaccgacattgccgcccatttaaaccccagcctcccctttcccttcctcttccattcgcctccgtgccattgccgccgctcccgtgctctgtctcgcctccgccgtccatcgccaagcgccgggagagccggtgcgttcgtggacgcggaaggggactccgggcgtgccctcttcttcctcttcctcggcccgaggccggagagatcactcccgcgccgtcggcctctcgtcaccgtgcccgtcccgcacggtagtgcctccctccgttcttcctcctcgctccatctccccacccccccttagctttcggtagtagctcgagtagcctccccgaagttagccggcgcagccccgaccgttgccgtcgctcgccgtgtgctcgccgccgtcgccgcccgagctcggaagcaccgctcgtcgccggcctcgctcggcgtagttccgcccaatccgacgctagcatcggattcccgtaaccgcgtagatgctctcgccgccgggaattagcccctagtgatctcgtcgccgtttcccccttctcccgccgccggttgccgccgccgcaatccgccgccgtcgagcaacccccggcaaatccgacccgttggttcgtctcccctcgtcacgtgcaaccgcccggtgtgctcgcttttacccgtatcgccgtggttcgctccgtcgctcgccgctgtcgaccgccgtccgttccggccggcgtcgtcgtctacctcccgccggcctgcgtggcagccacgtaggtgccacgtcggcgccagctcagcctagaccgggtcgagacgaccccggtcagtccctccccgtgcgcgcgttccaccgcgagccgtgaggctgagcgtgggcccgccgtacctgcgtccatcgcgaaccgcgtgcgtacaccacgtccatcctccaccctagcgccgcgccgcgtgctccctccgcacggtgagccgagccgctgacaagcaggtcccacccgggaccgcgcgtggtgcgcccggtccaccggactctctctccttcctccgcgcgcgctcgtcttgggccgccttgggccaccttcttgggccggccggcc

SEQ ID NO: 86138 - DNA, 3472 bp, Oryza sativa
ttggcgcgggagcagaggaattggtggcggcagagggaaatcggtatggcgggaatgggttttgggagggtgaatcggggatttcgcgctacggtttcgacgcgagggcgaggctacgccgcccacaacgcgcgctacccgggtcttctcctcgctgcgcgtcctggatttcgcgaggttttgcgtcgctcacctaggggacgaggaacctagtttaggcgcgggtccaagtgacacggcggcaaaaatccaacgtggcgcgacgaggtcccggtccagctcaccacactgtgagagcactgtgagaggcctcatgtcgtgcatacacaagtactgtctagagtttgtcttcttggagaagacccagaaaaaccaacctttgtatacaaaaatgcttaatagacatagtataagacacccttggatactatcccatcgtcatgtgaagtagcaaactatgttatgatccccttgatcttgtttacgcctttggatttaagatatgtacttaactttttagattagatagttttacctttgtgttactttggataccataactctttatcaagtaatattgattacatcggctatcgcacaccaatgacctcaaaaagtaatatgtagatcacacattcaatatagggtaagttgtatgtgaatggataatagagttggaataattcatagtactagtatgtatcgctccataagttattttgttgtaaatgctcacttacctaacttaggtactatttgtttcagcttaagattattgtaatctcttattaaatcagattactctaaactagattataataagctgacatagaataagctgccaattgtttggtttctctggattattagaggcatctaaggccttgtttctttcagcttggaattattataatccagattattgggagtaagctgaaagaaacatacaacttattgaagtagcttattataatctggtgcccagcttattataatatgataaactcatttaggtgagctttttccagattattgggtgaaaaattacccaccatgccaccccactccctctttagacttgcaaacccaataatctaggctctaataatctaggaaagaaacaactaaccgcttattctactacagattataacaatctagtttatagtaatctgactcaataatctagaatataataatcttaagctgaaagaaacagggcctaagagtagtgggtctttagccactcaataatttggaaaaagctcctctagtgaagatttatcaaatattctggacttggggggcatgtgttaacaaccaaatttggtaatatcggcatcaggaaagaagattagatcgaagcaaagtcggaggcggagatcgagttcggaaacagagcaggaatcggctagagtccagatcggttacgattagaatcggctgggtctgagtcgggctaggtaagccgatgcagccgattctgacaatgcaactcgatgtatgacatcgggttgaattgaggtgcttcaaggtgattgccgcacatggatagagtcctgagaagtcaattgtatctattaattaggatgttttatataatttccttagagatatgcttgggcaaaagtctgccgcaaagacttatggtatcttggagtttgttagagatagttgtcgtgtctgttatggacatatcttgtaattttcgggtataaatagacccgagcactatgtatcttttaacacacacgttcaatacaatctcggtgcatcgccaccttttttgctttagttttatttcgacgagttcttgctttcgggttgagctgcatcggtttcgatcttcaacaagaggtaaaacttgttatggcggcttgcgttcttgggattagtgcttccatctttatgacactctaatcttgtttatgtaattcgtcgagttatcatatatcctacataatccttggcaatatcgatatccaacctacaatcggctaacatccgtcaatagaaggcagccgattaggttaaataccgatgttgacttagattatataggatatctaccactctatggcacatccaatggcttgattgtctagatacggcttgacttaagtttgaccttataagtcgtgattagaatctcaatctctagcccgcttcttggttgctgattagggtagtatcggagtttcagccgatcttacctaatttaactgctttttatcctatatgcttgattgacatgttaaatctgtcctttacgttaagatcttgctgcatttaaatatattaggcttgtgtttagtatattctacttgctttaatatcttaatatagagtagtatcggagtattagccgatacatgctagatctatctgatcggctatgctatgaacgtatatagtctcattattaatatatatttcgatctaagtgatttatactgtctcggcatagcgaccgatctatcccaatcacttgatttaagtacgtattgatataaagattatatattggtaatatctgcagccgatcgagtagattcagtcctttcttatttattaatgactgccgatcgatgcatatacgacatcggctgaaagataaatgatatgtcatcggcacctagccgatcggctatcatttatagatttaactgcggtttctttgcttctatttcttgttgattacaggatcaaatcaactggcacgctcatacattcgaaggtgagctttggacctgcactggagttaagcagatctccaaggcctcgtgttttctgtcaacaagattataataatctagcataataatctatttgtttgtttcagcttactcctaataattcagattataataatcctaagctgaatcaagcggggtcttagtttgttgaaaaaccacccattacgtatatgcttaactgaatcaacatgtattttaaagtgtcagcgttaatgtggtctttaccaaaattaaatacctatagtcttgatacttttttgggtaagattccacaaacaaaattactgacaagagcttaaacgttctctcattgagttttgctatatgcacaaaaaaaagttcaattaaatatgaaaataagtctaatgtaagcacttggataaggttgaataggcttagcttagcctgtggtaactctacatcagtgctaacaggttaattcagttaagcacgtacgtagtgagatggttttgcaacaaaattaagtaggggtagatatttgcataaaatgatttattatgggggtagaatgtcatatgagatgattttggaatttttctctattatattttagagcggagggacatgagatttaattaaacacatccactataaaactcataggcaacaatgagatttaattaaacacattcactaaacacatccactatcaaaagcaaaacacccaccttgtgacacaaacccaggggctactg

SEQ ID NO: 86139 - DNA, 1483 bp, Oryza sativa
tcctgcagcccttacatgacccgtaatggcagaataaggtacaataacaggacttttagtttttcatgttgctgaatctttgttttaatcgaataaaaatctaactttctgtcatttctttcagcatggctggtgtaacaacaggaaatgtggcgtatttggctaatgctattcatgaggtcactaaaacaaatgaagctacttcctcttccctcttcggccaatgaaatgaggcttgcaagcggcggcgttttttttttggggggtggtctattgacctttaagatggttgtactagagaaataatccagtgaacatgctggtgtttctccaacttcggattttccctgtatggaggagagaactagaaacctacccaattttgagagctatagatgccgatcctgttatttcaatcgtcagatgttatgcctgtggcagcctggcaggtcacctcagaaacagagatatgtgaaagagaataaatgcaaatgagctgagcattttgacaagtcatgtgtggccctgccgaccgaccatgagaatttagataaaatttgctgctttttttgtatgtgatatcaagacgaggcaggcgtattctgctgaatattttttggtaaacgtagcatgagagtttagcatgtagactcgcaggaataagccgtctcagcgaagaacatttcatattgattcgtgcttttgggctctttcatactgattcttgtaactgagaaaaacatgcaagatgcaatgtaattttctcgagaacatattgtaggatgggtagcatactgatttgcactgtacagtgcatacgccaacacgaccagaaatgaccgatctacctagcagttagagattggatcgtgaggcatttgcaacaccagcaaactccttgcagattccaagtaaaactacatccagactatacacgtttttgtacaattgtcatccttttgtttgtggttctcccccctgatgtacaattgtgatcatctgggaccagatagctcaattggctctattatgaaggatgatgaatcatgaggatcctcatgccttactgagaaactgcaagatcctccatagggaggcacttctctattcaagtcgatgccgttctctggcagggtgacattagcttcaagggcattaaggacttccgacatcttgggacgcaaaatgggattggtctgagtgcattgcagaattacgtcaacagaacactccaactcggcgaaatcaaatgaatatttcagatccctgtcaaccagtttatccagtttattttcttccttgacttctctaacctgcagagaattaagattaggtggtaagaaagtatacaaggatatgggcatcaaatgacagtagttaggtaattagataaagattgaactaaaagaggatacccaatctaaaatcattcccttctgagattgcgcgtgcccattgctcaaggttttaggcccagtgatca

SEQ ID NO: 86140 - DNA, 3314 bp, Oryza sativa
aattcctgcagcccgatcttacacgtgacatgtgtgaaaatttctttttctagcatttttttccttcatgcacaaatctcgaaacgattaaatggtcacaaatctaaaagttttggaagaaaaaaaaacttgcgaaagttttctagcaaatcagccaaaagtagcacacatgcatatcctgatatatatactctttacaggatctacagatctttctgtcttatgtcgtctccctgctagtccctactaccgatcattcacaaccttccaaatatgttgcatgtgccgatgctctgctcccagctggtttaattcgatcgccatgggaagttttgagggaggatcggtcgtctaccatgcaaaggaggcatgagttactcgtttgttggtccatgcatatacaattatccattgctgctagccaacaagacgaagctatacgcccgtgatgaagggatggaccttaggattgaatggagggaggcttatcttctcttctttttcctccatcctcctctactcttcttttcccttcccttctccttctcaccatggagatggagatccaatgaggttgggggcagggcttgagccaatcatgttggatctgccccctacccagtagtatataggatcaatcgagctacaaagctaagggtttaattagttggcaaaaaaatttacctctgcatatcacatcggatatacggatatacggacatacatttaaagaattaaatgtagtttaataacaaaacaaattacattcctccaagaaaccgcgagacaaatttattaaacttaattaatccgtcattagcaatcattagcaaatgtttagtgtagcaccacattgtcaaatcatgacgcaattaggtttaaaagattcgtctcgcaattttccggcaaacggtgtaattagttttttttatatatttaatactctatatatgtatccaaacattcgatgcgacagcgtgaaaaattttgtttgtgaaataaacaggccctaaataggattgtagtgatggaccgatcgtatcaatcttcggcaaactccatccttataagtgcttatctccgctactttaaaaacaaactcgtactcctaattcctcatttctcacagcagtagttcataaccaccttcaaataccacccacccaaaattttgatacgaaaatcaaatcgaaaagccagataaaaaaactaaaacaccaaaattttgatccggataaaaactcctaaaccatataaatctcaatcccacttcaatagacaggggggcttgagccttatacatgtttccagaatctagtttaaattttgttaaatcatcgtttagattcaatactatcaattgagctctatcttaactaacgctagcctttaataattttctgactccgacactgctaggtcgtgaaagaagaagctagtgagattagtacgtgtgtgtctccctacccatcgccggccatcacagtaagggtccccatcgtttgtcttattttctaagagcatctccagcaatatgctttattttaaagcccctaaaagtcaaatgagggctgcccccatcttctaaggatccaaaaaaatacctccaactctagcaatagcccctatttcttagcccctactcatgtttctctttattttaacatgcaatccttctttacactatgtttaacaccacaataattaaacataaatatttctaacgcgtataattgaaccatagttaaatttacaatttcaaacgccacaattcaaatccaaaatcaaaattttcaaacatgtaaatatggtgtgggcagaatgccatatacaacaacatgcaaccaaaatttatagttcaccaatgaaaacgaaaattgctcaccaacatgtcattgtctgtctccatatcaccacaataggctatgtgaacctagtgatgcattattttttttgcggagatgcactatataatttaaaaataacacaccctactagaatgaatggttcgatcataaaaataacaaatctaaaagtagtacatatcctactagcaaatgacacttagataattgcagaaattaacacaaaaggactccaagaaccaatcgtggaaatgatatatcctactagcaaaggacacgtggatcatccaaaacgatccaacttattccatcgaagtgctcaaacttctccattaccgtcaccaaactcacctccaaagccactactaccatcaaatccaccattgagggcagccacctttgaagctgcaatttgtgtcctcatagccaacacatatgttctcacatctggttccaatgtggaaacatcacaaaacatgatcttctgttcttgatcccacactaaattatgctcagcaaataagagcttgcgctcttgaatctccttagtttccttccatctctcttctttcactttagcttctttctctttggcgtcaagcaaatctttcatcgcctccttttatggtccatcttctccattcttcatcttctcctttgcttgcttcctacccattggtctttttttagcacttggctgtaataaatcaggagttgtactcttcctagcatcatctccttcttcatcttcttcactagcactctcaattggggtggaagacttcctagaccttggcctcttgtgggattctagagtttgaaactttggagaattcctcaacttgagccaacaatgattaaactgaaatgccctattcttcgatgcattggatgagtacaatgcctcagcttcaagaacctgaagcaaaattcaagtgttagtttacatacatacaagattgttattaataataatgaataaacaatttaacttacaagctcttgatgtggtatgccacttggatgtcgacgctcaatttgctcgtagcagccctgaaacttgcttacttccttctgaatgttatcccaaagtgctcaagagagtttgcattcctatcagacttaaaatcacagttagcatggtagtgctctgcaatcctttgccaatatgccttccctggttgctcattgccaataataggatccgagctaatgctttgccatgaaatgcacagttgaatgtcctccttacgattaaagttgcttgatcttttggctcttccttttgcaccatttgttgaagtatgaaggtcttcattttgcattggcaaggaatatgcctcaacatgggtctcttcggacatcatgcacacaaaggaatcacattcatttgccatcacaatctagtcactgcaataagtagataaattgacaacttctccaatcaat

SEQ ID NO: 86141 - DNA, 4027 bp, Oryza sativa
tcagcgccatacgatttagcgttgaacaaaagggtcatttttgaaataagttttggccgcggttcatttgtaaaattagttttcggaaagggtcaaattgtcaaaatttgtgtgtttaagttgtatattgcaacattttgaaattctcatgcgggaacacttgatacttgccttgttggtgctggtgatttctatttgtttcttttgagggaagcaaacaaacaacattgtattgagactgctgagttcttacatgctaacagaaatacaagctaaaatttcaattgccttttcttttgcagttgaagcacttaagggaatagcacgcaagcttaacaagatggattgggacttcagtgtggatccatgcactgggtctaaaacttgggttaatgccagtgattccaatagttacccaaaatctagttatcctaattttccagtcagcaatctgacatgtgattgttcattcaagaacaacacagagtgtcatgttatcagcttgtaaggataatacctattattccacttcttttattgctctagagtggttcttatccagaatagttcaactgtttcagtgtctttcgttgttcactaaaatgttttttttattctttgttcatgcacatggcagggaacttatgcgtcagaatcttagtggagttctacctgaagaagttgtcaacctcacttatttgacaaatctgtaagtgcttccatccagctacttaaatttaagaacattcaccagcattcataaataaaagtctcactttccctgcagtgacttatcacgcaatttcatccaaggaccaattccagcatcatgggctagcctacctgtttttaatctgtatgttttgcatgatcctacatcatatcgtcagaatgcctgtaagtagtcatttgttcaactttctagtgcaattacaggtctctccagggaaatcgcatatctggaacagtacctaaggagcttggacgcatgcccttcttgaaatctatgtgagttgtggttgcacgatgattacaagcacctggagcttgctgggctgaaagtgtatactaaaatatggcaacatatcctatgcatagaagctcttacgtatacacacgtgcacaccaactaacaaatgtcaccaaaaaatataaaaaaaatcatacatgtactttcaatagtattacacataatggtaaaatcttaacctcaaattcattatattttagccgtaacaaaaaagaacatctgacagttttaaggttgtaattctgtcagaattttatcttttttgttactctctattggaagatgtgactttgcgcgtagatgtaatactattggaagtacatgtatgaatttttctagaattttttgtgataatttttagttggtgtacacggtgtgtacacgcgagggcctatgtccataggatatgctcccctaaaatattagaggaactaacttttgaacctcaaccatttgcatgcagaaatctagaaggcaatcagcttgagggtcatattccaccagaattcggtaacatcatcagtttggagagattgtaagttcctgtactgatacctttatataattatttacatcctcattgctaaggaggttcacttgtcttgcgttgttgtttaagacatatacttatgttgttaccgggaatggaaattcaaataaccagacttctttatttaaagttaaatttgcaacgactttgaaaactagcatgaatgtgataagtaaccatacctaattagcattaatacatcgttgctgttcaattgttcccattacagtttatatactgttaattagaataacacgatgccatgttttgaatgattttttttctccttcagatgctgataacttttatcaattaaagaaacatgaatatgccttgaaaacgaagtttctcattatttttccactaaggctgtctaaagtttcttgaattattactcattttcctcttacagtttcatttctgcaaatgacatcacaggagagttgccttcaaccttttccaggctcacaaatatgacagatttgtatgtcccacccttatttcaagaaaatcttttcttgactaggaagttctaatttttgttgtaatttggaacaatttcagccgaattgacgggaccaatatctcaggaagaatacccagtttcataaaaaattggcaacgggtcaacagaatgttagtttcactctgatgtagaacatttcacgagttgcagttgaaatggatgaaaatgacttttgttcaatgttctaatttcgtttaaatcttctctcttgatttttcagagacatgcagggtaccttgatgagtgggcctattcctccagaaatttctttgttgaacaacttaacagaactgtatgaatgtttcatacctatgctttattattttaccactgagtcacaactgatgtttttaacaatatatcttgtaaccattacataatcaggagagtgactgatttgagtggaccgagcatgaaatttcctcccttacaaaatgcacagcaccttacaaaagtgtaagtttatctttcagtgatttttactagcttacattagtacttccagcagagaacggcattgtagcccggtggtatgggagcttccaggtgctcttgctgggcagagttcgagtccctcctcagctctggttttctcaccatttcttctctcttaataattgatgctaagttccttcttagtatcccacattgagtgtccgttcaaaaacactagtacttccagcacaatatggaattctcaccatttcttgttcaaaaacactagtacttccagcacaatatgaaattctcaccatttcttctctcttaaaaattgatgctaagttccatcttagtatccttttgggtgtttgttcaaaaacattagtacttccagcacaatattaaattctcttatgttacagggtcctaagaaactgctccatatatggtgaaataccaccttaccttggacagatgcagtatctaatactcatgtaagtatccagccattattttgcttcaaccattaccttttagagtgaactttcttgttcatatggttatggtttttctgtttgcatcatcatgggtgagacgagaaaagtcagttgttagaattggaaatgtcatggtttattattctaatatgaaatatgggtgtcttttactgcatgcgttggacaagggtgtcttttaccattatctatttcacttgtttttgttgcactattagggggtaatagtattaaggggtaatcttggcataacctattgtctccttttacactgaatgctgataattacaaatacttgtttctctgacatgctaactcattctctactataggatgttgtataagttttactgttcattgaagctaacatatgtggccacacaaagccctggtgttttgctcaatgccatgattacaatctgtattaatttcagggatctaagcttcaacaagttgactggtcaaattccacaaaattttgacagaatggtggcactacaactacaatatttgtgagattaaatccttgagattttactttatgtgtcaacattttttgtttgattttggacaaaataaagtgtagaattctctccaacattggtggttttgtttattgcttttggaaggcgcctcatttcaattactataaataggtacttaagtgacaacatgctgactggagatttgcctggttggatgttgaaaaacaaggcaagcaacaaagtaaacatgtgcgtatgctataatgcaatactcttctgtgcacatacatatatgctctctactggtcactcttgtttactttttatagaatgaaaatcagttgtatatgtcactttctgttttggtgatatgttcttggataacaactgatgaatgcttgcagggatgtgtcgtttaataacttcacgggtaaccctccaaatgaatgtcaacaagcaaacgtgtatgctgctcatttg

SEQ ID NO: 86142 - DNA, 830 bp, Oryza sativa
ctataaaatttcaagagctgaagcacatccacctgcacgagctgccctctctgcaacgcatctgcgggcataggattgtggcccccaagctcgagaccatcaaaatccgaggctgctggagcctcacccgcctaccggctgttggtcttgacagtacccgcaagcccaagggggattgcgagaaggaatggtgggatggcctgcagtgggatgggttggagaacggacaccatccttccctctatgtgcccacccactcacgctactacaagaagaaactgcccagaggttccatgctcaggtatgtacatatgtctgtgtgcatacatgattgttacttgggtatcattccttgcgcgcacatacatacatacgtagaaacttatatagctcagtactttagttactccatcatatatatatatatatatatatgatcgagcttttcccttttttttttaattttgtctgacttggcgtgctttcttttcttcttaaattcaggtgatcgatatatacgtccatacactacatatttgatactgtaatcatctacgtatcattccctttccctcatccagtggctcatcaagttcttcagctctatctctattatatatgtccttatttggggctggtgttcaaagtgctcgctcatttcatcatatcatttgcaacggcaacaatatctaatgcatgatgagtaagtacatctccggccggcatccagacgctcgtcatctgcttgttactagcttggattctgttcatttctgcttcttttgttctgtgtgaaaattaataaatggacgctcaggggctgcaggaat

SEQ ID NO: 86143 - DNA, 1036 bp, Oryza sativa
gatgaaattgaatcctgaaaagtgcaccttcggagtaccgtcagggaagctgcttggttttatggtgtctcataggggcatccaagccaacccggagaaagttactgctatcctcaacatgaaaccgccaagcacccagaaagatgttcagaagctgactggatgcatggcggcgctcagccgattcgtttcaagacttggcgagcgggggatgcccttcttcaagctactgaagaaaacagataatttccaatggggacccgaagcacagaaggctttcgaagatttcaagcaactcctcaccaagccaccggtcttagcttcaccacacccgcaggagccgttgttgctgtatgtatcagccacctcccaggtcgtgagcacagtcttggttgtcgagcgtgaggaagaaggccatgtccagaaagttcagcgaccaatctacttcgtcagcgaggtcctgaccgactccaaaacgaggtaccctcaggttcagaagctgttatatggtattttaattactaccaggaagctgtctcattactttcaaggtcactcggtaacggtggtcacatcatttccactcggcgatgtactgcacaaccgcgaagcaaatgggcggattgctaagtgggctttggagttgatgtctttggacatatcattcaagccccgcacttcaatcaagtctcaagcgttagctgattttgtcgccgagtggaccgagtgccaagaggatacccccgtggagaaaatagagcactggaccatgcattttgacgggtcaaaaagactttcaggcactggagctggagtggttttaatttccccgactggagaaagactaagttatgtactttggatacatttttcggcgtctcacaacgtcgccgagtatgaggcgctccttcatgggctacggattgcgatttccctagggataaagcgtctaattgttcgaggtgattcacagctggttgttaaccaagttatgaaagagtggtcctgcattgacgacaacatgatggcatatcga

SEQ ID NO: 86144 - DNA, 1117 bp, Oryza sativa
cattattcccgaacctgtctagctgcaaaatcatcaagacaatcattctggatggttgttttgagttgacgcgaattgaccctcatgacctaccgccatcactcgagtcatttagcttctctagcagcagcaatgacaatgatgttgatgtcacagccaagatagagagcatctccttccgaggatgcacccagttgaagagtgtgcttttgagaggagtgtttgagaggctcaagcaactcgacgtctcaggcacttgtattaaaaccctcgacctacgttcaatgcgaggcaactggtctctcaaggagctcctactgcttggatgcaaggagcttcgtgcaatactatggccaaaacaagatgtatcattggaggttctgcacatcgacactagtagcactgaacttggtcatgctacaggtgtagttgaatcatcatcattctcacccgttgaatttaaatggtatatttcagtgagggacagaagactccttcgctcgctaaatgatacaaaatatcccttggatgcaccatgcatcgagatctcatcccctcctgctagtgttgctactgctactactgatagttctgaattaggcggaacaataagcaagagaaggcccattgccattagcagggctgaacaacgttggttgatgtcaaccaaaagccgacgaccaactgctgaccacaagaagttatatgcggatgtcgactccacgatccagcacttgcaactacaagcaaccatgaacggcaactggatgtggccatgtaaatcggagggcagcacctctcactacattagcttacaagatgataagaggatgcagacgaaaccattgtcgtcgccatctttgccaggttccatctgtgaaagagcttcaggcctgcacgtgcatgacagcttgtctgtcgcaagtatcacaagccattcaaatgaggcacggagatggtataacctagagtggtgcagagtggagagatgccctaacattgaaggcgttgtattcactccacctagtactggtagtaacagcattttctggtacctaaagacattctgggcatcccaactagcaagggcgcgccacatctgggactggagcacaac

SEQ ID NO: 86145 - DNA, 2680 bp, Oryza sativa
ttggctttttcaaacataagcttgactgtcctgggtggcttacgcccgaacttgccgaccaattcttcgtggcgaatccctttggtgaatgcggcgatgataacgtcgtcggtgatatcggagatcttgttacgttgttcagaaaatcgccggatgtaatctcgaagggattctccggacttctgaataacgttgtagaggtcgtattgtgtgccgggacgctcgaaggtgccttggaagttggcgatgaagtggtcgcgtaattcagcccaagatccaattgtaccacggggcaatccatggagccaagatcgggcggaatccgctaaagccactggtaaatagttcgccatggccttgctgtctcctcctgctgcgcggattgcgagaccgtagacggtaagccacgattctgggttagtggtaccgtcgtacttctctattccagtcggcttgaagccggctggccaatccactcgacgcaggtcgtcggtgaaggctgctactccgtcaaggtcgtcgtcgtggcggtccggcgagtgatgatagcctcgagctgcattggctcgctccacctgtccattgctcatggggtgtgccactgaggcatagcaaatcttaattccaaagtcctcacaaaagtctttaaaaactccgccagtgaattgtgtgccattatccgtgatgatccgattgggcactccaaatctatgtacaatgttgatgaagaagtctcgagcgttatctgctgttattgtggcaaccggtttagcttcaatccacttggaaaatttatcaatggccacaaagagatgcgtgtaaccgccgactgcctttttaaacgggccaaccatgtcgagcccccaaaccgcaaacggccaagacagcgggatggtctgcaactcttgagctggtagatgaatttgtctggcgaaaaattggcaaccttcgcatgtgcgcacaatcttgtcggcgtcggacactgcagtaggccagaaaaaacctgccggtaagctttgccgacaatggtgcgtgcagcagcatggtttccgcatatcccggaatgtatgtcgttcagcaattgtctcccttcctctaaagatacgcagcgttgcagaattcctgaagggcttttcttgtataactcagcttcatgcataacataaagtttgctccgccttgaaatccgctcggcttcatctttgtcttgggggagttcttgagaagtcaaaaatcgtatgaggggctctcgccagtcggcttcaaccatagctacgtcatgagtgcccgcgacttgagtagtatctttgggaggtactgtcggcgtgtaaaggtgttcgacgaaaacatcagagggcaccacctcgcgcttggatccaaagttggcaagtctgtcagcggcttcattgttgtgtcgaagaacatgactgagctcgagtccatcgaacttgtcttctaatttgcgtacctcctgtcgatatgccatcatgttgtcgtcaaggcaggaccactctttcataacttggttgacaaccaactgtgaatcgcctcgaactattagacgctttatccctagggaaattgcaatccggagcccatgaaggagggcctcatactcggcgacgttgtgggacgccgaaaaatgtatccaaagtacatagcttaatctttctccagttggtgaaattagaaccactcctgctccagtgcccgaaagtctttttgacccgtcaaaatgcatggtccagtgctccatcttctccgcgggggtatcctcctggcactcggtccattcggcgacaaaatcagctaacgcttgggacttgattgaaattcggggcttgaatgatatgtccaaagacatcaactccaaagcccactttgcaatccgtccgtttgcttcgcggttgtgcagtatatcaccgagtggaaatgatgtgaccaccgttaccgagtgaccttgaaagtagtgagatagcttcctggtagtgattaaaataccatataacagcttctgaacctgagggtacctcattttggagtcggctaggacctcgctgacaaagtagatcggtcgctgaactttctggacatggccttcttcctcacgctcgacaaccaagactgtgctcacgacctgggaggtggctgatacatacagcaacaacggctcctgcgggtgtggtgaagctaagaccggtggcttggtgaggagttgcttgaaatcttcgaaagccttctgtgcttcgggtccccattggaaattatctgttttcttcagtagcttgaagaagggcatcccccgctcgccaagtcttgaaacgaatcggctgagcgccgccatgcatccagtcagcttctgaacatctttctgggtgcttggcggtttcatgttgaggatagcagtaactttctccgggttggcttggatgcccctatgagacaccataaaaccaagcagcttccctgacggtactccgaaggtgcacttttcaggattcaatttcatcctgaaagcacggatgcttgcaaaggtttcttctagatccgagatcaaatcatccttttgcttggtcttgacgactacatcatccacataggcttcaacgttgcggccgatctgcgttgagaagcatctttggatcatacgttgataagttgctcctgcgttttttaatcc

SEQ ID NO: 86146 - DNA, 4582 bp, Oryza sativa
gttcatcaaccttccttgccacttcctcttgcatgttgagttcgtagctcgatacccggaactctaggtctgcaatcttcgccttggtatctctcttgctcctcatccgactcctgtacgtgtggatgtcctccttgaaaccaatcttccaaggaatcacccctttccctcgtgttcgtcctggatgctctggagtctgcagggcgagtgtcagctcgtccctatctctgtcgggtcggaacgtgccctgagaggaggcttccactgcatctgttagtcgtcgcgcagcctctcgtatctgaacgccgaagaccagtgagccatcagctgggttgagcgttccaccgtgagcatagtaccagaacttcgatcgttccggccaattggctgttgccggttcgatacccctctcaatcaagctagcctccatctcctcccacttcggcatcgcgacgctatagcctcctgaccccaagtggtgatgatacttcttcttgttggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaatcactgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaagtaatcttatattaaaactcaaataatattacatgctaagactaaaatagtcatgtatgctaagtgtttcgtgcgtatatgctaagtctaattaagactacaatagtcaattgttacttgtcgcaccacttccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctacttgtcgcaccacttccgtagtcaataattacatactaagtctaattacaaataaagtaatcttatattaaaacacaaataatattagaacactacacaatcttatatgataagtctaattacaggtctaataatcttaattaattgcattacaaatataacaatcatttatattactacgtcacttgcctgctccaattccttctagggctagctcttccactcaggcttgacggacgactccgacaacacgtcttttctgcaagatacaaaaagatgtattaggataaatgcgaagtaacatatacatacatacatatatatatatatgtatatatatatatatatgtatatatatatatacatgtatacatatatacatatatatatatatatatatacatgtatacatatatatatatacatatatatatatatatattgcatttcacgttaacgttcgtcctcgttcgttcgctcgttctcgttcacgttcgttcgcttgttctcattcacgttcgttccctcgttctcacttgtcttcgttcgatcgttctcgttctcgctctcgttcgttcgatcgttctcgttctccgttcacgttctcgcggcaacgtacgttgacgtgtccgttctcgctctcgttcgttcgatcgttctcgttctcgttcgttaacggcggtgtggcggcatcggggcggcggttggcgcggcggcgtggcgacggcggcggcagcgtggcgttgcggggccgtggcggcggcggcgtggcgtggcggcggcggcttggcgtggcggcgacggcgtggcgtggcgacggcggcttggcgcggcgtcggcgtggcgcgtcgtcgtcgtggcgtgtcgtctcgtggcgggcggcgcgacggagagagatcgagacggagagatcgagataaagggagatctggcggcggcggctctcaccctagagatgcggcggcagcggaggaggcggaggcggcggcgaggacgacgagctcgagacgacggcgagatacggcggcgtcgacgcggggatttgccctaggaagtggcggcgaaggagagaggccgagagagatcgatcggccgaaaacgtctaagtgttggtgaagaagacgagggcgcaccgggaatatatatacccccggatctttactcccggttgttctcaacaaccgggagtaaatatcttttcccgctatttcaaaattctttttaaacccggttagggttaagaaccgggactaaagattacagcactgcatatgattttcgcttacatatgtgtttataaaatagaagttaatgcattaacattatttaaagtacaaagattaatgacaattacttcgaaaaattatttttggctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgattttaaccttttaaaaattcgaatagtcatatataagtagcatatgaaagatagtaaattaaattatgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcattacatcggcggtggcggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcccacttaccgatgttcctggcgcgaactagagccaagt

SEQ ID NO: 86147 - DNA, 15213 bp, Oryza sativa
tgcggcagcgaaggtgggggtggcggcttcgccgggatctgccatccgcctcctctcctccctctccgccgccgcctcccttcccatacccctcctccgccacctcatccccacgtatgacggtggctgcctcctcctcctccctcagcaccatgaccactactagatagtggcatcaagatggtacacctattctacaaaagacagtgacacgtgtgccccgtgtactaactcgtccagtcaacagggtcaaagacgccacgtcatatgaaactgcctcccaaaccgcccaaggagtcgattgcaaactgttttgttagttggaggactgagttatacccggttttgaggttgagggatgcgattcaaacaggggcatgagttgagggaagaaaagtagacttattcaaacgggccttagtactctagtcaagtaccgcgccatgctcgatccaaacttgaggtaaagcccaaattggatcgtagccatgggttgggctcagaattttatgggccgaatctgagtcgtaccaacccgaatttttaggtgagagatgccactgaataggcccccggttttttacgctttcctcagaaagcaaaatccgcattcgactgagggttacgtaaacaaagtcccattgggggatccgccatctcaggtgaggaggcgggtagtttcctagatcaatcagcttgctcggtagtttcccagatcagatcctggtacctgcacaggcactgcaccattcctgacgttgctgctagctcttcctcattcagtgaccactttattagcagtaattcaacttactgtttcagcagatgagcaacacagtgccaggacaaaatgattactgcattttgatgtacatctacaggcaaaatcacaaatgggagagcacctgcaaaggtgtgtaaagttttgacgtgtcatcgggtattatatagggtgttcagacacttataaaaaactaattacaaaatccgtcagtaaaccgtgagacagatttattaagcctaattaatccatcattagcaaatatttactgcagcactacattgtcaaattatggagcaattagacttaaaagattcgtctcacaaattaatcgcaattgtattttttagcctttttttaatactttatacaaatgtttaaatattcaatgtgactgggtgaaaaaaaatttagggtgggatctaaacagggcctaaaaaacaaaaggccgacttaaaaccagtttagatgacagggtgagctgcactgttgcagccagcaatggtcatggtcccagtgccaggcaaagttaaataatgaacagcccatgttcttcaggcacaggctgggcacaacccatgttcctgaattgatgcactcagtacatggcaccagcaatgcaacctttttacagtaccgaaggaaccaaaccagcataacatttctgcggctcaagtgttgattgtgaccatgaattaccctcaaaagaactatagtacattacgaccagtaaatagataaagcattcgtgtattaacactcatggatcagcagcaatgggagaactatcagtaatgtggcccagaggagaattatcatgccatagattgcaataaataataaccaaaaaccatcaatcaaacgatcaaagaaccagatcacttatcttggagatgaatgtacaagataaatgataacatgactcgcacaagtacgattacaatagacgatcctaggtagtgggtacatctcccatttttcttttggtcctaccactaaccacaaacttagcatgacaaaagttggaccatgcatgccatgtataatacagcagccaccggacaaatgcataccaagagttcagaaggtgcataatattcagccatgaaacaaatccaacaacattctgataggacaccaacaatcccaaacagagtagcttacatgacaagggcttgtgaaaactgaaaagaaactgccttgtagataagcgattaaaaagccagagcttagaagcacttccggtgaacaattgctggacccgactcatcatactctccctttgagatccacatctgtagcatagatgccaaaagaatgatgttaacagaaagcagaaatacctgcattcttgctacctcataaagtgtaggcgtaaggtttacctgttggaaggtgctaagggaggcaaggatggaccctcctatccagacactgtatttcctctcaggcggtgccaccaccttgatcttcatgctgcttggtgcgagggcagtgatctccttgctcatacggtcagcaataccagggaacatggttgatccaccactgagaacaatgttaccatacaagtccttcctgatatccacatcacacttcatgatggaattgtaagtggtctcatggattccaggagcttccataccgatgaaagagggctggaagaggacctcagggcatcggaacctctctgccccaatggtgatcacctgtccatcaggcagctcatagctcttctccacagatgagctgctctttgcagcctccagctcctgctcatagtcaagggccacatatgcaagcttctccttgatgtcccttacaatttcccgttcagcagtggtagtgaaggagtaacctctctcagtaagaatcttcatcaagctgtcagtgaggtcacgcccagcaaggtccagacgcaggatggcatgaggaagggcatatccttcatagattggcacggtgtggctgacaccatcaccagagtccaacacgatacctgcatcaagagcaacagttcatgaataaagtgaatattttttaaaactctcaaccatgtgagtgagttattaccagttgtacgtccactggcatacagggagagcacggcctggatggcgacatacatagctggcacattgaaagtctcaaacatgatctgggtcatcttctccctgttagccttggggttgagcggggcctcagtcagcaacacagggtgctcctcgggcgcgacacggagctcgttgtagaaggtgtgatgccagatcttctccatgtcatcccagttgctaacaataccatgctcgatcgggtacttcaaggtgaggatacctctcttggactgcgcctcatcaccaacataggcatccttctgccccataccaaccatcacaccggtgtgacgggggcgccccacgatactagggaaaacagccctgggcgcatcgtccccagcaaacccagcctgccagcaattcgcaagaaaagtaaagtatacgattaaatcacataaacatggggataactgctacaaagaaatactacgaatgagcaccacgaaccttgaccatgccagttccattgtcacacacaaggggctggatgtcctcgccgtcagccatttcctcctactggttctgaattcctgacgcaaaaacagaacaacaggcatgcgccgcaacacgtcacgaaatggccattttccaacagaaactagacgcaaaccctccaggaaatcaaaatctcaaaagatcaactgctaatatttggcacatcaaaacttgcagcgaacagaaaacaaaacagaatatgcaaaactacatatcgatagtccgacacaccgagatctagaacttgtagagcaaaaagagtacgcgataatcaaccgcgcacaaagaatcaagcactaaaccgtgatgcaaggcaaactcaggtggcggatctagacgtggagcatgtgattcagttccaccccccacaaacattttttgcgcgcggggaaaaaaacacaaacaaacaaactgctaccagcatcaaggtttaataaggcgaatgaagcgaaaagtatccagatctagaacagtgaacagaagctacgagtacgtgcgtgcgtgcgtggggagggagagatgaggaagaggacacgcagatggatgctcaccggggatgcggccggaggagggaggacggtggcggcggcgcggcgggacggggagatcggcggcggaggcggtggcggcggtgaactccgagtcgcgaggaggcgagagtggagtcgacgcggagtcgagggggggagggggaggggtagataagagaagagaggggggttcctcgactagggccacacaatcattttttggacacaattaagcgcgctctgatttttcttttttcacttcttgggtacggttacgctctgaatctgagaactgagaagttggcgcctgtctgtcccaaaacaaaaataggaccctctatggctctatgggtttgtctatactgaatcccgcttccaaaatttaaagtttaaggtttgctttcaggttctttttcatctaagtttatcttttacattcaattttaaatcgctaagaatacatacataaaaaatttacctataaattattttttctctaatacgttgtacggcatttggcaaaaaaaagaaaaaaaaaaggaggagcctacgagttctcctaacacgatctctcatcaacttcggttatgtcgagctgaaaaacaaactagatggtagtatttcttttcacagtccagcatggattgaaataggagcacctatgaaaattttcatacaagcatgatgaagaagacgtcatctttatccacatatttggtcaatgaccattttcacgagcgtaggcaggtagtagagtgctcgtcaagggtgctagtgcatacctcaaggtgattataaccggttcatcacctataatatctcgacatggtagagcatgtaacttatttgctatacaagtaaaccacttaaaatgtactaatataacttagttttataatgcaaacaaaaatttattctttacaagaacacaatttaaaattaaaaatgtgtctctatattcttcctttgtgccttattttacttgttttttctcactcctcttccataattatattgttagcctagttgacagctaggtcgtatgccagtgttttgtaatatatatgatcggttctttttacatgagttagtagtaatattgtacttgtacatatagtctacatgcatccatccatatgcttttttaaaaataatctgagagatttttttaaatataatccagtatgatttgaggtaacgatatatgtgtaatttacacctttttatatttaagaaaagaaaaaccatgttaggcctcgtttggatcacattaattttcttcaatttcgtgcatgaattgattttcttcataatgctgataaatttgtttccaaacaaatcttggtaatcaatgctttttcaaaaggatatattatccttccatttgaacatttcttcatagaaaaagaaaaccatggtgtccgggctcttaactaattatcgcgttaacggtgcacatacattaacacacacgggcaatacggattaaaggtgcgattagtgcgctaatcaagtgggatcagcacaattaacctaagctaggcatggcagcaacacagccaggaacagctgttgcctgcgctgtcgtctgcctgactgatgatatgatccgatgggatcttgattttggggaaggatggaagaatttcaggctattttagtacacccccatgtgtgcctgaaaagctgcttgctgttcttgcgctgtttgatcaactcgctttattaattttgttcctcccccccagctgtgttgatcatgaccacatgtgggcaacccctggaaagaaaagcaagtaaagcttaattgggttggaatcataatcagttcatcaatcagagaactcaatgtattgtagttttgcttgctagatcatggcgacagagaaaaacattccatagtgaaattctaaaattttgggtgttttttttctaataatacgtgctaagtgttacgtaaaaagagattggtcatctggcaaacctatggctgcggctgctgcagtccactccttgcctcactgttggtgctggctgcactgccgtagtctcaagcaactaaacaactctaaacatttcacaaaacctttgcatctatagaaattcttattatttcgggttgtcttcaccaacaccgccttgaacttatgtgtgtttaataatataaaattaaccgtaaagttttttcttttattgtctaatttctagacaatattcaaccaaatgttagaagacatgcaatttgatgaaaaaggatgggtttctgtgtgatattatggctaaaatatgaggccccggttattccgcaatcgattttgctatacatcactcgggtgattctttacctgatatttgacgttttttctggccgctactatctccagggttggggtgggggcccatacggccaggataaagcattgcatgcagcaactccagtgggatcattagacgtgcgatttttttttctctcatttgttgttttttcgcgctgctctctatccttctctctcatttgaaactaaaataaaaataaaatacaaaattacagtcctatataactaaaattacatttgtaaattcagttgatacgatatgtaagtgcgctgtaattttgataacaatgatgtgtcagtaaatatgtatttgttattttctttaaaatataaaattacagtcctatataactaaaattacatttgtaaattcagttgatatgagatgtaagtgcactgtaattttgataaaaatattgcgtaagtatatatatatatatatgtgtgtgtgtgtgtatatatgtatgtatgtatgtatgtatgtatgtatgtatgtatgtatgtatgtatgtatatatatatatatatatatatatatatatatatatatatatatatatatatatatatatatatatatatatatatatatatatgtgtgtgtgtgtgtgtgtgtgtgtgtgtgtatatatatatatataaaattttcttttgtagtccgttggatgtaaatctaagggtagaaaaatctggatgatttcttgttaaaaatcacccgacaaatggatagacagtcccccaagtagacgtctacttattcattacatgtctcatccatagagctatgaaaaaaatttaattagaagttgacaagatatattaatttataacataatatatatatatatatatatatatatatatatatatatatatatatatatatatatatatatatatatatatatatataaacatgtaatttcaaattttgcttgtacaaattataacaaaagtaacattttttttaattcctctatgatttcggctagacgtgcattctgcatatagtccctcaccacagcacgagtagtcgtctcgtgtgtatgatgtatctgggtgtgccttcattgtggcacaacaaaagtaacaattttaatttacctgtcaatattcgtatactaattactccctccgtttcaggttataaaatgttttgattttgatcaaagttaaactgttttaagtttgatcaagtttatagaaaaaatagtaatattataaatttattataaaattatatttaattattaatttaataaaactaattttggtaatgtaaatattactatatttgtttataaacttagtcaaatttgaagcagttcaactttgaccaaagtcaaaacattttataacgtggaacggagggagtataacttatggacaatgaatttgaacttgcatgcttatatattgatatattttatcattgtttttaatttttttttattgatatgcaatagacaagtagatgtccatctagttgattagaagagtttgcttgataaggagtaactatatgatattcaatcaggggcggagctagaacaaaataaaggggttccactcgcttgttttagtctggtttgaatcaaatttagcttgatacgggtgcctaagtttaaactaacggggtatatatatagtgaaaatagataaattgtagctaaatttttttttgaatcaggttactgggcacccccctagctatacatagctccgccctgtattcgatagttgttttttatgaaaactactccctccatctacttttaatagtcatatttcaccttgacacacagaccaagaataagtaattctacttatcatccatttaaacatgctactagttattcctcgtaaacaagcgattcattaatatttacatttctcaatacccatgtaaccaatcatgtgtggtagaatggagagtcacgcattaaattcgagaaagtcattaagatgatgggtcgttggattgaaatatgactatcaaaaataaaattttcagatttggaaatatgactatcaaaagtagatggagggagtattatataaaaaaaatatctatagtataattagtttcatgctggacttgcaaacgtcgtgagcctccaactgaggttgggagtgctaattttttttttctctcttcgcatgattggcatgaatctctaagcaatttaacggtcacaaatccaattctccacatgtgtgctactgagtattttttgggagtagctatatttatggcgccatatttttcacgaaaaaatagtcggcatgtatttacattgtaacttcctaaattacatatgtaattttagtgtatttacaatataagtctcaaaattacatatgtaagtcttaaaattacatatgtaaatcctaaatttacgtactaattacatatgtaaatggtatgtaagtagggtgtaactactatataaatcagtataaatgtaattattaattttacgacggaggtgaagtgctaatgaggttggagcttgattaggtgcagttggttcattcgcataagctgtacgatgggtgcaggtgcttgaaacgaatctcatcggcggatcttacggttaaaacatccgactgtaaattgccctaaaatatgtcgacacaaatttagcaaaaccttatttttttttctctgcataaatctcaatacaatttaacaaaacttagatgtgtacgtagagaaattacaatgcaactatgatataattgcaatgtatcgaagatgtaattacaatataactatatatatatattataatttttttctggaactacattattaattataatgtaattagtctaatcaccttgtagtaccatattttaatagcacattctctgaaatatagtaaactctcgcagaacacatgcatgtaaaatccaaaatatggttgtcacgataaaacaagaaacccagcgtcctagcccatgatatttttttttgacacgaacccatgatatattgacacacattgaactgttttgtcttgaaaaaactgtcgccacaaatcagcaaatcccttgtttttttactactattccgttttggtttgagttacgtgtcgccgaacgaacttttttcgtttttagattttttttaatatttacagaaataatctatcggcgaacaaaattgcaaaaatagaccctgccgcccaccattggggcggcaagctggcgtggcagacggtgggtcgaccgcgccgtctgccgccgtcggccaaaattacgattaggcccttgccgcctatacagagggcggcaagggacccagatgtaaaaagtacggccaaaagatttttctatgcaatgttaataataaataaagaagtatttgttggtaaaacttgttaatattgttataaaaatgtattgaagttggttgttgcgcaatttcatatgttaagtgaggtattattttgtaccttattcgacgtattagtactcggataattaatataggcctatcgcagtctcggtcgtagaaacattatatggacttaaacaaggagaattatgtaacatgaagaaatagtagtacaatttgaacatgatacaactatttccattgcggttacatagatgatattagatttgaactaggagggaggtagtgcaatagttgaacacaacgacgatatagtaatgggacaaggaagcatgacagcagaaatttcaatatgccaagttgtccgataatagctaacccctacgtgaggatccctctcctctctcaaaccgcgctttagtaaccctgtattgctctggtagttcaagctgcacaacacggctaggtagagttagaacccttctggtgtctatccattctctgtattgacatctcattggtggttcctaggaggaaataatagatgtaaagcgagctaagttagtaaatgttgtgagaaaataaggattcatgtaatcaaaatattcttaccatgaaatcgtcgtccagaatatttggacaaacaaagaaccttcgacccaatgttgtaggatttatggaacgaagaacctgacaacgatcaccacacctgcatcttggacgggcttcccatggagggagtgccgtagttagcacccgccagtcgctctgttgttcacgacattgtcgttcataagccgcttttctctgtaagtattgctcagtactttcggatgcgaaataccagcgactttcttgtaaacaagtggttaggtcgaggacgggattttctgtatcgacccactcgatgtatgcgcaagccgtagtgcgggtctgccgaatagagtagtgttacgaagaataaagcgattgcctatacggaataaatgagcatatgcagataataaaataccccacggtcatagttagggcacctaaaaaagcgccttcctcgaatatcaggattcctcgaagccattagttggcatcgatcaccgcataggcagagaggacgctggcaccaaggtggtagtaggtatacacaaggatcgctgcgccagtttggatcctcaacaccccggcgtctaaccattgacgaaagccggtaggatttgtaatgaagaagtggggaagagagtactgaatgtgattgagttctgaaagattgtgaggcctcactcgttaaggcgacttatataggcgcaattcatcgagtgatatccttgacatgtgaacgtggtggggcatggtgggtacgcctgattggcgccgaaagttgcatgcttgatcggcgccgaaagttacattggtcgtatgcggcaaatggcgggcaaatactcgtatcgcacgcgaataaaggaggctgcatcggtgcggcagaaagtagtcgtgcatgcgccgaaaggtatcgtgcatgcgccgaaagatatcgtgcacatataacaacaacgtagtcattacacaagcatacaatactgaaaagtgaagcaagtaaacaaagagaagactgctctactgcccctgccccgcgccgcgaccacgcttggtcctccgggcctgtgctcgcacgtggtcctgggagtaggtgaaacgatccggtggcacagcacgggtagcacgagtgtctggcggaggagtggcctgcgcctggtcctgcgtctgcaccggcggtgcgcctcccagctgtgaggggccgatgacgtcctctgccgagcctgaagcgaagtcgaagtcagtgatgtcgaagagcacggtggaagacagcaagcagtccgacgaggtcccagcatggtccagtggtggaccctgactcgacgtgccggctgcctgtgacgaagtcccggtgtactgctggaactgcgctgagtgcgaggtcgacgcagctgcctgagacgctgaccctgcagcctgggagaagtgggcggcctgcgtcatagcgaactgggcgaaacctacacatcgacaacgggaccttgtaagctaggacataaaatgcatgtaaattgattgtcgaagtaatgttgtttttttaagtacttgtggggggcacaccagaaggcctagccgaggaaggcggggtgctgaacggtgcacgaaaccctgaatcaatcggcaagtgaaacggctcacatatatgtgcgagacatgtacagaaaaatccttaaaaatacttacctctgtgcggagggggagtcggcctaggaacgtgcgcagctggacggggaccagtcggtacgggtggccgctgtacagctgtgtctgcccgagcaacgtcgtctgcacgacaggtgagcactcggagaatcgactccaccatccgcgtgtacgtcgtccggtgttcctctacgggtaccggaatccccgcgtctaaacgttggctcgtcgttgaaccgtcaacgacgacccggttgatgtcgtccacctgcatggttattttgttcatacatattcgtaaaatttgacgatgagaaagacatgaaaacataaaggaatggtgcgatgcatgggtactcacacaacgagcgaagtcctggtcgcggtgcctggcgtagaggtctctagtgctcgcaatgtggggctgttgctccaagggagcgaaggtgaccctagtacgggtgcgtggctggtaccagcgtaggtaggcctagtacgcctcctcagtgtgtggctctccctcgtggtccacgacctccttggttgcgagcaaccagttctcaacaaaagtcgccaacttggcgggccagtcgccagctgactgctgacccttgcgcgagtgcctgcgaattaatgtactagtgcgaaacgtgccgtcagatcgtcctgccagtccacagccgtggtcactggcccaacagtgtctcccgcgagcggtagccccaacaagtacgatacgtcctgtagggtaggggctacctcaccgcatagcaagtgaaaagtgtgcgtctctggcctccatcggtcaaccaaagctgctaggagggacttgtccacagtccatcgtctggccgggtccacgtggccggcggcagcctccaccagccgacacatcggtaggaggccggcctcacgcagcctgcaataagaaattaatatgtcattataaaaaatattacagcgcaactaatttatagtaatacactgttcgtacctctcgacaaaggagtcgtgaaccgtgagtagctcaccgcacgtccgtgcccggaacgtcccaagctgagccccctgcaccgcagtaaggtgagaccggtgtcgctgatctatcgccgggtccaacagctgaggtgtatcctgacgtgccatctctgaaaaatatagtgtttcgtgttagaacaattcaaaaagtagtaatgtaaaacaaaagatgactcgcaaaattatgaaatagtaataaaatcatgagaataattatgtacaacaacagtacaggctatttaaataaagcaaacgttactaatggtacataacgatgacatgcaatttaacatatatgtagagttcgataatataacataacataacataacataacattacgtgtcgaagtccgacatacatcagcatacctaaagacactaggtgccttagtctgacgttacatcacgagacctaaagaaatgacatgccgaagtctgacattacacgacgaaacataaacacatcgataagttcgaaataaattacaagcaaacccacatgccaacatagaacataagaactacaccacgtagccagacgtggcacgacgacacctaggacgtggtcgagtggaggtagtgccttcacccgtagggcgagctccatctgctgctcatcctgatagtcctgcctccgccgcacttggtttctccttgtctttaggacaatgcttgtaggtgtgcccacgttcatcgcatttgctgcaatgcttcaccctgccagcctccgactcgtccatatcgttgcagatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttactaaagtactgtgacacatatactgcatctggtatgccacactccgctgcggcagcaatgacatgggtgcatggcctgtggagcagcttcggctttgaacaagagcaatgacatgtgccgtcggctttcagaacacactcctgcttcactctcttgcggtagatacccctgcctgccttatcttgacataatatctcaaacctgtgttgttgggtaccttgcactagagctcgatgtttcatggcctttttacgcaactcctctagctttttctgcatgaaagttccaaacaaaatgctgttgttcggcatagagggaagaactgcctggaaccgatccctaagatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttccgaatctccaatccagttcttctaaccaaagttggactatccgttgggagacgtccaagagattgaggagggtcatcaacggcggtagatggagccgctgcacgctgatcactgcatttggctgtcaactcatctaatctcttccaaagctcattgaattttttctcctggttctgattgcacagcctcttgaacatgttcatgagctccttgttcttgaattgcttgaagaaattagctcccatatgacacatgcaccacctactttgtacatcgtcccaaacaccagggtatcctggttccatgctcccaaactgcaactcttctatcactcgcagaatgccagcgtgcctatcatgtatcaggcacacatttggcctcataccaacaacttttgttttaaccaaatttcaggaaccagtaccagctgtcggtattctcactctcaacaaaagcaaatgccaagggcaatacctgattgttcccatctacccctattgctgtcaatatctggccccgatactttcctgtcaagaatgtcccatcaatgcagagaactggacgacagttcacgaatgccatcttgcatgcatgtagagctaagaacgccctttgcagcacactcttgccaggatgttcaattgatgggaatttcttcacttcgtaagagctcccagggtttcttccctcgataacaccaagcaggcgtggcaaattgtcatacgaggcttcgtatgttccaaatctcatctctattattttatgtttggccctccaggccttggcatagctaatagtatacttgtatgtctcctcgatgtgtcggattattgaccttggttcatatgtgagattatcgatgacatgcg

SEQ ID NO: 86148 - DNA, 4289 bp, Oryza sativa
gaacaccacgccgccgccgtcgccgcgcgtcgtcaagaccgagccgggctgctgctccgtctccgaagcctccacgacgacgacggccgacgccgccgacgtctcgtccacagggtcttccccatccccgacctcatcgaatcaggccgccaccgccacgccgccggcgccgcggccgccgccgccgttgccggagacgattcagcagctggacttcacggaggcgccatgggacgaggccgacggcttcgcgctgcgccggtatccgtcgtgggagatcgactgggacgccatcctctcctgattaatttcctgacggcttcatgcatgacgtcagcatctgtgttgttgtattagtttttgttcccgagtgtattggcctttgcagctactagctttgatctatcatcagtgtctcctggcctctgctgagtttgttttttggtagatggcattgtccaggaggagatagactgaagattactcaggctgaattgatttgtgtgcatgtgtgtggtcagtttgtggctgttgctctcatgaacaaatgctatgtgcaatatgccaaagacatagatactgctgctactcttgtgtgatacatgttgttgtttgtggcatgtgtgtaattagaaatgcagtgattgatgcatctgcataccttgaattgacacattggatggaaaggaatggctgttggtttgtgtttgtgttcctggtcagagaaccctttaatttgatatcaaattttattgggaccagttttatctcaacatgcatgactaagggtgtatttagttcataaaaacaaaattttttggtgtcacatcagacatttgaccggatgtcggttggggttttcggacatgaatgaaaaaactaatttcataactcgcctagaaaccgcgagacgaatttattaagcctgattaatctgtcattagcacatgtggtttactgtagcacttatagttaattatggactaattaggctaaaaaaattcgtctcgcgatttccatgcaaattgtgcaattagtttttttatctatatttaatgttccatgcatgtgtccaaagattcgatgtgacgtttttgggaaaatttgttgggaactaaagaaagcctaaggctgtgtttagatctaggggtgtaaagttttggcgtgtcacattggatatccgacacacatttgaagtattaaacatagtccaataacaaaatattacataatccgcctgtaaaccgggagacgaatttattaagcctaattaatccgtcattagcaaatatttactgtagcaccacattgtcaaatcatggtgcaattaggcttaaaagattcgtctcgcaatttacgcacaatctgtgtaattagtttttttatttatatttaatactccatggatgtgtccaaacatttgatgtgatagggtgtaaaattttgctaggtgatctaaacagaccctaattaatttagaaccttatcagtcacaaaaagaaccataaaattggcattcaattaaaatgcaatgaaaaatatgtgcggtaatgtttcttgagcaaatgctccttccatattaaatttgaagttacatatctctactttatatagagacttttaaaaaacaacagaattttacttataaagtcagtaaaactcattagaacgggattggttatctctaacggacctaaagcctcatctctttcagacagagcctccgtcactaagcaaagattactgatgtgagaaaatatcttaattgggcatccggccatcacgaatgacaaacatctcaatcaggccaacactatagccccatcacggatgactctcatatctaacgggccaacactatagctcgtcacggataactctcatctctaacgggccaacattatagcccgtcatgaatgactctcatttctaacgcgcctaaactatagcccatcacggatgactgtcatctcaattgggtctaaattatagcatgtcaaggatgagtataatccaaaaaaaaatattttttggctagcctcaggcctttgggggccacgcccttgggccggtcttttctgcgcactttgtcctcacttgtgtgaacccggtcggtcaccatcccgaaattgctccacccgggaagaatttcctggtcggttctccaccctaatctcgcttaacctcagagttctttggagatcagcttccaaagaagaagttgtacattcattcacatacacaaccattaatatatttaacataaccacattcacataacatccatttttttgaaatgacacgtaacattcattttgatcacatatttcacatccattcacatatttcaccagcaaaaccaagttaattggatcaaatatgtaagtattaacatgatgaggaggcaaatcaaatttctaggaaaaaaaaattttgaattgaattttatgatactaaatgaactcatatgaaaaagttgtcaaagacaaagttgtagaactcattgagatctaccaattttattttggtcatttctccattcgggtttgattgaactatataaaatttaaattttaaaatataagaaatttaaataatttttcgggtagtaaatgatttcaaatagaaaaattgtcaacaacaaagttgtataactcatcaagatctataacttttattttggtcattttttcacgtaacattttttgaacagtttgaatttgaatttgaaaatatgacaacttcaaacaacaatttcaaatactaaatgattttaactgaaaaagttatcaacaaccaagttgtataactcatcaagatctataacttttattttagtcatttcgtcatccgacaaagtgataataacattgttcataaaattcacatatctcttatctggttttataaatgaatgaagggatacacggtttagcgtgctgccaagttgctcaaccgatcagctccttcgaactcgcccttcttttatgggaagcaaaaagggtacccaagaatgaagggatatacggtttagcgtgctgccaagttgctcagccgagcagctccttcgaatttgcccttcttttatggaaagcaacaaggtaccaagaatgaagggatagacggtttagcgtgctgccaagttgctcagctgagcagctcctttgaactcgcccatcttttatgggaagcaaaacaggtacccatgcatgaaggaatacacgtgcaagaatcacataaatggaactagggaagcctacatgaggagaagtttttctattaccagttatatgcccgaattcggagatatcaatatattccagtttcttttgtgctggttttttcacgatatataggttgggttttggggaggatttaggagcagttttttttttcagagaagggatcgtctttttttctttggggcggagggaggagaataactgtatttttcaagttgttagataacacacttgggttattaactaatgaatggaaagtttcatttacatctagtatatcagaaaattcctgttctcgtgttgcaagcctaattaatctggtttctcttattttggagtaacttgtaatatgaactatcttttcgttcaaacagctagctttaaactaaacacaattagttatattttgaaaatcccactacacaatttatagaatgcatgacaggtcagactatcatctcagcagagttggtgtatagctcgttttgagtcttgcacttttcctttctcaagggaaaaagtgcagagggctttctgcagacaacgaaatataaaactagagttgaaagcaacggagtattttgtgacaagaaaaaagagtgaaagcatgtaagcaactaacctgacactgacatatgtgtattaacaattttctgtatatttacactccaatcagttactccacgcgcacactaaattatttagaacagtaaattaataacatgcactatactactatgaagactgaatagtatatacacatactgtgcaggggaagcagcatccaaattttactacttgttttcaatatatagataaagttatggatatttggacataatgtttgatcatttaataaacacttggaagtatcaatattttgttgacttgttgtttcatctttaaagttactttaaatatgacttatagtttttttgttagagtttgtatccaatatgtatacaaagtcggttatagattacgacttcgagttatcgtactaggtgtaggaatagagtaagagctggactcgatcctaagctctct

SEQ ID NO: 86149 - DNA, 2613 bp, Oryza sativa
caacgtcgtcctgtcagtgctcgccaggccggactgccacgccgacgcgctcgcgctctaccgcggatggttccccagggaccgcgtcccgcccaccaccttcacgttcggggtcgccgcgcgggcgctctgccgcctcggccgcgccgacgaggcgctcgcgctgctccgcgggatggcgcggcacgggtgcgtccccgacgccgtgctctaccagacggtgatccacgcgctgtgcgatcagggaggggtcaccgaggccgccacgctgctcaacgagatgctcctcatgggttgcgccgcggacgtgaacacgttcgacgatgtcgtgcgtgggatgtgcggcctcgggcgggtacgcgaggcggcgaggctggttgacaggatgatgacgaaaggctgcatgcccggcgtgatgacgtatggtttcctcctgcagggactgtgcagggtgaggcaggctgatgaggcacgggcaatgctcgggagggtgccggagctgaatgtcgtgttgtttaacacggtgattggcggctgtctcgcagaggggaagctagcagaggctacagagctgtatgagacaatgggtttgaagggctgccaaccagacgcgcacacctacagtatattgatgcatggtctttgcaagcttggaaggatcggttccgctgtgcgattgcttagagaaatggagaagaagggatttgctccgaacgtagtcacctacacgatcgtgctacattccttttgcaagaatggcatgtgggatgacacaagagcattgctggaggagatgtcagcaaagggcttgactttgaattcacaagggtacaatggaatgatatatgcactatgcaaggatggcaggatggacgaggcgatggggctcattcaagagatgagaagtcaagggtgtaaccctgatatttgctcatataatacaataatttatcacttgtgcaacaatgaacagatggaggaagcagaacatatgtttgaaaacttacttgaggagggtgttgttgcaaatggtataacttacaatacaatcattcatgcactgctgcgtgatggaaggtggcaggatgctgtgagacttgcgaaggaaatgatacttcatggttgctcacttgatgttgttagctacaacgggctgataaaagccatgtgcaaagatgggaatgttgatcggagccttgtgcttcttgaagaaatggcagaaaagggtattaagccaaataatgtttcatacaacattctgatcagtgagctttgtaaggagagaagggtacgtgatgctctagagctctcaaagcagatgttgaatcaagggcttgctcctgacattgtcacttacaatacactcataaatggattatgcaaaatgggatggatgcacgccgctctcaatctcctagagaagctacacaatgaaaatgtgcatcctgatattattacatacaatattctcattagttggcactgcaaagtcagattgcttgatgatgctgctatgcttctaaacagggcagtaagtggtggaatagtacctaatgagcgcacatggggaattatggtacaaaactttgtcaggaagccacttaccattttggctgaccaggttgaagtgtattagaaacatgtgcttctctatgttatatttgatggttgttgcggcttttgaagttaccgtagcatccgttgttcaatcaaaatgaaatggtcatatcatggtgttcatcgctgatttcatcatgctcggtgacctggtatgtatttcccctcttgttgaaagtgtgtactttccatctgttaacccttttgttgacattgttctacagatggcagctgtatgtccagtgggtgatcgtagaataatgcagattcttcctgacaagaatttcaagttgtacttacatacaaaaggtaataacccttaaatttcaactcgtgtaaaattagaacaatagtgctgactgttgagatcttggcccaccatccatacctttgatttttgtaaagaagaaagagaaaataggtccagatcaatttgttcctaagatggcagatgcttacttttcatgtatctttcagctcatctcagattcctatctgtattgcggtagggccaatgaatgcaaagctaacattttattagaacagtctaccagtttcattgattctgctcctaaggttggaggtgtttccttatccattgatcctggtcctgccgtgggttcaacatccattctatgcttcagttctgggtaagtgggtgttgtgtaccgcaggcgcaagcgcgcgccagcctcatcgggagctgttgggctgccagcagatgtgcaggaacagatgccagaaaggacgcacagcgagtgaaggcgtaatcgggtgcttggatcacagtgctttgcttcgtttagattgcatttcttatccctttgaaatagcatctggtttccttttgtttagcattcggtttagccatgtaagccatataaatggcaccattttaaatgaatagagcaagcaagatcaatctcaattcttcattcccttgttctcagttttctcaatctctgctgctgtgcttttgccgtgatcaccatgggc

SEQ ID NO: 86150 - DNA, 4873 bp, Oryza sativa
aaatgttcttaacttatttttttcctctgaatgcagatatgccaaaagttcaagcctcttagcaatagaattactcaacgaaccactggcaccagatgtacctgtggatacattaacaaaatactatcaagacgcatacaatgctgtaagaaaatacactttgcaagcctatgtaatcctgtcaactcgaatgtcaggggatccaacggagtttctctcagtagccagcagtctctttggtgcggttatcgatgtgcattactataacctgtataacagcatgtttgataactacactgtggagcagaacatcaattttgtaaggaataaccgttcatcagatatcaacacggtcacaaagcagaacgttcctctaacatttgtcggtaggtactaatatgtggcactgatccctttcaaagaaaatatgtggcactgacatttttctcttgtttcttcctcttctgtttcacattacactcatatgggagaagtgcaaaattgatctcatttgattaatacaataagcaaaattgacaaaaaaaaattatatttggtcagatctattgaaaatttgaaaatgctggagtgctcaactgatacattgtttggtatgcgctcttctttgcaacaggagaatgggtggccgagtggtacgtggataatgcatccaaggaagactaccaaaattttgcgcaagcgcagctagacctgtatgggaaagctacttttggatggtcctattggacattcaagaacgtcaagaaccactggagcatggagtggatgatcaagaatgggtacatctccctcaataatctgcctccatcatcaccacccatccggtcggtgaaccttggcggctggcttgtgacagagggctggattctaccgtcactatttgacggtatacccaacaatgacctcctggtatgtctatactcaatttcatggtaccttcagttagaacattagccatttggatggttccctgttgtgttttggcagtgatctcatggtgtttcaaaaatcatgtaactttataggacggtaccactctccatatcaagtctgtgatccaggacaagtaccttgcagccgaacagggcggcggccaaaccattgttgccaaccgagtagtggcctctgattgggagagcttcacactgtggagggtagacgagacaacattcaatctcagggtgttcaaaaagcaattcatgggcattgacagcaatggaacagtcatcgcaacagcgactacgcctggtctgtcagaaacattccagatcgtgcgcagtgacaccgataagaatagggtgcgcatcagggcaccaaatgggagcttccttcaggtaatgttcactatggatattctgctagcagggctaattatggacattttattggtctatgttggcaaagtgcggccaggaaccaaacaaccttgtacacttatgtgatttaaacaggcatgcaccacaggataaaaacatctttggatgcaattggcaaaaattagtagtattttcaaataaatctctagaaacaaaaggaggactagagctgcttgaatatgccttctaacatgttgtgtttggtttagggttaaaattaattagactatgctagcttcctcacccaaaaaaaaaggttatgcgaggttttgtatgtactaactaaaaattccagttagcatgtatcttttgttccatcctttttctggttaggtggattatagcccaagttttccctaaaaaaattgcattgtgagtgcatttaacttgtcgatttaaaatatattatgtggattagcttaatccgagttcaagggcatgtaatgctttgactgactgaattaaccctactaccccaaaggttcttggtgggttagtacctggactaaaatagagttgattcataagcttgggttcttgaagaattacttgtgtgctcttgaacagaaagcttgtatttgaataaaatttatgaatagaaagatttctaagatgaaaaatacttcacttggcatttctaaattatgatcattctaaatttactcactaattttgaattgaaagtagtttatctagctatctccgtccttgactcaaaatgatcagtcttctctatttcttgatgttaggcaaagactgccaattctgttacagcagattatggtgaaagcacaaactggggcaatgatgatccctcagtgtttatcgtagatatggtaggtggtccacaaggggagtatcagatttgtaatggctatggtgcagagaaggcctcgcaggtgcttagggtaagacatataggccacttttcctccacttgtatttttaacctattatttgatggagaatagcagaaaactcactgcaatgtgtaagacaatgcagaaaaaaattcttagcctactatgtacggttataacattcatgatagctattaaaaaattaagatggttgtggtttctactaactgtatactgattctacaagtttggaactgttatgctatagaatggttgttggcagaaagaaagccgatcaggttaggttctttcataatttctatgttctaactattggagtatacgtagatataaagcataatggcagaaacactttttccctgagaactgcaggaagaagaggcaaatacactacaatattgtgcaattatttgtgttgcccttaaaacctaagcattttaccttcagtagttagcatcttagagggttcatattggcttcattaaaaaaagaacaaagtttcctccactaatatttacatatgttgcttcaatggatttgataattggcttgttaatttctgccatgttgctaaacctttgttttttgacttattttttgagtcgatgcaatatatcctatatatcctgtcttatattcattgataaaactagaggccagtgagtctcactgtgctgaactgtccctctctaaattgttattagtcaacaaatgacagtgggactctgaagaagcattcctgaatgattagaaggaaagcaacaattgcatttctttgtatacatattataatcacaaatccttctctgataactactagtacataattttccctttagaaaagttactaatgtatcttgtgtagaaattggtaaacatcttgtcaggaagaatcatagcaatgactatcacattttctgaaattgtatgttttgcaggaacattggagcacatacatagttgagagtgacttcgaattcatctcatcaagcgggctaaatgcagtgagaatcccagttggatggtggatcgccagtgaccccaatcctcctgctccatttgttggaggatccctccaagccttggataacgcatttaaatgggcagagtaagtatctccatgcagccatttatttatgaataagcacctcttaccctgatggccatgtcgggtgaagaaatataacacagatggttttagtctcatcttataaagaggacattggtgcttacattgctaatgtgcattgaaatggcaggcttgtaaaaagttcaagcaaattttccacctttttaccattaactaaactttttgttgaactgttggcacatgtatataggaattacaatattggtgtcattgtggacttgcatgccgctcctgggtcacaaaaccattgggagcatagcgccacaagggatggatcactagaatggggcaccactgatacaagcatcacccaaacagtgcaaatcattgatttcctcgcttccaggtctcttaacagaattcaccatcatccttaaacacaccatacaaatctatgattttcttgtaacgctatttttcaccttaattaatctacagatatgccaatagcccgagtctgctggcaattgagctactcaacgagccatggggaccggatgtacccctagaaaagcttaagaaatattatgaggatgcatacaacgtcgtgaggaaatacaccgcgaaggcctacgtgatcatgtcaaaccggctggcaggggagtccaacactgagcttcttgatttcgccagtaggttcccgggcgtagtcatcgacgtgcactactacaacctgttcaatgacgacacattcaaaaatttaaacgtagagcaaaacattgaatttgtgaagaacagccgcaaggctgagttcagcaacatcacgaagcaaaagagccctctcacgtttgttggtaagtagtgaggtggctctaacatctctggttgatttcctcttcctattttcttgcttgaacggtctccctcttctctgctgactggcatatattgaaaagttggaaattgcctttcaatcagaatttagacatcagaaggtttttaattctctaaatgatcgagaatttgaaattgtagaagaatatacggtcaataggtcactgaagttattgttccggtgcaggagaatgggcggcagagtggaaggtaaacggggcatccaaagaggagtaccaaaggtttgcgcaagcacagcttgatgtatatggaagagctaccttcggatgggcttactggaacttcaagaacgtcaataaccattggagcttggaatggatgatcaagaacgggtatatctcactgaaaatatagaaatagtgccataattctgtctggtgggtgaatacacattacacctaatgcaaaggccagaagcccagaactgtaataatgattttccattatctaaaacgaagtatcaatcgggttaacacgaactagaataagtctgtaaatcttgtttaattacggccaataaatcagttctgttagccaggtggaagcatgcatccagatgcatgcttgtattataagacttatattgtgta

SEQ ID NO: 86151 - DNA, 12509 bp, Oryza sativa
  unsure (1)..(12509): unsure at all n locations
agccccccactgccgccgttgccgagcccaccgccgccgtctcctgagaaagagcgcgcgagcaaagcggcggtttcatgccgtcgctcgtcacaggtgggaggagttcgtccgccagttttggctggaccgattgatcccggatctgagaggaatattcctctgtagggaccaacccatcccactcacccctgaaccaaacacccctaaaaatgggttcatcccatcccatcaaccaaacactaccttaggatggcacattgagctgacaagtgtattggtttgaatcaaatggagaaacaatttgattggattatttttattggtagtctggcaagtaatattaatcatgactaactatattttttggtgccacatttttcaataaaagaatcaaaatgtgtaccgtgaattccatatattgcaacttcgattccatatatttatactataaattttaaatcttagaacatgttttttcaatgctcgtcgtacaggaattatgaaaagaaaagaatcaataaaaagtattagaaaagttgtcgatgtttcatattcccaggtggctaagtatccgtgcataattgtgcctaacaaggaagagaaaatcgttgtgcggggtgccttgaggatatttcctcatatgctcgaagttgattccgactcctcgtggggtgtggatcccctaaagttgatgctaaaaccacccgacatagttgcaaaaatgtcaaccatccctctatttctaccggttgagattaatttctcctaattaactctctctcaattagtattgatttagtgagaatgtatcttccttttcaacaatgagataagtaacataaatgtgtatatccccgtgagatcggtttatcctcattctgcatattgaaatttttttttgtctcggacaacactacttgaaattgatctaatgaaaacaaaaggaatatgcatatgttttctagattatgttgttcttgcatgttattttggtaaagagtgcattattattttttagtgttggatggagtgtaatcgttgttgtggaagggaacatcttaaaacagtagttttcctttaattccacactaatcaagttaattaagtgcgatgaggtgtcttaattgatctcatccgtataaacaaaataatggctataagtttgttaaatcgtcctataggttgtaaatgggccaggtctttccgtatcggcctgggcatgtatttatagttcacgacccaagaatggcatggcccgtttggctacgagtcatgttggcatgacccgtctagccatgttgtgcttgggccgccaccttagccccacgtgccaacacgacaattgcatgtagcaaactagcatgacatggtccaggaatggcacagcacggccagggctgtgcggcatggtggcgaccgacgaccggcgccggccaacaaccaccagttgagcagctactatcgtgcaggagctaggaggaaagaagggaagaatcaaggaagccaggggctcgaggcagaggaagcgatgatgggcgctcatcgatgtaggcctgcacggtgacgtggtggagcggcctgccccattctgaatgtgtcggtcgttgaggcctcactagctcggggtggaggaagtaggaagcgaagggccatgatagtgtttgatgaggaggaagaggaatgtgatatcgttgagcggaggacctctctagagctttactgaagtttgtgcggtgggatgcaacggactctattcacctttttttcttggtatatatcgaatttgggttacgggcctccacacaacctacatacccatttgtaccaggctgacacgacacaactaaacatctcactggatcgtgtctaggctccggccttagcatgtgggttgacacgacatggcccattggtgagccgtgcctaatcgggtcatggccaaatgtacttatttatccaccgtcttaaccctataaaaaataaaataaaaattcatcgtcttaatggcctagccctaggggatcctgacttcctgaccctttgtgagttatcttgatatctgacgggaatttaattatttggcactttacggactaccactcgtgagatgtcattttttctggatgaacttacagaaatgccattggagggagagagagagagagagagaatctttacaaattgccaatttgcatatgtggaaggatatgtcaccttgccaacatggacatgaaaatgacccatttacccctggtttgacctcagtgtatattgaatgtgccaataacatacaaatacaatatttgatcaattgtatactatatatactagcatatgaatagattttcatgtttcaattttttttatggatttatcctgtgcaaaaattttagtaatgtgaacaagatatgagaggataaatttgtaacaaatatttgaagtacaatgaacctattggatctgctagtaaatatgtttgtatatagttgctcaaatattgcacgtgcattttatcggcatactcaatgtacaataagatcgaacgagggcaaatgggtcattttcatgccccctccatgttggcaacgtgattagcaatttgtaaagatttactctctttctctagtggcatttttgtaatttcatctgaaaatagtggcatccaatagcctagttgtaacaatcgaactgaaatgggggtttgacaaaaaaaaaaaaacagaaccagtgcctagtctagagatgtaattgacttgagaaaaatcatttaaaccggattatctgcagaaccaaaggaactagggtggcctagggatcaaacccccaacggtcaatgcatatgggttctttcacaactttacctaacctttaaatattttcatgccaaaactgtataaaaaagtgagtacatcgtattttagatccaacccttaaattttataaggaaaatagttgggcccgttactatctctacctatatacatgcgtgcgcacctgactatttgggttagttgctaccatgattttagaaatatatcttatgttgattaaaccaaaattctcaatataaataaaatatataattttactattttattgaaccgatggaagaaccggccaatcgatggattcattcaccggttcgaacaccggtcgggtttagggtttagagaggcaatccgtaggtggtaggaggggccccatccgtcatcctgctgcttccgccgcgtccatcctccctgcttaggttagcccttcgcacatcctccgccgccgccgccgacgatccccatcaatcccgcgagcgagcggggccccgtcgttcgtcctcctgccgcttccgccgcatccatcctggttagcacctcctctttcccatctctctctctctctcgacccacgcacttcacttcttgtcgaatttgcgttaaccctagttagctcgctctgtgttctagaaatttgccttgatgtttggcatgttagatccgcccatggtagttgggggggggggtggagcgagtgcagactgatttgtttacaggatgatttgatagatggtgcgtaattttgatgtggctttctgatttccgctaatctcgtgttcgtatctgtgctactgcagtaggatcgatggaggcgaagttatcgttttctcaggacagcccgccaatttccataatttctgctgctaaggttgccggtgtctccctgtccatagatcctagtcttgctgcgggctcagcacccgttctatgcttcagttctgggtaagtggctgctcttctctgtatgtgtttttttttcttcttgtaggattgcataaggttctaggcatttgtttagctatctggagttgattagctataagtggagatgctactaatggcaaaaataaagatgttgttttctttttagcaaaatatgatgtttgaaacgttgtgcatcattactgaatgcaatttattgctgacttgtgttttccaagtggctattattatgatcattgttttgattatatttttcacttggctgtgctgtacttgttttttcacatagaagtacatgaccaattttagtttccaaattatcactttacttttacttgtcctttattttatcttttgggtttactcaccatctggaactgatagtttctcatgggaatctttgtttctacacagagaatcactccgtggtatcaaccctattctcgagtacattgcccaatcctctccaagcctccatggccgagatgctattgagtctggacatgtatgctgtgaccaagttcttgctaaaacatatttcataatctttgttttgttagtgttctaaattgctgttgttaatgaactggcaggttgttgaatggcttgaatacgcccccaccttccttttaggatcagaatttgaggttgcctgctcatttgttgatggatacttgatgtctcggacctttctggttggtcatgttttaacgattgctgatatcactgtatggtcaaatctggctggtgagccatgggcttctttcacgttctactctcaagcttctcctatgcttcataatgtgcgctaacaattgatgtatatcttctctttcagggattggtcaacgatgggagagtctacggaaatcaaagaaataccaaaatcttgtccgttggttcaatggcatagattcagactacaaagacacattgaatgaggttatagctgcttatgttgggaaacgaggaattgggaaatcccctgcaccaaaccttaaggaaaaggttaatgactcaaaggatccttcagctccagaagttgatctccctggtgcaaaatttggagaggtgtgtgttcgctttgccccagagcccagtggttacctccatataggtcatgcaaaggctgcactcttgaacaagtactttgcagaaagatatcaaggtcgattaattgttcgatttgatgacactaacccttcaaaagaaagcaatgagtttgttgaaaacctcctaaaagatattgagaccctgggaatcaaatatgatgctgtcacatacacatctgattattttccaaagctaatggaaatggctgaaaaactgattaagcagggaaaagcatatgttgatgacacaccaaaggagcaaatgagaagtgagagaatggatggtgtggagtcaaagtgcagaaataatactgtggaggaaaatctgtctctatggaaagagatgataaatggttctgaaaggggtatgcaatgctgtgtgaggggtaaacttgacatgcaggatcctaacaagtcccttcgggatccagtttactaccgttgcaacactgatcctcaccatcgtattggttcaaagtacaaggtctatccaacttatgactttgcttgtccattcgttgatgcgctggagggagtgacccatgctcttcgttccagtgaatatcatgacaggaatgcacaatactatcgaattcttcaagatatggggatgaggagagtagaaatatatgagttcagcagattgaatatggtttatactcttcttagcaagcggaagctgctttggtttgtgcagaacaagaaggttgaagattggacagaccctcgtttccccactgttcaaggcatagtacgccgtggcttgaaagttgaggctttgatacaatttatactccaacaggtattactatctgctagttagctcttgctttgtgttatttacatatgaaaatgatgaatcctgattgcatgcccatttctttgctgaagggtgcttcgaaaaatttgaatcttatggagtgggataaactctggacaatcaacaagaaaataattgacccagtttgtgcaaggcatactgctgtgttgaaagatcagcgtgtgatcttcaggcttactaatggtccagagaaatcatttgttcaaattttgccaaggcacaagaaatttgatggtgcaggaaagaaggcaacaaccttcacaaacagaatttggctagattatgctgatgcatctgcaattagcaagggtgaggaagttactctgatggactggggaaatgccatcattaaagaaatcaagatggagaatggagtaattactgaactgattggagaactacatcttgagggatctgtgaagacaacaaaattgaaggttacatggcttccggacatagatgatctggttcctctctcattggtggaatttgattacctgattagcaagaagaaggtgagttagcaattccagctagatgtagttagcatgaaagcttcttgcttgccttaactcaaatagtctgtcttttttacttgatattacatgctatcttttctctagtttctctatgtggatatcatattttcctgtacagtaatgttttttaaaaaaattgtggaactaaaccttctctcttttgtcatgcaaaatgtgaaccatttcttggttggagttagctcctatattactcgttcatttatcaatgagttaacactgaatgtcttctatgtttgtggccatgtgtacagcttgaggaggatgagaacttccttgacaacctgaacccatgcactcggaaagaaaccctggccctaggagacgcaaatatgaggaacctcctgcgtggggaggtcatacagcttgagaggaaaggctattacaggtgcgatgccccttttgtcagatcctcgaagccggtggttttgttcgctatccctgatggtcgacagcaggccagtttgaactaggcggcatgattctgatgagcttctcaagtcgttgagttgtcagagattcctgaatgctctactgaaacactcccatctcatactgtaatgtcgcttatgtgtcatgggtgatttgcgctaagttttggtgcacagtttaatgtttctcatgctccatgctccagttattaagaagacacaacatttcttagatggcaacgtgttagcttggcgatatcatactgccagatacaagcatctgaattttttgaagactaatatctgatattgcttggcatctgaattttttgaagactaataccgctctgggaaactgagttgaggacatttctggtccatattgcttgacatgcccttttatgtttccagttgttgattataactggtgaatctaatatcagtgttcgttggttttgtgtcagaaatcttttctacttttgcaaatttcatttgataaaattcctactttttttcctttagaaaataaaatgttcattgctatatcatcccctacactaacatttgggtctcacatttcatattattacactatcctttaataaagttctctcccattttatgttggctcttcaaaatcattgtaacgatgaaaatgatgtaagtactatttggactaaatatgtgcttaattgatttatgttgtgttcttttccccttctttctcaactcaactttctctttttttcatgcgcatgcttttcaatctgcttaacggtgtgtggttttttttaaaaaaaagttttctatacgaaagttgttttagaaaatcatattaaccctttattttttaaaaaaaactaatacttgattaatcatgtgctaatgagtctgtgtgggattagttaacaccaaatgccgatcgcagccttaataaggtcaatttgtttttcgttgaaatgccgattcttatgccagtgagaaactgagaattcattagaaatgcctatgcctctaaaatgaggcttatgcagtcagtcattgtaggctaacgaaaacatgttggttagttgattacaccttgcgattacatgtaatactggttgccacttgctacatatactgatatatacagatgcagtacataatcacaatccatcaggtttgccacaccagtttgaagttagtcaatactggttgctacatatacataggcataatccatcaggtgccaaataagtttgaagttacagccacaaacgaggttctgaggtcttccaggaaataggctgcgaatggaattgcatgcagttttggtactacacgcctgattttgcaacggcgtattgtcctcaaaacagatctctatgaacaataatccttggcgacatatatttccctgctttggattgatttcaccttcaagattacaatgaatataataacttggatgttgaaggatattaacacaaacttatgatttgtatgcctcgttcatcatctacgtccattgggttttcacagatccacaagccctgttcattggagcggcgcaaactaatcagcagttcattctttccaatttggaattgcattatctagtcagtaataattagatgaaatatgaagtacgaaaagtcgaaaacagtgagacctcaggatcttggaagtgacaacatggctgctgaaagccaaatcagtcccgaaagatggtatttttggttccagatttcatcacaggtccccgacaaatccatagaaaaacaaatcaaataaaaataaaaaacaacaataactataatggcagtaccaacatcatctccagattgggttggcctcagaattgcagaatggcagcatggccgccgagcggcggccgatcagccccgaaagatggtgtttttaatcgaggttttcttcaccggccaacgcagacaacagtgggactcgttcttaactcttactagtatgcagcaacaaaagaaaagtttaaaagaagaaaaaaaaccaagaacttgaggaagaaacgaaagaacagtcttggtagcaacggatcagcaatggacatcagaattgcagaattagcatcattgcacgcgcggcggcgccaaatcagccccgaaagatggtgtgtttttcttgcggtttttcatcaccgtcgtccaatccgccagccagacaccaaggcataataataacaagtgaaaaggcagaagaaacgaactcagctttctttctcgatggcaaactcatcgcaacggagaacaaaaaggaaaaagagagaaaaaaaaaaccaaacgagacccaatcaataactcagatctgctcgtcaatggcggaagatggagcggcggcggcggtaacctttgggtgcggagctaagtgagggagggacgagtagtttatatggaggctttgaaaccctagctagtcatggcgatagacgggccgggccctgtggtggagaattcggatgacgtgtacctgaaggcccagaggccggcccatgagccattcacagttcggtctcacctctcaagcgcagagattctgagccacggggggcgtggccatccgaacttcgtcggaacctgtcatcaggaggaagctccgtgacgtgcgaggagagaggcgaaaccgcattggagagaccgtgtcctcaaatgcgaagcagcagtcccctcgccaccgtcgtcgtcgaggccgccaccgccgtgccggccccgccgccgttgtcgagtcgccgccgtcgtcatcggactactccccccgccatggagagggcacgggatgccatcatcatgccgcccccgtcgtcgtgctgccaccgctgtcaaaccgccgccgccgtcatcgaagaaaattatttctaatttttttctggattttagggtgtttattgtaaattttagatcttcacataaactgaagataatattataagaactgaaaagaaaagtattagggactgaaatataaaattaaaaccacttgcactatgaataattcaaattttataaaaactaaagcttcatagtgtgtgggactgcctttgccttcaagctgtcgtcaccgtctcccgaggtcagatccggcgagaagggggtgcgaactggccaccagtggtgctcggtcgagctgcgccaccgctgcccgtcaccgcctcccaaggctagatctgacgagcctcagaccagatcttgcgaggagtaggaaggcagcggcaccccgacaaggaggaaggggatcgacggtgatgggagggagagcgctagtggggggagggtgagctgcggaggggaagcgacgttgccgatgagaagaggggaggggaggggagaggagccgctggtagggagagatgacccacggtggagagggagcgatcacgctggtgggggaagggggaggagcggagagggagcggaggaggaggaaaggcaccactggtagggacaagtggcccgtggtagagggaggggaggggaaaatttcgatctggggttagggttttttgcaccagcggttttgaacgagttggaaccgattcagccgtccatcaaattgaacagctcagattgatcgcgtgttgagtcagcccccatactcaggccacagcactgctgggctaccgcgcttcatgggtcgcgcgcgcgaatgccctagcaggttggtgagtcagaggtctttttttttcttttttttactttctttatttctggaggaatatatatttttaaaggctcatacataaaaactaaaccctaatcatctaatatttttatatttgttataactttagtttacctgttgcaacgtatgagcatttttctagtaaaaactttataaaagaattctaaatagagttaattgcactttgtctaccttttatttccaaagtttcactttgggccaccctctagctaatatttgcagtttggaccacccaagtcactttttctagctgcatataccctctaatctcgtaaagaatagtctacatgtaaattgggaagattatcggtttatgagtgccgatgtgattaaagttatttatgtgctcgagaaaagtttttgggggtggttcaaagtgaaacaaaggcaaactaatctagtccaaagtaaaagagatggtttaaagggttgtcgaaagtgaaactttggtgataaaagatggccctaaacgtaatttactcttttattctataccatactagattagaagtttacatgttaaattatagtggtttaaaattttatatttcatttaaaatagaaaaataagattcaactaaatattatcatggatttgtgaagctaggaatatcccgtttcgaagaaatcttggaccgggagttataccaaatagggacttaacattgtttgtagctcgaacagtgatcaaaaaattatttactacttcttttccaaaatatagactcataacgttagattatttctaattcagttctaggttattttattttgagtaaaatacatggctaatccttaaacttgagagcaggtgtttcttagatccctaaacttgaaaattacacatataagtccaccatcctggtttaatgaaccatagtcggtccaaacctcatttgacccgagctaatcgtcaacatgacattctatgtaggcaacatatttacagctagctccctccacggcgaagagtggtggaagaattacaatttgccccttcatattaaaataccctggaggccgtgagggaagggggagcacgtgtagtgaggccgggtcgaactattttttttgggatcgtgagagagatggaggctgccgggaggaagggattagggggagggaggaggaggcggaggcgcacggggagagaggagttacgtgtctgagccttacatattttttaattaggtatatagattggtagtatttgttgttggctgacttaatgatgaataaataaggtaatagcacaattattagcgaccaaacactagtaaacaatatcagacggctcctatcgttagggtttacgtcattgattagatagggggttatcgctaattcgatagatttcgaagaaacttcaccgaaattcatagaatttcattgaattccgtcgaattttcgcctgagttttgtactaccttgaggcatcgagcatgtgcgccacaactgaacttgcactaccccaaaagagtgatacaaatggcggagcaccacccgcctcgcctcccgccgtccgccgccggcgccgcggcgacgtcgtggccggagctcctcacgccgttcgacctctcccgccttcgagccacgctcgccttcccgccgctcaccccgcgccgtctcggccgccttcttgcgctcccgctctccccgggcacctnccttcttcttctcacctggtacgcctcctcccacccggcacttttctcccttccgatccggcctattctcgccggcggagaccccgaccgcgccctctctctactcgacttcctaccgcccggctttcttccactccgcgagtcccttcttctcccggtgcttcgaattttgccttccggtcgcgcccttcacctgttcgaccaattgccccggcggttcggagttcaaccgtcgttccgctcttacaacgtcgttcctgtaaatgcttgccaggagcgactggcacgccgacgcgtttgtgttttaccggcggatgtgtccacaaggacctggttccgcccacctactttattttctggattgtcctggcggccgctcttgcgactttggccggccaaaaaggggctttggct

SEQ ID NO: 86152 - DNA, 5828 bp, Oryza sativa
tactatgaactcatacaatccatagcgtgttgaaaacgcggtcttgggtatatccccggtcctaattttcaactgatggtatcctgatcgaaggtcaatcttagagaacaccttcgctcctttgagatgattaaaaagatcatcatccgtggtagtggatacttgttcttgatagttacttcgttcagtgagcggtagtccacacacattctcatgctaccatccttcttcttaacaaataacactggggctccccaaggtgacgaactaggacgtacaaatcccttttcttgcaactctctgatttgctttttgagctcctccaactcattgactggcatccgatatggtctcttggatatgggggcagttccgggtatcaggtcaataatgaactctatgtcatgatctggtggcatcccaggtaaatcttctggaaacacatcgggaaatcgttgcactacaggcattcctttcatgggtagcatggtaaatatgcctccggcacgttcggttagtctagtatcttgatccatggttgctctcatatccgatccccaaggtgtggtcagggtaacttctctacgtctacagacgattactcccctattctttgataaccaatccatacctaatataacatcaagggtctgtggtaccaagaccataaggttggagggaaataccacatccctaaggcgaaatggtacgtcaatgcaagctgtgtccatggctatttcacccccaggtgaatgtactaacattggttgccttagtttaactctggtcaaattgtgtcgttggcttgctttcaaagataaaaatgaatgcgatgctcctgaatcgaagagaactttaattggagtggagttgatagaaaacgtacccatcagtacgcccttgtcttcctgtgcctcttcagctcgaacgtggttaacttgcccgcggccaaatcctggtcctgttagtctgcggagtcctgaatagacctcgtccagcagcaagggtagtagtcccgtgaatagccgttgcattagctccggtgcgaatgggtgtcttgtttggatgaggacatttgttggcgaaatgcctgtactctccacagttgaaacagcttcctggcctcactgatccagtagcgacctgattcggtgcaggagctcggttcttaatggtaaccggcctgtggatgttgcttggtgcggtaggacgattggttgttaccaccgttggtttccatcctgatgcggtagctccgttaggacgctggggtgcgacctgaggcgagcggttcatggcaagcctcctcttacgattatgctccacaaccttccggtcgttctccagcctaacgaccttattgattagactctagaaactatcatggtcctgtccaatcatgggcccacgcaactcatcgttcaggccttcgataaacttatcgatcttttcctcctcgtcggctaggtctccagttgcgtaacacgccagttgagtgagacggtttaggtactcttgtatagtggtgttcccttgtcgtatcctcctgaattcattcttctttattcgcatcacggcggcaggcacgaagttgtcacggaaggccgtagtgaactcctcccagtttggttctccagcatcttcttctcgggcttctttgtaagtgtcccaccagtctccggctggtccttccagttggtttgctgcgaagatcactttatcggcttcacgtactcgaacaagggtcagcttcttctcaataatccttaaccaatcctcggcatccatacgttcttcagctgtggcgaacgtgggtggcttggtcctcataaactctccaaagcttgatcctccgcggttgccttggttgtttacaatggcttgtagaagttgggtttgagtggccataactccggccagggtggttaggtcaggtgtctgagtttcttcattgctggttgacgcccgacgttggcttgccatctgtgtagaccgattaagtaagtatcctaattttctaactagctcttatggttttatcccattaagggagttgttttgatgtgaactttgttttgcaagcatggtggaataaactcatttttaagacaacagcaataatattatagataacatcacagatttccacacatagtacataaatcatgatgcaattgactgcatacatacgcagtcaaataaggttcatccaaaagacacatcgaactaaccatcaaactactcgtcaatctaggtaagggggggtgtgtctcgcatactatcaaaaaccatctgaagcgagatcgaagctgcaacaatcctccagtctagtcatccaaccatccgcaggatcctggggcaggtagagggtggtcgcgggcacaggcaaacctgagtccccatggctcggaagtagtggcctctggatctggcttgggcttcttgcccgggggtcgggtgctcttgtgggcagtgctgagggtgcgagggccaccgaggaaggtgatgtggggaacaggggtctcatcctctgaagaatcagtgatgtctggcttgatctctggctcagtgtcggtcccctctgtctcggagtcgacctggatcgaagtctctaaactggaacccagctgcggagaaggtgtagagatcagtggagtgtgcagaatctccggggcaggtggctgtgtcactgtctggtccaccaagtaaggtgctgactcagtagccagcataccaacctctcccaaaagagcgtggaacgctggtgggtacggcggggtgagaaaaaagtagcttacatgtggctgctgaccgtggctgctcgaagctactgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagtggaaaataagataaacggcgcagacggctccactccacaggcagcttgaccagggctatacctaatccaccacaccatcagcatcattgtagaactcttcctctgatgaatgattgcaaggtgactatatgacatactcagcaagccacgcagcaaatatgcaagtgcacaaggataccaaaggatggcatagtagggtttcatttgaaaaagcagcatttagcaaacatttaagaatttaataaaacagttaagtaataattaaacaatattaatccaacgctatacaacatactctgttgcataggcccaaccattctgaacaaccatcccggctgcacagttgtatctccaaaccaggaatataccattccaaaccaggagctaaacaaattatttccagttatagcatcttctattatgatgagaggtgtgagactaatcacgaaagacattgttagacccgcccataaccgtgggcacggctattcgaatagttttgctctgatcagaggtgtaccactgtacccacaagacacagccccacatcatgtcaccatgtgcctcaataccaccacggtacctcggaaaggagctgtgacaatacccctcgcacaacacaatccactacagcgcacctttcctggatcataatcacccccttataaacaaggcatggactccccagcgacccccgtgggcttatctccgccacttctcagtctggtgccccgcaatgaaccatgctatacaaaaggtaaagctgttgcccacgctggcttgtggttggcacggttaatgtttcacaaccgaaactcgtgaaccggtccttaattgtcatgagcacgaccatcaaaaccatgtgctcacaacccaccattatcaagttttagttggcaaataattaattaaccaatcacgattgaccatcgtgaactatcattaagccatcattaaataatagtgagtcataagttatcccaatagtgtgctaatgtttctaagcatggctaagcaattatatctaatatctagctgaaccaatatatataaagctcaattagtccaattataatcacccaaggtatcaaggaataaagtaatcaagtacaaaagggccataacaaagaataggttaattccacccaatgacattcgaaaatagatgcaatagttgaatagaaacaatagctttaaataggatcaacatgctcaaagggttgtttgggatctgtgtgacttgccttgctggccttggaactcttcaaattcttctcctgcgaaaacggactctccggaaacgtcggagtctaaacagaaaagagcaaaaacaccaaaacagcacataaacaaacatgaacagtacatgcggatatttttaacatgtagatctcaattttagaaaaatttagagacttgaaccaactaaatccgagctaagatgaattagttatgaatttttgaagattaaatcggattaaaacacttatatggattttaattgaattatgacgcaataatgaattatttttgaaaaggaaaaggagatttattgcgtcagcggctagggtttgcggtggaccgggcgcacggcggcggttcacaagaacggacggccgagatcaatccatccaaaacggacggccgagatcgattggtgcacgaccggctcacagcgaacggccccgatgacgtcggcgatgacgtcacctaccggcggcggctcgggctcacacgctcgacggcgaacggtggtgcttcagcacgaacggagggcaccagcacgtagaggacgacgcggcgaactcaccggtgaccaaaacggcggcggaagaacaacggacgacgacggcgatgaggaagaagcggcggcgctcttcggcttgacgacggcgacggtgctccggcggacaacaacgacggcgaaggggcggacgaggacggtggtgactgtcacgtcctgataaattcatcccgaaataaaaatcattctctaaaagaaataatagaattaattaaaattcgaaaagaaattggcaaaccctaaaatacgtacaagaaaaattcaaatgtggcccggagaatttttgttaaattctccttggtctaaaaggagccctcaaattttagtggaattttcagagcacaaataataattgaaaagaaataaacaaagttgaaaaggttttataaaaagaaaaatcctaaaagaagttcttttcccccccttccctcttgggccggctcggcccacttctccctccctctctctctctcctcccccgcggcccatcggcctccccgcgcgcgcgcgccgctgacaggcgggcccgcccgccactctcgctgacgggtgggacccacctgtcatccccaaccccgcgccgcgcccgccgccgcccgtgccctagcgccgccgccgccgcggattccgccgcatcccgccttccccgcgcgccttaatgaggggggaattactccccgcgtttccctctcccgattccccctcttttccctctctctctccctcggattcgtccggattcatcccgcgaagttcgccggcgtcttcaatggcgcccgagatctccgcgcgcggtttcctctctccccggccgcgttctccccctctcggtgctatataattgctccccgagctccgctcttccgtttccgccgctcgccgctcgctctcgccgtcggatccatgctcgcgccgtgctcctctctctccgccgtcgccgccgagctccgttccgccgcccccgccgcttcggacttcctccctactcggcgaccccttcatccgc

SEQ ID NO: 86153 - DNA, 7043 bp, Oryza sativa
cccccgaccccctctctaggtcaccacgtacggtgggttaggcgtccgcctccaggtgcccacctaccgcatttatggcatcccgagcgatcgcgccacgccgtatttaatgcggcgtgcagtgcactcaaccgttctgtgaccggtcgaatgaccgatgggactggctagtgcgcctgtgcgctgctcgtgtgtcaggcggcgtgcagcctgacatgtcccatcaaatagtgatggtgagaggttctcatcctcttatctcagccggagtcaggcctcccgctctagtaaaagcaaggctcccgtttcccggtataataggagcccagaagtcttcacccattaaatggtgactgacaggggcaccccccgtgtcaggcggcaagatttgacaggccccatcatcaagacgacgtttgcttggcttcccaagtcaagagacaagacatgcatttaatgcaaagattacaatacttctccaccagagctaggttaggttgttgggcccatatggtaaccccttaaggtataaaaggaggtccaggcctagtggtggaggggagacttcggggcgaactggcgcttgggtctcccaaccccaagcacttgtgttctacattcaatcaatcatgcacaggagtagggtattacgcttctcagcggctcgaacctgtataaaccttttttgtctcatcgtcttggggggggggctaaccccctcaagatcacacagctctgctcaccaagccctcgaatctcacccgctgcccccggccgaactcacaaaggggggcctcacggttccctggttgaggaattcattctccgatatctggcgcgccaggtagggggcgcgttcgtgatttttgaggttctttcgagcgccggtgtggtgagtgtcgcgccgccgctactggggaaggcgcaacatcctcaggagtgtcgtgccaccccaggcagggggcaaggccccccacatccccaccaggtaatcttggctacctggtctttgtggcgagtcttcagaatgtccgagggcccccaaagctccagccctgcctcaccgagaagtacgacgatggcgccgacccctccgagtccctccagatctgcacggcgatcatagaggtggcgggtggtggcgaccgggtcatggcgaacgtcattcccatggcccttaggggccaagcgcggggttggcccatgaacctgctgctgcctcggttcactcctgggaggactcttgcagttttgagctccgggtgccgtcgaagcccgggaccccctgtgctagctcttctgtagcggctgactttggtcccgtcggctggctacgatgcccggcccggctcaactgatcgtcctttcaagcttcaagtattttcaatttttcaattcattagcttgaaatcttatatttctttccccccattctattctcatggccctgcgacgcccgcgtgttgcgcatttgtttgctccctcggtggtaagagcccaacctctcccccatctacatgaacgattcttcactaagtgtgggggctaagttttctagccttatcctagccttaagttgagccccgggtgccgtcgacgcccgggacccagtgtgttggctcttccgtagcggctggctttggtcccgccggctggctacggtacccggcctggctcaactgtggacggggattgctggctctagagttttcggctctcacactcatgcgaaagtaatcgtgcatgtagaaggaaaagagattggaaggaggccaccgaaaggaaagagcaaacagaatgtgtagtgtggggacacaggctcgtgggaacctaacctcgtttgctaagtggtcacaggcttcccaagatggttcggaacccatggtggggggccctcttcgagctaaaggtttgtgtttgcttcattcatacaagcaattctttgctgtaagtgtggatgctacgattcctagctctatcctagccctgtgtcgagctctgggtaccgtcgacgcccggggccccctgtgctagctcttccgtagcggctggctttggccccatcggctggttacaacgctcagcttcgcttgatcgcaggcgaaaattgctggctatagaaagttcagtcctcacactcgcgcgaagataatcgtttgcataaaattattattgcttatatttatctctcgcctatctcttcctcgcggtctccgcggtacctatgtgtcgcgcaccggcttgcctcccttggtaacaaaaagtttgtattcgcttcatccattcaaacgattctttgcttaaagtacgggggctacgattcctagctctatcctagccttgcgtcaagctctgggtaccgtcgacacccgggccctcctatgctagctcttccacagcggctggctttggccccgccggctggctatggcgcccagcttagcttgatcacgggtgaagattgctggctatggaaagttcagtcctcacactcgcgaaaataattgtttgaatagatgaagtagaacatgaacaaaggttaacaaatggcaggggcaagtgaggtacgcggcgtaaggtcacgggcccgagagaatctaacaacgtttgctgaatatatacataaaataatttcacagcctaaggtatgggctagcgagtcgcccttaggttggggcgaaaaaggcgcatgggtcctagtaccagcaaagaaagaataagagatcgggcccacctatcatcagactaggaaagtggcgtcaccctgaccacctggggaaggttttggtcagggctaacgccgggggctactgtcggtgatatgggcccggggctatcatgtttagagggaggaggctgccccccgatgccacgtgcccctcccccgaggggagttaggcccgaggtggggtggtggcccctccttccccaaagactagtcggtggaggctgccccccgatgccacgtggtcctccgccgaggggagtcaggcccgaggtaggacggcggccactccttcccagagactagatgtaggaggctgccctccaatgccacgtggccctcccccgagaggggtcgggcccgaggtagggcggcggccactccctggccgagactagagggagaaggctgccccaggcgccacgtggctccccctcgagggggaatcgggcccgaggtcgggcggcggcggccccttctcgtgactaggggtcgggctcccccgaccccttctctaggtcaccacgtacggtaggttaggtgtccgcctccaagtgcccacctacccgcatttatggcatcccgagtagtcgcgccacgctgcatttaatgtggcgtgcagtgcactcaaccggtctgtgaccggtcgaatgaccaatgggactggctagtgcgcctgtgcgctgctcgtgtgtcaggcggcgtgcagcctgacatgtcccatcaaatagtgatggtgagaggttctcatcctcttatcccagccagagtcagtcctcccgctctggtaaaagcaaggctcccgtttctcggtgtaataggagcctagaagtcttcacccattaaatggtgactgacaggggcaccccccatgtcaggcggcaagatttgacaggccccatcatcaagacgacgtgtgcttggcttcccaagtcaagagacaagacatgcatttaatgcaaagattataatacttctccaccggagttaggttaggttgttgggcccatgtggtaaccccttgaggtataaaaggaggtccaggcctagtggtggaggggggacttcggggcgaactggcgcttgggtctcgcaaccccaagcacttgtgttctacattcaatcaatcatgcacaggagtagggtattacgcttctcagcagcccgaacctgtataaacctcttttgtctcatcgtcttggggggggggggctaaccccctcaagatcacacagctccgctcaccaagccctcgaatctcacccgctgcccccggccgaacacacaaaggggggcctcacggttccctggtggaggagttcattctccgacatacatatacacatatatatatatacatatatacatatatatatatacatatatacatatacatatacatatacatatacatatacatatacatatacatatacatatacatatacatatacatatatacatagatatatatatatatacatatatatatttatatatacatatatatatatatatatatatatatatatatatatatacatatatatatacatatatatatatatacatatatatatacatatatatatttatatatacatatatatatatatacatacatatttatatctatacatacatacatatacatacatacatacatatatatacatacatacatatatatatatatatatatatatatatatatatatatatatatatatatacataggaagcctatatactactccctgtagtaggtactcctattgtaaccatcggacacctgcccaactcatatcagggtttcgggctttaactcactaacggttggtgagaaaagatccactgatccaccgatgcagaaacttgaatattctttttttctttgaaaattcgtatcaccgcgtggtgttctgcatggcgagtcattttgaatgttctgcatgcatggattgttgacccgcacgcatgcatggccgtgcgaccaggagagtagttagtgtggaggttgctgttgatactctatttaagttgacggtgatgtaggacagaaaatgaggagcagaattatatttcggatttgtgaggaagaagattttgttctgcaggtttttggtggagcagaacccctccggtggaaagggcagaatgtcgtcggcgaggtctgttgcgtcgccttccgcggcgcaagtaggcggaggctcgtcggcgcgtgatgtcgagcagcagaagtcggtggtggccgtaggcgcgtcgtcgccagtgagtagtagcaagcagcacaatctggcgaaggaagaaaatggaaccattacagctaatggtgacaagcagcagaagcctgccgcagataggtacacatagaagtttagttttaggttatgttctgttgaaaatttttctcttgtttgtttgtttggctctgactggttattgcgttatttggtcatcaggaatggttttgtgcgttgcatggatactgctgcccggagtgaagtgatgaaccactccctccagaaatatgtcattcatttggatggatgtcatcctctttccatgaggaatcctaggaagagatgtgcttggtgctcactccgtgatattcgcgtggcttgcgacgtgaatttcagaagcaacgaaacaacccggggcaacagtaatagttgcgaacatgtgtccaaggaaaatatgtagccaatagtgtgatgatcaggaaaattgtaataagggcttgctttctgcacggccgtagattagtcgtacgaactgtctctagttttgtatggtatattctatgagaaaaaagcgagtagtatctgagttgagaaatctgtatcttctgctatttgggaagtgaaataaaattgagatgttatcctttcatttatctatttaagttgtgtgtactgcaaactccctgttgtcatcgtgaatgcaatccttcaccaagatgaagttcttcgagcagaatattgtacaagaatggagcagagatttcgaattggtttctgtgagtgtagcgttgcgtattcggaatatttgttatagatgctatttttgtggcggtatggtttcatcagaattcgttaatgttgctagtggctgactttccagagtccaataacatgcttcgcacgtaggagccttgatttcggggaggttgttgagcagctggtggaaaataaaccgtaattatttgtcagtatatatccaaccagctgaaaaaaaaggacaccctagagcaaattctgtttgccaaaaggggtagctaccagagtccgtgctggacagaaacaatattcacggagataggtatggaggaagaaggctggccggagaaaggtggcgaggatcatagtggacaacccatggacgtagttccgttggaaaggtatttttttatgtcagtgtgattgtagtgtacaattcccctttctgcattgtttcctgatttctcgttttttgatcctaggatcgtggttgagggggaggaagatagtgatctgctgcctatttcactctctgacccagccattctgttgccggaaattgggcagaccttcaatgaggactctaatggctatgcgttctacaatctgtacgctaggttcactggttttggtataaggagatccaagaacagatacaaagatgaaggcgtgaagtccatgcaagagttctgctgcattcgtgaggtaaaaatctttagtgtgttctttttttttttgaaaaccatggtttcgtattctcgtaggattggcaagtttctacagtgtgatgcgtaggatcatcattcgataggttttacgtagtaaggtgttcctgtaatttatgcaggtagagataattctgtcactggtccgccgaccaggataggctgcaaggctatggtcaggttaaatcgttcttctgaaagtcaaaagtggagagtttctgcattcattagtgagcataaccatgaaatgaaacgggacctgcagcatactaagcacttcaggtctcataatttcattgatgaagggacaaagaggaacataaaggaaatggtagataatgggatgacacctacagctatgtatggattactttcaggtatgctcggcgggccgtccttaaccccctttacaaggagggctgtgacaagaatggcgtatgccatcagaagggatgagtgtagcaatcatgtgcagaagacactgaatttttttagggaaatgcaatgccgtagtaagaatttcttttacaccatacagattgatggtgcttcaaggattaaaaatatattttggtgtcattcactgtccagatt

SEQ ID NO: 86154 - DNA, 1618 bp, Oryza sativa
attcctgcagccctaatctagataatatatatcaaataataattgatcaccaaatataatgaattaaccgagatcaatcagacttgatatatttatgtagagtgatctatctatagaaatgacaaatatacgtataatagattatgagacatgcactatcatatatggtaagatcggctaaaaccccaatgctatccttagttataattaattccaagttaatttttaaggttctagacaagactagggttgatgtaactcaaagtatgtaaagagacctaaagtctaaacaatgaagtaattaattacttttcaagatggtagatatcttaaccaatctaatctggcatgatgatttagccgataccagcataaaccctaaagtaggccttagccgatatgactaaatcgagatgctaaactagattaaataagatatatgataacaaacgtcacacgaacaatattaatacatttaaagcaatgtaaaagccccgatgatgcaaaccattgagacaggttacctcttgtcgagagatcgtagctgatgtcccgacttgaagcaagaacctgtactgattttattgtcgtcatttattacaataaaaagtgtggcgatgtgcagaaaattgtactgattttattgtcgtcgtttattacaatgattcggggtttatatttatacacagagtacaaaactcgtccattatggacacgactcaaactttcataaagataaaaacaacaaacaagtccacacggcggactcttaccatttctctaattcaaaccgacattaatatcctaatgtaatagaaaaaattgccttaaatcagctttatctttatatggcaatgccagttatctcaatcgaggctccaaccgagcccaagtcgaggtgtatcagctacttcccatattggctgagttggtgtccaactctgtttcctgccgatatgatgtccagccgatgcgcagttagtttctggcaagatcaaatctctttcaagcccgctttaatatccatgtccaaatccgaatatatcttgccaaatttcattgttcacaataagacatgagaactaccttaattagacacagactaggggcccattggtccgatcggctgaacatctgcaatccaaccatcactatgccacaattatagaagacccggagtaagcgtcaagaaaacttagcaactcacagctggttgttgaatccaccaattggtctattcgaggaagagaaaagtaatcgtttgggcacgccttgttgagatcggtgaagtccacacctattctccacttttcgttgccccttgcggaccatgaatggattagcaagccacttcggaaggagaacttctcgggtaaagccagctttgagaagtttgtacagttcttctcgtatagcttgttttcgatatgatgcaaatctctgcagtttttgcttaactggcttggcatcgggtcgcaccatgagtttgtgctcgatcacctccctagggactcccggcatgtctgacggctgccaagcaaatacgtctgtattgtcgcggaggaaggtgatgagctcgagttcctatttactgcctagcgttgccccaatcttaatg

SEQ ID NO: 86155 - DNA, 3053 bp, Oryza sativa
ggacccccccttaaactgttgtggaagaaggaaggtgtccccgtgtgggacgaggacaaacaggagaagtttaacctacaagcgctactgttcgtaaccatcaacgattggcctgcacttagcaacctatccggacagtccaacaaggggtacaaggcttgcactcactgtatggatgaaacagaaagtacgtatcttaaccactgtaggaaggttgtgtacatgggtcatcgtcgattccttgcagcaaaccacccggtacggaagaaaggcaagcactttgaacatacggcggaccaccgtacgcagcgggaaaacagtgtttgctatggttaaagatcttaaagtagtgtttggaaaggagcctggcagccagcctatagagagtgaagatggtcacgcggcgatgtggaaaaaaaactccatattttgggagttaccctagtgggaattcttggacgtccgccacgcaatcgacgtgatgcacctcactaagaaccttttcgtaaaccttcttggcttcctaggtgtatatggaaagttgaaagatacactggaagcacgtaatgatctgaagcatatgaaacaacgcggcgaccttcacccggaaccacaggagaaaggcagccattacttgagtccagccagctacactcttagcaaggcagagaaggaaagtatgtttcaatgcttggagagcatcaaggtaccgtctggatactccacgaatataaagcgaataataagcacgaaggagaagaagttcacaaacctaaagtctcatgactatcacgtgttgatgacacagctgctaccagttataataaggagtatcctcccagacaatgtccgggtaacaataacaaagctatgttctttcatgaacgcaatttcgcagaaggtcatcgatccggataggttagaagcccttcagaatgatgtggtgcaatgtcttgtcagctttgagttgatatttccaccttcatttttcaatataatgacgcatctgatttgtcacctagtgaaagagatcggtattctcgggcctgtgttcctacacaacatgtttcctttcgagaggtacatgggcgttctgaagaagtatattcgtaaccgtgctcttccagaggcaagcatcgccaaggggtatggaacatgggcgtagaatttattgaagaccttcgcccaatcggggtacctgaatcacgccacgaagggagactacggggaaaggggactctcggaaggaaagcaataatgacggtagacaacaatttatttcataaagcccatttcacggttttacaacaatcttcattggtggctccttacatcgaggagcacttggctctagttcgcgccagaaacatcggtaagtccgatgcatggattacacggcatcacattgatactttccccgcatggctgcaacaacatctcatgggtaacgagacgattaaccagtaactggccttcctggcaaggggttcatctgagtcgatcgcgatattccagggatatgagatcaatgggtacacattctacacaagagcccaagacatgaagagcacgaaccagaacagtgctattcgtatcaatgccatgggacacgatggtacaactggcacatattacggagccatcgaggagatataggaacttgactatggacctctcaaggtccctctgttccggtgccaatgggttaggttgactggtggaggcgtaacgattaatgacagtgggatgacaacggttgaccttaacaaggttggatactcggacgaaccttttgtccttgccaatgatgtaacgcaagttttttatgtgaaggacatgtctagcaaaggaaagaatggcaaagggcctgacgagccgaagcgccacgtggttctcccaggcaaaagaaaaatcgtcggagtagaggataagactgacgaggattacgatcagtttgatgggcaaccccctttcacggggacgggtgaccctagcatcctcctatcaaacgaagacaccccttactcatgtagcgatcacaaggaaggaacaatagtgaggagaaagtacgtgcggacaaccgtcaccgctgatctattgccgtaattgttgtaaactaatttggatgtattgaatatgctagttatatatgattaattacaatttttaacaatttaatatcatgcatatactaattatatatgattattagaatttttaaaagttttaaatcatgcatatgggatttacatatgttagttacaatttttaacaatttaatatcatgcatatgctaattatatacaattattagaatttttaaaagttttaaatcatgcatgtgggatttacatatgtttgttacaatttttaacaatttaatatcatgcatatgctaattatatataattattagaatttttaaaagttttaaatcaagcatgtgggatttacatatgttaattagaatttttaatgcattatttactattttagaaacacatatgcaacgaaattcaatattcagtgctattaactttagtcctgtttcttaaccctaaccaggtttaaaaaagaatttgaaaatagcgggaaaatatctttactcccggttgttgttacgaaccgggagtaaagatatctttactatctttactcccggttcttctcaccaaccgggagtaaagatccgggggtatatatattcccggtgcgccctcgtcttctccaccaacacttagacgtttttccatcgagatcgagcatcggcttctccttcgtcgccactgcctagcgctaccccgcgccgacgccgccgttgtctctcaccgtcgcctggtggtcctcgccacctccgccgcagacgccgtcgccgcgtctcttgggtgagagccctcgccctctctctctctttctcgatgtagctctctgtctctctctctttcgccgacggacaccgacgacgccgacgccgacgtatgccgccgggccgctacgttacgctgccgccgcgcccccatgccgccgggcccccatgccgccgccgcggcccg

SEQ ID NO: 86156 - DNA, 3070 bp, Oryza sativa
atatgatctatgaagtcactaatcatagcaggtattcatgtagcaatatagacaatagggtgaaaatgaaggtgtggttggttgaacatcatattgataagcatgtgggttgtacctaaggattttaaccgtggaacaaccttgcagtggctttagcaataaatcaagtcagttccatttaggaattaatgaccatgtcctttatttatttatttttattaaacttgctacagtacattgtaaagtcttgacgtagaacaatctaaaacatgtatttgttataagacaatacactttagtgatgattcgctaaatacattatgaccattacttcaaaatttcaggagagaaaatttagaacgtatacctttaccccatactaggttatgttttcttatattttcgtcccaaattgcaaagatcaaatcatttcaaggatgattaatagaatgaaactatccaaaagaaaaaaaataaaaatgggcataaaataaattgaaaattgaaaaaatattgctggattttaaatcaatacttgattgaaaaattcaaacattttacaaggatggttagaatgaaaaaatatatctataattttaaaatacaatcaaacaaaaaaaataatattattgaatttgttttgaggttgtaagatatccttttggcgagttaaaataccctaaattttatcataggaaccacctccattgtttcgacacaatagtttctcatcaattaaaaaccacatgatctcaagtaattttattttagaatttatatgttgcacgggtaattataaaaatataacaagctttcaaatcacacaaaataagtttaattttagtttagaacataatatatgatattttaataaaaagccacccgcatataaatattcataataaaatttcactcacattatacgagaaggtgcacgcgcatgtgcgcgggctaactttctagtttaattaaacttgaaacaatttaactttgacatattataacctgaaacggagggagtagtatataaaaaagaagtatcaccgttttttttcttagggtattagctgtagttgggatccacacccaacgttctgtaatcggattattctactcccgtaattgggccagctcagtcctaacatgaaatggacggtgagagcaaatttaagtagcttaataaggtgtaacagcacacccttataaaaacataatgattccaaacgtaagaatgcatagtaggaagcagttctctctgtaaagcgcaggtgtgtcgacgtttgatgtcgcggttctggtatttgcatggtatggggatcgtcggtgctagggtatacgcgagactaaggtaaaagagatgaagacatggatttttatacaggttcgggcccctgaattgtcaggtaataaccctacatcctgttggccaaagccggtattgctcttattcatgatattcacaccagtacaatatttggggtagcctatctaactgttgtcgacatggcggtctgacgatctgactcgtagtcgacaacagggtagccttcctccttgaatccgtgcccggcgagatcagagatagcgctttcatatctcctaacagtatccggagacaccgtaggggactagccgtgcttatctctgaagtcgatatccggcggcgtgtcttggcgtatgtaggcttctatgttgattgtgttgggtgttgatcctctgtgtatgttgattctcccgttgggcgctgatcccgttgggtgttgattgtcccccctcctcctatggggcttgtatttatacccatagttgtctccttgtccaagtagaactagggaaaccaatatggatacaatccgagtagtccttgtcattttcatgtagaactctggttgtctttccttatccggaactcccttgaggtcagtttccgtataagacatggtatgtggtggatcctgtcaagatttagtcaactactattaggtatgtggtatccataaccctgacaaggtggtagttggatgtccatcgagggacaaaaaaatccacggtcaaatttattatttttgtttcgaattgtataagtcgaattttaacttatatgtgtgtgaaaagatacatcatatattgatctatcttgataaatttttaaaatttttaataactttttgaacgtcatgcacaaaacgaggggatgtcgagggaaaaaatccatttccaaggttatatatacactctgaggagatattgccaaatcgatcggtaaaactttggtcgctggctcgctgcctgccagagaattccttgtagacttgccagccgtcatggactcatggtcctctgatcgatcatctcgtttgtcgatcgcctccttgccgtttttctcgtcgcttatcccttcttttccagcgcgccctctctgtctgcagttagcttcgacttcgaactagtggtacatgtacctggccccttagggcttagggtgaaattgatagtacgtttgaaactgtacgaggtgcaccaggagcgtgaaagttgtgttggactgtagggtggtgcatgcaccaggtggcaaagagtaatgacatggattctcaatgtctacatgaaggtaaaccacataaatactttaaatttaaatggtgtttgattacaacacgagaaaaaagtatgaaaacatgagctaccatcttttggttattttctctgaaattgccataggattgttcaccataagaatttcaaaggaaatgataggattcaattaatcctttatttcaaataatttcatagaaaatttttctatatattaattataaccttctaaatttctatgtcaatcctccaattaaaaggggcctcattttggaggataagaacataaggcttgttttctttttttctaaaattttgacaactttaatagtatcgatgccgctacgtttagatataccttttgggttgactttaaaaagagttgagtgtccggggacatgctaagagcatctctaacagcctcttcaaattggactctccaaacacccatatggccaactcgggctgcaggaat

SEQ ID NO: 86157 - DNA, 7876 bp, Oryza sativa
  unsure (1)..(7876): unsure at all n locations
agcttctaaacctagtagttggtctatttgtgtttttttacctgtaaaagtattttttttattttctcattaaatagaaaataacacatgaatgaaaatatggaaagacaagagggaagtacgtacagtacatacgcacgtacgttcgacattacgtacgttggttccgtatatgatggttccggatgttcttttttctttataaaatagatctaagtaaatccaaccatccaaaataatgggtgcactaatataagtaaaaatagatggtcagatttttcttattattatggtgccacttggcgatttgagagtggttccgtatatgatggttccggatgttcttttttctttataaaatagatctaagtaaatccaaccatccaaaataatgggtgcactaatataagtaaaaatagatggtcagatttttcttattattatggtgccacttggcgatttgagagtgtttagagggtgccacttggcggtttggaagcgtttataggaagtttaatggacttttagtatataatagatagatagatagattggcgatttgggagtgtttatagggtgccactttgcggtttgggagcgtttatgggaagtttaatggacttttagtatataatagatttaaagacaaatatagtaatatttagagtcacagagcgagagctgctagacctaataggtggaggtctctttgtgattttttaatgtaaaaataattttgattataatttctcaagaacatagcttgttggtatgtatgtgatgggaggttcggaatgtgtgcttttttaaaaaaaaatctaaccttctagtataaaaataatagatcactgatttaaataaaaatcaatggttggattagagtgccacttggcgacctaggagcgtttgtaatgtaccacttggcgaattaaaagtatttgtaagatatttaatgaaattttatatataattgtctttttttaaaaatttctaagattttctttaatttaagtatgtgatatagtagcttagaggtgtttataaaatgtttaatggattttaacaccacacaggggtggggagggagggagagaggtttggttttttttattaaaaaactaacaaatcgatagccaaatgttttgttcttttttaagattttctagcattttatttaatttaatagcaccacgtagtagtttagaggtatttgtagaatatttagagtcacagagtaagagttgctagacctaataggtggaggtctctttgtgatttttttaatgtaaaaataattttgattatgatttctcatgaacatagctcgttggtacgtacgtgacgggaggttcggaatgtgtgcttttttaaaaaaaaaatctaaccttctaatataaaaataatagatcaccgatttaaataaaaatcgatggttggattagagtgcacttgatgacctaggagcatttgtaaggtaccacttggcgaattagaagtatttgtaagatgtttaatgaacttttattatataattgtctttttttgaaatttgtaagattttatttaatttaagtatgtgacatagtagcttagagatgtttacaaaatgtttaatggattttaacactgcaaggggtggggagggagggagagaggtttgggatttttttattaaaaaatctaacaacttaaatacatcagtttaagtagaaatcgatggtacgttgctttgtattatttaagattttctaatactttctctaatttaatagtacacgtagcgatttagaaatagggagagcttctaaacctagtagttggtctatttgtgtttttttacctgtaaaagtattttttttattttctcattaaatagaaaataacacatgaatgaaaatatggaaagacaagagggaagtacgtacagtacatacgcacgtacgttcgacattacgtacgttggttccgtatatgatggttccggatgttcttttttctttataaaatagatctaagtaaatccaaccatccaaaaaataatgggtgcactaatataagtaaaaatagatggtcagatttttcttattattatggtgccacttggcgatttgagagtgtttagagggtgccacttggcggtttgggagcgtttataggaagtttaatggacttttagtatataatagatagatagatagatagatagatagattggcgatttgggagtgtttatagggtgccactttgcagtttgggagcgtttatgggaagtataatggacttttagtatataatagatttaaagacaaatatagtaatatttgcattaccaaattagttgtattaaattaataattaaatatatttttctaataaatttatattgggtcaaaaatattactattttttttctaaaaacttagttaaatttaaagcagtctgactttgatctgaaacggagggagtactagtatcttacttcaattgcgataggaaaaactaatagaaaaaaatatagaaattaaaatagtatacttatcaaatcctataagaataaaaaaaatacagtaaagagaacaggagtcctcctttgataatgcccagagagaaacaaaggaaagttcaaaaaaaaaaaagtcacacctcttgttatttatagtatgcaacattttctacagaaaataaattatctttaatgatgttctaaattacttatttgtagatgaaagaggtggtactttatagccgtatcaacatcatgagataaataatattgaccatccgctagtctgaaattgtcatatagtactacaagtacaatgacaaaatgttcacagctgtgaactacgctggttacaggtttacttcgatcaaatctaagaacgtgtcacggaaccaccgatggcgacactattgcgtaaactctagatcatcactcaacattaagcaatcaatcaaatctacccctttttacgtatacaaattccctccattagtgcatgacaaagtgataaagttgtacttatatttcatactcatttatttttgacgaggcagtttctctctctgtcgctgtaaattaaacgaggcttccacttgtaacgaaagcgagagggagagggaggaaggcccaaggcgacaacgtattcgagctggtgcccccccaataataccactccaattcgcaatttggaatcgaattagaatttttcggattagccgcatcgcatcgctcccctcgcctctccccttcaatccccccacgccaccacgtcgtcgctgatcggaaaccgatcggcgattcaccaaccgcctccgcgtcggcggtggccgccgccgctgccgtgcgggagcgggggattcccgtggcggttgcatgtatgcgggaggggagaagagaaccaatgggggattggatggtgagggagcgggagcgggaggggaaggaagaggggcgcttcgccggcggaggcagccgcccacctccggctcggccgcgtcgtcctcctacccgtccacctccggctcggccgggtcgtcttcatccggcaggagggtggaggaggaggagcaagggggcggcggcggcggaaggaaacaggggaggcggaggaaggcggtcgcgagggcgatccgggagaggctgcccgcggcggtggcctgctggggcaacggcgcggtggttgaggggatcgggggcaggagcgggaggaggagcccgagggagagaccgggcgatgacggtggcggcgaggacaacccgggcgccgccgcgagggctcccgcggcggcgtggtgcctgcgtgtgccccgacgaaaagtgcccgctggagggaaaccccagcgcccacggcaaggaggacccgggcctccgcgccctcctcgagaacaacgacttcttctccgacgactgcaacccgcacgccgccgccgccttccccgagcccggcgaccgctccaattaggtgccattgatcccattccatccaattacccatcatcatcaccacacacatttctgtacacagttttacagaaaaagaagaagaggatttttcttttgttttattccattcggagctgtgatgaggtgtctgattgcgtttcttgattcctttcccctgattcttcctgtactttctctgtcactggttgtatgtgtactactgtgatggcaggcgtggtcatgaagtggaatgaaatcaatggatcggcatggattttcttggttttgttctgtagccatttgtgcgttactgtgttccatgtcagaggttagtgtgctgcaggctgcagcactgatgactctgcattgattatctatgataacaagtgtcacaggcaatacttatcccaaaataaatttagtatagaatgaaacgatattagtccgatgaatttttatgggcacttatctaaatttgttataggtaatgtttcatcctattttaattggtttatattggaatagaagaagtacacatcatttttccactcttctgtgtttaaagctctagtccaattgtgatgcactgagccactgatgcctgtcattagaggggctcacaggtcagagcttggaatcaaggactgctactattcaaaaaaacccaaccaattttgaaataaaccaacttttatatataaatttaaacataaaccatgtcacgctggctgtataaagattaacatatttttttgggatagtaaagagtagtgagtgtatctgcgtatgtttcgtccgtgtgccgagaaagttggcaggtgtagtacaacacttgaaagagaggggcaccacaaagtgtggcaggtgactttggtagaggtgaaatgtggtggccttgtgcttgtcctctactagctagtaccaccaatctaccacgaaggattggaatgaagagtgcaacaaccgattgctttttctcctgaaggcgattgcagaccatccggtccggctgctcattttatcattttcctgacaaatcggcccctcactctctttctcgttgtcaggatttttgaccatatctttcctactacaggttgtcaagttcacttcttattagttcttccaaagtttgcttttggatcaccttgcgatggaaatagccaaagaggtctcttgtcgccacgagaagctcatgctgttgagactttttgatggggggtgcaagcgccacatcagcagaagaacaccacatattgctcatgaaaaaatcatgactatcagtcacgctttgtattattatacgtgtggtaaatcaaaattgtcgtccgagtatggctccaacaaaatacatctttggatcagtctgatttaatctgatagcgtagcttagctagatagaaagggaaggcatggaaaggtctttccatcacaagctgtagctcatgttgctgaaatggatggtgcaagcgccagatcagcaaagaagcagcaccacatagtcacgatcgaaatcgggcgtaaacataaaattggtactattcgctatatgtcattgtctggaaatatgaccactagtattaaaggctaaatgcgaggacgatgcggaaagctgtctcgatttttttccccatcacataaacaggacgtatcatgcatgaaatgcctttatcaaatgatatcagccagcgcaaatattgtgaattgtgtttgatggttaaatggcggcacctatcgacataataccagcacggtataaacctagaatatcgatcttatttcttctttcaaggaaagaaaatatatgtacttgtgtggattctacaactgaagtctcaaaattaattcaatggccttatatttaattagccaagagctttggcatataccatagcagattagcagatgcacatacaactgacgaggttaaactactccctcattaggtcttctgtaccaactataccaaacacaaattttgttgaccaacttctagcacaaacaagctataacctaagtaaatcaaagttaagtttttttttcaagaccgtagaccaaagttactcaatcctagatcatatattatttggtacaatcttaacattaattgttagacgcctaagagtactactccccccgtcccaaaatataagtatttttttatctcgacgcagttttcgagatgctactttgaccaataatatctataaaaataagatgttttgaataaaaagagcaataaatctagtaacatcaatgttacatgattgatttttttttatttttttgctattaataatcaaagtttaaaatgtttgacttgacactatggtaaaattgtttatattttgagacggagggagtaaaatatatttgctaagatagctggtaatgctaattatctagtgatggatgccttgagccctacaagttagtagtaagatgtttcttagttgaggactactattgtttaaccatactgtctaacgacgaaaagtgagcatcgactagttagatttcttatgatagaatcagacgtatcgatcaatagtgaggcgctccacagtgacttctttaatattaaaatatgttgtcgcagtcttttggagctgctcaaaaggtagagtatgctcgtgtgcgtttataggggtaaatgtatgcgtgttgtggtttcttaagaaaaaccattttttttaatttatgtaataaaatatttaaaaaatattttttggtttcaaagttttacaaatctacacttttaacgctctctgggagagctttattttttatgacatgacacatgcccattggtgtgttgtaacggccgcgtgaatattttacacatgaacccctttgcagccctctaagagggcgagaaggaggctgcctgtaaaaatagcgacctacgacattttgcaagtggctcccttacaaccagccctctaagaggatgataaggggctgcctattagaaaactagttttgaaggacgacaaatggtcagccccagttgttttgcaagcggtcccctttagccctttgggaatgcagcaaggggctgattgcaaaatggctagctggcctttatgtggatgttagaaaacgcacatgtgccatgtcaaaaaaaatgtcctttggaaaagcacattttgcaagtggccaccttacagtcagccctataggaggacgataagggacctacttattagaaaactaggtttgaaaggcaacaaatggccaaccccagttgttttgcaagcggtctcctttagccctttgggaatatggcaaagggttgactgcaaaatggctagctgatcttgatgtggatgttagaaaacgcacatgtgccatgtcaaaaaaaaagtcctttggaaaagcgtttttaaaaaacacccttttagaggatattaggggtaagatttgtaaaactttgaaaaaatattttttaaatatcttaataaataaaattataaattaagaaaaatttaaaaaaaaaacgtcgccatctaattacggtacaattttgctatatatttgtcgacaaattttcccacaaaaatttgacagatgtaattacagtacaatctagtataattacactgtaacttgcatgtaattacactgtaactataatgtaacttgtacgtaactttaaaaaatctctccataacatgttattttggtaaaatggaggtcgtgggaacaaattctttcacataggtgtgtgctatgattttttttcttcctcaccgaaataaatcttgtaatagatctaacgattcaaaactacgtgaaacttacatataagttacactgtagttacatgcaagttacagtgtaattacatactccctctgtttttaatagatgacgccgntgactttttctctcatgtttgaccattcgtcttattcaaaaattttatgc

SEQ ID NO: 86158 - DNA, 6522 bp, Oryza sativa
atctcgcggcgcgtggcgccctccgccgcgcggatctccgggatgcgtctcgtgcggaacagctcctcggcgtcggccggcgccgccgccggagactgccgcggcaggcatcgccgcctagaccttggagctcgcggcgagatccagaaaggaagcgatcgggattgaggaggaggtagggaggagactgtgtgtactaggagatgcacgttcgtttgagttgggtagaggaggtgactgagagcggtgggtgcaggtggaccgaggggtcgtcagagggtgggcccagtaagtcagagacccgacaaacagtacaccgggttctgggagtgatcttgtgagataattgttgcgagttgtggcccgtgggtttaggttgtatttaggggttgtttggttgatgcgtaagcttatcataactaagcttaggtaagttgtggcatgtggcaaaagtatggccaagaaatagttaatcacaagtgtggcaatgttagctctagttatctgaatatgacatgtgggacctaagggtaggaaagtgtggcatgacacaattgtggcattaaaacaaacacacgcctagaaactgtggcatgactgaagtgtggcatggcaaagtgaagcaatcaaccaaacacccccttaacgttaaaattggaagtttgattgaaattagaacgatgtaacggaaaagttaaaagtttatgtatgtatgaaagtttttatgtgatgaagaagtttgaagtttgaagaaatattttggaactaaacacggcgttagcaaagttgctaaatgtccatattttcttggcttaaattaaacaaatctagaacaagatgtatcacgtcccatattatatttgtttattttttaggatggaggtacatagttagactgttgtgaatgcttgatgcatagtagtccataggtctatttgaaatattcttgtaatgttgatagtttaagtcactttggttgacaacttaagacttaagcaccttcattgttaagtgatacctctgcatgatcattatctacatactcagtggtagaagaagtagtagtacatggtatccatgcaatacttgcattaggcagttgtgcttgacagccttgactcatgcatggggggtgacaaatagacaaagcatgtcctaaccagaaaaaagcctgattcacttctgactaagcccaggtcaaaactcttattgggcccagtctgaggtctaatcaaccaaacgatgccggccttgtcaagtggggataaaatatgaaatggccatgtgtcttatttacttttttttattatcacaggttatttgctttatacttctaataaaaatatgctttattaaaaatattttatatagtgtatttgtttagaccacttattctaatctatttgtgagtttcatttctaaataaaatataaatgtttcgtgttaatgaagtggacaatccatctgaataatctgcgcaaaaaattgtttcaaacatggcccaccaaacaactaaacaagacccgtatatggcaatgttaactaaacaagtccaatagtttgcatggcaatgtttgccgcatagtatgattgcaagtctgtaaccttgcattgaacgaatattactcctggtcagacaaaataaagatcaattgccgttatatcgtctattgtctatacagtagttctttttttttttagaaaagtttatatgctgtgtttgatacaggagttcccaactcctccctttcgttttccgcacgcacgcttttcaaattagtaaacggtgtgttttttttcaaaaatattatatacgaaagttgcttaaaaaaatcatatatatacaattttttttaaaaaagctaatatttaaataattaggcactaatagatcgctccgttttccgtgtgtgtgatgggttcccaacacccaccaccgaacacacccatatagcagttggtatgcataggataggaaatgcttggtaggtcaaatatcattggtcctttaggctgagttctttccttgaggttcctaactcacctcattctttttcacgcatacatatcccaaagcagtatagaatctgtctactcccttcgtctcgaaaaaaacgaatctagtactggatatgacatattctagtacaacgaatctggacagaggtatgtctagattcattgtattaggatatgtcacatccagtattaggttggtttttcatggacaaagggagtacatgatttttaattaaataagacaatagtacgatgaatcatgaaatcaagcaaatcaaatcatagtataataaaatgctaaaaagggaatgtctgagcttgtaaaatagagataaacaagtgactatggggtaggcatgaaaacggatcggaaacggacggaaactagctttatcatattcgttttcatattttttttcggaatcagaatcggaatcgaaaactcggatacggaaatgaaatcgaatattatcgaatatagatacggagcgaatatgagacggaacgaatacggtaacgaatatttaccggtatataaaaaacccctcaaattgagtttcttgatcaaggaagagatatctcttattattttagttcaacatctccaacatttatatcgtcaattttgtagacggtctcacacccgtatgtgaaaatcgattttcatggctattcctctaagagatccatatgcaaatatgattatcattttctattccccaagaccttttactagatatataacttatttaccctttataaattggagatgttatttattttacttcacatcttcgaaacttgtaatatttgttttatactttaaatgctttcaaatacaaatgttataaactacaaagtagtagatcccgttgagctctataactttgatatggaacacatctccatcagatgtcgtttgaattgtagatctgagattttgtaaaaattaatatggtatattataatgaatatttagacccttaaatgacctcaaataataaaatagtcaataagaaagttgtagatctcatcgagctctacaatgttgatataaagtttgtcttcatctgatttcgtatgaaaaagttatttatatatatatatatacacttattttttctaaaatttgctcaatgtgtgcggatatccgaaaaaaaatacggatagtttccgaccgttttccgattccgacggatagtacccttaccgtattcgttttcgtttccgagaaaaaaaatccgaattcgtttccgaatccgagaatttccggatagttccgaccgaaactgtccgaatccgaaaaaaggtccgggcggacggaaactatccgaaccagtttcaaccctactatggggtgcttagatccagggtataaagttttggcatgtcacattagatatacggatacacatttgaagtatcaaacgttgtctaataacaaaacaaattatagaatccgcatgtaaactatgagacgaatttattaagcctaattaatccgtcattagcgaatgtttgctgtagcaccatatttgtcaaatcatggagcaattaagcttagaagatttgtctcgcaaattagtcgtaatatgggcaattagttattttttagcctatatttaatacttcatgcaggtgttcaaacgttccatatgacagggtgaaaaaatttggggtgggatttaaaccagtgttgtggaagacggtatacggatatcggacggagagggtaccgccaaacgattaatcggaatttggcggaaatataacgttttgaaaatatatgtacatagttgataatagttttccctttttgataaacaaatgcatataactaaatatattccttctatatatccttaaatagaataaccatgtatgacatttaaataagttcataatggatagctgttactgtatatctcaattctcacgtagtaatgggttttgttcataatgcttgaaatgataatcaagagaatgttacatagcatagatgaccgtaatcaaggtcccaaataacatatgtatcggttacctcgaagagcttcatcaaatacaaactccaataacgtgattatcatcaaaatcaaggaacccatgttcaaactttagaggaagtcagttccttgtcattttacatcttgttgccttgtgaaaatttcggaagagcttgtagtcagtagtagtaaagggcacagctaacaaccatcatcacgccgacgattatacggttgattagacggagatggacgatttaatcggtaatgatcggatttatgcgttcgttaccgactaattatgaccgcatcgacgtgatgtgacggtctgatctccgtattcgtattatcggacgtattaacggccattaacaccgttttccacaacactgatttaaacaaggcctatgggggtgtttagatcccatcctaaaattttacacctcatcacattgaacgtttgaacacctgtatgaagtattaaatataggataaaaaataactaattgcacggtttgtgactaatttgcgagacaaattttttaagcctaattgtttcatgatttgacaatgtggtgctacagtaaacatttgctaatgacggattaattagacttaataaattcgtctctcattttatactgatggattatgtaattagttttattattagactacgtttaatatttcaaatgtgtgtccgtataaaaaaaattgggcgtgaaactaaacacggccaattttcataaatcaacaagctcaagttgcatcatctgacacgcttctttgtcctggccaatttaagagctaatttccagttcattaagtgcttcgcctgtgactgcaccaaagaaaatcaacaagaaacagcaataattgcatttttcaatcaacaagaacaagtcatgattgtcagtaactagcacaaagaaagacaggcgtttaaagcaagaaacaattactagtatccaggttgctttcgtcgaatatattattattgaagttaaaatccagacggactttttctatcataaacgcaaaaccccaatatcatgtaccataaaatgccgcttatggcaagaacacgctgaacacaatttcttggctgcgtatcttctgccactaaaatgttgagccaagcttgcaattcactcaatcaacgagcatttgttttgaaagtactgttcactaccaacttgacagaattccaccacaataaaagaaaactaagctgtggaattatctaatagtaccataatagttttgctgtcattttaaaggatgggttgcgcacaaacacagattcagctcaacacaattcacaaacttatttctattgaattgccatgatttgtttaattaactgatatataactttgacaacaatgtacaaaacaactgatatcaatagtcttccatgcatcacactgtcatcaaggcgacaaggcatgcctcctgaatttagctctagaccctaccgaaacaagaaaggtacaaaaacaataattccctagatcttaaaaatggcaagcattgcattcatacatatggtcacatgtaaaaacacaaggtgatgaattgccagtgtagagaagttacctgtaatattcctcagatacctgcaaatctcactggtgcataaggtgaccatgcaaacggagttctgcggctggacatcaagcttggttaatccttgcagcgtcctcttcctcacatcaatagcaaacaccaaatgcaacttgtccatgggactgggactggttctagaaagcaagaaaacaacatcatcatccatgcttatggtggggtttaccattggaagttccttgaacatttccacgatctcgctgaagctcaagttagaacgacatgggttgctggcacccaaggtgatgtctttaacaccaacctcacagtcacggtgccagtgctcgcacgaagaaccaatcaccggcattggcatgctccatgttgtggccttccagtcgtcacggattacctgggatttccttgtgttattgagcacgcaatccacataagaaacaggagtgctggtggtattcatcggctcttttggtgaccacatttccatctcaatatacttgatagagtctctgtttcggctgatggtcacatcccggaaatagctggggtcatattgtatcaggaagagatccctgttgctcctcgctgggcacggcagagggatgtcccggagcgcagggaactcatcgagcacgtcgcagaggaagatgccacgccagaggtccacccaggcgacggtgccaccctcgccgccgaccgtgatggtcttccctgtctcgtggtacagcctgtcgacagaggcaggtatagggataaacttgtctctgatgaactcggtcaccgataaccgcttggaggtccaacctttggaactggaggtggatctgtagaggtggaggtagaaatcccagctaacgggcgcaccgcctttgtacaccgggggggctgcaggaat

SEQ ID NO: 86159 - DNA, 1651 bp, Oryza sativa
tgctcgtgtgtttgtacagagtgtatagttgttagaactcaaaaggaaagacaattatacaagtttgtgcattactctctagtagtctgtacagttgttatatttcattcggaagtacgtgcattggtgaatcataccataagaatagcaatcgtgtatactccggccattaaaatgccgtcaaaattcagttcatgcatatacacaagctatatatcaccgcgagaaagaataatactataagagagtgtaactaattctagctgtcagtccattgtgatccggcctggccctcccttcagtgagcggtacaaaggtctggatcgcttgaagccgaatatgtcagtgattcggtaagttttgggtgtatcagcttcagcaatggccttcttgaactctgccaaatgttcgccgccgaagacttgcacgcttacagttttcctttgaggggcaccaagtcttatatgctgatcaaaaaattcgatgaattcttctttcttcagctctcttagaagagctacctgcagaacagttaaatgcacaactctatcatatgcttcctgtaaataaattttaccaagtttaatctgttcttgattttttttttgttaaccaataacttgttttcattaattcgatacattttttccaacaattaactgtttgctgaaaacagagcactaacctcagactcgaccctgtcaaacttgagagttcctgcctcaatctctccccaatagaagtgggattcctcccacaaatttttgaatttctccagtttcgaatcgacaagtgattttacattcctctacaaaaagaatgccatatgtcaataccccagccgcattgatgtgtaaagaaccacctagtagtaatgtgctccaactgagtacatctagtgatcaaaatactatagagcatactatatcactgctcttttatcgattacaacccctccagatattgtatacaattgtgcatgtggaagtttaccgcacagaaatgaatgtttaaaagaacatgtgagcacttaaggaagataaaagaaaggaagtttcatgaaagtttggaaatcttgaaaactcgattcaacgaggctacaaaccttaaaatccttgtctgacaattcatgaattttgctttcaaacatcttgaagaattcatcaatcctagcatcaagatgtgaaggatcctaggcattcaacataagatcagttagagaaagcagtaaacaacaatcatactactatcaattactctagccttgaacctgtacctttactgtggactgaataacaacctcgagtgcccagactccacaatcagatctgatgaacgaggatattcattgtaagctaggatttaaatggtcaacctcataggaaatatttatgtatctcctaatatggcaaagtaagaagcaacaagtctaaggcaaacctctgccgctcaccttaaagaaagacctgctatatagccaagctgctcaacagttcgcagctggttgaaggcaggctggctcgcaattaaagcaaacagttgaagtttgatatttgaaagggcatcgtccagatgaacctgaatataaacatgcttagcatcctcacatgcttttttctacataacatcaacattttttacttttcaaact

SEQ ID NO: 86160 - DNA, 655 bp, Oryza sativa
aaaaattttgaatgtaatatcgaacgtttgaccgaatattggaaggggttttcgaacacgaatgaaaaacctaaattcataactcgcctggaaccgcgagacaaatttattaagcctaattaatccatcattagcacatgtaaattattgtgccacaaatggctaataagggactaattaggctcaaaagatttgtctcgagattttcatgcaaactatgcaattagtttttcattttatctatatttaatgctccatgcatatgtccaaagattcgatgtgacgtgtttgggaaaaaaaattggaaactaaacaaggccttaagaagccagaacctatacgtgagtacaccaccgacgatagatggaagtatttcaatgcaacccattctaaaaaataaatcacatttcctttcaaaaaaaatcacatctcacccatattaatagctgtttcttgtgtgaatgtgttgtccgctcacgattcctcgcaacagtccatcggatagcatacagtgtaaagcctctgtcgcatactgagtgaaagaactctcttggtctgcgttgcgctccctggccgcttaccagtcaggtgtctggtcgtcccatatgcatttatttatcggccaacgcacttggaaaggctgtttgcgtattgg

SEQ ID NO: 86161 - DNA, 826 bp, Oryza sativa
caagggatttgggatcatcctcagcatcaacagctgtcctgtttccacaggtaaaattaaaatctatgaaatgcaacagagagaaatccattaatgtttgcaatacaggatcatagtcatagcgccctatttcttgaaatttttgtatgagaaagaatggaatactgaccagcttatgtacaagcaagtttgttagcaacacaagagtgattaggcgcctttatgttgcagtgatctctggacaaatggatggtcaacagctgagcagcagatggccgatcatttggatttacttttacacacttaattatgaaatcacgagcatcttctgacagtgtagctggaatttctggtggtattcctctaccaattttaagcaaagcatgcgtctacatagcagaagaaaagactgcatcacggacagtaataatacaaattcccggataataagaaaattaacacagcaacatacagtggatttgctgtttgcagttctgatagaaatgtttaattttcctactgacatttttaaatccaatactacccaaattttcctgatgaaactaatgtttgattttcccaaaaagatatacttcatacgtactgatgtaagcaaacaagtcatcaacatgaagaagttgtcatcaatgtttttgctcctttaattaaatagcgtgcagcccgcgtatatcagtgcatttggtatttaaaaatgggatgctgttactggaaagtaagacaagagatatactcacccattccatatcagggtatggaactttgccagtcagcatttctaaaactgtgcagccaagactccatatat

SEQ ID NO: 86162 - DNA, 1265 bp, Oryza sativa
aaaaatggagcagtgaaggttggagattttggactggcaaaggaaggtcacttcatttttggtttcagtgtccttttttcccctggtttgactgacagattattaaatgattttgtttgatattgacgatgtgaattctcaacccttttaattgatgtaatgccagataaaagtttggaagcagaaaagatcttgtaccggaagtgtatattggatggctccagaggtaattgtttgacttagtatttatacatagagttttgctcccatccagcaggtaccatcgggactgtccggtaccaaatctcagccatttaatcagcgaaatcggacggtggaaaataagtggtacctccaggtacaaatttgcccatgaggaggtgctaaaaaatttcgagtggtggaagggtaaatttgttttttcgcgtaggagtgtccagggaggcagtggcgagttgcttcgtgcttcgtcggcggcggcgagttgcttcgtcggtgacgacttgcttcgtgggaggaggcggcgtggcggcggctgatccgtttgaggctgcggcgtctgatccgtttgaggcggaggtggcggcgacggcggtggcggcaggtggttcgttgcggcgaggttgtgttgggcgcagtggtggcgggcgcggcagtggcctggtgctgctggtggcgggcgcggcggtggcctggtggtggccacggtcacgaggtagcggcggcggctggtgtgtgggcagccttggctgcgaggtggcgacgggcgcgatggtgccggccgtggtgatgaggtggtcgtcggagccggtgttgtggcggctgcagcgacgagatggtcatggagtcgtcttagcaggcgatgtggcagtgtatacatcgatttcttttcatccgatctaaatcattaggttcggttggttgcagcagtagatactttcattttctgggctgcatatactcttcttcttcattgcttataggatttgtattgtacgatttattggatgttttgatgagctcaaccattacttgttctttgtgaatgttcaaatggccaataccctcccatatcatttactgattactcattcgagtaagggcgtgaatgaagccgctggtgaaggagctcgctggttccgccgccgcggatggcagatgcggggcgagcaagcgagcgcacaggcgggggcatggatgcggggtgagcatgcgcgcggctcaggtgggcttcgcacgggtggggctgcgctcggagggaggaa

SEQ ID NO: 86163 - DNA, 610 bp, Oryza sativa
tattcattattttgatttgagaaatccaagtgcgcctgtccatgtttttggtgggcacaagacagctgtttcttatgtgaagttcctgtccaccaatgagcttgcgtctgcatcaactgatagcacattacggttatgggatgtcaaagaaaattgccctgtatgtgtcattgagatttttcttgcactgcaattatgaaattatgtttttgccttttaagcagctatgacttattagtaaaaagtgatgttttaggatatactctatttcatatcgataaaaattggagctatagtgtttctttatttcctgggaaaaaactatttgagaagcttcgcttttttttcgaagaattctggtccttgaaaaacctttggttaggtccgaaattcttggataagcatttgttttcacctttgtttcttttttagctcatctattagtctggcttggtttagtagttacgtcatgctaggcttctcagaaaacagattgttgaccttttgtttaaaatggttacctttttcaggtaaggacattcagagggccaagaatgaaaagaactttgttgggctgtctgtaaataacgagtacattgcctgcgggagt

SEQ ID NO: 86164 - DNA, 532 bp, Oryza sativa
tgagggcggagtacggcatcgcggcgcggatggagcactacggctgcgtggtcgacctgctcggccggtcggggcagctcgaggaggcgatgcgggtggtgaccaccatgccgatgcggccaaacgaggtggtgctcggcgccctcctcgccggctgccggatgcacggggacgtcggcatggccgagcagctgatgcagcacctgctcgagctggaccccggcggcgacgccaactacgtgctgctgtcgaacatctacgccgccgtcggcaagtgggacggcgccgggaaggtccggagcctgatgaaggcgcgggggctgaggaagaggccgggctacagcgccgtggagatcgacggcgacgtgcacgagttcgtctccggcgatcggtcgcatccacaggcggaggagatatctcagatgcttgggttgctcatgcatgagatggcagggcatgattatgaccatgtaatcgattgcttggatgggggatgaattcagaccctggagactggagaatgcagaagact

SEQ ID NO: 86165 - DNA, 1501 bp, Oryza sativa
ttatgcgcttgtacgaataaatataggttcctaaccaaaacagacagacataaataccactgcggtaaggagcaaatctataagcctcctgaggagttcagcatgtcttgtgtcctccatttgcgtcctaaatttttcctctctgaaagaagctttctgaaatcccatagaattttgatcttctctagcatgtgtgagtatgagctgagagctatctgagattgcttcaattgcaatttcctcatgtttagtcctatttcaagttccttgagctcatttgaacgagtctgctcattcagagatctctcaaatacattaagaatgtgcctatcaaattctggactagctttattatgaggtagtttaaccaactgctgatcggtgcccgcatgaagaatgatttgattatccattgaacttaacgatgtactctcctggatatcatgtaccggcctttttgaatcagcaccactcaatttgatttcagcagcagaagtaccatcttcgtgagaaaaccgagagttatcttgctcatagacaggtgtctcattaattaaatgaagtgtcctcaatgtacttccaaatgatttctcaaagtttttcgtgaagttgtcgaatctatcaccatatatctgcagaataacgtaagtcagatatgtaaaaaaacctgtctaagtgtaatcacagacaaggaaatgaaccattcatacatttgtcaaggactctttcactgctgacgtgcacatctgcatcaagattcagagttagcatacctgaagttctgttatagtccatggccatcatttgtagaaaggctaattacatgaactgtgtacctttgaaaggaaatcaggttgtaatcttccttcagagcaactgcttctattaaggacctgaaacaggataaggtcagttcttgttaattacgagtaagaaaaggttaaaccatacaagctgaatccatgcttcagaaccacagttctctactggagagcccaagaaattcatttgattcatttttgtaaataaacaacttcattttaatttggcttggatgtatttcatcatcctaatggcgagacgatcatccagagaacagaaggattacatatctgagcctacgcttcaaaacacacgcttctgttcattagtgccgtcccatgtaaatttgcttaattcaatttggttatataaacgactttagttgaatttagatgcaatgtgaaaagacgcccaaaatgagttccggagcaaaagaatatctctacttctccatcctaaattcataatccaatgaccgtcccagcaaggcaagaattgggtgaaccacatgaggagggtaaaaaccgaacctttccgccgcgactaaacaagaaaccagtcaagaatcgaagcgaacgcgcacctgggcaagaaccgccgcgaaggacatcccgagaggcagcgcgaggtcctgcgcgccgtcggcggcgcccctcccatcccctccagtcgcaagcag

SEQ ID NO: 86166 - DNA, 1312 bp, Oryza sativa
ggaggatctcttccattctgcactatacaacaaaacctggtaaataaatgacaatagttcatatatagtatcaacacttttgattgtttttttttcatcacatgttgttcattgcttataggtgtatcaacttggaccaaaaatgcaagtggcttggatacctacagagttcaaatggctggctttaaagcctcactcaaagggtctggccaaatccgcagcgagaaagtcaaaccaagaattgtgagttggttcctgaatagttctcagcatcacattttatagatccttgctgcatttaagtgagagtcaagttaataagtcaagtcaagagtctttaagtagtaagccattagttgaattatttccttatcttaagcttagtgtgtgtagttcagtgatcctaccaagaaaccatacttactttctcatttttatagaatatttactgccaagtttatcacgaagaacgtggtgaggagcataacctgtgagcagtgagttagatgggaatgtggtatataaagcttttggtggactgaaacatggacggtttgcaatgggcaacggagttttcaagaaaactgaagttcttgctgctgttaaacataagaaatctggaatatctggatctacgaattcttacaatgctgtagtgcgtgagaatgcacaacttcgccatgaagtgactgaacagcgtggaatgatacgtgaacagcgtggaatgatacaagaacatcgtggaatgctaaaggtaataactactaaattaatctctgattcatttattttttttcccctcacagaaaaatccaattagcaaatttaacttgcatgcctataggcagtatatgagaagcttggaatggacatacctgaggaggtactttcaaggtgggagtcacaaagagaggtacatttgctttgacaaatgtataatttgttgtttcaatgatttattgtagtagagcgtgaaactgatgtctttactgttagtgaacaatggttgctcacaatgcatggatggatgattgaatgctaatataaagtctgcaagatacatttcatttatttatttccagtattttcatacatagcatggcatgttttctaaatggtttacctagcatacatatatactgcaatatctccatttttcttcaatttgttgtctagcatgccctcttttgtatccacaagactctggaattaagttcttttgccggcacaatgttcccttaacaaaaccagtccaatctccaattattaatcttttagcatgcttcaatatgactatggcctataagcaata

SEQ ID NO: 86167 - DNA, 503 bp, Oryza sativa
cattgatcacctaggatagaacagaattaacaacgtgcactgacgagtttggatccattagcagatgatttctgtagggtggtgccaaatggcgtgtttcctcacctcactgacggatttgtcgccgagttgggatggattgacgaaatcagtcacaccgaactcttttcctgcaaaaagtagaggtttcttcagttgtgagaaaatgcaaagattcttcttcactgcgtgttatacacaggaaaaataatttggacttgccaacttcctctttgttaggattcaaatcaacaccgataatcttcgttgctccacacatttttgccccttgcactacctggaaaaaaaagtcaaaatatttgcagcggtcgtcaactcatcatgtatccgagtaagaaattacactgcttcacctctagcttaccgccaatccgacggatcccagcccgaagacaaccaccgacgaaccgggttgcactttggccaacctccatgctgctcct

SEQ ID NO: 86168 - DNA, 593 bp, Oryza sativa
ctcgatcgattgattctcgatccatggacaccttcgacacgcccctcttcactgggttccagatcccaattaaatgtattcaagtagaggattaattaattccaatacaaatctcgaaagtctttgtgatttatatgaggtttctttgtgagcactgagcagtgacgagtgacgacgacgcatggttaatcaacaataaacagtgccacatccttaagcaataggaggagattggactacttcttttgtagctagagataatttccatatacagtaccaacatccgaaaccacttttgggagtcatacaaaagttttcaatatttaggacactaaatgcagagtaaacatacttcttccggtttcattttaattgacattttagacaatgacacggtctacaaaatatatctttgaccttatttttctattataatatatgcaataattaaatgcatgcttacttttattatagtgttttgacagacaaatctatatatgttgttatagtttctttaaactaaatatttttaaagttattgatggtcaaagttataaaagtttgaccttaagcttatccaaaacgtcaattat

SEQ ID NO: 86169 - DNA, 954 bp, Oryza sativa
cttgcttacactccagtggcgggtggaggagatgccattcccgctccccggcgatcttctccggcggatcgaggcggcggcggtgaactccggcgcgtccgggttgaggcgctccgagacgacgacgacgagctcctccggcgcgccgtcgtggccgtcgccgtagccgtagccgtagccggtgagaccatcaacgcctcgccagaacccctcgtagacgaactccggcgcgtccgcggagagcttcgtcctcctggcggcgtcgcgtcgtcggcggcggcggcgtggcggtgccaccgcggcacgaactccttcgcgttcgggttgaggctgcgccccgccgccgccaccaccaccctcgaagtcctcgcctcctccgctcccatcacctccatacggtctccgactctccgtccggctgcggctgcggcggcggcgatcggcggcggcgacgaggtcgagagcgcgagatcgcgaggagggggaggggagaagagttggtagatttggcactacgacgatgtgaacgcggcgtgctttatatgctacaaccgcaagcgcgagcgcctcaccctcagtgacgccctgcgccgccaccggtggccacgcacgccacactcaccgacaggtggggtacgcgaggatgtgggccccactgtcagcgaccgcggtgggtcggtgagccggtcgggaggtccaccggtcggcgagaggaagagttccgtctctctgtttggcacgcgacagctgtggaggaggggtgtgggggcggggtgagttgctgacgtgtggccccacgggtggcgtgggccagggcggtcagcgagaggcgcgggtcgggtcgcgtgtgcggtctccgaggtcaggaagtccatctgactaggtcaatgacactcggggccaaccaggggggtgggggccccttatgtcagtgatgacgcgagcgctctttac

SEQ ID NO: 86170 - DNA, 713 bp, Oryza sativa
ttccccgacaggcggccgtaagccgcgcaaggcgcggggaggtgtccagctacggtgggcgcgaagacgtgccgagggtggcgcccgcagaggcgcccagggcgttgccaccggcaaccacaagccggcacgagacgacacctgccgcaactgtggcaagcttggccattgggccaaagactgtcgacagccacgacgcggccaggcccacgtcgcacgggtggaggaggaagagccggctctgctcctagctcacgcaagcatcgagctacctccagcggcaccggccgcagcggctttcctccaccttgatgagccgaaggtactcgtctccctctgcgacggctccagcaacgacaaggctgatgggtggtacctcgacaccggcgccacccatcacatgaccggccgacgggagttcttcaccgagttcgactccagcgtccgaggcaccgtcaagttcggggacgcctccggcgtggagatcaagggtgttggctccgtcaccttcaccgccaagtccggtgagcacaggctgctcaccggagtctactacatccccgcgttgaggaattctatcatcagcgtgggacagctggatgagaacggctcacgcgtgttggtcgaggacggactcatgacgattcgggatcgccgtcgtcgccttcttgccaaggtaaccagaggcactaatcgactctacatcctcagcg

SEQ ID NO: 86171 - DNA, 1685 bp, Oryza sativa
ccccatgatgaggttgtactggaatccctgcagcctcacaactacatccgacaactcgtaataagtggttttagaggattgaacttctgttcatggctaggagaccggtccttgtttagtttacaagaactggagctgtgcaagtgctactacactgatcatctaccaccacttggacaattgccaaacctgaagcagctcaagctgacgagcctgtggaaattgagaagcatagggcctgagttctacggcgattgcgaggccccatttcagtgtcttgagacattggtggtacagaacctggttgcatgggaggaatggtggctacctgaaaaccatccacattgtgtcttccctctccttcgtacgatcgacatcaggggctcacacaagcttgtgcgccttccactgtcaaatctccatgcccttgcagggatcaccgtatcatcgtgcagcaagttagagaccatagttgggctcaggagcgctgtgaagtgactgctgggaacggtggattgcaagcaggtcagactaacgtgcttccctcccttcgaagggtaaagatcactgcttgcccttcactggaggagcctctgatatcgatgcttcgccggcagacggagatcggcttctcctactgggaacaaagccccagcacctctcccaccgacatcgctgattttggcaagactccatggaaagattctggcaaggatagtacctcatgtggatgtggatttctgtttggtaccagatgctcctcttcatggcacacaccatcctatgcatgtaatgtaggaataagtcttggctggttgtccttggtcttgtggtgccttttttcctgtttttcagctttctaggacagcatctttactttcagtttggatgctctaggacagttaggacagcagtttgttgagatgctctaggacagtttgttgggatgctctgctctaggacagtttgttgggatgctgacagcaccctcttagactagcatggctgcatggctgctacaagcagctataaatatgtatccaatcctctttgggaggatatggcttttgtgtttagtgaatgaagaaaaccagaaaattgccccatctcgagtgccatcctcttctcaatgagagtaaccattgaaattctaacatctggtatcagagccacactttcctgtaggctaaacatctcttgttccaccccttcccaagctcggttgagctctcagccaccaccagcagcagcaacaccggctgctcctccttcccctttcccttccccctctccacgcagcagccccccggaggtgcgccatgtccgacgttcggtctcggcgttcggtcgcctcgagcactcggcgtcagcaggacgccgagctcgccgcagcagaagagcgcaggcgagcaacggctcagaccgctgcagcagcagcgagggcggccagactggcggcagcagagttggcagcagccagggcggaggcagaagcagaggcggcggaagatgcggcacgtgcggcggaggtagaggttgagaccttgcgcagcagcatcaacggctccatcgccggcgacatcaccgctgacagggagcttgaggagctggcaagaggaagggcacgggagcgagcagagcggtgggcagcagcccacctccacggcggcggcggcggcccaagg

SEQ ID NO: 86172 - DNA, 671 bp, Oryza sativa
ccggctggggtggtgtcgacgacgagctcgtcgtagtcgaagtcgtggcccgagggtgtgttggtgttggagtcggtggaggctcggggactggggtagacacgctcggtgaagaagagctgcctactcccccagctccctcgaagtggacgtactcgatggtgaagtcgtcgtacgtcggagtcgaaccatcatccaccgccttgtcccatacccaccctcgcccttcgtcgaacacaacatcgcgcgtaatgcgcacacgctgtgtctccgggtcgaggatgcggtaggccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccgtctggttgcgccgctcgacgacgccgttctgctgtgggctgtacggcgcggtgtagtggcgctgaatgccctcatcagcgcagtacgacgcgaactcagcc

SEQ ID NO: 86173 - DNA, 1476 bp, Oryza sativa
gatagcccgagtcaacaaggtaaaatttccctgttagcataaacataaaccatgagacattattttataattgatgctagttcgacgagactattaaacggataagagaagttaccaggtggtggatgagggaagatagcggcatatttgcgcaaagcatcattgaacaccctcatatcatgtgccgatccaggccaccccgcaacaattaatgcaaacctcatgtcaaagtcacaaatggccaagccattttgcgtcggatatttatttctacccacatgttgaaccacctttgatgcgggcacaactactggtatatgtgtcccatctattgcacctatgcaattgttgaaatggggctcaaaccgatcatcaagtagtcttgggtgaatagttgtgaagtttgggtctctaggtttgacaagatcttttgaaaggagatagatactctgcaacacttcattgaattttctactaatttttccttttgacctctcaaatcggttcttaacttgaacaaatgattgtggagccccaatggtccacaaaaacatttctaaagcttcaactgaatccatcttactagttgacttcagaccataagatgagaccaacaaattatgtaacctctcaaagagtggcctactcattctaaacatgtcataacaatcttgtggaacttcaaggtttctcataacccaagcatgacccgctaaattagcttttctatacttggacttgttcaaataattttcagcgtagaacataccaaatgatgtcaacaccggtccaaattttctcatcatatctagttgtctgctagcaacaataatagtttcatcctcctcctcatcgtcatcatcacttccatacatgcccatctacaaacaatgcaacaaatgatatcacctcaatagtcacagaaagaccatgttgatggatcactaaacagtagttcatccaatcaaaattaaggcgccatattacatggccaggcagtacataagttcatgcgaataaataagtagcaatcttgctaatacatattgtctgacaaagtaaaaacagagataactagttcatgcatataaataattagcaattttctactgctgcccttccttctcgcaccatctctgcaaccaagagagccttcccaccttggtggtaagagtcttgaacatatcacgatgttcagctttcacaaataatcttgtagccatgaaatgctccgcacttccttctgctgccccgcaatccaccaccaaatccatcacctccttaatggaattgaacctaaattcaccttgcatcaccttgttggcaatatcacaattggtatccatagtggtttgaatattcctcattatcctaaccatggggttcttaaccttcttgtatggactagtggcggtgctggaagaccctcgcttcactggttttttacccaatgagcaatctactggtgtgtcgcca

SEQ ID NO: 86174 - DNA, 716 bp, Oryza sativa
ttgattgtttgtagctccttacctttcaagtggaaacatccaacggaattgcacaggaccaccaagtcgagcctcataaggtaaatgcatcatcaaatgttgcatggagttgaaaaaaccaggaggaaatatcttctccaatttgcagatcagaataggtatgttctgttccaacctatatacattttccttattaagctctctggcacataattgtctataaaagaagcttaactccgccaaagtcacccatatactctcaggaaggaagccacggaatgctgcaggtagcaaacgctccataaatatgtgataatcatggcttttcatgccaaaaatctttttctgtgccaaattcaccccacggctaatattggctgcatatccatcagggaatttcagttctttaaaccacttgagaatggtgaccttatcattcttatcaatacaataagatgcctttggcttatgccacttgccattagcttttagttccaaatgcagccatggtcgatggcaaatctcctctaaatcttgtcttgccttcacattgtcattggtcttatcagcgatgtcaaagcaagtattccaaatagcttcagcaacatttttctcattgtgcatgacatcaatattgtggcgaagcatcaatttgctgaagtaaggaagtctccaaaaacatgatatatgtctccaattgtgctttttcccataat

SEQ ID NO: 86175 - DNA, 698 bp, Oryza sativa
ccgagaaacacgcggcatggcgtgccgcgatgcagtcggagatggacgcggttcaggagaaccgcacctgggagcttgctgacctccctcgtggtcaccgcgcgatcacccttaagtgggtgttcaagctgaagagggatgaagccggagccatcgtcaagcacaaggctcgcttggtggcacgcggtttcgtgcagcaggaggggatcgactacgacaatgccttcgctcccgtggcacggatggagtccgtgcgactccttcttgcgctggctgctcaggaaggctggggcgtccatcacatggacgtcaagtcggcgtttctaaacggcgacttgaaggaggaggtctacgtgcaccagccgccgggatttgtgatccccggcaaggagggcaaggtgctacgcctgcacaaggccctctacggcttgcggcaggcaccgagggcgtggaatgccaagttggattccacgctcaaggggatgggcttcgagcaaagcccgcacgaggcggccatctaccggcggggcaatggaggaaatgccttgctggtgggtgttacgtcgacgacttagtgatcaccggcaccaaggatgcagaggtcgcggcgttcaaggaggagatgaaggccaccttccagatgagtgatctggggcctctctccttctacctggggatcgaagtgcacccggacaact

SEQ ID NO: 86176 - DNA, 715 bp, Oryza sativa
gtaatcgtattctattatggttggatgtaatgactgctagatgctttattatcctttatgtcagtaagttagaccatatgaatgttgcattttgatgtgatgtagtgttcttttcatctttttgagtgattgccatgtcatctagtctttcttcttgcatatcactcatcattcaagcactcacatctgcatcttatttgtttgagggtagtgtgaagtttcttttgagctttccttcatttttatgcatattgtattcatctcatttcattatatgcatatctttagggggagcttcacacttctctcatcattccaaatttaaattctattatctttttgtgtgctttaaccatgttgtcatcaatcaccaaaaagggggagattgaaggtgcacttaaaccccctagtgggttttggtgattaatgacaaggtggttaaaggggactaacgtgtttatcaagtttattcacaggagtttagtcccacagcaagttgtgatggctaagaatgcaaggagacccaccaaattgaatgttcctaagtgtgaaaaacacagaaggtgattagactaggtttttcactttcgaaattgagtttaggaaaaaccgtactattaagaggggtttcaagtgtggttctagggtatacaaagtgctcttagtcatatccatgagtcaaaatatttttagaatcatttttgaaaaataattt

SEQ ID NO: 86177 - DNA, 731 bp, Oryza sativa
tcctgcagccctgcttgatgggtgccttacatttaagaagagaagattgaaggaacatgaatatgaaacttgtaaagctggtgctgtaaggcttatttctatagttgccatgggtggaatggggaagacaacactagctaggctcgtctataatgacgcaaggttcaaaatcactttgatatacaagcatgggtttgggtttcagaagtattcgatgaagtcagactaaccaaagcagcaatcgagtcggtcaccgctaaaccctgtgatctgactgagctagagccactccagaggcaattgcacgaggaggtcaagggtaagaagatattgcttgtgtttgacgatgtttggaatgaggacaccatcaaatgggagacgatgaaacggccattttctgctgttgctacagggagccacatgatcatcactactcgcaacgagaatgtctccacaattgtgcaggcgaagaaggtaattcatctaggtgggttgcaaaaagatgacagttgggcgttgttctgtaaattgtcattccctgacaatgcttgtagagaaacagagttgggaccaatcgggcggaaaatagtagaaaagagtgatggagtgccactagtcctgaagactctaggtgcaatgttatctttagacacaagcttggagttctggaattatgtactgacaagtgatctctgggagctgggccctggatgggaccacatccttccaat

SEQ ID NO: 86178 - DNA, 564 bp, Oryza sativa
gaacctcttgccacccccgaaaccatcgagcctgacccggtgaaagggctgcaagaattttgtgatcgagatcattcaaaataacctacgaaaaaaaccatgttgatggagtctcatcggtcattgctcgggtgaaggctggagagactacatactccgcaacaaaatcaggtccctgcaagttggcgaaaaagttggcatcaaaggctgtgcttaaagatctgattgctggtcacaaagatacagaggctgctgcagtatagtgatgcttaactatttaagcgtgcaacagtagctaacaattgatatagatagttgcgcacaatagaaaagttttggttggattcatacatgtaatttggaaatgctcctttttgtgtgctcgcaaacgatgcgtgtgaacggcctcatgaattctggtaggttttcatgcttcaaacttacaagtatcgcaattttgtaaattacaaatacgggcatagcacacctgcccatgccatgcagtagtttttttttcctcgaaatagtagcattagttgtatattactcatagcatcagattgt

SEQ ID NO: 86179 - DNA, 2833 bp, Oryza sativa
cgcgccctaccgggacgagctccgcgcccttctggtgggcctggacgacgccgccgtgccgccgcggctgttcgtggacggccggtatctgggcggcgccaacgaggtggtcaccctgcacgagcaggcgcgcctccgcccggtgctccgccgcgcgccacgccgcggcgcgggcgacgccgcgtgcgccgtctgcggcggcgcctggttcgtcgtctgcggcgcgtgcagcggcagtcataggctctatgacgccgccgccgccgccggcggccgcgtgccgtgtaccggatgcaacgagaacggactcgtgccatgccctctctgcagctgaagctgaaccggagctcattcttgcaagcactgcatgtaaaatcaattttttttttgtcatgtcatcaggatcaggagaaattcttttgattgttttatgtaatttatcatgtgtaatctatctccaccaaccaaattaagcaacaaatcagaggctccagatcgagctttgtcacctcgaggttgaattgattgctcccttctttcaaaaacaggctcttgaacacatcaaccgggtattgcctactagtagtagagtactagtaatttcaccactgcatccaggggaattgcctggttgtgagtacagagaaccaaggaaatgaaatggacttctcaaagttatctcttttttttttatgttgattcaattcataaagcaaaagtgtgtctatttgttagtaaaacagattaaataaattctttgatgacctcacttttccatctccctccctctccaacttaccacagacgttgacgctttctgagaagactggcatggcctcctcattcctcaacaatcaaacctctactagtaattcttcacaagtcaactgctttttggttcttgtccaagtttaatacgtagtagtgatcctcagaggttgtcttaaatacgttttgtcatggtttcttagaagatgctttccttttatttactcctgccattcccaaatgaaagtcgttttagccatttcaactcttttctggagcttctaccaccgtcccgtagtttcgtcttttcttccatttatgccattgttaaaaccatgttcagttatcatctaagctgaacatgcctatgaggattcttaagctgtgaattttgcttcttttttttttacaacttgtgttaaaaatcaaggatccaacggggccatcgtttcgcttattctcggaataagcggaacggcatatttgcaaataaaaaataatttgtgaataaaacttttatatatgttcttagcgatctaaaaacaaaggctgaaaataaacttcgataaaaaaaactcaaaattagctacaaatttaaggttgaaaatttaaattttggctgataaacataagcacaaacgaaaagatgataccataaaatatttactcttacatctcataattatactttttttggcgtgaatttaatggataattgtaactctgcttctctcgcttgagtgggccttgttacgagacttggagtgaatcttcctagattttgcaagagtatttggaacatgtctgcatcagaaactgaaatcaggaggttcctgggtggattatgacatgtaactaattaaaatctcagagaaagagccaacattgtgacactgacacctacattaacatagaaacttttttttgtgaccttttgcaaggttcaattacacctaattaacctgatgtagagcttcctcaccatatatgaaatgtttcttttccaagaactgagttagtcaatggctcctaaaaaaaatgaactcgaagaaacaggcaatgcaaaggaaagacctcggcagtcacccttacataaggttttcaaagagtcatgagaaattaaactgtaactttcgtcgaaacgactccaattgagttcacccgagactgtgactccgtccagtgtccacattgctcacaagtagccaaagtaaccgcgtgtgagaagagatggtagacaacatattagtcattgtttatggaggaataatctgaatattctctcccaatactccacccaatccctttagacaacttcattgttaagggagacatttgtgatgcatttcgcattggatactggtgtaattcaatcgaagaaatgggggaaaacttcacacgattgatgcaaattaaagcattacaattgggaaggaaattaatctagcaaagtaattgaaaaattttgcaccatttcacccgcgaaataaagttgagcttctctgtctctctggtaatcctacgtcgataaatgctctgcaaatcctgatgagtaaattaaccggcggcggaggcggtggcggtggcggaggaagcggcggggcggctcgtccgcggcggcattgggcggcagccaggcttgggaagcggcggcaacggcgacagcccgccgcggcacagcgggcaccgccggtgcttgcggagccagcggtcgatgcatcccgcgtggaagaagtggccgcactgcaccacccgcacctcgtcggcgccggcgtactccgactggcagtacgcgcacctgtcctccccttgctcctcagccgccgccgccgcccgcgacgacgacgacgccttcttggccgccgccgccgccgcctgctcgtacgtcatgagcgtggcggccccgagcgcgcgctccacgtcgtccacccgcgccgctgccctcttcctccaccggccgccggggaacgcgccggcggcgagcacgacgacgaccgcccccacggccaccaccccgacgagctccacgcgaagcgccgcgtcggggtccatccgcgccaaaccg

SEQ ID NO: 86180 - DNA, 1236 bp, Oryza sativa
aaactccccagatcattcaagaacattaaggttgtgtaccaacaggatggtcttcaatgaagaaggtcgtcttgtttcatttaaaggtgatattgtaatcatcatttattcatccaatgaattatcatttgaagtaatgcaggatatatgcattaaatgaattctctacctccctgaagtttgttgcctggggtatgggattgctgttacttgacaatatttggctcttttgattgagacataatttgactggcatattcatgtcaatatggatgggtcaatccctttttttctataccatcttttgcaattgatgacttaggttattgattgtttgtctacatcaagtacttaaagacctgtgcattgaaacaaactatggtgtaatgtaggaaagactattcatgttctaaacaaaaatgagcatgccttggacatggcagctccagtgcatgacaatttgggtgatccaaatggatatactgatgactattcgttggtgaagaagaggaccaatgtgcttctccttggagatcacattggcgaccttggaatgtctgatggtctaaactatgaaaacaggattgctgttggatttctgtaagtagacttccttatcatcttgctttttgcttaccatttttagatttatcttctgctgcatctatagcttagtttatccccatggatctagactgtagagtactgaatttttactttgatactgtgggcatcttggtgccagtgaaatttgattagttattccgatgcaatgagcgaagttctgaacaatccataggttgcattgtttctgttgaacatgcttttggcctaatatctttcaattgtaagctctcattggaagttctgagcaaatcctgagacttgtcaacgcatgaggaaatacccaaactttaagttgaatttttcattcccagtcatctttattaggcttattgtgttgaataagtgcaattagatgcaccaaattcattacttatgtgcaggtgtcattctcttctaattcaattgctgtacaagattaactaagctaagctgtacaagataaacaaagtataggtttggtccgtaagaactctctctaaagaaaaaaaaagttttttttttggtttgaaaccaaagttgagcaaccacagaaagtccatgtttgtgttctactggctttccttaatcaatgcaaagccaatgttttatcacatgcaactcgcccactgt

SEQ ID NO: 86181 - DNA, 747 bp, Oryza sativa
aagcaccatcataattcaaaagccccatgggaataagttcagttgttaactgaacctctgaaaacaagtagtgcctccacaagaaggatcagaattctaacaacttgatgctctgttggaagcatatataccatacgtataaacaatagcacagaaacaggtccaaaacatagctaacacatgtgcattactcattgattagtaacacaaggttcttgatggttacaaatccggcacttgagaaaaatatgtaggagcaaacacctatttatacaaaatgcaggcagaaagctcctaggcctggacaaaaacctatagtagttagttcatattaggcaggatacgagcgcaaacataaaggacacaaaatctccagcaagtatgcatgcagtggactgatgtcaggacagatcaccatcaggaagctatacaacagcaacagctggtgctagcgcgatctccattgccggtggtggctcaggccatgagaactcaaaaggggcttcgatggttagaatttgaggggctgaggtaatctcctttggggatgatgcagtgtagtggaactctatttgaagccggtggtgcaatggcgtcgacgccatcaggcctttcttgatgtcaacctgtagttcccggattgggatggctgccaagaaactcttgatatactccttgcatgattccttgccctttgaaaccagtatgttctcttcagtgccatcttcactgtcctgctcaaccgag

SEQ ID NO: 86182 - DNA, 2287 bp, Oryza sativa
gacagtttcaagatcaaagtgcttgtcaggaaaacgctctcgtacatcagattctcacaaaggtttctccactctaatgatccttcacggattaaactgtcaaattgtgattgtataggcattatatcctggtttgattggaaccagtccgcaataacagccacaagtgctgtgcaagcactctccccagcagcccgctcacttctctggtctattgatgcaaagaaaacatgggaagagagcttcagatggccatcacggctaactatctctttcaattcccaattcccaacaacgaagttgtcatcaccaaattctgaaaccataccattaatggacccatcttcaccccttgatccctgcaattgaaagatgtacagttaagaacatgtatcacagacactcaaaactagttctatgatttagaaacaagccattatttaaagatgcagatgatgaattgtaaaatttacctctgaaacagatccatcagaagaggttagcagccgtcgatcatagtcaatatcatcacctccctcttctccatatgctttcttcaacagaggttcgcctttgccttcagtgatcgcaaactcaacttcctctttctccaaggaaggatactccgttttacagttggcagcatggtttcctcaacagttgatgatggctttccctctacatggtaaccggcatcagatttgcggtgactataatagatccagtcctcatgctccccatcaatctttgcatgagcataaactaggccgcgacatagttgacagactgcagtgagccataactgaaggacttcctgacagttgaatccccaacttcatcttgctgtgccctgtcatccaaatcgtcatccagagactcgatgtcacatggatattcagcaccatcactgttaacatagcatttttcttcactgctttcatcatcttgggatgtcttcttggaccttcgtgtcgacaccagatcagtgaggattttcacctttctcagcccggctctgataactgaaacctcatcttttcctactggagcagaatcaccagaggatggggataatggagcggccatagcagacctttgtgaagcatcagatgtttcctgaaaagcccttaattccaccatacccagggtgagctgcaagaaagaaaaggttttgattgtcagaccagatggaattcgaacacgaattgtgaactaaagcttgttagcaccacaaacttacatgtagcgagggagctgactcagctgaaccatttggcacggacaatgggagaattatctcaatattctcttcggcggcggatgcataatctgctaggttaagggaagcagttccaagaattgatggcttgatctttggtcctctgttggcagcctaaatcgagagagaacaaatgaaagtcacagtcagactcgctagcagaagtaactgaaaacaaactcatcagcagaaatcgctcaagaaaaaaatgtgtagaacaaaaaaaaatgcatactattaaatgacacgtttccgatggccttgacaagaaccatcttgtccacatttgttcacaccttgttcgcattctcatataggtacaaggttattatcaagaagttctaactggttcttattaacgagaatatctcagtgcagaggtaagaaatgtaaaattttccattatacaaaatattttgattattacgcgattcatagccatcaactactattatattatatatccattcattcttcagaaccaaaatgaaatctttttcccatgtaagacgaatctaaaacacacaaatcatatcagcaaggagaagcaaaaaaaaaaaaaaagtagccaataccctatccatagaccagacaaattaaattaagtaaaattgataacatagataggtaacagtgcaatttttggagcacaataatagagggaaaaaaagaaaacaacaaaaaagaatttcaacaaacaaatctattctgagaaagtgagacaagaaaaagacaaaaagaaaaaaaaactatgatgccaaaaaaatccacataaataataattatagtcttgtctctaaattcatgtgaagaacatagacggtctactactagtaggaagaagaagaaaatgctcacagtgaacacggagaaggcgagctcccatggctggaacgcggcgtgctcccggtgcgacgcggcagcgagcgtcaccggctctcgaactcctcctcccacgcagccaccaccacgcccggcgcgtctctggcgcccgcggcggcagcggca

SEQ ID NO: 86183 - DNA, 911 bp, Oryza sativa
tgaaagaaaggggtaagagacagaaacttgtgcgtgtttcaatatattgtatatatgaagaagcttcgttgttgtcatcaattaatataatatattagtgtactcgttgtttttagtgattatttaccaaatatagtgaatccaaaatactatgtgcatgttccaaaggagtatacaacacaatttgcatccccctttaaactttagaacttaacccaaatctgcaacagcaaaagaaaaccaaacctccaagaactcaaagagcttcaccactccatctctaaaagtgattttagcatcagccacagattgccttatagcttcatatgtaagtccaccttcgataaggagagcatgtgtcttctcccacctgtagcaagtaatggcatcaggactgattagacttcgtgaataatctgcaggcaatgtgcctacactgaacattcaatcatggtatttgctggacaactgatgaatggcatggaaatatcacaagcgcatcaagattgcacaaaatctgaaaaaaaaaaaaagaaaggcttccactccgattgcaatccatgcaacacatttaagcttgacatatgaagaagcataagcatcaaaatcaaatgttgtatgcagcaccactctcacttcgtcatcacttaaatgctaaattcccaaatatgtccaactgggacttgagaacttgaccacaacagaatccacctgatcggtgtaccaaaggataatagggtggaaatttgcagcactactcactaaactacttcctcaccattcttccatgagcttggccttctcggggagcgggatgtcggggcagatctcgatggggtggtagtgctcgaacagctcctccctcttggcgtcgtactcctcgttcccctgcctcagcaacccatggctgc

SEQ ID NO: 86184 - DNA, 586 bp, Oryza sativa
agtccatcagaatcaatatcgaacgacgccgggacgagcgccgagctgcccgcatgggggaaggcgcctcctcgtatggagtgccgcattcctcctcgtgaggcggcccgccccccacgttcacccttggagggaccggttgtagggccttcgttgtgagtctccagaacgtccggtggcccccaaagtttcgccctctgagttcctccagatctacaccacgatcatcgtggcggcagggggcgacgaccgggtcctggcgaattacttccccatggccctcaagggtcaggcgcgcggctggctgatgacccagccccccgactgcatccattcctgggaggacctgtgccagcagttcatcacgaacttctagggcacatacccccgcccaggagaagaggcggacctgcatgctgtgcagcggaaggacgacgagtccctctgatcgtacatacagcgtttctaccaggtccgcaacactattccatgcattctggcccacgcggttgtttatgcgtttcggaatggcttgcggcataaccgcatgctggagaagaacgcctccaaggagcccaagatcact

SEQ ID NO: 86185 - DNA, 725 bp, Oryza sativa
cgacagcagcaagtgagctcacagagacatccagagctattctatagctgtaccaaagccacacgacaggatgaggatgatctcaccatgagtcggccaccggcgtggtctgcgcggcggcgaggatggcctgcaggcagtcgacgtggccgtagtacgccgcgtggtggaggcaggtcctcgcgtgcaccgagtcgaacatcaagatctggtgcgaaatcgtaactgttactgattttttcaaacagaattactacagtattatcagtatactgattttgcagttcttttctctcacatttgcgtcggcctggaggagcttgagcacgcagtcgatcttgccgtgcatggccgcgagcatcagcggcgtctgcagcataagcagaagaagagcaaagcaaggtgagaaaacaaaaggacaagacgagatctttctttttcattcaaaatcaaaatatgatattttcaagcagatactagtaattcgaaaaacagtagcaaaaaagaagagagattttggtggggatctcgcacctgcttgtgccgattcaccgcgtccggcggcgccccgcgatccaagaacatggagagcacctggaagaagaagaagaaagaaaacaagagagaaagggtgagacaagcaagtcccggagaccgagggaagaagaagaagaagaagcagtgaggtgagcgacctcgatgcggccattggcggcggcgatgtg

SEQ ID NO: 86186 - DNA, 1042 bp, Oryza sativa
ccccccccccccccgaaattttttatttttgttttatttgtttgatatttttttcacgcttagggacacacaagaaccaaccatacaaaaattgaactcaaatggacgtaatatgtgacatgtagaatttttcctctcctctcctctctccgaactagtgcaaaggagagagatgtgcaacttttttatttttattttatttttttgatatttttttcacacttaggaactcacaggaaccaaccacgtaaaaaataaactcaaacggacgaaatatgtggcatgtggaattttccaaagctccaccgaaaaacttctctcctcgaaaacacaatcttgcaagcggaatttggaggttttaatatcgccgaacccggcaaagctggggagaatcggatgtaacagaatcggatgtaactttttctgtagatgtccgtgcatatattatttgcctgattccgagtccgtatgagaaagttacgcctattttaatacatggcatattttgtccgtttcggtagagttttggaaaattctacatgtcacatattttgttcgtttgagtttattttttatacggttggttcctatgttctcctaagtgtgaaaaaaatatcaaaaaatgaaataaaaataaaaaaaattacatctctatgtactgtttaacttatatatgtcatttcatgtggttatattttgaattagattaagtaatttcatatagtggtagagtgcattatgtttaacatgctgatcaaagggttttactaaaggagttatggtctaattttagtgaaggtgcaaagtagactaagtggtatgctagatattttcagacttagctaagtggtagttcgagtttaaattttttttgtggttggttgtatcgtgatcctaagtgtgaaaaaacatccgaaaaaataaaataaaaatgacaccgttgcaactccatacagagaaacaggaatggaggcggcggcgccagccatgctggcgccctcctccctagggcggcgccagcatggctggcgccctcctcctg

SEQ ID NO: 86187 - DNA, 4519 bp, Oryza sativa
cattaattaattgtgcggctgacgtgcggcccattttagttggccgggatgggcttctggcgcaatcgaggcccactttactttgcttttcgttgggccgaaacgggagcccgttgtaatcatcattgatgcatcttactagtagtacctcgttaatacactactccctccgtcccataatataagggattttgagttttacttttactgtttgaccactcgtcttatttaaaaaatttgtgcaaatataaaaaactaaaagttgtgcttaaaatactttggataataaagtaagtcaaaaaaataaataataattttaatttttttttgaataagacgagtggtcaaacagtacaaacaaaaacttaaaatcccttatattatgaaacggagagagtactatcttgccttagccatgtctaatcctcacttcctcgcccaaatatcacgaaataaagagcaagcatgcacctacaccacacttgatcttgaaccacttgattatcaaactagtagtactattttttttattaatagtttcaggaaacaaggacagtactaatcgtcatgaactagaagtccttttgttcttcatcttagtattatattaggtccacggataatcatatctatataggatattgccgacttttgtcttggataatcccaataatagaacaactctggcccagctgcaacacgctagtagatatagagtcgcggctccattcctaccctctcccatattaatcccaaattaaggatatatacgcatccaaattccaattatggatgcaacttggccagcaatttgcctttttttgtaaacaacaacaaatgatggcccgtccacggttcaggtatcgccgtctgttcgtctttcaaaaccaccagctgctaaacaaattgttacatgaatcatatatctatttactctcacatcaccattataccaatatgacattgaacacaatgatatcactaaacctgattgattatccaaaacagattaacattactacaaagcggtccggatgaacaaagtctctcaccagacaagacgggccagaattacagaacaaggcaatcattcggtggatcatagatatccagtggcagctgcgaatgattaattactgatcaaattattcaggtgtttggttcaaaacaatgtacacgagaatagtggtcactagagaatttcatcgagtcatttacaaccagatggtacatatatttataatatgcttttgcattaacaaactagggctctaagctctagaaactagcatgaatgctgacaaagtgacaagtacaaaccccacatcagggaacagggttaatctactcaagaaatagcaatcatacaggaaggtaggaaggaggcaggaaagcaaggcaggtgaggcagatggcacatcttgcactactttacaacaagctcatgtatctgtgtcagcatccagtaataccctggccaaaacaaagcacaataattgaagctccgatttgctcctcccaccaaacatatgcctttttcctctctttctttctctcttcatgacataacatgtgagcaacgtgaaaatggattggaattgggagacggagatgcaattatgctcatttgtcattttcagaaaccatttacaacagtgctcagagtatgtaactccaaataacatattctgggtatgtcatccgctcctttgttacacatattgccagctctttctgaagatgacaagcaggcgaccttcataaagatactttcttccatcaccactgaacacgatgagttggtcacaaacccgtaacatatccttcaatgacatgatgacatgaacagaaaactggcaattgtaggcagtgataccagccagttatggcagcaagtttatcaccggcagtgacaaacctggagtagtcctagtctgagcgttcgcctggtaattaactggaacagtttggatactgactgtatcagttgtctttgagctttggattggtggagatagaaaccaagtctcagttgtaacagcccagcagcgttttccttaccctgtcgacaatacggttcctattgacaaggctgtttgacaatgggaactcactgctatcatccaggaggaatctgtagacctcccattgacgctctgatgctgcctgcctcccaatttcagcctgaaatgcataagcaagagagtaaatacaaattcattttgaaccctctctgaatattctgtgattcttacagagaaaatgcagatcccaagcgctttcagagcaaatgtagcatcgtagaatacacgtggtcgtcccttcccggatagctcaacagggttagcaacaaggagttctacatcgggaccccggttgacaatcatcaccctgagaggatggagcatctctgacctcaggcgtgagctgagaacatcctgtttctcaggatcaataatcttctttccatccgcttgcttgataaaaagatccacctctcgaaaacctttcttgtctgaccagaatcggccatatgttacctgaaaaggtattgagttatggtacattcaaactatatactagcgacagctttgataaacaactattgtcccctgtaagccatgactagataacagataacagatcattatgtagcatttgatggttataaactttcttaacaagaaggtgggaaacttgtttgttaatatatcttagtaatttctaaggtgacagtaccctcagatgtccagaacatctaaatcccccagtcttacttttgcaaaattatctgaatgttacagattaataagcattcatggcattagttatatactacaatacaggcaatatatctccgtgtacctgaatgctgcagtccttcattgttctcaaaatatcataaaggagccccttttgatcagcacagttaatttggagcagtgtgtgtgcggggctcagggtattgtcaaagttgatggttgctttctgcactcttttcatctccgcacaaattgaccttgaacagttgtcaccatcagccagttccaacctgaacagctcctcagagattgtcggtgggagagaagagaatccttgctggaacccttctgctaataggatttcacagcttatggaaggacctaaggtagcaatcagcatcgaacaagtctcttcttgtctttcctttgtgtgcaataattcccttcacatataagtatcaacagtcatataatagaattattatgtgttgcagctcggcagcatattgcacaagcagcttgttcaaagtggcaacataaccaaaggacctaaactttaacaatgacaacttacatgccgtcggtgatgaagaagaggtcaataactctgccatctggcgtggttgacaccttcactctgtggattataagctctagttccgataatatatgcgtaacatctgcatatcatatggcacttgtaattatatcacagcttggtctacttcaaacattgaagtttggaaggtagaaagagatgctcaggttctcaccgtgcaatagccctttgcgatcagctgagaaaagcttgagaaggtagaactgggaggggcctggctgggtgatctcagggtagaaagtcattgggtaatttgacgggcacattgacatgaggcggttcttgagattcgcccaccggaccttgattgatggcgtgcggggcacgacccagaacacaacgaagcaccattgcccatccgtagacacatctgctaaaattgccaaagaaacgaatttcagatgttgacggaaggattaaaagaaggattgaagaacatagttttgatgaagcagttgaaacagtgcacagcacttgcaagtacatagtacatagtttttttgaaactaaataaaagaagtttacttatcatgagtaagtactagtagttgcaagttgcagtggttcgtcaggttatgatgcagtacagaattaatgttttaagatggaagctccaatgattagtaaggccgacatgaatctgaaatgcagtgagcacacagcaacagcgacatgaacctagacggggacttggcgtaggtaaatccgataacgatgagattaaacaaaacaaattggaactgagctgtgtctaactaatcgatacatatcttggaacggaaacagctaaaaagtttaactgatcgatatatatcttggaacggaaacagctaaaaagttggaaatcttttccgagaaagacggcaccgcacagaaaaaagaaaagaaaaagataaaaagagcaaactgatcatccagattccaaagacagagaaagagaagcagtcgggcaacactaaaactcaaaaaaaaaaaaatctctcacgctcaagaacaccagcaagccccccaaaaaaaacgaaacatcatgctaaaataaataaataaaaaatctaatgtctccaattctttgactgcaattcagattttggtaaaacctaggctcgaacaagcagccctaattaagacaggaggagaa

SEQ ID NO: 86188 - DNA, 673 bp, Oryza sativa
  unsure (1)..(673): unsure at all n locations
aattcctgcagcccattttcagcaccctatcccttgcgctattcatagataccatctcatcaccaagattcttcatcctgaacatacagttgactatgagcacttcatccttgtcaatgttcaggtcctcaatttgtacggtttcccaccgtgaagcaatgccctgatattgaaaaggcaccnttgaacaagtttgcataatcagccaaccgcttccctgtctcctcaattatttcacaggggtggaaacctggctggggcatatctatacctgtgatcctaagcttgggtggacccccttcttcatttgcaagccgctgaatcaatgatggccactgaaagccagtgcaaatgccgaaatgaacaatgtgcacctttcttggttgctgccctttgatgcatcaagaatagtttggtttgcataggcgaatgacgccctttcgaaagggcaagctgaaaggtagaggctgtaagccttcaacaaactctcagcactggttcggcttgccatgagcttgcgatacacctggctcccgatcccagccaagcgcgcctccagaccatccaccaagtaaaatgccaacctctggttactatctccatctggtgaagaatgctgtcttatcttcttcactagttcactggccgaaatgcggtcgtcagctgctactgc

SEQ ID NO: 86189 - DNA, 1001 bp, Oryza sativa
gcaagcataaagaccattcttctctggatcatccaccaacttttcaatatttggaatgaacctctttgcttcctcaacacctctcctgaattgcaaagccaaacggtcaaattcagaagaccagtcggtggttatcgaatgcgcatcctgtgacccaaggagatcactaacaaagctaccactacatgcctgttcatgataactgctgctaccattatcagggtaatctgcttgactgtcaccgttaattgctgtctccttagatgaagatgggtatgccttcccaagaatatcatagaagggcttctctgtcgcctgaagtgcatcctgtcctttttttatgctgatcttttcatcaatatcctcctccatcaatattctgtttatataatcaagagttatgtttgagttggtctgacaatactcagggctgtccattatgctagacctgcattgctttaagcttctgaagcagaaatttgtgatctacaaaagagcaagtcaaccttttagaagggtttctttaccagccaatgtcttttttttttgcctctcaaaacttgctaaaatatcaaaataagtcatagataggataataggataagttcaagagttcttttatggtcctgagaggtgccacgctaattaacaacaggagttgccaatatgaatgaaaacattaaaattcggaggtactggtacctcccaggactgtaatcagcaaaacatagttttttgcctagataaactgacatgtaaaaccatctctggcacccaattttgaagattgtatgcactacttacctgctatgtaaatcatacttttgacatggataacctccaaactctggaagacaccttttgttgagaaaaaatgttggtgtatcaaaatgtaggagttggtaacttggtataccaactacactgtagaatatatcccaaatatactttttatgatgtatactactattactgctgttaccaattgttaacagcagcaa

SEQ ID NO: 86190 - DNA, 2066 bp, Oryza sativa
tacctacaactgatttcagggctcttttttcgcaagttaatagtcgcttctaagaagtataatctgtcaacgaggcacaatatttgtgatggaataatatgaagtgtgtattgagtgaggttagtttcctagcatatatgcattttttttgttcatccttgtattagtaggcagttgattctgcatatatttttaattatctgtgatctttttgttacctggtactgttttgagaaaaaaaaagttcgctaattgcataccaatataacaaaggcagttacttattactcaatcattcaatatcttcaaatcatttaagagaaatacagatgattgctatagtaatgcattcacagtaagagtatgttaagagcaaatttagttacccacccctaccgagaactccttgttcgtattaattggaaaaatacagagagcaaacataagtcggaaaaccaagccatcttccaagatcatctccaatatccatcaacacaagaaataaattgcaatacttagaacccttatgctgatgattgcataactagcttttgagaatattggagactgattgagatctgctttggtctttctgattaccacatgatcacctaggtttccactttccatgttgacagtgcctgtattatcctccccttccatccctgcagcagccagccactatcttcatcaattacaaagtcttcatgataaaattccttgtaatgtactgatctattcagaatggcttgattaacaggacgttgcttgaacccagccctgaggatcctcatttgccactgtttgtagctttctggcctctcaatcctttctgcaccttcgcatgctacagcattaagtgcatcattcccaaagagatccttctctaccaatatccttgcttcatggttctaggaacattgttgtcgagcatatcaaaaagtgatgagtaatggaataaaacctctctgaatctagtcagaaagaatggggagctgtacaatccattcacaacaccaagaatgaaaacctgcgggttcatcctcttcatcatgtgtagtaccctatcccttgcactatcaatgttttctgtctcatcacctagctttctcattcgtgacatgcagttgattatgagtacctcatccttgtcaatactgagatcctcgatgcagatagtttcccatcttgaagcaatgccatgatactggaaaggtacgttgaacatatttgcatactctgccaaccgctttccagtctcctcaatcctttcatgagggcgaaaaccaggctggggtacatctacacctgtgatacgaagcttaggggggccaccttctcgctttgcaagtcgctgaattagacatggccactgaaagccgaagaggatgccaaaatcaacgatatgcaatgttgttttcccctccaatgcatcaatgatggttttgttggagaagtagtatgttaccatctcaaaagggcatgctacaaaatatagatgataggcctttagcatgtctctggtgctcgtttgtttcgccatcagtttttcgtacatttgactcccagtcccagccaagcgagcctcgaggccatctgcaaagcagtttgctagcctctgagaaccatctccatctggcaaagcgtgatgccttattttcctcagtagctcactagcaaagggatggttgttagatgctatcgcttgtgcacattggatgagaagaacactgagatctattgcctctttctgtttcttcttactactgtgtggcttcctttgcccttttccatatcctttgctttgaaatttctttgggttgtcgcttgcttcttttgccatcattcctctaaggttagcaacttcaccagggagctgcctattgcagagcagaatactatcaaacatttcatcccgtattgtttcactagtggagatggccatatgcttactgttccttgcttccatcaactctatgtgctcaacatgaggatcatgaggatgattccttattttgttctcatgcttgcccttctgttctgttgtctctgttgtttgtttgcag

SEQ ID NO: 86191 - DNA, 623 bp, Oryza sativa
tgctatttccctatggagaagatggcttcacaaacaaaatattgtacagagataaccatggatccaaatgcaagagaaaacatttgaccatgctggagtactatgcttatcgcatacaacagcgcaaaaatcaatgtatgcacttgctaatgtgtgaaaaattgacgttgcagttcattgttgatgcactagcgtgcataatccaatataggctggactggataagaaaacatcaagggaatcttagaactgaactgtatgctggcttgcaggatgcaattgaaaggggtgacacaagagctgaacaggttggaaaaaggatactacttccttcatctttcacaggcagcccaagatacaaggcacaaaactaccaagatgctatggcaatatgtcgttgggcaggatacccagacctgtttgtcactttcacgtgcaacgctgcttggccagagatacaaaatatgctaatgaaataggagttcagaaaccatcagatagacctgacattgttgaccgagtattccatataaaattgagggaattgatgacagacataaaggacaagcaatactttggaaagactcttgcaagtaaaaatcctaaacccgcatattcattag

SEQ ID NO: 86192 - DNA, 1848 bp, Oryza sativa
aagtaaaagttattaggctatgggatgcggttaatcctacaatggttgatgagttctatggtatacagatgattgtactagatgcagaggtatgattgttgtaaacatgtgatttaatatattgttctattatgtaaatactatttttttggtgcagggcaactcaatacatgtctctatctcaaagcaattggcgaaccacttcaggccaaaaattaagattaactcaatatatacttttaaaaatttcaaagttatggaacatgataaataccgtgtcctaaaaaacaatctgaaaatccttttttatcatgataccatagtaaaagaggtaaaatcaaaaagacaatgtttcttggactattacttcgagtttacagacaggaaaacattaaggagtaggttgaataaagatcaacagttatcaggtatgtgcataatcttacttcttttaaacattgttatttgtactaaagacctgtttgtatttagatgtgattggcttacttagcgggatgaagccgatcgagcaaagaatgctaggaaaaaacacaagcagggagagggtttgcaacatgcgtgaaattgaactccttttattagagtaagattgttgtctgcaaatttaaaccagcactaatactttctatgtggtatattttacatgactttattgcatttgtaggggagaaaaagttaaaattactctatggggagatattttagcaaatatggttgacgacgatttgcttgggaagcaaactgtgttcatcgccactggacttctggttaaagaatatgaaagtgaggatgttatttttttctaatttaacgtacttatagttttagtaaactaacgacattgatcatttagaattattatcatttggagtaacaagttcaacagaagtttttttggatatggaaattcctgcaagcatggaaatattgagcaggtgtgcagtagtagcatttaaattcatatatatttgttgatttgtctaaaattatctgatggattatattgcattttatttataggcataatgctgaaaaggttttgcccacaatgattgaagtggacgcaagcactcaaggaaccattgaagagcaaatgttctacaatagaaagacattgaaagaaataacagaattgcgatatagtaatatacaacagaaggtacatatccattcctatgttacgtttatttttcatttgtgtatttaatgttgggaaaaatctacttgatggctgatgtaatgagcattacctaaattaagtggtacgtttagtcgtgaagtcatctttagtcactctttcaagctgattagttaaccaacattaatttgttttttatttaggaatttatatgcacagtcaaagctaaaattgaggagattaatcaagaaattggtggtatatgtcttgcgataagtgcttttgtggaacaagaaaggaatcaaatgtatacatttgcaattcatgcggaaaggaagcagtgaacccaaaaccacggtaagcatgctcttcaaattttatttgacatattgtagcaggtatatttaccattaacggcacattgtaccaggtatgtaataaaccttgagataagtgaccacactactaggacgacatgtacaatatttaatgaggaagcagaaagaatatttggtcataagtctgtgtccaccatgctggaggaacagaatggacaaattgatatgattcctgatacaatacgtcagatatgtggaagaatattgatattcagattgaagttgactaaaaggaatttagaagagtgtaaggaagactacaaagtgaactacacttttacacctaatgaa

SEQ ID NO: 86193 - DNA, 736 bp, Oryza sativa
  unsure (1)..(736): unsure at all n locations
ctgcgacaactagttgaggggactggcgctcccgcaanacnncatcacggcgcgacgagggagagggtgtgataacactctgaattcttgtccctgtctacataaatcttggatccaaacacctttgacacctccatgagtgtgggggtgttggccaagcatgtctgacacaagataaaccaccggtgcattggggtgcttccagatgcaattgatgacctgaaatcatgagagagcaaaaatgtagagttacagttgaagagaacagttgtcagcgattcagcaccagcagcaatgttgacctcacctggcggatggagtcgtgcttggaggggaagtggagagagcaggcggcgattgtgcagtcgaggaagacctagtctgcggcgacgaagcagaagtccggggtgaggcggcagtcttcggtgtgaaggacactgccgaaggaggcgcccctcaagaggaacatgactgcgccggggcagtggttggcgtcgaatgcggtgacggtgaattagcctgtggggtccgggacgagcaacggtgctcccagtttcacctacacgaaggcgttggcgcgatcgaactttgaattggagtggtaataaatcgattctgttggtgatttgagatacttatccatttgtgaatgaacgctacactgtgggaagatgtggcanaccgattaacgatgttgaggccaaaaagcactacacagcgggcgacgtttggtggg

SEQ ID NO: 86194 - DNA, 2635 bp, Oryza sativa
ttactctaattttcgatatgaagctcaatcggttggaaagaattgctcgctgtacgggttctcccataatctcattctcagaagtcttggataaaccaaagctgaaacgttgtgactcgttccacatagaaaaatttattgaggagcataacagtgccagtgatggtggaaaaaggctatcgaaaacattaatgttcttggaaggcttccccaaaccgttgggttgtacggtatgtctagttcataattgtagtatctataacacattcatgcattttgatcttattcatttcgtccataaaatttgttcttcctgaaatctccccatccttttattaggagtgacaatgaaacctctaatcaaaacacccctgtcactgttgtatgccaatctattctagcttgctgtcttttacttcaaacaattattgattcctgatggtacttgtctgatcctgccccatatccaagtgaagtgaagtaaaagatttttatgttttgacttacaaaagggatagtagggaggtgtagatatctgaaatgctctcaaaacatgacaaaggagctgctccttgtcttttggcaaggcatgccaaattttagcaataaagcttggcaggagctatgcactctatggttctttacaatagcaaacctggttttgattatgatgtgctatacagtagcaagtttcatgcatcttttttttattatgatgccaaatgaatatgaccccttccatgcatacttattctctcgactgaataggcacatgtggagtcacttctttccactgagtagacacatgtggggtagtccatattttttataaattatctgcacaattataattctttctttatcatccagatattgctaaggggtgcaaatagtgaagaactgaaaaaagtcaagcaagtcatgcactacacagtatttgcagcgtaccacttgattcttgaaacatcattctttgaagatcagaggatatttttgaatgatcaaaatgcttcaagagagaattctgttactgccatggcagggccatcagcaaatggttacgatccatctgttctttgtgcctctgactttccttcacgagatgactctccagcacttagactgtaccatgccacttctaatggctacactgatgtgaagaaatccctcagttcatcaacaaaagtagatgctccaagttcaataacaaacagctcctcgagtgttggagaagatgcaagtatccgatacgactcaaagccaccacttcattctcaaaggttaccatcaccagtcccaggaacgctaaggaaatacgttggcatgttatctcatcagaatatttatttacctgtcacatccttgcaagaaacatctgctacccagatagaaggcgaggttgaatctggtaaagaaattgtcagtaatggttttcatgttgggtcaaaggtggaagagcctgcagtttctactgcaaatgtggattgctcacaagatcaccagagacaagaaagaattcaagatataatgccaacaaattctacgcacgacaaacgtgaagaatcacctgttatggtagaagatggggaacaacatagcaccattgatatcattagcaaagagaaaactactaacgaagatcaagcggatgatgcccttgatactcacagcatattaattttgatgtccagtcaatgcataacaaagcaggttatttgtgagcagagccatctttctcgtataaaatattatgggaatttcgatgtgtccttagggcgatatttcaagacattttgcagaatccggttttgcagaatcaggtacactgtttattaaacttttactttgtcctcgagtagtttttcttattttcacgaaatacccacattttgttttagcattgcaacttgattctgtttggatgcttactcagctcattgatgtaaattcatagcagaaactgagctgctcttcatgtggagagtttccagagtctcatctgtactcttacactcatcggaatgggaatttgaccgttcgagtcaagcatttggcgcctcaacatcatttgcctggtgaatctgaagggaaaatatggatgtggaccagatgcttgagatgtgagaatgaacatgggattccaaatcgactccaagagtgctcatatcatctgaagcacgaagtctctcttttggaaaattcctagaactcagtttttcaagccattctgcggcaagaaggctttcaatatgcggacatttggtgaacagggactgcttgcgcttttttgggtaagctagccagctaggcatattttcatttgcatcaaacaaaaataattttaagctgaaacaccagtatttggttaccaagcatagctatgccgtggaaagacatactactatacctttcgtctttcttgacattcattattgtctgttcactactgctttcaggttgggctcgaaagttgcaatgttccggtactcatcagttgaaatttatacaacctgcaaaccacaaaccactctccagtttgataatccctgcaggcaggattggtttaaagaagagaggagatatgtatgttttattaacttcagtataatcatgctatgttttcgatatgttttaa

SEQ ID NO: 86195 - DNA, 688 bp, Oryza sativa
aatgcccaaggactcctttgagaagcagcagtctaggattgtggcaactggtcggcatgtgcttgtgagcagcatttttcttgaagactaaccccttgatcacctcactgcaatcaacattgcaaaatgaaggggggggggggggtataatttgaaacataaaaaaaaattcaatgttttcaaagaattttcttcagtaaggaacaaattatgtttcacctttgccgacgagtaccagatgctatgcacttgaccttgatgtaagatccagggtccatttcctttcccttgctagcatctggtttgatcagtagtgcagcttcccacgatagggaggtaaggatatcaagccaactctcaccgctctctcctttggaaaaggagataccagcagaggccaggaaccgacttacaagtatctttaactgcccattcatggcatctagcatcgcgctttctcgctcatccctagtattgtggctgacctcctgctcctcattagtggctgggaaacttgaccggccccacttgatcccatcactgtaatcatcgtcgtcgtcagcgtaagcaatctttccagaaacactgtcagcctcatattccttgtctgcagcttcaggtggtatccagatgctatcattttcagtgcatgttgagtcaatactgccacttttgccactggtactct

SEQ ID NO: 86196 - DNA, 802 bp, Oryza sativa
ctgcaccccttctttggaccaggagccttcaaacgctcccaatcatttcagaaaaattccagactgggatacaggggaagggtggatttggaattctttccatgaatgtcaattggcttacagaaaggacatacaaaatgaaattttggataaatttgaaattgtcaaccgttattctccgtctcatatgtctcccttgtttgagcaacatgaagaagtgagctctccacagttcactgttggtccaggtggtaatattttatctgtactggaggatgagatatctagtataatagcccgtgctcttgctgtatctggggaacaccgccatttagtggagaatgaaacagagggtgccaggttggagcatgctaaaacaatggaaaaatcatatagctttatgtctggaagttctcttgactcatcaccatggtcatctatcggatctttagattccgaagcaagttttttgtctcttggttcatcagtttcatcagatgacctatctggttatgatagcttgcctttgttctcttcaatacatccagaagtcgctgtaaatggaaaagtagctctcagaggcaaatattctgttactagcatatatgctaaacaattccaagatcttcgaaagaagtgctgcccatctgagcttgcatatattacttccctaagtcgctgcaagaagtgggatgctcagggtggaaaaagtaaagctttctttgcaaagacagtggatgacaggttcatcataaagcaaataaagaagacagagtttgagtccttcataaaatttgcccct

SEQ ID NO: 86197 - DNA, 688 bp, Oryza sativa
aagtaatgtaagtattaaagctgctaagatacaatgcgcttctttttaagaaatacaagatgcaccccacagttgaatctggactgcaagatttgcagccactcttgaagcagaacttatattcttagcttatatattgacccaacagtttgcgtttatcttaatatgttgacagaacgaagaagaaaatttgctcagtatctgtggttcatattaccagtccaaattgcatcagaagtttggaaaaatcttagcttctaaacttgtgaagagccattttctacttcagaaataaatggaaacaagctcgaacctttaaagacagaagatgacgatacaattctggatccaatgaaggcagatcatttaagaagttgtacctgattaagagcaaaataccagatacaataatccaaagtaaaacataatcagtataatgcaatatagcatatggcataatgtttcaattgaccgaattgtgaaaggaaaaaaaaagaacataacccaatcaaatatgatcccatggtttgtttagatattctgtttagtttaatctcagtggatgtaaattccaaaagtatacatcaagtccctacgcacagtgttatcggttatcatagaagtcaattgatatgctttaaagaaaatttaacccagtcattggtaggggtggaatgggctgcaggaa

SEQ ID NO: 86198 - DNA, 641 bp, Oryza sativa
aggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacattcttccttcatgcacctcacttcatacacataatttgttgacttgaccaccctaaactctctctgcaatgaaactgcccaatgcttcaccgcctccttcatctcatccttatgagcataccttgcaccctcaattacctcgttctccttatactcccagggtacatgatcaccctctgatataacaagaccagagaagtcctcatttgcccaatcagtggccattacatcaccttcctcatcggatgatgcgtcgtcctccgcttgctcattatccgaatcttc

SEQ ID NO: 86199 - DNA, 2805 bp, Oryza sativa
tggagactccgatccaagtcgactccgagacagaggggaccgacaccgagccagagatcgagccagacatcactaatccttcagaggatgagacccctgttccccgcatcaccttcctcgaaggccctcgcaccctcagcactgcccgcaagagcacccgacccccgagcaagaagcccaagccagatccagaggccactacttccgagccgtggggactcaggtttgcccgtgccagcgaccaccctctacctgccccaggatcctgcggatggttggatgactagactggaggattattgcagcttcgatctcgcttcagatggtttttggatagtatgcgagacacacccccccttacctagattgacgagtagcttgatggttagttcgatgcatcttttggatgaaccttatttggactgcgtatgtgtgcagtcgattgcatcatgatttatgtactatttgtggaactctatgatgttatttatgatattattgttgttgtgttataaatgagtttattccaccatgcttgcaaaacaaagttcacatcgaaacaactcccttaatgggataaaaccataagagctagttagaaaattaggatacttacttaatcggcctacacagatggcaagccgacgtcgggcgtcaaccagcaatgaagaagcttcgacacctgacctaaccaccctggccagagttatggccactgaaacccaacttctacaagccattgcgaataaccaaggcaaccgcggcggatcgagctttggagagtttatgaggaccaagccacccacgttcgctacggtagacgagcctatggaggcagaagattggctacgtatcatagagaataaactgacccttgtccgggtacgcgaagccgacaaagtgatcttcgcagtaaattaactggagggacccgctggtgattggtgggatacttacaaggaagctcgggaagaggatgatggagaacccacttgggaagagttcactgcagcatttcgcgagaacttcgtgcctactgcggtaatgcgtatgaagaggaacgagtttagaaggctgcgacaagggaacacaacggtgcaggaatatctgaaccgattcactcagttggcccgctatgcaattggagacctcgcagatgaagaagaaaagatcgacaagttcatagaagggctgaatgatgagttgcgtggacctatgattgggcaagatcaagagagtttccagagcctaatcaacaaggtcgttaggctggagaacgatcaaaggactgtagagcacaaccgcaaaaggaggctttctatgaatcgcctacctcagggagtgcctcagcgactcaaggaagccacttcgtctgggtggaaaacccctattgtggcaaccaaccgccccgctgcacctagcaaattcaacaggtcggttgcgattcagaaccgcacccctacaccaaccctggctgcccctggagccaagaagaatgtggactgcttgaactgcggggagtatgggcactacgccaacaactgccctcatccacacaaaactcctgtccgtactggcgctaatgcaatgattgttcgtggaactactacccctactaccggacgaggtctattcaagactccgcaaactaacaggaccgctaccggatttggacgcggacaagtgaaccatgttcgagctgaagaggcccaggaagatcagggcgtactaatgggtatgttctctgtcaattctaccccggttaaagtcctcttcgattctggtgcatcgcattcattcatatctctgaaggctagtcaaaagcacaacttaaccctagtgggacttagaaagcctatgatagtacactcacctgggggcgagataactgtgagtcatgcttgcatagatgtacctattcgtcttagggttgtggtgtttccctccaaccttatggttttgataccccagaccctggatgttgtcacgcccagaaattcccgaatagaattccaagcagaatgtgcattaaaatccccgtccaggaccagccggggtacacaaacgacaatgttgacattcagatccacgtcttacaaacatcataaagtcttacataaatgcagcggaagaaaagaaagacaacaggagctaagccttgactaaactgcagcgggaacaccactccacaggcatcctcgacggcacggacgaagcctactcctcagagaaaccttcatctgacccgaactcgaactctggggttgggaaaagtagagcaagactgagtactacccactatactcagcaagtcataccggaataggggtatgatgcagggaattaacaaagaagagctgaagtggttcatttgcataaagcgagcatttataaacagaaattgaaagatttaaacagttgtaataattaattcatattaatcatccgttgtccaacgctaacccacgttgcgacaggcccaaccatccacctaaactatccaaattcaaaagattacactagggtgagactaatcacggtgaatctggttgaccgcccataaccgcgggcacggctattcgaatagttttactctgatcagaggtgtacaactgtacccacaagacacagccccacgacatgtttccgtgcgccgacatgtcaccacgacatacccgaaagaggccgtgacaggacccttcgcataaccccctctaaccaagcacaccacacctcaggtttcacccccactcctcgcaaggcagcgggcagtcccctctcgtgcctaggtgaatccggaagccg

SEQ ID NO: 86200 - DNA, 1239 bp, Oryza sativa
gattatagatccaaaagacctagatggcttgcaggccgatattgttagtaccctgagtcacttggagatgtattttacactagctttcttcgatatcatggttcatctcactgttcacctactgaagcaaacaaaaatatgtgggccagcttttatgagagaaatgtggccatttgtcatgaccggaaataacccagcgggcgttccttacgtgcgtgtattattccttgtcccaggaggcaaggtacaccaaaaattgatacaatacagagtttaacaagcggaagcgtaaacaattaatttattacatgggcggtgaaggcccagcacacaggaagacaaacaaaaaacagcggaagactacggcgacgaccacaggcgcttgacggcaggcacgagctagacaccaaagccttcatcttccaggaactcctcttctgggtttgggaaaaattgagcaagactgagtacaaccaccgtactcaacaagacacacccacgagtgcagaataaatgcaagggagtacaagggagttataatataagggattagggtttgtagtaaacagcattaaaagacacttagttgctcaaagctattttgtaaatacgatcctcgagctatgcaatattattaatcaaggccgtgaacccacacgaacctgccttaacccaaggcctacgatgattcagaccgaactggcaactcgaccctgggtcccagctcgtcccaagccaacccaggccaaccattccacattttagtcgttaagaaggttttaagaattgaaacactaacttgggtacattgctcggcttgcccataaccgagggcgcggctattcgaataggttatactctaatcaaaggtgtacatctttacccacaagacacatcttcctcacgtgtaaccacgtgccacataccaccacggtatacggacggaagacatgacatagtttccaactcatcctatccatagacaagagtaccgacccaaccccacctacgggcggaacctccgggacaggtaggcaggactgagcccctagcagcaggacatcggccctctgccctgacatctcgactaccgggccgcagctcgtgtagccttcatttgccctagagatgtccatcgacccccgacttcgtccatctccatccgtgaacttttgttataaccagactgagccacaaactaagccttaccactagacatgtggaagtacggtagtgctt

SEQ ID NO: 86201 - DNA, 9778 bp, Oryza sativa
atcgccatccgcccgcccccgggccgccgcccaccacccgcccccgcgccgccgccaaccgcccgcccccgcgtcgtcgccccaggcggcggcggctggatttggggaaccggctcacctctacctccgcccccagcctcgcgagcgagctccgccgccctccaccgctgaccgcccgtgtccgtgtgcgcgcacgagagagagagcaggggatctggaagaggttgggtcgaagaggggatgacaggtgggcccagtgttttttatgttttttttttgctgagtagtctgccacattggcgccacgtgtgctagtactaagtcaaaaccgctcataacagtgttaggggggtaatttgtccggtattgaaagttcagggtgagtaatatctggttttcgggttcagggggaaattcggccgaccgcgatagttcaggggggtaattcgtactttttcctatcatatatccatatgctgggccggcatccggcccaggctaactgcctaactaggatttcagtactgccgctactaatactacactgaagagcacagtatagctagtgaaccaaagtaccaccaaacatggccccccatattaacagcaactggtctaacgaataatgagcagcaaatttcggttacggttccttgtgaggtacatacacggttgaagtcacaagggcccgaccatgtggcgctcgttctcttagcttagcttgatgcaatgatgtttgagttacaacatgtcaaagtgccaccatgtcgatccggcctctgcatcagctagagaatgtacacatgttgagaactatgagagggagtggtacacttctcgccctatttcttccttaaaaatggcacgaatatataccaatatgcatatgcatgatgcgcacactcgttcaattactttcttacttcctccgtttcacaatataagtcattctagcatttcccacatttatattgttgttaatgaatctaaatagatatatatgtctagattcattaatatcaatatgaatatgggaaatattagaatgacttacattgtgaaacggagggagtacatattaatcagatcttaccaaagaatattgatataattttacttagacatgcttctttccgggacgtgatttagcgagcacacgtgagtttcaccgataaggagaccacatgttgtcaatgataaaggtggtggtggcaccgctactatcttctaaagcagtatatccgaaagtgtttttcatgacaaatctagctatattatttttcttatgttaaattatagtattttttaattagttaataattaatggttgtaaggtttgattgcacctattctacaacgatatccaatcgagaacagaggaaggtacatggctggtgcagaaaagactcaaaatagaaggagaaagcaaagattctgatgagttctacacttgtctgctactgtcctacctaacgttttttttgacccttgtcagtggcatctaagattttggccgttgttattgataagattttagccgttttacccctggtcctcccccaaacctccggtagtacatctcgttaacctaaaagaagcaaaggcagcagatcaaatggcgattactttaagcagcacacactccatcactgctgtttgcacgaccgatcagtgtcattccccaagttcaagctctgccataaactgaaccctgcacgaacctactaacaaattatatttaaacagcattggcacttgacaatagactatatacttctatataaaaaaaattgtcccagttaggacagtggcgacatcttctcttgcgatctcccttttgatattcgatcggcgacgagcccatggagatcgagtaggcgccaaagattcgaaagctggaaagatgagaaatgcaggataaaaatagagggggaaggggcagcccggctggaccgtggaacatgcgcgagagcggctgcggtgccacagctgcaatgattcgggagtccactcgcaacagcagcagcagcatatattccatgagcaccagcggcagcagctagccgcaccaaccaatcgacggaggaatctggcgtacgtcgggtcactcaaaagcggacgagcagatcgcgccccgccgcggcggcggcggcggcctcgtcgtcatcaccgtttccggccgggtccaaagcgggcggcgccgcgagctctcgcgaagttgcccgtacgtcgggtgatgcgtcgctagcttgctcgtgcgtgcgtgcagggcggttgcgtcgcgtctgggcgtgttgctgttgtcaagtgtcaaccagcttatttcgtggtcctgatatattacttagtgttgtattggttggctttggacaaccaaaataatttggatagggattctatgtttttattttcaagggtctaaaagagaactagaaaacaataaaaaaaaacacctagaaccacttagaaaattaaattttccggtggcttataagggtctccagatgcaagaagcacccaaacaatccagatttttacccagactcgaaaatgctgggtaggtgtaaaatctagaaaataaactagaagcaagaagctgagtagcttcttcgcattaacatcatacttacatgtctagttcgaacctcaatgttcgaaactcttttcctcagcaaaaagaaaaaaatgatgtatattagcacataattaacctgatccatgtctagttcgaacctcaaggtttaaactctcttcctcaacaagaaaaatgatatagaatagcttattagcataataattaattaagtattagctaaaacaaacttaatgaataaattaatattttttttctcaagcaattttcttatagatttattttgtaaaatatatctttagtagtttgaaaaatcgtgcacatgaaaaaggagagtaaaaggccgttttggaaccgatctctctggcatggacaacggagcctctcgttaacgcatgataattaagtatcaactaaaaaattgaaaaataagttaatatatttttttacatttttttaaaaaagtacgtcattaagtatttcggtaaacgtgcgtgtgaaaaaaatagagagtaaaagataagaaattatagtgtatataatacagcctaaacgactgaacataccatctcattttatttacaagaattttagtcacggagtaaacaacagcatgaactctcctctattttcttccttttcctttttggagacgaacacttgttttgatatttttggtatttacgagtactgactgcggcaggatgtttttagcatgagaaaagtggtttggtcggatctgtcagcagctggggtaaatgcggttattgcaaaggggaccaaagcgtggagcggagtggaaggagtggcatgcttggctctggcgtcgtgggccctaccatcacaccaaccgaaaataatgtaacccggcttgcagcatcgtcttgaaatggaactgttttggaattgtttttgcatcgttgtcaatagaaaaccatgctgaaatttgatactagcagatttttcaacagaaatctgctaaacaaaattattacagagaatgctagtagacactatgtacaaaaattgtgaaatatacagaaaaaaacaggtgctactagaaatttgtgaagttagcttatggcctgtttggcacaactctagctccacccctcatagagctggagctcagccaaatagtttcagctccaccaaaactgggagtagagctgggtggagctctctcacaaaatgagctagagttgtggagttgggttaggcaactccacaactccactccagacccaactcctagagctaaatttaggagttggagctgtaccaaacaggcccttagtgctatattggttggcttcgactgttaattagtagtggaaaaataagcagtgaaatgagaaaaaattttaaggtatgaatatgtttcttagcgatttaaaagccaaaattaaaaatagaagtaaaaaaaatataaaaacacatagagagtttaaaatttaaattttgaccgcgacattaccaagaacaaacaaacaatcagggctcctttgatttataggattggcaaatgattttcataggatttaaattcctatggtttttttcctatatgttcttttgattcatatgaaagaaaggaaatttttcataggattgtatttctatgcttcacattttataggaaaaatagtaagatgtgtgacctctttgtgagaaattttctataggattatatttctatgcttcacatttcataggaaaaatagtaagacgtgtaacctttttgtgaactttcttttatttttcccatagcataagaaacatactactacttcaatttctgctttttctctatttctatatttttcctatcctgcagatcaaaggatcacaaggtgttattttgtccgtagctgcacatgaaactatagctacgtttgaatggttttgcactaaaaaaaaatcattgcaacagttttttattagtcccaaaagccaagcattccccgcaaaaaaaaaaaaaaaagccaagcattaacctcacgaaaataggctggcgtttcgcggtgggcaggagaacgaacagagaaacacaggaggccaaaactgcaaattgcagcaaagcaaaaaggtagcggtgggtgcggctcagtctcccaggggtcgcaaccgtagatgcgcaaagaagaagaagaagaaaaaaaaggttaaaaattccgtaggcgcccgtggcgcagatcaaactcgcacgcgcacccgacgcatcatacacacacactgtctctctcactcactctgcatctgctgctgctgctgccactgccactcttgtccagaggccaccacacactctctctctctctcactcactcactctcctctactagctcgtctccatctcttctactcgtccaggcctccaagaatctctctgttcttgctgcttgcttggtggtggtggtagctttcataatggaggcggtggtggtggcggcgctggtgcttctcatgtcgtccagtctcgtcgcttcaggtgagcgagcttaagctcagctctccccgggggagggtctttttctaacctttctctttccgtctcgtttagatttctgtcctgagtgagtttgtgcctcttaaataatggctgggaactgcaaaggctgctgctttttgtttctgaaggttgattttgttggagttttggggggatttgttcaggtgttgttctattctacacttctacttgtcggtggttctttttctttttttgttctttgatgtttctcagtttctgcttggttcatccattggtatgtttggaacttggaagaagagatctttctgtttggttcttccattttctaggaaagatcagcattgcatgtaggagtacacgctacttttgttatggtttgtgaactactttttttttttcagattcccctttcctaccttgctatgtcaaacagtactagccatgtactgcttagctcttgctgttcatctattgctgaagaaaataactcaacaaggaccaaggacaagaaatctcttgttctcccctctgagacagttggagatgtgttcttctcaagttgatttattttttttacatttttactttctaaaacaagcaaaaccgttactacgccgattttctcctagttttctgctctttctgcgcagacgctactctctcttcttgattgctttcgtcacattccgcatcccatctcttcatcaagaaactggcataaaaactgccgccttttaatgaaacgcacgagttaattaatctctctcattgaatctcttctttttttttgtgtgtgtggtgtttcttggcgaatgcagattggtgcgtgtgcaggtcggatcagccacaggcggcgctgcagaagaccatcgactacgcgtgcggcgcgggcgcggactgcaactccatccacgagcaggggcagtgcttcaaccccaacaccgtggtggcgcactgctcctgggccgccaacagctacttccagaggaacagggccatgggcgccacctgcgacttcaccggcaccgccaccctcaccaccagcgacccaagtaaaaaatgattcaccacccaagtcacttcaattcttgttttttttttttcacgaatgcgcaaaaggattgcacgtcaatatattacttcctccgtttcacaatataagtcattctattatttcccatattcatattgatgttaatgaatctagatagatatatatgtctagattcattagcatcaatatgaatatggaaaatgctagaatgacttacattgtgaaacagagggagtagtagtcacttcaattccttcccagcatttctgtccactgtctactgcttgattaaatttgcgctcgcgtttcgggttcaagaacgcgtttgagtactggctgtcataatgtcattgagcgcttgcaagtttttgcggcaagtgtttctgccttgcacgattagaaatgtttggatggtgatgagtgggagtggtgactagcaatgtgaaggacgagctgtacagatgatggaattaagatttgtcgtgcgttggggcaatgcaagcatggcgtaatgggacgtgctttaattcaaccgtaaagtatgttgaagttttttttagcttgtttgcttgtgtcaccttatctcaattataaggtctctcagtctgatatgttggctagcatttgagcttgtggtcagttaggacaaacgaaaaggaaaaggagatgtcggtgacatctttttgatagctggcatggaagttcatctgagtgtgggatgatatccattctatgtatttttgttattttcttcattggttagagacatatctattcctcacacaatctcatattatctttggttgcaggtgtttctggctgctccttccctgctagtgcaaggtacattattaacttcactttaactgactgagttttattaagtatcactaaggatgattgacgtttcaaagtggtaaccaccaatgaaacttttgcattgtgtttgagcagaaggttcttttgaacacactatctgcctccattatatagtacatgttcactctgaactgcaatactaagacctatgaactgaatgtagccatctgttcaatgaactgaatgtgttacaacttccttatctcttttgtttgcttgtcaaagtcgtatatgctttgttattgaaaaataccaaagagtcaataagtaagtatacatcaccattaagaaccaagtccatctgttatttaaagctagtcttgtacctcatcctcaactactcatccataccaaaatgcacacctatgcctttccggcctgcatttgtgatgtacacatgactcctgaatgatctatagttgatgcaagtatcattgaaggattcctatagtatggtgtgccatatatctgaaggcaactgagatgctttgcaagttgaaacacgcaagactcttctggatttcgttgattgtaatatcctaacaacatttccatactcatgtgcagtggtgctggaacatcaaccactccgaccatgggaggcacaactggaacaatgaccccaggaaccttcacacctggaactggtatgggcacaaccaccggcaccggcatgggaacagggactactaccggcaccgggctgggcgggctagggccaacaggcacaagcagcatggacaccgcggcagcgggattgcacctaagagccgggctagccaccttctgcaccgtgctcctctcgttcgttgcgatcgcatgagggttgcacccttgaagcaacactcattttcgctgattgaaagaacccgatttcggtggttgcaggagcaatgtgatctgtgaaaagaaaaaaaaatgaacagaaaccctgatcctttctgaagatgtcatcccatccgaaaacccactattgcctgccaattcttgtttggtgtcgatgggtgtttgtgtggggtgagtttctgtactcccttttcttatgtcgtgtactctgtaatttggtagtaggatgtctgtctctttcatgcaaggactcccactatttctttttctttttcccatctttattatcttgtaaatctagggaaaaccagtaggtaggctcaaggttggttggaatgagaaggttgttgttgggacaatgccatcttaaggctgttatcaacttatcatcaagttgctcatccctgaagatggttgtggctcacatccttttgcccttcagtatctctgaaaaccgcaaaaaatgagagtgaaaatgtgagaggcagaattgaacatgtggtactagtatagtaggaataagccccctttgattcaaaggaaattcataggaattctaaaggattttattcctataggaattttttctatatagccctttgaatcaaaggaatgaatcctatagaatcatgtgaaattcctatggaatgcctaatgccatgcaagttttgtaggaaatctagcatgaggttttacctcatggaaactttcctacgagtcttcatctctcctttaattcctgcgtttttcctgcggtccaatcaaacggctattcctgtgttttgcaatactctcgtttgcacttgcatttctgccagaattctatattttttcctattcctccgtttttccattcctacgattcgaaggggccctcagattgtgcagatgtggctcctgcagagtgacattttagccctttagctgttaggtaacgtggcgcatcagtgctgctactctgcatcgctgaaaccgtcgtccgtttcttgcgcccatgtgggggttccatcgcggcgtcgggcgtcttgttgttgcgtagcgcatcgagacagattctcggttgatacttgaaaaaaatattgtgaaacatgcacctgcagctctctgatgaccaatcagtgtgttggtacgaagctagtacaggacacaggcatgcatacagctaagctaagccaaggctgtgtttagttcagcgtaaagtttggattttaattaaaattagagatgatgtgactgaaaatttatatatgtatgacaggttgatgtgatggaaaagcactgaagtttgaatccaaactttaaatctaaacacagcccaaagccaaagctgccaatgatgatggagcaagagcaagagcaagtgaggaacttgatgaatgatgatggtgtcaccactgtcactcacgcgggcctggtgatcggcgcaggcaagccgagtttaatggaggcagtaatggccgcgcagaagcagggtggatgatgcaggcaggcggcagcgagaggggtggggctcgactggaatcatggctgtctagcgcgcgcggcgcatcaggcgagaggaatcagggggggttcggggggtgacacggcccagttaaccttcgggcccacgttggacagaacagattggatggaaaaagtacaccgaaggtccctcaacttgtcatcgagttacaaaatcatccttcaaccgtaaaaccagatatatgatattatgaaaaccgttctttttgcccagctcgctaccttactccgctcggcctacctctcttcggtccagtccacaagtggacccgcagggcccagctcgtatatccaattgccatctacatccttcggaagacagcccctatgataccggagccgatccttccattaaatccggtcgaatctttctcgatctcccaaaatt

SEQ ID NO: 86202 - DNA, 6129 bp, Oryza sativa
tgaggcctttgaggatttctgcattggcgcgctccacttgaccattgcttctggggtgggcaggtgaggcgaagcagagcttgatgcccatgtcttcgcagtagtcgccgaagagttcactagtgaattgggtgccgttatccgtaataatacggttaggcactccaaaccgggccgtgatgcccttaatgaatttaagcgcggagtgcttatcgatcttgatgaccggataagcctcgggccacttagtgaacttgtcgatcgcgacatacagatactcaaacccgcccggggcccgcctaaacggtcccaggatatcgagcccccagacagcaaatggccatgaaagtggtatgatctgcagggcctgggccggctggtggatttgcttggcgtggaactgacacgctctgcatcgccggaccaggtcgaccgcgtcattgagagctgtcggccaatagaatccttgacgaaaggccttgccaaccaaggtgcgcgaggcggaatgggctccgcactcgccttcatggatatcggcaagaagctcaacgccttgttcctgaggaatgcacttcaggaggattccgttagccgcgcgccgatagaggatcccttctaccagcacgtagcgtttggaaatgcgttggacgcgttcactcccttcgcggtcctcaggtagagtcttatctgtgaggtatgcttggatctcatagatccaagcaatcaatctaagggagctaggagcgctcccctcgggtcccgaggcctgggctccgacgggcctcgggggccgatcaggcgcgtccgtctcccttaaggggtcgggtcgcgccgacggctgggcaagcctttcttcaaagacgcccggtggggtctgggctcgcgaggacgcgagtcgtgagagttcgtcggctatcatattatcccgtctgggcacgtgccgaagctctatcccgtcaaaatggcgctccatgcgccgtacttggcgcacgtaggcgtccatctgcgggtcagagcaccggtactccttacagacttggttaacaaccagctgagagtcgcctaacaccaagaggcggcggatccccagtccagctgccactctgagtccggcaaggagcccctcgtactctgccatattattggtcgctcgaaagtcgagacggaccaagtatctgaggacgtctccgctcggagaagttatcgtgacccccgcaccggcaccctgaagagacagggagccgtcaaactgcatcacccaatgggcggtgtgaggcagctgcgaggggtccgagctggcctcagagactgaaacggtctctggagccggggtccactctgccacaaaatcggcgagggcctggctcttgatagcgtggcgtggttcaaagtgcaaatcgaactcagaaagctcgattgcccattttaccacccgtcctgtaccttctcgattatgcaagatttgaccgagggggtaagacgtaaccacagtgacccgatgcgcctggaaataatggcgcagtttcctcgaggccatcagaatagcgtaaagcatcttctgggcctgagggtatcgggtcttggcgtcccggagggcctcgctaacaaagtagacaggccgctgcacctttcggcggggccgattctcttcgctaggggccatatccccggggcgctcttcgtccaagtggcctctcggggcgcactcgctttctgtgccgatgacctcggggtcggaggaggacaggggcggccttcccacagtggcctcggggccgtcctgggggtcgggggctcctggcgtcgtcggacgagcgggcagaggcccaactccggtcgtcaggggccttaggccaccgttcggctcgggggcctcttctccctgctctcccctgggtcgagtccgcacagggttagcctcggggtcaaagggcgataggtgcggccttcccgcagtggcctcggggccttcctgagggtcgggggcacccatcaccgtctgacgagcgggcagagggccgactccggtcgtcagaggccttaggccaccgttcggctcgggggcctctcctccctgctcgctcccgggccaagtcagcacagggtgggggtgcgcggaatgaggattgtcctcatcacgctccacaaccaacgctgcgctaactacttggggggtcgccgctaagtagagtagcaggggctcatttggctctggggcgaccagaaccggaggagagctgagatatgccttcaatcgaatgagggcatgttcagcttcctccgtccaagcaaacggcccagagcgtttgaggagcttaaataggggtagcgccttctctcccagcctcgatatgaaacgacttagggcggccatgcaaccggtgacacactgcacatccctaagtttgctggggggggcgcatccgctctatagctcgtatcttctcggggttggcctcgatgcctcgggcagagaccaagaacccgagaagtttgcccgcaggtacaccgaatacgcacttatcggggttcaattttatgcgggcggagcggagactttcaaaagtttcggctagatctgagagtaaagtctcttggttgcgcgtctttacaaccaagtcatcgacataagcctcaacattacgtcctatttggctacccaaagaaattcgagtagtacgctgaaaagtaggacctgcattctttaacccgaagggcattgtcatataacaataggttcctatgggggtaatgaacgcagttttttcctcatcctccctagccatgcgaatctgatggtaaccagagtatgcatctaaaaaacacaaaaggtcgcaccccgcggtggagtcgacaatctgatctatgcgaggcagggggtaaggatccttaggacatgccttgttaaggtcggtgtagtcgatgcacatccgaagcttgccgttcgccttaggaacgaccaccgggttcgccagccactccgggtggatgacctcgcggatgaatccggcctccagaagtcgcgccacctcctcgcggatgaaggcttgacgttccggggcctggcgccgcactttctgccggaccggccttgcgcccagccgtacggcgagacggtgctcaatcacctccctggggaccccgggcatatccgccggtctccatgcgaagacgtcaacgtttgcccgcaggaaagagacgagcgcgtcttcctatttgccatccaagagaccaccgatccgtgtggtcttggacgggccgtcgcccaggacaacctccttgaccgggacctcatcgcacgtgactatccgctgcctcggggcggcgggggcggatgtaccaagcctctcgtcgccaccctcgggcttggacacgacggcgaggcggtccgcgcgctgctccatacaagcgagcgcgactttgaggtcgccatggacagagatggggccatcggggcccggcatcttcatctggaggtaggcgtagtggaccgccgccatgaacttcaccaacgcgggcctccccaggaccgcgttgtagggcagactgaggtccgccacatcgaagttcacccgctccgtgcggaaattggcgggtccaccgaaggtgaccgggaggtcgatatgacctagcggccaagtgtgccccggcgtcacaccgatgattggctgggacggccggagcatcatccccggggccttgatggcatcaaaggctgcgggggaaaggatgttgagggctgctcctccatcaatgaggacccgccccaacttcacgttgcaaacggtgggggaaaccaccatcgcaatctgccctccccgggcaacgcacggtgggtggtcggtctggtcaaaggtgagggcaacctccgaccaccgcgcccgacgcgtcgcctcatgagtaggggccccggccagaagctctcgcttcatagccttgaagctccggcgagaaacgtgagcacacgctcctccatcgacggtagcaatggtggccccaggctcttgaaaacctaggtcatcatcgccatcatcgatgtcctcggcgggggccttctgcttggcctcacttcgccgatggccggaaggaaccgccggggacttgccttcccggcgctcctgcctcctctcctcctcccacttccttgtccgctcagccaagcttttgactgcgcgacagtccgcaaggtcatggagggaggtgttgtggacggtgcaccacttgccggtggggcgctccctgctgggagcgctggcctccttctttttgtcgctcgcaggcctcccctttcgggtggcccgcgaagcgccctcaacggcgaggacatgaccctcgtcgtcggaatggactgacctctttttcctcctcctgtcacgccgccctgtttgagcagcggatccgggggcggccgaagctgccacaccggaaccggaggggttccaagtccaggcctcctccttgcgagccactcggtccgcgagctgaaaaagctctgcggtagtctggggctccttggaggcgatcttttcgagcatgcggttgtgccgcacgccccccctgaacgcgtaaattaccgcgtgtgcagggatgcatggtatggtgttgcggacttgacagaaccgctgaatgtacgagcgaagcgactcatcatcccttcgctgtactgcgtgtaagtccgcttcttcacctgggcgcggatatgtgccctgaaagttcatagtgaactgctggcacaaatcctcccaggagtggacagacgcgggtggcaagttcattagccaaccccgcgcttgccccttcagggccatgggaaagaaattcgccatgaccctgtcatcacccccggcggcctcaatcccggtcgtgtagacctggagaaactcggcggggttgatgctgccatcatatttttcggcgatggtgggccggaaccttgggggccaacggacattccgaagactcgccacaaaggctctacagccgacaccaccaaccgggggcacggagggctgatccccacgtccgtgtcgaggtgacactctggacgaggaagcgccctccgttgcgtgggcagcacttcggtcattgcgccggcgctcgatgctggtgcgggcgtcctgctccccacgcagatcttcccgggtcgaaggagtcgacgaaggagtggcagccgaacggcgaacagcggctgccgctcgtcgtgccctccgtcttgacgatgcggagccggtggtagcagcaccagaggccttggtggcggaggaccgcccaccagcatctaggcgctgccgcgccgtcatgaccaatttggccacgtcgtccagccatcgttgggctggagactccgggtcagggacgacaggcgggtggcgtaagagcgcgcccgcagcttggagcgcgccctggggcgtgctgccgtcgccgtagacgaggaggcgacgctccccatctcgccgttcttttccgtcgcccgcgatcggtgaagtcgcggatctttcgaccctctcgagcgcctccccctgcttaggactttggcgtggagggggcggtggagtacgagctcgacggcgtgggttcggctccccgtcgtcgccactcatactcggagagaggtcgtgcgcctttgcttgctcggccatcaggctgaacaggaaaagcttggcgcacagggcagagtgcgagagctcagaagacacacgctgaaccccctacctggcgcgccagatgacggagcgtggggctcctcaccgggagaccgcacaggcccccctttgccggttcggccgggggctcagggtgagatcccaagctctctctgtacgtggaaagatcgcgacctatcgaaagagcatgagacacaagcgatgtatacaggttcgggccgctgagaagcgtaataccctactcctgtgtttttagtggatctgtgtatcaaggagctacaaagtgtgagccaacctccccctttgttctaggttccgaatcaggaaagaatccaaaaaatcccccttctccatgggcaaggtcctccttttatatttcaaggggataccacatgcaccctccctttccaaactggacttttcttctcttcataaatggacggagatttgcacggttgccctccga

SEQ ID NO: 86203 - DNA, 580 bp, Oryza sativa
aaagctacactacaagcccagccgttgcccacgctggcttgtggtaagtacgataagttcttccagggcatcccgcgaaccggtccttaactgccatgagtgcgaccagcaaaaccatgcacccacagcccaccatgtgattcattttattaaccaacaccagagcggtggtactaatccaacattaccattagaattaacagtctaaacattaatatgattttccccattgtgaactagttgaactaagcactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggactttt

SEQ ID NO: 86204 - DNA, 1519 bp, Oryza sativa
gacgcgggggagtggggaggagagagaggcgggattcggttttcgaatcccggccatctcgggcgcgggcgcgagcgggagagagaggggaaaaggcgcggagagcgcggcgcacgcgcgggcgtggtcgacgtggcccggagaaggcggaggcgtgggcgcggcgacggttgcgggcgcggcggcgcgccggaatcggcgggaggagggagacgggtccgacaggtgggccccacctgtcggcgaccccgagagaggaggcagcggggcggcctgggctgccggactgggcctcggcctgcggccggcccagcaaggaggagggaaggaaaaagggaaatgggccgacggcccatttgacaaaaaggaggaaaaagaaaggaaaaaagaaaaagaaaaggaaaaaggatttttccctggaataaaatattgcttgctcaattttaattggttaaaattatttctagagctctgaaaattccactaaaaatcctgttaatgaattttgacatgtagaactcaagaaaaattccacatgtcaagtctgattattatttgcattactttctttagggttttctcctgatttcacctgcattttcttagggtcatttgcaaattaccattttgacttgggaggaaaacttcggggtgtgacagggctagtgcctggggagatccacatgtcgagactggccaggccgggaacgtggtgaccgagggttatgggtgacccaattgtgggtttttgccgattcccccccggagttcaccacgccccggggcacggctcggttctgggccccgtttggcgatttttagccgacccgagcccccgagggcaggattgagcacgagtgacctatttcaagtcaagattcttcaaaaggaaaaaacagcacagatacaacctttaggaaattgaaactgcttttattgaaattctgaaataagagaaataagaaagtgcatgtgtggcagcccccggccaaccctgcacgcccgagggggtgcggggttggcccgagcctgaaacctaacacccgacccccccctcaggggtagaagcgacgaaggtgctcgatgttccatgggttaggcaactcagtgccgtcgcccgtggccagccgtatggagcccggccgggggacgccgatcactcgatacggaccctcccacattggtgagagcttgctcaatccagcacgcgtttggacgcggcgtaagacgaggtcgtcgacgcagagtgatcgggcccggacgtggcgctgatggtagcgccgcaggctctgctggtagcgtgcggctcggagggccgcacgccgccttcgttcttccaagtagtcgaggtcatctctacgaagctgatcttgatcagcctcgcagtacatggtggtccgaggagacctcagggtgagctcggatgggagaaccgcttctgcgccgtagacgaggaagaaaggcgtttccccggttgctcggcttggtgtggttcggtttgcccagagcgccgctggca

SEQ ID NO: 86205 - DNA, 678 bp, Oryza sativa
attggttgtcattatgccataccgagatccatcggtgtcgaacaatagagcccacttctccttaggctcattctcaatccactgagagaaatttctgatggccgaccctgacctccttctcattgttggtgggtcatcatgtaatgcactaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagatccataagatgcttgttcttgaattgcttgtacaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcgaaagccataggtagaacctggttgttcccatcacacccaattgctgtcaatatctgacctcggtatttacctgtcataaaagttccatctatgcatacaacaggtcgacaatgcacaaaagcattgat

SEQ ID NO: 86206 - DNA, 4462 bp, Oryza sativa
agggcgattttgtactgtgctctatattttttttatataaatatcaatagttatcaaatctttttatattgaaaactatacaagactaaaatctccaagactggtaaaatacaattttattattttttagggcatatttggaatgttaccgtacaaatattttgttaatgccaaaatataagcaagttttggcactaccaaatatttggtatggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggtgagggatcgacgctccgtgagaggaagagctggcgaacgcgcccgaagaggtggcgaacgcccctgcggagctcgcggaagcgccggtcgtgcctgcgaacgcgctcgaaggcatacgaggtcctgcgatgaggaaacgtgcagttaaaaaatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcagtcaagtgcaaacctctgctcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattgtatggctcgatgatgtaattatcataaaaatttagaaatgaacaatccgaactcacgagtggtcggcaggggggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaaggaaaaaaaaaagaagaggactgataaacttataacgcagcgaagttgcactaaccccacgtcgacaccagtaagtccccatcgtgggaccgtcctctggccactgcgcgctgcgaccaaccccgtagggtgcgctgtccaccactagtcgccctatggcaaacctctcggctgcccaaagctgaagcaacataggacagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacagttaagaatgaaatgttagtacaaaacactcagccggtcgcaaataagcatgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtcgacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtgcaaaacaaagcaaagttgagttcaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaagattgaattgtaattacacgatagaagtatttagtccgaacactcattacatcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaactttgatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttat

SEQ ID NO: 86207 - DNA, 855 bp, Oryza sativa
cacaacacaactcaaaacagtgcaccgttcctggatcataatcaccccctctacaatcagaggcatggactccccagcgacccccatggacttctcgccacttcacagtctggcacactataatgaatcatgctatacaaaagataaagccattgcccatgctggcttgtggttggtacggttaatgtttcacaacagtagctcgcgaaccggtccttaattgtcatgagcacgactctcaaaaccatgtgctcacaacccaccattaatcatattttaattaccaattaattatcataacacgattaaccatcgtgagctaccattaaaaataaccataaataataatgtagtatatatgattcatcccattagtgagctaatgtttctaagcatggctaagcaattatatctaacatctagttgaaccaatatatataaagctcaactagtcaagttataataacccaaggtatcaaggaatagggtaatcaatgcaaactggccataataaaggaataggttcacaccacccggtgacattcaaaaataaatgcacagttgaaataaatagagaatttaaatatagaatcaacatgctcaaaggattgtgtttaggatctgtgtgacttgccttgcaataatcggtcttcaattaatcttcttgatgacttccgacgcactcacgaacctttgcaacgacggaaacgacaagctaacacgtaaaacgaagaaaaagactaataaaaaccaaataaacagtacataacaagtaaacaaacacgtagatcataattttagatgaattatgagacttgaacggcctcattctgaatgcaaatgaatttattatga

SEQ ID NO: 86208 - DNA, 2708 bp, Oryza sativa
acctaagtaggcgcgccacgccacatttaatgtggcgtatagcacgcctaaattggtctgtgaccggtcgaatgaccgacgggacccagggtgtcaggcgcactatcgcatgtgtcagggggcgtacatcccgtcctgtccagtcagtcatgatgatgagaggtcttagcctcccatcccggccagagtcggttcattcgctctggtcaattagggttcccgtttcccagtgcaaccaggagcccagaagactacacaccttaaatggtggttgacaggggcaccccccgtgttaggcggcaagatttggcaggcctcatcatcaagatggtatgcgcttgcttcccaagtcaagagacaagacaggcatttaatgcaaagattgtaatccttctccactaagttgtgtttttgggcccatgtggtaaccccttgaggtataaaaggaggtccaggcctagtaagagagagagagcttatgcccctgatgatcaacaccttctaccccaacaaggagatcttgtaatttctcacaagatcagctaagcacagaagtagggtattatgcttctcagcagcccgaacctgtataaaccccttgggtcagatctttttggggggttcaaccccatcttcacacatctacacaggaatctcgaatctcacccgctgccaaaccaaaaaagagggacctcacggttccctggtggaggagttcacctttcgacagccttgatgtgttccggtagcttcttctcgtctagcgtgtatgtgtggttcggcttacttatcatgcacgggtttaggtaggcaacaggcttttttatcacttcggcctccacgtaattcatcctgccaacaatggatgatcaaatgagctacgcatataggtgtagtgatctattaaaacgttcaagtctagcacttacagacaccagatggcaatcaaattggcgtccagcctcttcctacagtagagggaatgcatatcggagaaatggacttagagtagacaaagacctctctagaagatgttctcccccacagcaactgtgaatgatgaaatgcctttcatggtgcttgccctaatgtaccaatcgtgccgccttcttagttgccacggtccttctcttagtttccagtcgtaaatgaatggtttgtcattctcaaactcgtgtggctcatctagagaattgatatagttgagatagtgataaaaggtatgtttgaacccttttaattttcttttatcaaactcggcatttacgatatctttctcctttcctcggaatgccgttaccatatactgtttcttggacgcactttttgctttgtgcttgtgcgtccttaccatcactagcacatcggcatccttaggttcctctggttgcgatggctctggttgatcaggcattgtctgttcaggcaccgcttcaatttcacccgccgctagctttgtaggctccgcttgtacaggctctgatggttgtgcggaagacatttgtcgtattgctagctgtgattgttgctttgcaagcaccgattgttcttatgcatcctttttagtcggaggtgatgcaacaggaggctctgatcctggaggtgatgcaactggtggctctggtctagggggtgaagcaataggactatccctcggactagctacgactagtggacgtgatgataataccgatatccttggtggacaatcagttccttcagttgaccctagttcaatatcattcttgtgccatagtatgaattggtcgacggcatctccaaggtacacaatctactcagtagttggaaagtcgagcgcgtgcatccagtaagcctcaatgaccgtccggacctctaccttggcgtagtcatccggaatgtcttggcaatgaaacctgcgacctggtatgaacctcccagttgcaacgagtattttctttcccgccctgccgaccggaatcaagagcttgcacggagtatcctccgttacatcatcgaaaggatagctcagctcaggctctaaaacagcagcaccgtgcatcattttctgactccagtatatattgcattcgtcacgagctactgccctagcctgagagtcaatctcttccctgtagcgatcacgcttcttgtatgtatgagcatcctgtttgaatccatccttccagctagtctttgaggatactccccgtacacggccagagtgctccggtttgcccaaggcataggtcagctcgtcccagtctctatctggcacaaacgtccaggcctgttgctgcgtgatgatgttcttcatcttgacagctacctcctggagcttctgatccttgaatactacatccccctcagaggtgaaggccggtgttcttgcacgcacccagttcctgcttcgtgggttgtgatttttcataggaatcggtttcccagccttctccatctcttcatcttgttttgccatttcttcaccgcttgccggtaaccggtcgatcccaaatgatgtggatattcattccttcttgctagctcagccatcttctagctcttctccttttcttccgccgatgtcttaagggcaatgaactcatcccactgggcctgtgttatccttccgtagtccttaaacggcgtgagtcccttctacatatatttcttatttaggtctattttccagtttcgccacagcttctccatagtcttcaacgcatatt

SEQ ID NO: 86209 - DNA, 620 bp, Oryza sativa
gtacccatttttcgatgcggggcttcgatttccgtgcaacgtcttgctgcccgagatacttcttctcttcatgatcgaattgccccaacataggcccttctgctctggttcgggaaggggaaaggagacacttgggaaaggacttagagtcatggaggatcatcgaggacatccaagtcaaggtggaggcccaaaccaagtcggcttcgagtgcaattcagagtctaggatcagtctgcactaaaatgggcacgcaggtcgcatacgtgaccagattggggcgttctctatatggatggaaagctaagaagatatcctttccaatggttttggacacacgtccaaattctttccgagtcaacgggaatcgactgaataagttgacatccaaaatatatcccggtgctgcatcatcctatttgggctttcgggccgtgtatcgtgttggaacctattagggttgcgttaagggttggttgcatgaccctaaactcttgatatcagtacctgtcgtcatctttagggtttgggttttgcttagattattctgtcgagaacagtttcaccgctagatcggtttgtaagacccaacttgtgagcttattcattcatctgcattt

SEQ ID NO: 86210 - DNA, 860 bp, Oryza sativa
attagtgatgtctggctcgatctctggctcggtgtcggtcccctctgtctcggagtcgacttggatcggagtctccaaactggaacccagctgcggagaaggtgtagggatcagtggagtgtgcacaatctccggggcaggtggctgtgtcactgtcgggtccaccaagtaaggtgctgactcagtagccagcataccaacctctcccaaaagagcgtgcaacgctggtgggtatggcagggtgaggaaaaagtagcggtcacgtcctactgttgtggaagtagaagctcctatggtgctgaccgtggctgctcgaagctgctcctccagctagctgacgtgctcctgactctctctcagctgctcctcaagtgtatccatcatcccgcggctgtcgttgtactggtcagataactgctggaactggtcgccgtggacctggagctgtgcctttagtgagtctatctcactgccccaagcctggtgctcctcttccagctgaagctgctgcactgtgaggtcagtcacctcggtctctaactctcccatatgcctctgctggtcgtcgatctctaacagagcctcctcgtaaaagtcgtctactgcctcagcccatcgtgacagtagggtcactatcgggttgtagcagcaaggtgtgtcctgaactgtgcagacggagttgctctcctctcgaaacaggtggtgagcaaactcagtactcaccaactcagctcggtggatagagctaagtccgaggaaggcctaccgggctgcatgctgcatcgcggtctccggtaagacctgacagtggcccatccggaaggcggagtctgactctgaaggaactcgcgtgtgaacct

SEQ ID NO: 86211 - DNA, 549 bp, Oryza sativa
cgactctagaggatccccggtttcctatttgtgcagggagttccgtaatatgtgttcttctcagattaaggtattccaattgaaacagcctgcacaagtctttgagatctctatttctcaggaattcgtagccttctaagtccaatattctcattaatttcatccaaccaaactgcaatgtttctccatcggcaaatatgctcaaggaccggacatggcataatatttctcttgtggcaatatatttcacacctctgctatgaacagttagccgccttatcttctcttgcggaaacaaagtgttctgttctcctactagagtgataaaattatcttcaattgactttgacacaatgatctccaacatcacatcatgaactcggaatgttttaaccttccctgtaaagctagtggtcactggctgaataatgctccggttaatgaattcatcaaagtagctttctgccacctcaaaaacactcagtccacgtttgccagtcacaaagcgttctgctacccatcgctgaggggtaccgagctcgaattcgc

SEQ ID NO: 86212 - DNA, 623 bp, Oryza sativa
tctcctcttcctgtttagtaaataagaccaaggaaactaaatctgcatttcctccatttctccccaatgcagttctagcaaattgtggtacaatcttgaattttagtcatgtcattgctacgagaagtaatgcaccgcttgaatcaaaacttgaaattcttcttcaggtaaatcaccacctcttgctgaaacaagtacagtatgagggttaatgctatatttctctttttgataatctcatttactttaaggaagctgggaggggaaatatacttacaatcaagcaaagaattatgcagcctgcagctccaggaaaaagggcataccagagttgcaagtggtgaaactttggaccatcaataaacaagagaggcaagcttgcagctgcaatcatcatggaaatggcgagctttgctatgatgcatttaagtagagtacaaaaacagatgtcaatcagaaatatttttttaaaatctgctgagcacatctaaagcaccacatccctgttgaaagaaagattatatacctggagggtgtgaggcgccttgaattgtcatgaatgctatggatgcagaaagagcagcacctcttgccaaccatccaagcccaaataaagaaagggc

SEQ ID NO: 86213 - DNA, 686 bp, Oryza sativa
agtggatccccccttgttcgtccacagaacaataatttccatgacgaaatggttgagcagtacggtcgggttaaacgttttcttccggcggtgttgcgggacctgcatttccgtgcggcaccggcaggtgaacatgtactggctgcgattcattatctggcagaactgaatggttcgaaaaagcgcatccttgatgatgcgcctgaacatattatcaccggtccctggaaacgcctcgtatacgatgcggagggacggatacagcgtgcaggttattcactatgtttgctggaacgccttcaggatgcactgcgccgccgggacatctggcttgaaaacagtgatcgctggggagatcctcgcgagaagttgttgcaaggtgaagagtggcagactcagcgtattcctgtctgtcgggcactgggacatcctgtcgatggacgtaaaggtgtgcaacaactggctattcagctggatgagacctggaaagccgtggcatcacgatttgaaaagaatgcggaagttcatatctgtaatgaaggtaaatatccatccctgactatcagttgtctggagaaacaggaagagccaccatcattgcttcgtctaaataatcggatcaaacagctactcccaccggtagatttaacggaactgttacttgagatagatgcccagacaggatt

SEQ ID NO: 86214 - DNA, 556 bp, Oryza sativa
gcatccgtctctcccgggccacgtcgaccacgcccgcgcgtgcgccgcattccccgcgcccgttcccctccctctcccgctcgcgcccgcgcccgagatggccgggattcgaaaaccgaatcccgcctctctctcctccccactcccccacgtcggccgtcgaatcccgccgctcccggccacgtccggttcccccatcccctatttaagcatcaccggcaccccctctcgctttttccccattgcgccgacctctcccgagctccccaacgcctccgcgccgtgcaaccacccgccgccgccgcttttgctactccggccgccgctagccgccgctaggctcgccgccgtctcacgccgtcgccgccgttagcttcgcgcggccgaggtccacctcgtccacccctcctccgtcgaggttcgtcgccggagccctcatctccacgcgcacgggtgagcgccacctctaccgccgccttcggccatagatcccgatcgccatggtccatctctctctctctaatctctatcttctccttccttagggctgcaggaa

SEQ ID NO: 86215 - DNA, 625 bp, Oryza sativa
acccgggtaaagccaatgtggtggcagacgctttaagccggaaaagttactgcactgccctatgcatcgagggcatgtgtgaggaattgcggcaggagtttgagcatctcaacgtgggaattgttgaacacgggttcgtagccgctctggaggcacggcctacgctcgtggatcaagttagagccgctcaagtaaatgatccggaaatagcagaactgaaaaagaacatgagagtcggaaaggctcgggatttccttgaggatgagcatggcacaatctggatgggagaaagattgtgtgtaccggacgacaaggaattgaaggatctgatactcaccgaagctcatcagacccagtactccattcatccaggcagcactaaaatgtatcaagacctcaaagagaagttttggtgggtcagcatgaggagagaaatagctgaattcgtcgcactctgcgatgtttgccaacgagtgaaagcagagcaccaaagaccagcaggtttactccaacctcttcaaatcccggaatggaaatgggaggagattggaatggactttataacaggactgccccggacatcatcgggtcacgattcaatttgggtagtcgtggatcgactcac

SEQ ID NO: 86216 - DNA, 668 bp, Oryza sativa
cacaggcttattcattgttccaccttttatttcgtgccattgctaaggtccaatcttgatacctcagagagctgcatgatgtgtagatagtcctaacttaggtccgttggttagaatcatccattcatgtttagaaaagtgattaacaacgtgtgctgcattaaccattaatgtggtcaactctgatgcttgtgctatggtcactgcaggaagtacctatggagaaaagacctgagttgggtccccagtcgttccctacttcgtggtcatggcaaatgcagggctcccctttgccattactccctactgcagcatcatcaggattctctacgggcaccgtcgccgacgccgcccgctcgccttcctcccgcccccatccatttcccggccaccaccagttctacttccccccgaccgcctgactgccacctattctggtggaggcgacacctcaccgtgcatccaccgccgcttgctgataacattcgtcgtttgtccagagagggaccttctccatatgatatccctctctatgttccacctggttatgatcagaattctcacgctcatgattcttttatcttcatttttgagtgcgaaaccacgaatcgtgaccgtgctaccaggtaaacacccttgtacctctttgactctacaataaaattaat

SEQ ID NO: 86217 - DNA, 555 bp, Oryza sativa
atctacaacttttgttttggtcattttgctatatcactctgtttcaataatttgaatttgaatttcaaattatgacaacttcaaacaatattttcaaatactaaatgatttcaactgaaaaggtcatcaacatcaaagttgtataactcatcagtatctataactttattttggtcatttcttcatccgacaaagtgatagtaacattgtttataaaatttacatatctctcctatagtttataaactatataagagatttgtacattttgtgaataatgttataaatcactttgtcggatgaagaaatggcccaaataaaagttataggccttgatgagttatagcactttgttattgataactttttaggtgaaatcatttagtacttgtaaaatgtcgtttgaagttatcataatttgaaattcaaattcaaattgtgcatacaaagtcatagaaaaatgatgaaaataaaagtggtagatcttgataagttatacaactttgttattgacaacttttccattggaaatcatcgactacctgaaaggttttc

SEQ ID NO: 86218 - DNA, 708 bp, Oryza sativa
cgctcctacaaatactcctaggctgccacatggcactatctaatctcaccgtcgattttcatttaaattggtgtacctgttaatttagaccattagattagatctattattaaaaaggtgatagttttttctaaaaaatatgcaactggtggctgtgaaaaggaaagaaaactaaatattcgtacgcaagtataattgaaaaaagaacaaataagcttcctactgttaggcggaagaaaaaaaaaacatctgtgtacgacaaaaaatgataaagccaaaaaaaatgtgtagttagtaccggtggaaaaaacgacggtctaaaataggattttgtataatataaaatataattacataatatacggaagtatatgatctatgatataaatatcaaatatcaaatcaacggtctctaaacattatcttttaaattatttttcgtttaattatatatagtatcggtgtataaaagtaatgttgtggtcctaaatacatcatgacacatcgggtcgacatataataggtaacgttagagacctattaaacgtgctacaaacgcttctaaatagtcgtgtggcactcctacgaatacttctacgccaccacgtggtgttctagtaaattagagaaaaccttgtaaattatgagaaaaaaaacatccaatcatttttattggttgacccactatttttaaactactagattaga

SEQ ID NO: 86219 - DNA, 715 bp, Oryza sativa
aggtgcacagttgcacacatcaatccacaggagaactgtagtactgtaggatgaatatggtgcttctttttttttttgaattatttgcatccctcttatgaaagtacgatttctgcaaatacttcttatatcagcattgcttaattacagcacttgttctgtttgtttgcttaattcaatagcttctctatgcatttgtttctcctctaattcaaatggagtcaacatattacaagatattggacggctcgaagcttctctacatttgttttctttactctttatcgatgaataggatggcaattgatcatgatactaagtaaatactctctgtatttaatattacaagtcactttagatttattataaatcaaatatcttttaagtttgactaggtttgtagaaaagtatactaacatctaaaccactaaattagtttcattaaatttaacattgaatatttattatagcatttatattttgtgttaaaaatgttgctatatttctttgtaaatagatgtttcacttgggataaatctaaatagacttataatattaaatggatggagtagcttaattaatttctattatgaaaaagatagcgtctgtgatgatcccacttgtagaatcttagctgtccaagcaaaggaacattgattggaacagctaaagagcggacattagaagtgggaagccgcatccagtcttagcccag

SEQ ID NO: 86220 - DNA, 1389 bp, Oryza sativa
attcctgcaccccgtcctgtttggttccatgagctaattattagcccccaccttttagctctgaattagccctcaaggatccaaacaggtggtttaatttgggggtagagtgaattagcccctctcagaacattagcccctctaaggggtgctaatggggctaattttctgtggagaccatcaaaaagcagccctatctctccctctctctcctctctttctactctttctccaccttttagccttaaattagctcatggatccaaacatatcatcttaggctaatatttagcctaccaattcatgactaaacattagttctcaaaattagccatgggcaatcttccaaacagggcctagttcctctcgcatacctgaaaaagcatcatatgcacaaaagacggattcggacacaactaaaattcaggtttagttatttgttatataaagagagaagatttttcatgactagaactaatatcatagcacggctaacttgtgcagaaggttcgcctgataacactgttcctgatacctctcatacctatgtagacttattatatatgcagtactctttttttttccttatatgtgatgtgtgtcctctggccaatattattgtttcatctgttctgcatttggaggtttatatgacaacatgcataggaagaagagtagtgacaagaggtaggtgctacaaagatcctcatagatgttcatgttcgccagctactttcttcctgcttactccactttttacttttttcatgcaatttaccctaatatgtaaaaaaaaaaaaggaagtaataatgtgagaatcatgacgaggcccttatagatgtcatagtctcacaggatgataatagcagagtagaagtaggtgctgtaattgcttgccgatgtaaatagttaacgtccaatgtggatgcacagcaagctgagtaaagaaccatggtggaatgatcagtttttttagaggccttcatgaatgcagtactgtaaaaaattcatggccattttatggctcattctacactgcacaatatatcagcagtgaacttatcatttcagttccaatacaagcatgtccaagaaactgcatacccatagttcatacatcacgcgataggcatccgcttcgaatatcaaatggttcatgagaatctagacacaatagattatatgcatatcaacgccttaacaccagaggctcgcagatgcttccctcttcaggcagcagcgaccgctggaggaggcaacagggttatctcaacattgtcatgagccccctgtagaagcagctcaccatcatacttaacaatttttctcttcttggcagcccgcaaggtgccgactagtgcttcaaatatgtttgcacaacggtcatc

SEQ ID NO: 86221 - DNA, 1059 bp, Oryza sativa
agaggcgatgggacgacacgacaatgccctcaagagggaatgtgacgcaaacgccatagttgtcggcctggccaaaacctggctaggttttcacccatcgtccgccgcctgcctatccaccactgatgctacattgctccttccctatcaaacctccgtcggcgcgtgggtattgctgcaccggcgcccactgtcggccagcctcaccaacctccctatcgtcaccagccactgtcgcgtcagctttcctcgccatcggttgggccggcctccctgtcgtcgcccataccgaacctcctgacgccacccgctctggtgtaccgttgccactgtcgctacccactctcagttgcaccacgcctccatgccaccggtcattcctccacagcggcctccaggccggcctcacctccacgcgcgccaggtgcgcctccacgccagccacgacctcgcaccgttgtcggctgcacctccatgcgccatggctgcctgtcgccgacggccgaacctccttgctccatcctccaccgccagccgtggcgcctcctcagcctacccgcgctacgccagcgccacctcaagccccactgctaggcggctgccggctctagccgaggaccagatccggcggcacataccgcagtcgccgccgtccctactgcgaccccgccgcttcctcccttacctccaccttcgccgcctctagatctggcggcacccaccacggatttggcctcgctgtcatcgcagccaccccccccccccacgttgtttgcacctcgcggctatcttctcccttccccgcgtccactttcgtttgtcgccgtcgtccgcgcgccggcatcccgcctcaatgccgacgtctttccagcctccaccttcatctgtggtggtcgctgtcgctgtcctcgcaggccgtcggctttgagcgccgactttgcggccactcactcaagcggcgcgaggtaggggagaggttagggaaggtaggcggcggcggctagagtttcccccgagtcacatgtgtgggaggcgacacgacagctaagggtatgcagt

SEQ ID NO: 86222 - DNA, 801 bp, Oryza sativa
agcacttatttacatctttttatccagatttttgaaagaggagtcactcaggaccaagtaattctgatggctgctagagcatcccgaacagaaaatcaagatgctattgatactgcaatagtcgggatgctcgctgatccaaaagaggtacatcgatttgtcagataggggaggaacgactatcttgtttatttgaggaattaaacaccaggaaatatttcctgcaggcacgtgctggtattcaagaggttcacttcctgccattcaatccgactgacaagagaactgcattgacatacattgatagtgatggaaagatgtaccgtgttagtaaaggcgcaccagagcaggtacaacaaaaatcatctgcagatatgttaaaaaagctttgctggaaatttccatttatatgatggagttattgattgatttcataaattgacatgcagattctcaacctggcacacaacaagacacagatagaacgacgagtccatgctgtaattgataagtttgcagaacgtggacttcgatcacttgctgtagcatatcaggttagcacttcttcggatactctttgcacaatttgaatgttttaacattttgagttaattaagattaggaactatccagagtcattatatatgttgaaaaatcattgttccctgggccagtttaattttcattatggtctcctttccctgtcatgtaggaagttccagatggaaggaaagagagtcctggtgggccatggcgctttgttgctctccttccactctttgatcctccaaggcatgatag

SEQ ID NO: 86223 - DNA, 632 bp, Oryza sativa
accaaacaattttcatcagcttaagttatgtttgcccccatccattgttccgtatttgataggttaaacacaagcaggtatgggctttattaccacaggaaataaaaagtagttgaaaggtaactaacaacaattacctatcaacaggtaaaattttcctaaatcctgttggcatgaccaatgtcaacatagaaaggaaaaacagaataaattaaaaaaataaaactatttcagattatctaaattgaactatttcagaggggctataaattgaaaaaaagaagaccaaaagtatacctgcacacggccttcatctgaactgtatatttttaaatcatgtctgtacgtgctatgaaggcgaagcaaaccagttccttcacctatattcaggataacatactagtaagaaaagaatattgagtacaagaaataaactttttttaaaaaaaaaaaaaagagaaaagaaaaccaagatgatacaaggtcatcatgcaagacaaggcagcctgacagagatcacatttcattgagaacattacattacttaaaatgttttaaagcttaaatacatgcaactttattcttaaaaaaaagaaacctgcaacagactgtaatgtcagtaaagttacttt

SEQ ID NO: 86224 - DNA, 984 bp, Oryza sativa
aaatctaaatcaactagtctcaagtaagtgcacaaagaagctagcctatgttgaggtttgcaccctaatagcacaaataaactctatatgtaaacttgctcaaagtaaatttgcacaaaataaaggagacaagagacaggaatttttcaccgaggttcggaaactcgccggtttcctaatccccgttgaggcgagcccaactctaccgctcaaccacgaagccatcgcacgccccctttgtcaaggggtgggcaagacgggagccagcccacggagaggactaccaaagcctcaatcactagggtagttcttcctacactccgaaggtggtaaactccaaaccactcacaatcggcgccgggcctcctccacaatctccttggagaggtcaccgggcaacacctccacaagccatctaggaggcggcaacctccaagagtaacaagtctaggatgcttgctgaggatgatcaagtgctgcactagctataacaatgaagcaatgcacttggattggcttaactcactctctaatatctcactagataaactaagtgcacaagggtatgagagctcttgcaagggttcaagataatgcaatggagtgccaaaaccttacccttgctgctggggagtgggtatatatacccccaaccaccaaaactagccgttggaactgaaatccccaactcagtgctctgccggtcagaccgccattgtgaggccggtcagaccggactactttttaacggctagaaaactagccgttacagggcaatcattgagcccactcaacctggtcggtctgaccgcagtatagtggccggtcagaccgtccacggctcggtcagaccgccgtcggcttggtctgaccggttgcggctctgatagatctgtatcgctaccaaaaaccagaccagtggggccggtcagaccggccttaccacgtaggtcagaccggctaacagccctggtcagactggcc

SEQ ID NO: 86225 - DNA, 706 bp, Oryza sativa
  unsure (1)..(706): unsure at all n locations
ttcggcagatagtcttcgtcttgcacccttcgcntaagacgcctctggcctggcaaggcactcgtacgactctttgcctcacgccgttcttgctccatagtcttcgccacgggtttcggcagatttggtcgaagggcctcatgccatccgccaacaaccgtgcttaccagtattcgaggtagaaacctaataacgatctacccattcttgcggatggttccgggcctcggccttcgactcgaagtggtgctcctcggagtctgacatggctcgactagaagtggtgctcctcggactccaacatagcgatcttggtgagttacctcatttggatagatcactagttcattattattgaatgcatacttagcgaccgcatctttcatggcaacatttgtactagactagatgatcccaaatcacctccaatgcaactatttctatcatctactagcaactcaatagatgaaattaacgtaactttttttatcatctactagcaactcaatagatgacattaaagagagttgctgactatctaaccaactattacacaccccaaatttaaatttaacatttggtttcctccaatatctctccaatcgctaattataccctctaaaacaaaaacatatgctaattttcattctcaaccaataacttagagaaactgtttatttataacatgttgcccgttgccatcctg

SEQ ID NO: 86226 - DNA, 513 bp, Oryza sativa
gcccggcccggtactagcccgacattttttgcttgcgagtggagttgaacggaccgcaccggcgtcagctcacgaggcaggaaagaaaccccaaacccgcgtcgccgacgccgtcgccggcacactcgccttcgcctcgcccaccaccaaaccacctccgatggcgcccggctcctcctccacctcctccccgggaggaaaagccgccgcggtgggcggcgaggcggggaaggagggcggagccgtgccctcgcccgcggcagctgcctccgaccacgctccggtggcgcccgacggctcgccgggaggtggcgcgctgccggcgggcggcgaagcggggaaggaggacgagggcgtcgcctcgaccggctcccgcactccgctggcccctggctcctcctcgggagaaggcgcgctcggggaatgcggcgaggcgaggaacgacgacgaagcgccagcgccagcgccacggctcatcgcctcgcccaccgccgccgccgccgccgccgccac

SEQ ID NO: 86227 - DNA, 648 bp, Oryza sativa
taacaatatcctatgccatgtatcaggaagtctctggaggcgaagccaagcagctccctctgtgggtgtgcctgcccatgcccattcatgtatgatatgcacctgaaaagaatagttagccactattgaaccagcagattggtatatgagaaaagtacaaacaggaaacttttggtttagaaatgatcatctaaacttgattggatagctcccgcttaacagatctaagttatttcaaggaaagagccttttctagtaactttaagaaatgggggttcgattaattgcagttcagtcaaagtaaaataggcacatactgtattaacccggtaggacttttctgagtttctatctgatcaattcagatctatgaagtattcagagaacacaaacaatgcaccaaaattgccagcaagtagacataatctagtaaacctcagcagattataataccacgcaagattcgttttcacctaaacccatgccataagaggaagactttaactagcaaagacctcatgtttgtatcaactatccccgtggcatcaaatttcacatgaagaaaatacattatcatctccacgaaacaccctaaacggcaggataaagtaaatgtacagtccatattctcacacgagaaaatggaca

SEQ ID NO: 86228 - DNA, 522 bp, Oryza sativa
gaagaaaaaaaaaagagcagcaccaattatgtgtatcatgttgttgtgatatgtagacagtagatgcatgataaatctcataagcagaaaatgagaagagaagtaaaacaaccaccacacataaacacaagaaatggaattaaggagaacgaatatgaccttaaactacttccccaaagtattccgcattatcaaccaaccatccatatgaaagtcattggagtgacaaaagaactctgaggggggcaaatgttgacataataaagggctaagttagttctataataacaaaatggctcccacatattatgtcctctcctcgcgtaacactcactcctccaagcaaaatagttaggaagctaagcgtttgccccagctcaaccctcccaggatgggcgtggccacctccctgcgaacctccaccttgattgttgtaataagagttgccaccaccagagcgaccacccctgcctctgttgctgtaccccctctgctggtagtaaccaggctcattatagtagt

SEQ ID NO: 86229 - DNA, 530 bp, Oryza sativa
tgctgagacctgcctcaatgagcatgacggcctcctgtacctctttcagcccgtcaattgccattcgaccagagccaatccagttggcattcccccaggctgttctcgcctcctggaaactgaaccgggctttcgaaggaagcgtgaccacgcggcggacaatcgcctcttcaagccagcaaagaaacatctgacaggcctgtcgggatgccacaaacttgcgacgccccataaagtacgcccaggactcgttagcacttgcgcgtgcggtcgagtagctcatctgcgaatagtttcgcgaaagctgctcatacgacacaccaagcccagcggcaatataacgcagcagggactgttcaaaagtcgagtagccgttatcggtatcctgcgccgactgaaggttgagagaatcacccggcaacaggtgtggaacccttgccccacccaggcgaacaggcgcagctgagtaataggacgccatttcaccgagccagcccgtaagtttgctctgctgctctttattatccgcg

SEQ ID NO: 86230 - DNA, 729 bp, Oryza sativa
tcctgcagcccgatcaaacagattgtagtaatgcaagtctacaacagtgttagttggacccaggtcagcctgataaagctccgttgggtctgcattcccaatcctctggcagaatataacgtaagctttgtccgaataacttcgtacaatctggtatcctgttttgtaatacgacactagagtgcctagtggtaccgcgcctgcagaaggctcattcaatagctcaatacctaggagagaggggttgtttgcatatctgcagataaagagtgtacatcttgttagaactatggaacatgtattatgcatattattttgccgggttgttatgcatattattgcttttcatgttattttggatagatctcggtggatccaatggctccttactttcgtgcattttcttatgaatgaatagatttatcatagtaatcataattcaagtaggaaatgatttcagatgaatgaaaagaaaagaaaagaatgggacatcgattttttccccagagcccttatgacattatctaccctcatgccaccaattgcatattgaagaaacatttcattcacctaaagcaattttttcatgatatacaagaaaatatagtggatggatcggtgctacctttgagccagaaaattaatgacatccagtgttttctcgatgttagctggtgaaagccaatctactgaaccatccctacttgcactgtgttccattccgttttg

SEQ ID NO: 86231 - DNA, 768 bp, Oryza sativa
ctgcacccctactacaatctgtttgatccgttttttgagaaacttaatgcaacagagaacatacagttcatatacaataacagaatgcctcaagtgcaggccttggataaagcgaatggacctcttgtttttattggtaggtcctgcaaaatcaatttcctttgctcttttcttttcataattttttcttcttctctgtaatgaataatggtgctttctcaatttatccaactctgtgcagccattctttccttgtattcggtacatcttaatccccgttttctcatttttcaggagaatgggtaaatgaatggaatgtgacagacgcttcacaaaccgaataccagttgtttggaaaagcccaattagaggtctacggggaagcctcctttggctggtcttattggacagtcaggtgcaacagtgtgcactgggattatgaatggaacaaaaggaataggtacctcattggtaagcaatttatcctgttctaggttctccggagctgctttctaatatccagtcattctatactaaactctattatcaccatatagcatatgcagtgggattgcattagttttgtgattacttttgcttggtttatgccataaagtcacattaagcttggtcgtattaattaacacaggcatatgcgtcatataacggctgatgggtaatagttgctctactagaacttagatgagttgcagcgtctatttcaccttgcagttcgatccagtactctccattttctgtggggctgca

SEQ ID NO: 86232 - DNA, 660 bp, Oryza sativa
ctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacggatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaatgcgtggcaagccaacgttaagctgttgagtcgttttaagtgtaattcggggcagaattggtaaagagagtcgtgtaaaatatcgagttcgcacatcttgttgtctgattattgatttttcgcgaaaccatttgatcatatgacaagatgtgtatctaccttaacttaatgatttt

SEQ ID NO: 86233 - DNA, 575 bp, Oryza sativa
ttgggaggatttgtggcagcagttcaccacgaacttccagggcacatatccgcgcccaggcgaagaagcggacttgcatgcggtacagcgaagggacgatgagtctcttcgctcgtacattcagcggttctgtcaagtccgcaacaccataccgtgcatccccgctcacgcggtgatctacgcgttcagagggggtgtgcggcacaaccgcatgctcgagaagatcgcctccaaggagccccagaccaccgcggagctttttcagctcgcggactgtgtggctcgcaaggaggaggcctggacctggaactcctccggttccggtgtggcagctccggccgcccccgggtccgccgctcggtcagggcggcgggacaggaggaggaagaagaggtcggcccattccgacgacgagggtcacgtcctcgccgtcgagggtgcttcgcaggccacccgaaatgggaggcctgcgagcgacaaaaagaaggaggccggcgctcccagcagggaacgcccgaccggcaagtggtgttccgtgcacaacacctccctccacaacctcgcggactgccgcg

SEQ ID NO: 86234 - DNA, 795 bp, Oryza sativa
cccgccgctgcgcgccctcgcgtccagctcctttgcccgcgcctcgagctcagcggcccgctgatccagtgcggccctctcggcgcgggcgccttccagattgcggcgcgcctgctcctcccgcgctgtctcgcggagggacaggctgtccgccagcctttgcgccgcggcctcggcctcctcgagagctcgctcccgctcggtgagcgcatcctcgcggaggcggagtgcgaactcctcttcggcacaggcggcctcgtgcgccgccagtattgcctcccggatggcgacggcggcctcgcggtccgccaggtccctctccttcgcgcgggcgcgctcttccagcgccgtggcgcgagcctcaagggcctcttcgcgccgccgggacgccgcctcgttctccgccgcccgccgttcccgggcagcggcggcgtcaaggaccccccgtgcggcgtcgagcttcttccctagctccgctgcctggctcccgtattggaggcggaggtcgtcccgcgcctcggaagacttcaagatggtgatccaaccggtgctgaatctcagctccgtggaggcatccctcatcccccaaggtgtcctccccctctgcagcgatccagagcgcgccaacatcctgaccatcatgcaggcggtcggggcgtcaggggagcgggcccctcgaggccacgatggcgcgggcgtgagccacaggggggaacaatctaccccgggagggggtcatgcttctaggccccgcgacgggagcagccgccctgccgacgcccgggggaagaggaa

SEQ ID NO: 86235 - DNA, 721 bp, Oryza sativa
attatttactgcaagcttcggaaaatacattttatcaaagaactcttctattatttcgtagaccgtttgtttttagttatttgttaagcttatttatcaaagtatttaatttatctagataatctatagaaacaattcgctcaataatctgtttcaaaccgagattaaggtgaacttgcatttcttatttatatatgacagggtaaatcaagagggtgacttgtttagcagtacatgagtaacatgaaacgaaacttgacaacttgacataacagctagtacaagacaattggatagctcacagcttgcctatggtatttgatcttttcttatcactgtttctgtatatatatgactttcagagccccaaagatgggatgttgcccagatgactgttcttgttcaactgccatgaggcgatcctcctctttctgagccgctcggcgatgatgaacgccaactccagagactgcgatgcgttgagcctgggtcgcagtgtgtgtggtatcgtgagcccagatcgtcgaatgtcaccgtgcgtgacccgccgatgcattctgtcacattttgtccagtcatctccagatgcacccctcctgggtggctgccttcttgttcgtgcacatcaaagaatgcgcgcacctcagcctggtttcaagaaggcaacataagtcatcttagttgatttaagtcgccggtcatgttaatgtcggggtgcagg

SEQ ID NO: 86236 - DNA, 1559 bp, Oryza sativa
ccagtggtcgagttcgtctcgctgccggatgccacaccggatggcgatgatgatgacggcgcaccgcgtcgctaccgtacggtggccaacatcctcggcacaacggcgccggtcgagctcgactccgacgagctgtacctggtggccgctgaggagcccagcaacttctccgaagctgagcacgacgatctctggcgtcaagcgatgcttgaggagctcaactcgattgaggagaacaacacctggatgctcacggatctcccggtcagcaagcgccccatcgggttgaagtgggtcttcaagctgaaaaaggacgagacgggcgctgtcgttaaacacaaggcacggctcgtcgctaagggctatgtccagcgccaggggattgatttcgacgaagtctttgcccctgttgctcggatggaatcggtgagattgcttctcgctgtcgcggctcacttcgggtgggcggtgcatcatatggacgtcaaatcggcattcttgaacggtgaactggaggaggaggtgtatgtctcgcagccgccgggttttgtcgatgacacgcacccccgcaaggtcatgcgcctgaatcgggcgctctacggtcttcgtcaggctccgcgggcatggaacgcgaagctggatgccagccttcagcaactaggtttcaagcggagcaataccgagcatgctgtgtacacgcgtggcgaagatagctcgcgcctcatcgtcggcgtctacgtcgacgatctcgtcatcaccggcgcacgctctgaagaaattaataacttcaagggataaatgcactctctcttcagaatgagtgatctcggcttgctcagttattacctgggcatagaggtgcaccaaggcagagaaggcatcaccataactcagtcagcatatgccgggaagctgctgaggatcgccggactgggggagtgcaaccccacttgcattcccatggagcctaggctgaagctgccgaagaacagtgacaggctggttgttgcttccaccctatacaggagcctggtgggaagcttgaggtacttagtgcatacccggccggacattgctttcgccgtcggctatgtgagccgattcatggagacgccacatgacaatcatctgatggcggtgaagcacatcctgcagtatgtagcaggtactctgaattttggatgctgctttgcaaactcaggggaaacgggaatacatttgctgggtttttcagacagtgacttggggggagacgttgatgatcggaagagcacctcaggggctttattctttctcggctccagtccaattgcatggcaatctcagaaacaaaaggtggtagccctttcctcttgtgaagcagaatacattgccgccacaggagcggcttgcctcggcatttggctggcacgcctgctagccgaagtgttgggcactgaaccggagatggctatcctcaaggtcgacaacaagtcggcgatctctctgtgcaagaatcctgtgttccatgatagaagcaaacatatcgacactcggtattactttatcaggcagtgcat

SEQ ID NO: 86237 - DNA, 881 bp, Oryza sativa
agatagcttatcaagatctatatactatgtaagcctgtacaaccaacattttggtgctcaacataacactagtcactcaaacaacaaccttctctatctaagggccgggaagaaagtcacagctgcctatttacatggtgtcctttattcattattgcagtgaaaaaccgcacatgataaaaccctaggtttggttattcactgaagccaacacggggtactatagaaccctcagtttggtaaggaaggctgcacagaagtccaggaaaaggagctgaggccccgtaactctctgcatatccagcagatacttctcgtctctgctcttgtaaagctgaagaaaagaaacggaatcagtaattcgacagccagatatacaaaaaatatataatacataccaaatacaacagctacaccattcgaatgatactatactaggctaaaagtataatatatggctaactggtactttttagtatttaaagttaaaaattgctggttcaaaatggcatgagcagacaacacatattggcaacaatgcatcaactcatgattgaacctaaaaggtgaggcattcttttgtcattccaatgggatctttaatccaaggatttaactatgacaacaatatttagttgaatatctagaaaaaaaaaaatattgctgtaacaaactttttaatcagcagtgctagaatttgaaattgcacacctggatttcaaacttgatcacagcaggtaacctcccgtttacatcgccattatccattataattgagtcatcaacaaagctgtggttgacatctaacatatcagtggcctgaggatacccaacgctccatctgcacttcatgttgtactgtccattcttcttccagcaga

SEQ ID NO: 86238 - DNA, 1175 bp, Oryza sativa
ccccataaatttatctcacctttatctttttgaataggttggggatattctcgtcatcaaatggaagagtaccacaaaggagagcataaaggatcactccacagctccatacatcaacctcgggtccagcatataatttaccagagatcacctgcaaagggaccataatactataataagaaaaaatattgcatgtaaaggagcaagaagatatagtctcacagtgatacaaaaaaaatacctctggagcagcataattcggactcccgcagcttgtctttaaaaaatggccatcatgcatgacattactcaaaccaaagtcagcaagctttacgttatactttgaatccagtagcaagttttctggcttcagatcacgatgaaccaccatgtttctgtggcagtattcaaccccagatataatctgttccataaaattttaccttctaaatattaagagaaataatgtatatgtattcaacaaaatcagagcaatgaaaaactctaagttcccataaaataatgtatgtccctctctccatttcaggttaaaatcacatgccaatgattacaccaacacagtgaagacttaggaattaatcaaaagtttgatttagtacatcactccatcccacaaatttaaaattcaatgataaggttagaagctaaaagcaagccgattacatgtgaacctgagtcaattaattatgaacaccacacacaaaacctccacacgacgaatatgaatggcatgcttatgctccataggttttgaatgatgaaaataagcaagcattgaagttggaaataaatgctaaaagagcacatttaacaagtgaaagaaatgagtaaggtcaagtacctgctggaagattcggcgagcctcatcttcctgcaacctgcctttctcaacaatgtaatcaaacagttctccaaacttgcagtactccatcacaacatatatatccgtaggagtgtatatgacctcataaaggcgaatgatatggggatgaatgaacaacctcaatatcttgatttctctctttgctgtaaacaagaaacaataagaaaaaatgaagtcaggccttagcatttggcaagcatgaaattccagattgtagaatttccagctcaaaagcattcgaagaaggtaaaaccataaaatttcttcttta

SEQ ID NO: 86239 - DNA, 1464 bp, Oryza sativa
tttgtttcaagtgttgatagttattcatatatgaatggcaagtggcaaactctagccactagtgtcctaccacattatgcataaacgagaaccatcattttgacaaagctatgttgtttcagatatattataatgtttagttccatcatgaaacaccctataaacagcttctcactgcatagcagcatagtgcatatgcaattaggctgtccagcaaatataagactattgctcagttacagaccactgagaagtaataggaacaagcaaatactgaaaagtaggctgtaggccatgcaaggaattaccaagattctatcaaaggagcgagtcttgaggccacaaggagccttcattgtgttaccatgcatcggatcagtaacccatgttactatctggccagcaccacggacagcacgtattaggtgagggagtttcactctcatgttttcaggtcccattcttgtaatgatagtaattctccctggtttgttctggggattcaagatatcaatcaacttcacaagttcttttgggtccatcttgtcactgacctgcatttagtttgatgagtttagggtgaattcctttaggacaaagtgtgaattacctgcactttcaaatgaagtttgaacttggtatacattatctatttatctgtcttgacaagtgtaggaatattcctatttaccttgatacccagagggttcgcaattcctcggagaaactccacatgggcacaatcaagctgacgtgtacgctctccaacccaaaggaagtgagcagaacagtcgtaatagacgccagatgtggaatcctcgcgagtaagtgcttgctcatagggaagaagagggcactcatgtgatgtccagaattctgttgttgtcataataggatggtccatatgagaccagcagctgccatgaaccccaaagcctcatcaactcggtgagccagctccatgtacctgttcaacattgtacaagaattgcagtggtgagcatatggctgtggcttaaatgaattacatgaatcaattcatctgagaagcaatcaatgaagaattgggacagtttaagataaaggtaaccacctgtcaccctgttcactatgctctgtgaagtcaaggttccattgtgttaccctctgcatggcagcataacctccagtagcaaaagcccgcagcaaattcagtgttgctgcagactgtgagtatgccctgatcatgcggtgtggatctggcaatcttgatttctcatcgaatgaatccccattaatgttatcccctctgtagcttggcaacttcactccatccctctcctcaaagccatctgaccttggctttgcaaactgacctgccattcttcctacctacatattccatgtgagacagtaagtgatacaattctgtgcgatgtccactagaaatgcattaaaggaacgcaaaaacaacatggtaacagg

SEQ ID NO: 86240 - DNA, 719 bp, Oryza sativa
ttcctgcagccctgctgcctgtgatgatccggggatttgtcaatcaggacgtgtgggaagcattagctgagctaagccatttttatagggtactttgtgctaaagaggtcgatccaactcaaatgcttcagatggaaaaaaaatatcccaattctaatatgcaaactcgagaaattattcccaccaggcttctttaattatatggagcatctaatcatacatctgccataccaatcaagagtaggaggtcctgtaaagtatcgttggatgtatataattgagaggtaactaaaattccacatgttgtcaatttaaagtcatattttatcttaggtgacaaactaacatgtcatgttatgtagatttattaaaaaactgaagcaaaaggttcgcaacaaggctcgtgttgaagggtcaatagtggaggcttatcttgtagaggagatctcgcacttcacatcactgttcttacctgatctcattgctagctcacgcaatcgtccacatcggtatgctcaagttggccctgctagtgaaagcaaccttagcctgttccaagttcaagggtggaagaccggtagaggaatttctcgaactttaacttttgaagaacaaaagaaagcaatgatatacatatacacaaacatgagtgaaatggatggatttgttgagtaagtattctaaatttgtaaataagatattaattctgctataaaatg

SEQ ID NO: 86241 - DNA, 503 bp, Oryza sativa
tactacctttcagatagcgcattactcgctcaagcgcacgcagtgatcatctctcggattagaggtaaaccggctcaacttgctcacagcaaaggagatatcaggcctagctgcactagccaggtacatcagcgagccaatgatttgggagtattccagttaattcctagcaattctattgttcttgcgaagcaacaagctagaatcataaagttttagagaaggcttactatcaatgtagccaaagcgattcaagatcttctccacataatgggactgcaagagtgtaatcacattctcacctctaattagcttaatgtttaagataacatcagctactcccaaatcctcatatcaaaattttgagacaagaataatttaacctcgtttatcacctcaaggttgggcccaaatatcagtatgtcatcaacatacaaacacagaataactccctcacccccaccatggcgatagtacacacatttatctgcctcattgactgc

SEQ ID NO: 86242 - DNA, 644 bp, Oryza sativa
actcctaagtgaatttagaagcatatgcatctcctaatgcagattactggaaggtggctgtccgtagtgaaatggattcgattatcgctaacgggacttgggaggtgacagagcgaccctatgggtgtaaatctgtggggtgcaagtgggtgttcaagaagaagtttaggcctgacggtactattgaaaagtacaaggcttggcttgttactatgggctatactcagaaagaaggcgaagatttctttgaaacttactcacctattgttagattgaccacaattcgtgtgctactttccctagcagcctcacatggtcttctcgttcatcagatggacgttaagataacttttcttaatggagagctggacgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattctgtgtttgtatgttgatgacatactgatatttgggacaaaccttgaggtgataaacgaggtt

SEQ ID NO: 86243 - DNA, 552 bp, Oryza sativa
gcatatgcttctgaaattgacttatgagtgtcatccacaaggtacacagtgaaatcatcaccaaaggacttagccgtcctttgtctcttactccttcgaggagcttcactgacatcctcctcagtgacatgttcatgtgtatgtttagtttgttctggtggtgtgattgaactgggaattacttcagagggttggctcgaactactatgtgtatccttcattgggaaaaagctctcaaagaaggtagcatcacgagactccataattgtaccaacatgcatgtcaagcacctcagatttaactattaaaaatctataggcaatgctgtgatgagcatatcctagaaagacacagtccacagtcttaggtcccagtttgcgcttcttccttattggtacattgactttcgccaagcacccccatgtgcgcaaataagaaagtgatggttttctcccaatccatatctcatatggtgttttgtccttatttctgttaggaactctgtttaacacatgattcgaggtcaacaatgcctccccccaccatgcctta

SEQ ID NO: 86244 - DNA, 3259 bp, Oryza sativa
ctaacaaagtagacgggccgctgcacctttcggtggggccgatcctcttcgctaggggccgcatccttggggcgctcttcgtccaagcggccacgtggggcgcactcgtcttctgtgccgatgacctcggggtcggaggacgacaggggcggccttcccacagtggcctcggggccgtcctgggggtcgggggctcttggcgtcgtcggacaagcgggcagagggccagctccggtcgtcgggggccttgggccaccgttcggctcgggggcctctcctccctgctctctcccgggtcgagtcggcacagggttagcctcggggtcagagggcgataggtgcggccttcccgcagtggcctccgggccatcctgggggtcgggggcacctggcaccgtctgacaagcgggcagagggccagctccggtcgtcgggggccttgggccaccgttcggctcgggggcctctcctccctgctctctcccgggccaagccagcacagggtggggatgcgcggaatgaggattgtcctcatcgcgctccacaaccaacgctgcactaactacttgcggggtcgccgctaagtagagtagcaagggctcatctggctccggggcgaccagaaccgggggagagctgagatacgccttcaactgagtgagggcacgttcagcttcctccgtccaagtaaacggcccggagcgtttgaggagcttaaataggggtagcgccttctctcccagcctcgatatgaaccgacttagggcggccatgcaaccggtgacgcattgcacatccctaagtttgctggggggggcgcatccgctctatagctcgtatcttctcggggttggcctcgatgcctcgggcagagaccaagaacccgagaagcttgcccgcaggtacaccgaacacgcacttatcggggttcagctttatgcgggcggagcggagactttcaaaagtttccgctagatccgagagtaaggtctcttggttgcgcgtcttcacaaccaagtcatcgacataagcctcaacattacgtcctatttggctacccaaagaaattcgagtagtacgttgaaaagtaggacctgcattctttaacccgaagggcattgtcgtataacaataggttcctatgggggtaatgaatgcagttttttcctcatcctccctagccatgcgaatctgatggtaaccagagtatgcatctagaaaacacaaaaggtcgcaccccgcggtggagtcgacaatctgatctatgcgaggcagggggtaagggtccttaggacatgccttgttaaggtcggtgtagtcgatgcacatccgaagcttgccgttcgccttaggaacgaccaccgggttcgccagccactccggatggatgacctcgaggatgaatccggcctccagaagtcgcgccacctcctcgcggatgaaggcttgacgttccggggcctgccgccgcactttctgccggaccggccttgcgcccggccgcacggcgagacggtgctcaatcacctccctggggaccccgggcatatccgccggtctccatgcgaagacgtcagcgtttgcccgcaggaaggagacgagcgcgtcttcctatttgccgttcagaagaccaccgatccgtatggtcttggacgggcctcgcccagggcaacctccttgaccgggacctcgtcgcatgtgatcatccgctgcctcggggcggcggggacggaggtgccaagcctctcgtcgccaccctcgggcttggacgcggcggcgaggtggtccgcgcgctgctccatacaagcaagcgcgactttgaggtcgccatggacagagatggggccaccggggcccggcatcttcatctggaggtaggcgtaatggaccgccgccatgaacttcaccaacgcgggcctccctaggaccgcgttgtagggcagacttaggtccgccacatcgaagtttacccgctccgtgcggaagttggcggatccaccgaaggtgaccggtaggtcgatatgacctaacggccatgtgtgccccggcgtcacaccaataatcagctgggacggccggagcaccatccccggggccttgatggcgtcaaaggctgcaggggaaaggatgtcgagggccgctcccccatcaatgaggacacgccccagcttcacgttgcaaacagtgggggaaaccaccattgcgatctgtcctccccgggcaacgcacggtgggtggtcggtctggtcgaaggtgagggcaacctccgaccaccgcgcccggcgcgtcgcctcatgagtaggggccgcggccagaagctctcgcttcatggccttgaggctccggcgagaaacgtgagcacacgctcccccatcgacagtggcaatggtgaccccaggctcttggaaacctaggtcatcatcgccgtcatcgatgtcctcggcaggggccttttgcttggcctcacttcgccgattgccggaaggaaccgccggggacttgcccactcggcgctcctgcctcctctcctcctcccacttcctcgtccgctcagccaaacttttgactgcgcggcagtccgcgaggtcgtgaagggaggtgttgtggacggtgcaccacttgccggttgggcgctccctgctgggagcgccggcctccttctttttgtcgctcacaggcctcccctttcgggtggcccgcgaagcgccctcgacggcgaggacatgaccctcgtcgtcggaatgggctgacctcttcttcctcctcctgtcacgccgccctgtctgagcagcggatccgggggcggccgaagctgccacaccggaaccggaggggttccaggtccatgcctcctccttacgagccactcggtccgcgagctgaaaaagctccgcggtagtctggggctctttggaggcgatcttttcgagcatgcggttgtgccgcacaccccccctgaacgcgtagatcaccgcgtgtgcagggatgcatggtatggtgttgcggacttgacagaaccgctgaatgtatgagcgaagtgactcatcatcccttcgctgtactgcgtgcaagtccgcttcctcacctgggcgcggatatgtgccttgaaagttcatggtgaactgttggcacaaatcctcccaagagtggacggacgcgggtggcaagttcattagccaaccccgcgcctgtcccttcagggccatgggaaagaaattcgccataaccctgtcgtcacccccggcggcctcgatcccgg

SEQ ID NO: 86245 - DNA, 3260 bp, Oryza sativa
ttttattattgccatcccatcttgatattcctattattcctggggtgcaacaaatgagtaccactgtggctaatgttcctactaatcctgctaatcaaatttctggagatgaattatcgctacaggaaaattcggcagcaaataatgcagctccagatggtgcggacgcagccacagctgccacgaaagatccagcggctgactcccctcacacctctgacgcagcgtcttcgagcgtcctccagcgtcgtgtggaggccaccgcagagtcctcctgctctcctgatcggttgcatgtcgagctcacaccggcgcactcacccgtggccatgcaatctccagatgccacgtctcctactgcttcctctaactcacaggagccatccacgtctcttgatgcttctgttgcaggggaggtagatacacagcaacaacagcaccatgtaatatctagaccggctacgaggttgcaaagtggcattcgtaaggaaaaagtttatactgatggtacagttaaatataggactacttttctcactgttactggagagccagaaaatttagatgacgctttaaaagataataattggaaaaaagctatggatgcagagtttatggctttacaaaataataagacctggcatttagttccacctcagaaaggtagaaatgttatagactgtaagtgggtgtataaaattaaaaggaaacaagatgggagtctagacagatataaagctcgcttagttgcaaaagggtttaagcaaagatatggcatagattatgaagatacttttagtcctgttgttaaagctgctacaatcaggattattctttccattgctgtctctaaaggatggtgtatgagacagttagatgttcagaatgcttttcttcatggagttctcgaagaagaagtgtatatgaaacaaccaccaggttatgaggacagttctttgccagggtatgtgtgcaagcttgataaagctttatatggcttaaagcaggcacctagagcttggtactctaggcttagcaagaagttatatgatatgggattccaagggtccaaggctgatacttctttgttcttttataacaaaggagatttgattatatttgtactcatttatgttgatgatattattgtcaccagttctagacaggaagctgttccagccttgcttcgggatttacaaaaggagtttgctctgaaggatcttggagatcttcattactttcttggtattgaggtaactaaagtgtctggtggtatagttcttactcaagataaatatgtcaatgatttgttgagaagagtaaatatgtttgactgcaaaccggttagtacacccctgtctacaagtgagaaattgtctataaatgaaggagatcctttaggaccaaatgatgcaacacattatagaagtgtagttggtgctttacagtatctaacattgactaggcctgatattgcttttcctgtaaataaggtttgtcaatttttacatgctccaactacacaccattgggcagctgttaagagaattttaagatatttgaagcaatgtactagacttggacttaagttaagcaagtctagatctatgttagtaagtgcttattcagatgcagattgggctggttccctagatgacaggagatctacaggaggttttgcagtattcttaggagataatcttgtgtcatggagtgcacggaaacaagctactgtttctagatctagtacagagtcagaatataaagctttggctaatgctacagcagagattatgtgggtacagactttattggcagaattgcaagttgagagtccatctatggcaaagttgtggtgtgataatttaggagctaagtatctttctgctaatcctgtgtttcatgccagaactaaacacatagaggttgattatcattttgttcgagaaagagtttcaaggaaattgttagaaattgattttgtgcctacaggagatcaaattgcagatggttttacagagggcttgtcagttcgacagttggagaattttaagtacaatcttaacttaggaaagttatgattaagggaggggttaaacatgtgatatgtatttgtgtgatgcacacggcatggttagatggatagatatgattagataaggctagattgagtttgttgtaacagaataggagcatatctatccatccacctgcgccgatctctgtaacccacaacggtggttattatcgctaatataagattaacaaaggtgcggcccgagagggttgaacgcttctgaacctctgatgtttgatacctccacctatcttgcactgctaaatgctgatctcctacacttgcctctaactctgctcgaaccgcatcagcatgttaagagcaaccatcccccaagtttggtgtgccttgcacttgatctggagagagcaggagcatgatagcggtggtggctcattctggagcatgaacaagaaagtggtaggcttgtggaggagcaggtgcaaatagcaagggagcaagagggtaaagcagcagcatgctcgtggatgtgcaagagcaggttggtagcaagattatggaggtcttctccacggctcccccttgtggaacccgccttgagcttaagctctgtacagcccaaattgtgcctcccaccatcttcatcctccatctccacaatgggcagcggttcgacaagtcacactaggagatattcctggcggagcgccttgatggagctcaccagtttggagctgcaagatgcacccatccactcccattgattttgatgcaagaacgcatggtttgctgttggcccttccaggtaccacatgacctccttgtagagaggatggaaatggagtttatggcgagcggcaagcatccaatcaacggtgctggtcgatggtggtgatgactgacacacagcaaagctagtccaaagtgcaacagattgcaagtgtagctggtttaaactgagaccattgtaatagagctagtccaagctgtaaatgtggtaaagatagtgacggagcgtggggctcctcaccgggagaccgcgcaggcccccctttgccggttcggccggggaccctgggtgagattctaagcttctagtctgtggaaggttcgcgagaatggaagaagcacaagacacgggcgatgtatacaggttcgggccgctgagaagcgtaataccctactcctgtgttctggtggatctgtgtatgaagaagctaca

SEQ ID NO: 86246 - DNA, 6003 bp, Oryza sativa
gtcacccacaacctcagcggcatgggctgcagcgccggcatcatcgccattgatctcgccaagcacctccttcaggtacaaattaattactactcaccatgcatgcatgcagatcagcacgcaaccaaccgttgtaacatcttctcccatgcaaaatgtacaacgttcgtgcatgagctaattaaacacgaacgtaatagtaacaaagaaatgacatatcaacgttggacatgcatgcaggaactaatagacgaattataactagcagggtgcaattatacaccagtaatgcaatcctgacagtatatgaactgtgtcaatgagtaggcaaggatataggattatattacacgtcccagtctgtgcgtaataaagattccttgttttgtttttctggtcaacatatttaagtatatctggagtcaaccctgttggctagatttaatttttaaggcatatagctttattaatctttacaattaatgaatctattgatagtagtagtagtagtagtatggttttctaccaaatcattttttatttacattaagaacagctaaaagagtatacttacacacacacacacacatatatatatatatatacacacacacatatatatatatatatgtaaattaattggtgctacatggagtatgggctccaagattcaaattaagtatatacccaatttgaatgagtatgaatttttttttaaatgtttagatatgaacattaacttctttactaacaagttcaaacaagtttgaactgagtttgaacttttttttgttagattttggttctaggtatataacattcaaacatataattcgttaggtatgtaataatgaattgtgaaataaagttaagtttgagttgttttgttgttaggtatatgtatgaatcaaattcatatacctaggtatatactcacaatttaaaattttttaaaaatttgagagaatttgtgtgttttataccttggagcccgggcaccatggagtcccatatgggtatcccacatatatatatatatatataaccatatactgattaattaacaagattataagtttttctttggctgctaaggctgttgtgtgcattaataacctatagtaaacatagcaggacatggtcagttcatgactgtccagttggacattgttaagtccattttagatagtactactcctcaaaaggacaataagccatgaaacatgaatagtccaattaatctgaaacagtagagctgatagaaatagatagtgactaaattccataatacaattggtcggtcccatgcatgcgcgggaatatgggctgctggatctgagacaaactactgctagattgacaagacggtgccatttgtaattgaagggcgtaatgagaatttaattaatttgaccacccgagacgtaccaccatactattcctaccacagtactcctgtactacatatctataagctaatactactatacgataccttataaacatgataatgatctatagggaggcacttaccaatttaagtattaacactactttctccgtaaaaaaaactcaccctagtattttccagtactagattgagttttcttagacagagaaaatatatagtaaagaatcgtcgtaactatagcttctacgtaaaaaaactcaaccgagtattgggatgtgatatgtcacgcctctcggtacttagttgaggggttttttttaaagacggatggactatataagctgtgttcagtttacggtaaagttgaaagtttggttgaaaattggaacgatgtgattaaaagtttgtgtgtgaatgacaggttgatgtgatgaaaaaagttaaaagtttatatgtaaactttggatctaaacacaataaagaatcgtcgtaactacagcttctgcggcagtagacacacatctccaatattttgatcaaaactgtgtgctacgaagaaattcgaaagaacgcccagatcgattcaggctgtgtcccatactcccataccacccattattcaggctgctccatgtgaccactgtaacactgtcctgtttccaacacccaaagacagatcctgatctgaacgctcctgtgttcagattcagaacactggccagctatagcccagagagttaattactgtggttgggtggcagttactgccaaccttacctgctgccaccaagtactccgagatcggtagcactgtacatacagctagcaccgaaacgtgaaaaatctcaggccgtcgcaggacatggcaacaatgaacacctgcacctaccatgcactagtcacttcatggtttaactccatttcagaaaaaaatcagcacttcctgatcactgcatgcaactggtttttcacttagatctgtttagttacgtaaaatgaaaatttttagatgtcacataggatgtttaaccgggtgttagaagtggttttcgaacacgaatgaaaaaaaactaatttaaatcgtgagacgaatgtaacccacatatgctagctaatggcggattaattaggctcaaaagtttcatctcgcgatttcctcctaactgcgtaattaattttttaatatatatttaatgcttcatgatgtttccaaaaattcgatataatgtttttaagaaaaattttttttggaactaaaccaggacttgtgtttgtgtacatgcaggtgcacgctgagacgtacgcgttggtggtgagcacggagaacatcacgctgaacgcgtacatgggcaactaccggccgatgctggtgaccaacacgctgttccggatgggcggcgcggcggtgctcctgtccaaccggcgcgccgagcggcggcgcgccaagtaccagctgatgcacacggtgcgcacccaccgcggcggcgccagcgaccggagctacgcgtgcgtgacgcaggaggaggacggcgccggcaacgtcggcgtgtcgctgtccaaggagctcatgtccgtcgccggcgacgcgctgcgcaccaacatcacgacgctgggccccctcgtgctcccgctgtcggagcagctccggttcctcgccacggtggtgctccgccgcgtgttcggccacgccgccggcgtcaagccctacctcccggacttcaccgcggcgctcgaccacttctgcatccacgcggggggccgcggcgtgctggacgagctggagcggagcctgaagctgagcgcgtggcacatggagccgtcgcggatgacgctctacaggttcgggaacacgtcgagcagctcgctgtggtacgagctgtcctactgcgaggcgaaagggaggatcaggcgcggcgaccgggtgtggcagatcgcgttcggctccggattcaagtgcaacagcgccgtctggaaggcgctcaggacggtcgacggcggcgccggccgggacgccggcgcgtgggcgcaggacatcgacgcgctgccggtgcacgtgcccaaggtggtgcccatcgtcgacgacgacgacggcgccaatggcggcgacggcgaccgacacgacgcggcgtcgcacgtacgaccggaataagctacatacttaattatgtgtacttgcgtgtaaatcgtcacgagtcatggatggactgaaaaatactgtcgcgtgttgtttcatggacatgaggacatcgtatcgtgtcagggaaggactgataattccttgtgcggcattttgtctaggtatactgattaatcaatcgtgtgtgttaaatgtgtgaaaggttgagtatatacgacaataacttgagtattttctctttgttatgaatcttttttgttgttgtacgaattaagagatgagcagggttcataaaattgtttggtttttgcgaaaaatgatcggtttcgtaaaaccgatgatactcagtttgtggaagccgacttgtattagccggtttccatacggtattgatcaaaagttattggtttttgtcggttttccgcgtaaactagtgaccaggggttttctacttcgaaaacgaaaaatcacccctacacgagtgcaatacctattatagaagaaagtttacgccggaagaaagcttatatcttaaaaaaaatagcttatcgtagaaggacgcttgcaacataagcaagcttgcaggagaatcaaccttatggcgtaagcaagtttatagtgtaagctattaatctcatccgcctgttaataggaccatgaagttccaagacgaggcggaaccctcccagacaccaccgactctttttgtactctaatccagaaaaaaataaagtatattttttcagtgttccacaactttgtgtttctttgattatgcgttgatcggtagaatacgtaattcttaacactcttggtcctatacttctcttctttttagagaaaccacgagtggcatatattcgtagaccttaaatgggcccaaaatataactgggctttactagcccagattccctactggacaaggcccacgagtccgtgacacctgtcctaaatgggcctaaatggagtactagcccctttagccggtgcaacggattccaccaacgctgtcctgtcctatcctcccatctccattgctcccacgcagccactgccgctgcggtggttccggagcgccggccgccgcctccgccgcgacgacctcactttctgctatcaacctgtagcaaaccaggagcagcgtcggcctcctcctccgcctccgagctgtgtcgttctccggattgagccggggtaagcgactagtacttcgccttttccctcccaaattgccgtgccatctccgcctcctcttccattctctccatggttggtctggctcgaattggtttgcttatttggttctcgtaatccagagtagccgtggaagctgaggccgaggtgcatttgtggttttcttggcgcggataaaggctgggggtggggagatgatgagcccgtgcgattgcttcctccatgccaccgcgccgccgctgaatccgccgtcgagtctcgcggctgcggcgccgggagctcgctggagggatagcaacctctcgttccagagcagcgcagtgtctgcgccggcgagaaacgtcgagacttcccccaatttggtggttccatgtacggttcatacgcaggctgctgaaaggaagaagagtgggaggtgggtgaagtatggcgggtcgattccggcgatgctggaggcgcttgagcgtaatgaggatatcggggaggcgctccggccatggagggacacgatgagcaaccgggagaggacaatcattctcaaggagcagaaggattggaggagagcggttgaaattttcaactggtttcgcaggaggaggcgccatgaggtcaatgtgatacactacaatgttgttctctgcgcggttgggagggcgaggagatgggaccttgttgctaggctatggcatgagatgcattccggtggtgttgcgccggataattcgacgtatggcacgcttattgatgtgcactgcaaagggggcagagagaggatggcattgctttggcttggcgacatgatcaagcgtgggttgctgcctgatgagattactatgagtattgtgcttcaggtacacaagaaggctggggagtatgagaaagccgagcttttcttcaagagatggtccttggagtcagatgtaaagatgaaagggcatccttgctatagtttgtatacttacaacaccttgatcgatacttatggaaaggctgggcaacttgagaaagtatcagatacattcaatcagatgttaagagaaggtgtttcaccaaatgttgttacatttaacacaatgattcatgtttggggtaaacaccgtagaatggagcaagtagcttctctgatgagaacgatggaggagtttcagtgccttccggacactaggacgtataatattctgatctcgctatacagagaaatcaatgatattgatgttgcggagtactatttcaggaagatgaaagctgaaaatctgctt

SEQ ID NO: 86247 - DNA, 1800 bp, Oryza sativa
aaagaaatgtatgagaggaacatggtgattgatgaatacacacaatcagctgtgacgaggatgtatgtcgatgctgggatgcttgagcaagcgtggtgttggtttgagaagttcaattatcagttaaactctgagtgcttttctgcaaatattgatgcatttggggagagagggcatatactccttgcagagaaggcttttatgtgctcataaaaaggaagatgctaagcacttgtgtttgtaatgttatgatcaaagcatatggtttagtagagaagcttgacgaggcttgtgagattgctgatggcatggagaggtatggcattttgcctgattacttgacttacagttctctgattcatctaatgtcaaccgctaaattgccagagaaagctctttactatttgagaaagatgcaggcagcaaaattgctgattgattgtgttccttattctgtggtaatcagttgctttgctaagaatggcaatttacacatggtcgactgcctgtttagagaaatgatcacttcagggatccaagctgatacttatgtttactctatcttaattgatgcatatgctgaagttggagatgtccagaaagctgaagcatattttggtttgttgaaaaaggctggtttatgtgagagtgctacaatatataattctttgataaagctctacacaaaggtagtgtatcttgcagaggcacagaaaacgtacaagcttctcaaatcattaaatgcagacaccaacctttatgcgtcaaactgcatgattgacctctatagtgaccattgtatggtgaaggaagcacgtgagatttttgagaatttgaaggttacaggaaaggcaaatgaattttcacatgcaatgatggtgtgcttgtacaagaaaattgctcgctttgatgaagcccacaggatttctaagaaaatgcaagcttcaggatttctaactcaggcattaagctacaactctgtgatacaaatgtatgtgtctggtggaagaatggaagatgcccttaaaatatttcagaagatgttggcatcgaacacaccaccaaatgatgcaacattcaaggcactaaagattattttagtgaaacgaggagtttcaaataatgatattagaaggttagaattgctcagaaaaaatagaattcatgattgcttgcgccactggtacaggatgctatgcatggcggtaagatcaggtggtagttcttctcgacgtattagtgataattcagctctgaggacgcatatttttgacattggcaattccaagagtggcaaaagaaatacaagaaagcatgtaacttcataaatatttcgagtctaactggtttaacatcttcgatgttgacacaacacggtgatgatccatctactaaacagttgatggaaagcaccgtgttatcttcaaaagaaaaccccatgaccactgtttgactggtgctctaagaatgtggtgaaatttccaatggatcaggctagattaccgcagggatgcaggtcagttttgttgtatattccccaatctgtatgtaccacaatacatgggttcacacttttccaacatcagggtttaatgttattaactggaacatctatagattatctaaatacagcaaagattcagtaattttgacaatctccaacacagcgtatttcatttctaactgtattactaacctggaaatattttttttcctgtaatggcaggtctcttttgcgttttgttaatatgatgcccataatagtttttctattcatacttcatattgcttgtaaatgtt

SEQ ID NO: 86248 - DNA, 1199 bp, Oryza sativa
agacttatagctttgcactgaactctattgcaagtagtagcaacaagttgagtagtattaattgtgtccgtctcagaaagaaagaatgtacgataattctggctatgcatctggacaacgatcgttctttttgaaatgggtcgaggtagtagtagtactactgcagagtggtgtacattccgtttgacttgaggccggcccggccgggctatctctcacatatgtccgtataatgtgtatgttgtgcatgtgcacctctgatgcctcttgtgctgtaacaaacgcatatgcatgcagatagtaccggaggtggagtcattcagcggcaacggggcgaggttcgtggacggcaacgagatggcgttcgatgccgtcatcttcgccaccggctacagaagcaatgtcccctcctggctccaggtttacacatacatatatatatctctctgtatagctagactgtagaatgaatgcagttaaggcaatgttgctgatcgataccagtactgtgcttgtgatatgtatcatcaggaggacggtgagttgttcacggaggagggcaagctgaggagcagcggcagcagcagtgagtggaggtggaggggtccaaacgggctctactgcgtgggattctccgggcggggcctgctcggcgctggagcagacgcgctgcgagctgccgccgacatcgccgggaggtggcaggagacgcagcaggcagcagccaacatctcctcggtgtagtcgtccacaggccggatcgaggacggacgggacggacggtgcatgctgcgctgtgcacacaggctcagctacctcagctgctgctgctgctgctgctgatggcctctcgctcgcatgcatggcaacatggcataggtagccatggccggagtcgcatgcattgcaaatattccacagctcgcgagctcacatctgttgctagctagcgagcagcagcggccggctggtgaccagcgatggcgctggtgaccagcagcagcgagcagatgcacagagatcatatgtagtcgatgcatgggagaggaggaggaggaggaggaggggtgtgtgtgtacgtgtatgtgcagtgcaggtgggttgtgacaaagttttgcataggatgttgcttgtctgatgcgccccatgcaatgcagatacggctgaaagagtgcagtcgttctttttgtttttataat

SEQ ID NO: 86249 - DNA, 618 bp, Oryza sativa
atgcaaactgttgatagcccaacaacaggatacttctgctctcctcccacaagttcaaaactttgagttgttcagaccgtttgtcagctttggaggagtagaagtcatacaaaggaatatcatcaacttgccaatgaagaaattcggttctccatgttgatagaattccctttgggagaataatcaatggccttccagcagggtatttggctaggaagctgtggacaaaactaattatcaaaaaagtcttcccagaacctggtgcatgtgccagaatacagccaccagggttgttctcatctgccaagttcttgaccaggaaattgaaaccttccacttggtgaggtttcatatgctgtgaatgttgagggtggaggcatagagcatcagggaccacttcgagaatagctcctgaagttttgtcaattgcatctgcatcactagaatttctgtgttctgagggacgtgctctgtacgattgcttccgctgacacatgtaacagataatgagaaatatttttgaacaaaaagaaggaatgtagaaggaacataatgtagaaggaggctaggcaaggagctattagtttaagagtagcaaaatgatttccatgtgcattt

SEQ ID NO: 86250 - DNA, 1058 bp, Oryza sativa
aacttaccacccatgtcgaggacgacgtactgaatgcccatctcgcccttctccttgcactggtcctcctcgtcgtcgatccaccgcgcgatcctgaatgagcatcacaagtcgaccatggtaagagatccaaatttttttcaagctggacacgaggtgagtgaatctgcttgctgaattctgttcatcttgctcacctctcacgcaggtagctggcgttggtgaagtagatgggcgagtcgacgcggagcacgagcacgccggggaccctctgcgcggcggtgtactggtccatccgccggtagatcatcgtgttggggatgttcccgagcaccgtcgtcctcggccgcgccacgaacagcagcacgcggaggatggagatcccgacggcgacgacgaggccgatctcgacgctgccgaagacgacgccgaggtaggcgccgaggcagacgcagaagtccaccttgtccacctgccacaggtggacggcggccgggtagtcgatcagccccagcatcgccgacatgatgatcgccgacagcaccaccagcggcgtgtagtggaacagcggcgtcaagaacagcagcgtgatcatcaccgccaccgacatgatcacgttcgacatcgccgtcttgcagccggcgttgtagttgacggccgacctcgagaacggacctgcatacacacatggtatcagaaacccagaggtctcgagttcgaatcctggctaccacgaatgtgcataccggtggtgaggtagcaagaggtgagtgatcccacaatgttcatcgttccaaacgcgatcatctccttgtttccgtcgatgtggtaattcttgaacattgcaaagctccttcctacggcaatcccctcctgcattcgtagaaacagacagtatacatcagcactccggtctgatcaagtaatgcagaactgcaattaatgtctgcagaaatcaatcgatttttcaagcttacagcgagggcaatgacgccagtgatgatcccggtcttcagggccagcatcatgtacggcgacgagaagttcaggcttgtggc

SEQ ID NO: 86251 - DNA, 1408 bp, Oryza sativa
aagaggagcatgagtacaaaagagttaaagcccctgagaaacgttcacgcgttcttttgagggattatatgactgcaaggaaggacaaaaatgatgccggacagaagacgaagaagaagaggatacccttctgtggttgtgtccgtattaaatcaagaactgagccttaaccattaagtaggtagcaggaggaacatattcatgtcagcccaataggttgacagaacgtgatgctcttaggatctcttctgagatgagtaacactatgatattaacaagaaactcgtgcactcaaatttccctttcttgtcctgaaatgaggcagtgatgtctagtgtaatgagttaatattattaatgctgttattaattgaagcattgtgcatatgtgtttcctcttgtattgcctccatatgattgctgtgaagctaccaagatttgtgtttgtcatgaagccgccattatgtatagtataatgcctcctttggttacacagttttcgctctcttataactgcgtacatatcaatttcatcttttatttctgtactcagtaatgaatatctgtggttgattcagtgtagttgatgataggaatgctggaatagtgcagtacattgtacagatgcaaatgcctgtgcattgtatagtgtcctcttctattacctgatcaaaagcaggaactttgagctctcttgctttgtttggatgtggtgagtgattgagtgccacttatttgtttttctgggactgaacacagatttttggtaagagtactaatctcaatgccttgtagcatgtttgtgttgccttcagcactgcgaatcgattactagtatatgaattttgagctgacacctgatgattttcatttttgccatgtaggcgctcattctctttagacaatcatcatgcaagaatcaagaattcaggatggatatttggaaaaaaggtatgatcttgagtcaatacttcaaagaagtagctccaatgcatctgtacaggctctgaggctcatcattttcgccttgcaaaaaaaaaggtgattttttttcctttgaacttccttgacaacttagtactacaatactcgagatgcttatatttatctcggctttgcttgttgacaacctcaggttgatcaaactcaaccatactacagtaagttcttctccaatcagaccaggttctcatggggtgctccactgcccatgaccattcccggcttctgcgagtgcatcacgaagtcgcactccgccaccgcctcgcccaccgtggggaagatccactcatggccgatcgcctcaagcaccttggagctgtccaacttcttcatgatctcgctccccgggttcgccaacacaatctgaaaaggaaatggcaggtaactgaatcagcctgggttcctga

SEQ ID NO: 86252 - DNA, 677 bp, Oryza sativa
tgcaaaagatctgcttgtgtggaaaaaaagaagtctttacatatggcatttatattcaacaaatggcagacaagagatatgttcagagcatccactgctttcccttagaaagtttgtcttggtaatcaattctgataaagtgactgcccatttcaagttatcattccaaacctccaataaaaaaggttgaagtatcccataaggccatgatcccatccagtactagcacaaatggaatgtaagtaacattgatgaattggataacctgctgattttagctatctctacaatcttaatgcgacatcacagaggtttgttatgaaacagaacatgcccttctctgaaatgatttccagtaaagaaaatgcaatttactctgtgctaaccagagcaaattgaaaagtttgtgctgtatgcataccgttcattctttgcaggcaggatgattatagattttgccttatttgctgctgctctctcaaatgattttgtcaagctaaggctacagctgaaatgtaaaaaattggagctcaatgagttttgatatgtcaaagaaagtgtgtcaagcgtaaatggatggaagcaaatgatcgtgaccctttacctcttggtgaagacgtcaatatggtttaaatctttggcaaagctatctccaagtttctcgatttgctttctgg

SEQ ID NO: 86253 - DNA, 1098 bp, Oryza sativa
gaagtagtagatttctcaaatcctacaggaatcagcaaacacaggaaagacaataggagtcctttgatagtgctatgggaaaaacaaaggaaagttaacaaagaggtcacacctcttgctatttttcctataaaatgtgaagcataggaatacaatcctatggaaagtttcattcctttccaatgaatcaaacagacatgtaggaaagaatccatagggatttaaatcctacgaaaatcctttgccaatcctatgaatcaaggggccctaaacttgctcttatccttcaaatacgtagcaagttggcaacaggcggcaacatcatgaattgcagacgtccactcaaagcagcaccaggaccctcaatccattttatccaatgtcacactgagggcccctttgaatcataggaatgaaaaaacggaggaatagaaaaaacataagattctgacaggaatgtaagtgtaaaacagaggattacaaaacacaggaaaaacatagaaatgaccgtttgattggatcacaggaaaaacataggaatttgaggagagataaagactcaaaggatttcttccatgaggttctacctcttgttaaaattcctccaaaacttgtatgggaagaggcattccataggaatttcataggattccataaggttcattcatttgattcaaagggctttgtaggaaaaattcctataggaatgaaatcctctaaaattcatatgaatttcctttgaatcaaatggggcctgaaaatgtaactccccatcaatggcacagcgtcccagtgcactatgcagtgatgatatgtgatgacctcaaaatggcttgctatctgtttgctgaaactgattctacttcggagcgatgtattattgctgaaatatactgtacatcatacatgtgcaatatatactaccctctatgacttggtaaatagtactggcatgcccaacataaaatgttgctggtaagtacttcgtagtgtactatattactccctccgtcccacgatataagggattttgagtttttgattgtaacgtttaaccactcgtcttattcaaattttttttgcaaatataaaaaacgt

SEQ ID NO: 86254 - DNA, 1916 bp, Oryza sativa
acagaaggcatcaaaagctggcagcataaccaagtactaatacatgaactcgatacagtaacgaaccatggaaggaaacacatcaaaatataagcagtgtgtaagaagagattagtagacggctatgcagtacttctacttggattttcaacggagcttcatccataggttaatggagaagcaggtcacccggatgagttcatcggtgtcagtggagaaaacggttgcaggagttgttgttgggcacgtgcagacgaagaacccctcttacaaggggctgtttctttggggcttggacttcatgttatgctggccaagcccgagaggagagcagaatgtacaaaagattgggaatctgggatcgttgcagcaagacattcttccatgatcttgagttgcctttgcccaacatcgacagccttggttccgttctccattgatttctcctgcaaggtagtaacaaccaatgtcttaagtcttaacacagtcacagaggtaggagtattggttagaaggctacagtagtgctcactacagaaacataataactcagctccatgattagtatggataaataagggagcatgattcacatgcaaggataaaaaaataacatctgctgaggtttggaggactcatgctgatagtcaaaggtaccatgttgagttggactaatggatcatctagtgcaaggacaacatttaggcataaggagatctccattttttacttgaacataaggagatttcttgcagatagtacaaacaagctctccttaccccccaaaaaaggatcataaatacccaaaagaaaaactaataagctgaatggactaactacatgagcagagagaagcatactacatgcaaagcttttatgcaactcttgcagattcacattcataatttcatcattgaacctgtaatggtgtcatagtatacttcagaagaggggttttgttgcggggatataattcagaggcttaacattcataaatgaagtagggcctatcatatgcatttgtcatgatcagttgaccaccatcagcagagttcttaatggttccgcacccatcatcaaataatccctaaataaactttgccactgaatggatgttgacataatgatgcagtatgtcaattgggtaatgttatttacattcacatcattataaattatgttagtaatcagattcttacaagcttaaaatgccgaccctaaaacaaagaaagatcactacaggaaaatgtggccccttcatacactatgttcaggctagttaattaggtccatctcacagagaacctcaatccctattgactcaacttacaaaaccctgaatttgcctacaatctttatctctatgacaaattaagttgttgaagacattaaattatataaaagttttcaatgctaagttcttacgaggcttgcaacatttattcctgaatgattcctactgcattttagatttttagttcactaatcaactaatactccacagccaggaaaatccaactgctcttccatgaagttccaatatcaggtaaatctgtggatgatcgaacccacctataaaatcatctcaaaccttatcaactaataaagcagcaatcaattcgtcttccagattggaccatcctaaacactcccaatgccaacaacacaacctgctcatatcataagaggatggcacaaacagatactaaaatgctggataacatcttcgtatgagaacagtagccaccataccaaaccaaactgcacaaatcgcattccgcatcgcaagcaaacggaaccccccccccccaaactacaacaacaacaacgcgtgcctcccctcccagaactcctctcaatcaatcggcggccaaaccaaaaccatcgcaaaggagagcaacatacctcggagccgg

SEQ ID NO: 86255 - DNA, 597 bp, Oryza sativa
ccagttccacgccaagcaaacccatcagccggcccaggcccgccagaccatacctctttcgtggccgtttactgtatgggggctcgatatcctgggtccgttcaggcgggccccggacgggttcgagtatctgtatgtcgctgtcgacaagttcactaagtggcccgaggcttatccggtcatcaagatcgataagcactccgcgcttaaattcatcaggggcatcactgctcggtttggggtgcctaaccgtatcattacggataacggcacccagttcactagtgagctcttcggtgactactgcgaagacatgggcatcaagctctgcttcacctcccccgcccaccccagaagcaagggccaagtggagcgcgccaacgcggaaatcctcaagggccctgtccaattcaaagaaacataatagatacagatgctattagaaccaaaagatagcatcttcttaacaatagcaagcttgagaacccttggtggttactgttaaagtgtcagttgctactagtatttgacaatattaaaaggcgacatattaaaatttcagcataatgaagatttctgaacagacaccactagaag

SEQ ID NO: 86256 - DNA, 671 bp, Oryza sativa
tgggtttgaaaagctaaagcaatgcggaatggaagctttcagatgagatttcgtaacaagataaagtttgatgagcttgcaaactttgattatttcaatgtcaagggcactgatgtgcaagttaatgtgaaagaatggacccagaaatctgaagcagttgggaagttgcatattgtctgggtcaaaaaaaaaaaaatttttcccccaaacccttgggggggaatttcttgaggaaatgaagggttaccaagctttgtatgaaattgggtcaaatttagggcctgtcttggaggttgatatggctactttcagagctagcaatgtgatcagggcaaaagttggaatgatggagctgggtgttctgcctttgaaactagtgttaacttctcccaagggacttttgttccaagctcatttcagtctaaagaaggtgggggggttgggggaagagaaaaaaaaactctttgggggggggtggttatagttgatcagctagatgacacttttgagaaaattgagatacaagaaaatactctggagggtagcagtcagagagagggtaagcaagttgtggtggtggatcccatgacagaagatcaccatgtcagtaagacgggtaacgggctattgaagtttgtcagaagcaagtcctggtgccagaattgatgctg

SEQ ID NO: 86257 - DNA, 664 bp, Oryza sativa
ggccccggcaccgctcgcccgtgggagtgccgagccaacttgtcgccgccatccgcgccatagagtgcgacgccaccctctccgaccaggaaaaggcacgccgccgccaggagcttctcggcggcgccgcgcccgccggtgccgacgccgatgatgacgagggggacgacgtcctcgaggtcattttccgcccgggggggggcccccaaaaaaggaaactttcagctgcgccttctgcatgaagctgcccgaacgccccgtcaccgtcagtactcttgcggggcctttcccccattcttcctcttactacttgctttgcttatatgtacgatgatttatcttaacgctagggtgatgatgggggctatcctatcccctctcttcacacatttatattcattacttacatagagttgtatcatccctgaaaaaatttttaaaaatttcccccccccgggtttccaaaatctatatttttgaggttgacgctgccatttattcttttctgttggttcaatttgcatttcctgttatcgtttaaggtttctaactagttgaaatgaccatgtaccatttctacatgatattgtttgcttttgctactcatttcttatatttcttatttacgctaccatttgaattccaataacggaacaagtcttct

SEQ ID NO: 86258 - DNA, 1291 bp, Oryza sativa
caatctcagcatagttatactgattggcacgatcatttacagcatgctcacttgcatgtgcagcaatcctaccattctcttcttgaccatgttcaggatgctgagtttttagatgaaggttcaatttgtaactgtgaatgtaggctttcccacaaccatcatatgggcagacatatggtcgctcagcaaagcttgtgggtgctggtgttgtaggcttagttgatgcaggtgttgtcgtcttcgttgctgctggtgttgtaggcttagttgttgctggtgtcgcaggcttactgctgctttgtggtttatctgatgatggcacatattgtgctgtgatcggagttccagtctgcatcatggccacattgagcgcattatgtaaatcagagggagtacataaaaattctacaaaccattgtaaattttgtgatgcaacacaataggtgatttgaaaaagattttctagttgcattttattataatatatcagtatggcattaacccgagactacattttgctgctgcaactgtattttattataatatatcagaacaacaatgagcatgcattctgaacaagtacactgggggagcaggcagtttcgtgttgtaatacttttctttgaaaaatagctatgagaatctttaccagtttcaatttaattatttctgatatggcttctataatgagatttcaagctagtcgttacatataaaaacaattgaaaaaacagcaaatggaagtcagtgcaccatagagcataccttttcatggcccttgacatgggattttaatttggagtcactcgtaaatcttttgccacatgctggaaatgggcatacatgatagttttccaacgcatgcgtttttagatgcgaacgcaggttaaaatccaatgagaaggcctgaaattcacaggatttctttgtaagaacatgaagatgcactgcaacatggtcaaaggattcactaattaaaaggcctgagaatttatgctacatttcttctcaaatcagccacttgtgggtgtgcatatgttgtctccaaattttgcaataatgtagacagcatgtcagtgtacaaacaaacaacagaccggaaggactagggtaaatttccataaagcagctcaagtgttcaactaatcagatcaggggaaagtattcaatcaggtagagttaacatgaaatcacatacaggtttgcacctttaacacaacatatgctaaggttagctttgattactatggaaaaaaaaagtaaaagaacaagtagtatgtggagaagtaaa

SEQ ID NO: 86259 - DNA, 977 bp, Oryza sativa
gcaaagctgattttaagttgtggggtctgtaatcattgggacggaacaacaagctaatcctggtgtcttttagtcctatcaggtgcaggtgcaaaataaagggcaagatataacaactaccaagggcagctcgatgtataaaaaagggtgaatagccaaagtggtccttcaagtttcatctgaggctcagtttagtccttgatgtttcaatctatccgtattagtccttcaagttttcattttagttcaaacttagccttgaaccaacaactctcttgataaatgacacttatacccctatcattcacatatataatagaaaaattgcatgcttgatttttcttttagataagcataataaattatgtaaaacgaaaataaattatgtactagaaagtatatatacgatagcaattgcttaagttccatgtgcacatgttgaaataatgggaagtacatctgcaatgttgtttattcatcttggttttctattttctagtatatagttgtatacaaattaagggcaaaagggacattttctaatagaaatattaactagaaatagccatatggcatattaagggcatattaagtgggcccaaggatgatttcaagccaaaacaaatatttagaggagctatgtggacaaaatgaaatgtgaaggaccaaattgagccttcggtaaaacttaagagactaaattagctattcaccctataaaaaaacaaacatatactactaacacagatgtggcttagtatgaaactcacggcgcattctctgcaggcttgagattgtattcagcaccatcagcagccaatatagaaaattcagtaggacgcccatatgggatattgatctggaaaattagaaaaaagattatgtgcagataatggaaacagaaaattctgttcaacagaatgtggctatattggaacattagagaacccagaaagtttaaacgaataatgcttgct

SEQ ID NO: 86260 - DNA, 3078 bp, Oryza sativa
taacaaaacatacccattacaaagagaaattgtcaagtcaatcttgccttcaggttcgacaagtgagtggtgaattcaatttcaccagtaaatgttggtgctcctggattcccaacccacagaaatctgtgctttaataggctactacagaatactaatgtactccactttatttactgcagcattgacatgcataagtcatcgctccctccaagaggagaaatccagagttcagacagagcctccaagaagcttgaaaatgtttaacttccagcaatatctaaatgttccagtgccagcttgatcgtagggaacgcatgcaccatcgcgcaaagccccaaactcacacgaagaaccaaagcttgacaacaaaaacagcagcagcaaagacaaaaagacacaaaatcagcgataaaaagggacgagacggaaagatttacctaccaggatcaccacaccattccattccatgccctgccatgccaagagttttaattgcggataggggaacctgagctgctgctactacggctgtagctagaggcacttcttcctcttaaaggcctaccaccattgaaaagaaaccatatgatgcttcaatgttctatttttacgatgccacacatttaagctgcttgagaagggaaaggcacataaggattactaccttctaggactgcgacttctgagcacccttcttggtccctgcacaagagaaaaatgtttgtcttggtacaagaagaataaatacacagacaaaaaaacatttctttctcttcttccaaaaaagataatgacatttatagttatgagtttacccttcttggaggagtaggtgaatcagaatacgatgaggatgaccgtccacggcgcacaggaggaccccgacccctggttccattatttgatgtaagctttcatctggtagaagatgcaaggccactaatctaaaacggggtaaaagggcgatcaatcctaacattacctgcgtggagaaatcgatctggaaggggagcgaattggtcggtgaatgggagatctactgcgatggcgaagtgactgtggtcttctgggaggactccacatcctccttggaggagtcctgcagaaataattaatggtcaatggaataacaaaatcccaaaattagtttactaggcaagaaaaggggggggggggaagcctccaggggagaacaaacacctctttcagagttattagaagctagagaaagcaaaatcttggcccagaagcatagaataaactaatcagattttcagctcaacactctgattatccactctaaaatgttcaaaaaaagctaagtagagcaaccatccaagaaacccagcatggtttagcttcttcgtaacagaacagtagaagctagaccactacagactgaaatgaataaagagcaaatagctgtgcaacttaaaaaagatatacacaaaactcatatgccccccaccttctcctaaattcataattcagataacatatgaaatactaaagaaaaaaacatcaactagacaagcttaaaatacttacagccttctacgaggcaatggggagcgcctgcggattggactgccccgatctcttcttggtgataggctgttgttattatgaaatatttcagcacttccaaacaaaatgctgataacaaagagagcgcacagacgcattactcactgccttggtgatcttagtcttcgagggggcggagagggtgagcgccttctgattggggatcctggtctcctgctaggagttccaccatgcctgattggagaaggagctgttcgacggcgaattggaggagaatcaggcctacacctaggtgattcaactcttcgacttggaggagatcgccttcttggagatggagctggctttctttgaggagatgctgctgaaaggaaacaagtgaggtttcaaagttcaaacactatgttttaccacccagtaaaaatacaaagactggttatggttcaaaatcaaagtggcaaacaaaattgaaggcaaggtgactagcaaaaataacaaaaaattgatgctggtccagagaaagagtagcttgaagaaggttacataagaaggagcaaaatcttacgtttcctgggctgctgtttggtggccttttcagcactaggaccaactttattatgatcaaccacatccctttttggtgaagggtgaagagcttttggagaagcagcagctctttgctgctgtggtggaagcgcgaatctgactttaacaacatttccatcaatttggccctgtgaagatttgtaagtattttaagttttaatgctatgttcatactaaaattccaaatgaatgttgcaggaaagaattcatgtactcttccattatctaaaaaaaaagaggaaagaattcatacaccatccaagtaaagaagagccttctcagcatcagctctattcttgaactcaacatatccatacccacggggaagattgacctgaatcaaagtaaatgatgagtatataaagatgagacaagagtgatgaaagttttcccccctgccttgtgcattactgaacccatttacttaccaccctatccatggagagctccacattgacgacttcaccataattttctgcaaaacagcagaagtatgagctaaagaagcagcaatgttgttgagtgcaattcagctctattacatcaggaaccgttcctattatgtgaaaagtgaaaattagaagactaatagccccaggatcccagggctctcagccatggtcttggaacatcagttggttatgattttatctactttaaaatgttgagtaaaatgaactccagcgtagacgcgagcgttgatcttgccaaggaaaaatgtgtaaagattcaggtttttgagccaaaaactgagaagatgataacctgcatacaacagcaacaacatactcggtgtacaaagcctgagaaataacagtggagggagaaggatttaggaaggaaggaaggaaaactgaccaaaaatctccttgagatgatcctcattgacgttcctggagagatggtcaacatggaggacgg

SEQ ID NO: 86261 - DNA, 959 bp, Oryza sativa
ttccttccgccgccgccgaagcagaagaggaagaagagagaagaaagaagcattggcgatggctgcggcggagggccccgttctcctcttcccctctacctcgtcgacgtccgcccgggtggaggcggtcgtcgtgttcaacatctgcgacagctacgtgcgccgccccgaccaggcggagcgcgtcatcggcaccctcctcggctccgtcctccccgacggcaccgtccatgtccgcaactcctacgtcgtcccccacaacgagtcccccgaccaggtaaactataaatatctctcttctccttccgcccggcatcatcagatctagggttttacttcttcttccattgattccctgaacttgcctttctaatgttaaggttgctctcgacatcgagtaccaccacaacatgtatgcgtcgcaccacaaggtcaaccccaaggaagtcattgttggatggtaaaccctcttcttttcttctcttctcctattctcccctcattggtgatgatgtaccactatgatattgcttctgtccctgctagtagttagtacaacattaagagttaactagtttgagtggattaacttgtccaatcatgctcaatacacacacacacagcacagcacatctaaatctcactggttctgttaggtttgatatcagctagaacaatcgcaatgatttccctgttactcatgattctctgtcctgtttttacctagtgctgtgcgacaattaacagtacccagcaatgcaaacttagagttgctgttataactgtaatttgttttctttcagagtaggaaagaaacatttcaaaaaatgaatgagcagtaatacagtacatctgtatgcaggttctcgactggcttcggtgtttctggggaagtacgcttatccatgatttttagtcaagagaagtacagagccccattcatctcactgttgacactg

SEQ ID NO: 86262 - DNA, 544 bp, Oryza sativa
cagccaatgcaacagcagcatcatacatatctgcaccttctccatcaagctttgcagcatacatccagttaccacttgctttgacatcagaaagtgatgaaactttagcccaaaccagattagtcaaggcttccccaatagcaagtcttgccatggccttgggattaagtaaacctttcgttggctgttctccaatggcacaggcaccacctgttagatcagtgtatgtctgtgcgatcacagccacatctgcaagaggaagttggagaggtccaactgtctgctgttgtgcaacaagacctgtcacacacctgtcaacttttgtggttaagaaacgcttagagcatacagatggaagactcaatactcgcttcagagcatccatgattgttactccacgggcaatatctaagggctcactgactacagagactcgcttgaattcaaaggtcttttggggcatatctcctagaaccttttcaagctcgagatcctcaacaggggttggaggaggaaggccatttaacttcgcatgctccacagc

SEQ ID NO: 86263 - DNA, 576 bp, Oryza sativa
gccttaggaatcaccattttgttactacattttaactgttttgttactacatttcctgtactattttactgtctgatttattacatgtgaacttgttcaagagagctttttccctaggaatctccatgttactgctgactggttactgcaagtatttttttactgctcattggtgtatgtatcgcgtatgaaataactgtcggctgtctaagatattgcatatgagttactacaaataattagcggtttcaataacaaaggggagcggttacaataacaaaggggaggaagaaagacaaagaacaaccggtgtcgaaacaagctgagagcaagcagccgaaagaccatagcaaaaggtgcagcgtctgtcacaaaattcaaggacacaatgctagaacatgtcctagtagaagcaaaagacaaaaaaacaatcaaccgccaagcaatagatgattatgacgaagaaaaagaggaagaagaataagtgtacaagtgatagatacattgcttctgacttgtaggacatttgtaatatgttactgccatagtatataactgtgactgtctttaagcata

SEQ ID NO: 86264 - DNA, 511 bp, Oryza sativa
cctctttcataatgtgttgcggctataaaaaaaagtatagcaatttattgttcggtagaaaacaagcaatgcaactgaaaacagtggaaaggggtacccacctaaagaggagcacaatgatcgcaaggatcatcatggaggatgaattgccaacagcaagaaacactggaagagttgttgcacagggtgataatgcaggtacaagtacaagacctgcaactgccatcttctccattggatgattatgagcatggccatggccaccttttcccagtgcaaacagcaggatataacttccaccaagaacaatcagcaacagtgatgcaagtttatgcactgtttcctcgcctgctatagtatttgccatagtaacagcagttatcccaagaagagcagtggaaacaacatgaaggacgcctccaaatgcagctgcggaagttaggatattttattagtagtgatatatagaataagaacatggaaaagtaatatgagtattcatcactaattt

SEQ ID NO: 86265 - DNA, 1014 bp, Oryza sativa
aggagggaaaagacacacgcacgccgacgccgtcgcccaccaccccctgccgccgcgccgcgcggccatggggctccacgcgatcctcctcctcctcctcctccggatctccgcctccgcagccgcctccaggccgccgctcgacaccctcggcatcccgccgcaaggttccatcttgttctttttctccccccccggatctgcctgtatctctctttcttggtgcttgatgcggttcttgatttggtgcctgtgggggcgggggtggctggctgcactgcactgcagacgaggcgtacttcaggggcggcgtgatcaggtgcagggacggatcggggaggttcgccagggacaagctcaacgacgacttctgcgactgccccgacggcaccgacgagccaggttgcttccttgctctcgcctgaaaaagattatccctttttttttgccttagctttttgcgcaggtgttctggttttaggttctcgtgtttgtgctagtagctcgaatctacttactgtaggcaatctaagagagctgtttaatcgaattgtgtttactttttgccttggcgcagggacatcggcgtgcccggaggggaagttctactgccagaatgctgggcattctcccatcacgatcttctcgtcgcgagtgaatgatggtatctgtggtaagaggattataatcggtggccattctctgtatcattcaaatgtaaacacagtaaatgtacacaaaatcaattgtaaggctagagattagggtgcttttgttccgtaaacatagtgcttgagggaattcccgctatatttttttctaattacccatatgtgtttgtcgctgcctcttagattgctgcgacgggagtgatgagtatgatagcaatgtcacttgcaagaatacgtgctgggaggctggtaaagcggcaagggataaattgaagaaaaaagtagctacatataaaagcggagttgttattcgaaatcaggaaattcaaaaggcaaaagtggc

SEQ ID NO: 86266 - DNA, 583 bp, Oryza sativa
atcattccgacgggacagggcgaggcgtgcgaaaggccgcctgttgccacctaacccgcgatctgaccggtctatgaccggtcacacactgagacctgtcacggaccgaacgagtgtgctgcgctggattaaatgcggcgtggggcgctagtccaacccacaataaacgcggttaggtgagcgccgctgtgctcacctaacccacacacgtggcgccaaacccacagggggtcggggcaccccaacccttgggggcgaaacgggagcggactgacccctcggggagacaaagggaggggcggacacatcaccctcgggcccgaccccccagagggggtcaagccacgtgggagactgcagctgccccaaagctctagtcaagatacccccggacccatgttaacgacagccgggatgtgtctagactccagaagtacggactctatgatatggaaggcggcacctaatggtgacttattggagcggaatgactacactattctttcggccggtagaacatcctgcccgctcggcaagattatatggaaatcccacgcaccaacaagatgcaagttcttcatgt

SEQ ID NO: 86267 - DNA, 1165 bp, Oryza sativa
aaatattggttttatactctgtaaaagacgaaaaatttgcgaaaaagaacatatctccaaattacatggaaatatccacgagtttcaaaaaattcaaattcctataacaacaataagaaatcagcgtcctacaaggtaagttcaataatacatatcactctttgttctctctataatagccggctgaagtctaccatctgcatgtcatataataaaattttaaacaaatataaatcacaaagtgtttgctaaaatgttatcatcacattttatgactgattatagtcaagatctaatggctagttataagttttccattaaatttgcactagcattttctatttacatctatttacgtcaacttaacttacattgtaaatacattaaaattacatatataacttagggacttacgatgtatgtacgtgttaactatattttatgaaaaatacgacggaataaatataggtagtcccaatcacaaaatcaactcattaaactatttgccttccaaaattttcaacacgaagaacatgattatatagccattatgtcaatgtctctaccaacgcacggaaataataggttcttgcaggaggtccactatgcgaaaaaaaaaaagcgaccattcttcccgtccccctactgctcagccgtttgctgttccgttttgtgattggatttcagagatttccgacgggaaaaaaactgaacctgattgactacctgatgctgcgtgagttggtggacggctctaatgacggctggctctaccaaatcggcatatccagtttgggttgcaagaatcttcagtttttcctcgtctggaataatgcgggtcttttttaggggaattctcagtggcatggtcaaaagggaggaaacattttcatcatacaccgtgggtttttttttaaaaaaagaaaacacataacactttattaaatgacagcatttagggaattgaaatcccgaatacttcgcccatgataaacataagagttgaaccataataagagagaggttaactgaaaaaagggaagcaaacttcctaatgaaactaagcagcaatgaagcagcaaatcgacagggtactgcggcaatgccgcgacgactgcatccgagggactctattgatgtgcacttcgcttgacaaacccgtaaa

SEQ ID NO: 86268 - DNA, 1184 bp, Oryza sativa
agcataagcgaaacaacatatttgcaaatgaaaacaaaatcttaaaatcaactttgaatttaagtttaaaattttaaattttggctgataagaataagcgaaaagataggccagtcaaaaccaggggtacttaggggttgtttggatgctatactaagtttgccaccattcaccatattttttatgccacacttgcctaaattgtggcttacaaaaagtgagccacaacttagctagcaaaattggattgtgccacgctttggtgagttgatgacatgtgggacccaaacagatgagaaggaatcttgccacaagtgtggctatgaactaaacaatagactaacttggtcaaacttgactaacatgaggtgtggcaagttggcaatctttggtaaactttgggagcaaaccaaacatcctttttacacagtgacctttgttctaactgcaccgatggggctgatgatgcatattggaggcccagccaactactgggctcatcatggatttggggaaagcccacctaaatggcatatgccctacgtgggtttacgggtggagaaagttcaaatttggttcctcattataggtgagtttaaatcatatctctcaaccgcaaaactggatacaattagcatgttcggtaagactttgctgtagcgttttaagttgtgttgtacaacgtagccgttcggctacacaaacacatagttacaggaagttgttgcttgctgctggatagttataactcctgtagctactggctggttggctgcagcgtagccacaatgctgctgtagctaagccgtccgaacaaagccaatataggagtatcttttatctttcaaaaccagtacaaatatagttccaagatgctttagacggtgatttttagctgacgtgacatccacgtgatgtttgatttggttttcatttgacatgacgtctacgtgacgcctacttgacataataagtaggaaaaaaaagtaggacctgcatgtcagttacagtaaatataatcatttttttcattcctctctatcctctctccctcatccttttagtccatatgccgtctatatctttttgtcatggcagcaggaaagattgccaactatggagctcgcttgtccccccccccctcgtgcatccgccttggacactactcgtggcgctcctgctct

SEQ ID NO: 86269 - DNA, 712 bp, Oryza sativa
cgcctcctccttccccttctccctcgccgagaaatttcgtgatccaccggccggcgagatcctctccaagctgccgcggtcgtcgccgccggtggcgatgggcggcgaccactaccagacgctggggctgcggcaggacgccaccaaggccgaggtgaaggccgccttccgccgccgcgcgctccgcgaccacccggaccgccacgcccactcccccgacgcggccgcgcgcgccgacgccgcgcgccgcttccgcctcgcctccgacgcctacagggtcctctccgacgaccgactccgcgccgagtacgacctccgcatccgctcgtcctccttctacagccgcgcctcctcctccgcctccgcctccgcctcggcctcggcctcctcctcgtcggcctcgtatgactacggctacggctacggccacagacgcggaggtggtacctggcgccggccgcctccgggcggagggggcgccgcctcggccggattcgattgggacttgctgctgaagtcggtcacgcggcgagggttcctcatcaatctgggtttcgccaggtgaagctgctcatatgcgctgatgcttttcttgctttggctgatttgatatgccgccattgcgtgattgttgtgctgatccgttacattgctggcttttctcgagggaatcattgtggaaaaagcaattgccaagttcataaataatagg

SEQ ID NO: 86270 - DNA, 1442 bp, Oryza sativa
  unsure (1)..(1442): unsure at all n locations
atgtatgccgcgttatccagaattttttctaaaaaaagaagatagaataaatcaatatgtaatatatttattgtacaaacatgttatcagggctatggataccacatacctaatagtagttggctaaatctcgacagaactcaccacataccatgttttatacggaaacaaccttcgggtatagaaggagttccggataaggaaagataaatagagttctacatagaaacgacaaggattactcggattgtatccatattggtttccctagttctacttggaaaagggaacacgtatgggtataaatacaagaccccctaggaggagaggggggacgaaacaatagatcaagacacaagatcaacatataagctaacatgcaccaagacaagacgccggatatcgacttcagagataagcatggctagtcccctacgatgtctacggatactgtcaggagagacatagcgctgtctttgatctcgctggatgcggattcgaggaggaaggctaccctggcgtcgactacgagtcagcacttcataccgccaagtcgacaacagttagataggctaccccaaatattgtactggtgtgattatggtgaataaaagcaacgaccggcttcggccaacaggagtagggttattacctgacaattcaggggcccgaacctgtataaaaatcctcgttcccatctcatttacctcaatcttgcatatatcctaataccaacgatccccatactatgcaaataccgtagtcgtgacatcaaacgtcgacacatgtaaattcaacttggacaaaaaaaaagntgatatttctcatttatattgatctaccatgttatgtttaaaataaaaaattatttatgacaattggatttacctaaaaatgagagcgaaatctcctaatgaataaagagttttccgctattgtctatctagtacgaatatgggacatatcgagaatcatagttctatcatatacttcatccattctaaaaaaaaccaattccgtatttagggatataggatgtgacaacgaatctgaatattcgttatactatatatgttatatcatagtatgaggttggttttttatttttggcggagggagtattagctaggatatttttagttagagagagtactatagctggtagtagactactagctaggttaggcttaggtgtagaatcattggtctttttggcgcgaaaaggtggggtcgtgggcgtgcactccactaacacacacaagggtcgatcacgcgcactagaaatgggcgggattacggccacgtatatacgaccatgcacatacatgcgtcgttgcgtttcactggcatccactacgatccaactgtttaattgcgccgtgattatctatcaatctatctaatcttggctggaatttcatcgatcgaaaagccaacgagct

SEQ ID NO: 86271 - DNA, 682 bp, Oryza sativa
aatatattctttcttttgatgaagctgcttccaaagcatgttctagagataacgtctgcagagtaagcccttatgtcatcatcaatctttatgtctatggtcccgccatttttgtctattccttcttcccatgacttaagcagtgtttgcgcagaatctaccatcagatccaccatgccctaagtatgtgaaaaaaacaaagaatcaggcaggcaagtaacactcattgttgtcttctgtcaagctgtatgcttgttcttaaatctttgaattctaatttactgatgccaataggagaagaataaaaaacccttatgtaagtgtgataaatagctcatcagaatgatccaatgttactgaaagtggtcctaactagagtggggtatagcacgttatcttggtggatcagaatattgtagttttgctgtcgtgagtggtcctaatcagaaattttaatgctcgtaacacattatctagctggatcagactgtagtagtcactctgctccaggctctcttacgttgaactgtaattctaaattgcgtttgctaagcgggaacatgtagatccacatatttatttctccctgaaactatgaggatagctttgaatgcctacttgctggggcataaggttttcctccgatgccttcaaatctttgttagcaacccaagtctatttg

SEQ ID NO: 86272 - DNA, 4799 bp, Oryza sativa
caccaccaccactaccgccacccagaaattcaccatcgcctcctaaaccgccaagccaagcagcgcaatcgcctctgcccccgacaacaaccacgactacgcctccgactgctccagtaccagcagcagcgcctcctcctactgctccctccccttattctgctccgtctcccactcccactcccacccacacccagccccgcccatctccgccgctgctgcctacacctgccactgctgctgaccctgccaaccccaacaaggccaggcaccccagctccaacaaatcctccagccctgctgctcctcgacgcactaactcctcctcctcaccgcccaaccttgccattgctgtcggtgcagtgctcgccatccttgtgcttagcttattaggagctgctatatggtacactaccaagaagaagaagaagcagcgtaggagggataatggctaccgtgctggattcatgtcacccacttctcccttgtcttctcaccacccatcatcaggatcaggtactgcactcctcccatcccttgtactactgccattttttcagttttcacacctacttctattcctcactctacaatgtaaaatgagcacaaacttccttactgttcacacattttcaactgtccttccttatagaggtaccgcagtaccacaaagtaacgctatagaagctctcttattgtgtgattctaacattttcaccatgacgaatttcagcatgtagtcgttactatctttgtcactttttcttcaggtgcctccgcaaatgtaggatcatcgttggacccttctttcaaaacaaactatagcgccggaagtcccaaactgaaagcatgcatgtctgatattagcatgggcaattcccgcttcttcacataccaagaactgtaccagattactgatgctttctcagctcacaacctgctgggggaaggagggtttgggtctgtatacaagggccacttgccagatggaaaacaagtggctgttaagcaattaaaagatggtggtggacaaggggaacgtgaattccaggctgaagtcgagataattagtcgtgtgcatcaccgtcatctggtatctcttgtgggatattgcatttccaataaccaaagggtacttgtctacgactttgtgcctaataacacccttcattatcatcttcacggtatggtttaacctcttgctacattgtacatggccatttcgttcttctgcaagtagaaactgaaacatgtattgaatcaacctgtaatcacaggacaggggaggcctgttctagattggtcggctagggttaaaattgctgcaggtgctgctcgtggaatagcgtatctacatgaagattgtaatgctccttcctatttttgactatcttcacggtcattattccattatttcgacctaccttgtccctccacttatatctccatttttcaggccatccaaggataatccaccgagacatcaagtcctcaaacattttgttggataataacttcgaggcacatgtaattatattcccaaaatgatcccaagtgcatctctacactacatagttaatgtaaatgagtctggccatatctcatggcctacttaatttgctgatttgatcctgtccatgaattctaggtggctgattttggtcttgcgaggttggctttggacgctgtaactcatgtaactacccgtgtaatggggacatttgggttagtgaagtactggcaattttcagaagcagatctgtcgtgatcttacagagataattaataaaattcgtttttccttgcaggtacatggctccagagtatgcatcaagtgggaaattgactgagagatctgatgtgttctcttttggtgttgttctcttagagcttatcactggtagaaaacctgttgatgcatcaaggccattgggtgatgagagccttgttgagtgggtgagttatagctctggactgaaatcttattgcttaaaatggtttacttggtggcatatttttagttctgatactctataatgtccttatcggtgaattttttatctgactattaactggagatctcctagaatattgtttgttcactgggattggcttaagtttctattgtcacgtggcccttctttcctagtattttgatggaatgttgtcactttagaagttaagagggacatttagtttgaatgcgctatttgatatttggagtacccgttggctgatgagcggctcaaacaaatgtggaatactgtaaaataaatcctatgtatatattcagagaagaagatttttatcggagttttttttttgtatatgtatgtacttgtgtcatgtcgtaaaagctagtagctactaccctgaactgcacaatcgctacctgactctggttctcaactactgtatgcaataacaagacatcactaacagctaaatgagctacatatcactcaaatagttattttgttgtccttcaactttgcaaactcttgacatttcttgaatccctattgtttgcaggctagaccattgcttactcaagctattgagacaggtaatttggaagagttggtcgaccccaggcttgagaggaacttcaatgaagctgaaatgttccgtatgattgaagctgcagcagcctgtgttcgatactccgcatcaaggaggcccagaatgagccaggtgcatataatatacaagctacgtttggaatttgtctggaaacatttcatttttttacatgaactgggaacaatgctttgcattccaatctgcgcatacgaatagtgcatttcatttcaattggtactacggttgtggttttcagtctatctagaagcagttatcaagttaaaatcttgatttctttcaggtggtgcgagctcttgatagcttagccgatattgatcttacaaatggcgttcagccagggcagagcgagcttttcaatgtggcgaacacagcagaggttaggatgttccagcggatggtgctgggcaaccacgatgacagctccgacatgagccaatacggttggagcagcagtcgccagtagaggtactctactcatagcctcaagctccaggatcctgtagcgtgcagtagttgctttctttgctcagtattgactagtctattcttcttcactcactaatccgggttgaattgggtatggagtgtccagtgtaatccttactatgttagggctaagcaaagcgaactgaattgattgtttgattgttattcgcagaagaatagggtggcgaattgagtgctcccgtaacgtgtagatcgatcatgtatgtacacatgaactcattcttcttgtttgacaaaattatggtgttggtcaaagcacaaaagcacacacgagatcatttaagcttctagatgttctctttctctgaatttttgatgttgacgccaagaggaggacgacgacgttagggcatcagcaatgtatccttcccaagtagtaaataaggtgggaccaaccaaaagcaggtaattgttattcaagatctcacaatgtataggaggtaataagataggtcccacatgtatataaaaatctaaaagtatacggtagtatggatagagaagaaagattcaatacatagctgagagaatcaatgattttttattccttactagcaggtcatagcgctattgcttggtatttgttgcttactacctccacaatgtttactacctggtattaaggctgtatttattgcttactacctagtttttgagcacattatggatgccctatggtctcatgtggcgtctcaactgaaccacccacaagaaacgaaacgtcgtcgtggtggtggctaacaagttacatcattttagaatggaataatgctgcctgtaagtgtaacaattaacgccgaatgtcttgcctgaccaaaaacaagtgttcctgatttccaggccatcaaatttgactatcacacgagttctttttaggtgatcacatcacaaagaaagagccattggtgaaccaaaatgaaaacaagaaaagaatggaagtatctttattgttcctgaatgaatattaatgtgtgatgatgaaggaacaaaacaagataaaaatggatggtacgtacgtatgcgtccgctccaatgtacttacatgttgtcgtatgagatgagcaagtagggttaatgtacagttacaaggctagtactaggcttcagctagtataaattttgtacacgaaaaagggaaattgatttggatgtggaaaaaaaaatggtgctgttagtgaacagtagctgcttgctagactatactattactaggtagatgtggtttgtgaatgtgaatgtgattgggaaggaggagggaggtggaggtccctggcgtcgcggcgggcggagacgccaaccccggtggacctgacggagaactggcgcagggcgtggccgaactcggggtcgtcggcgttggagccacggtgctgcagccactggatcttgttgtggtagtcggggaagaagcgcgtcttggcggcggagtaggtgaagtaagggaggagcgcggcggcggggacgagcagggtgaccacccagtaggagggcgcggcggccaggccgtcggtgaagagcatgaagtagttggtggagaaggccggggtgatggcgccgtaggcgaggaggaacacgtaccacagcgccacgctgccccagatgcaggcgtgctgcaccagggtgaagtagttggccgtcaccgtcatctgcgcgttcaccgcccacaccacgcacgtgtaggcggtgcc

SEQ ID NO: 86273 - DNA, 576 bp, Oryza sativa
ggctttcggacacgaatgaaaaaactaatttcataattcgcctagaaactgcgagacgaatttattaagcctaattaatccgtcattagcacatatggattactgtagcacttatggctaatcatggactaattaggctcaaaagatttgtctcgcgatttccatgcaaactgtgcaattagtttttttatctatatttaatgctccatgtatgtgtccaaagattcgatgtgatgtttttgggcaaaattttttgggaactaaacaaggcctcaatagaaggccaaagaagtgaacctgagaaataatacttaatttcatatggttgggacttattgttgatgtacaagcattgattcattgttggcatgcattgttaaagaaaaagagcataggatctcatgtattacctttttaacttgccctcggattccacttactgtccgaatagttgcaccctcaaacctagcaacctctaagtcagatgtgaacatgcctttgactagggcagttttcttaaatatcttgcacggtacacctgtgagcttgattttcttcatgattcgggcagtattg

SEQ ID NO: 86274 - DNA, 936 bp, Oryza sativa
gcaggttcccccatggcggactccggcgctcgcaggcagcctagcttcaccaaggtcgaccagctccgccctgggacccatggccacaaccttctcctcaaggtcgtcgactccaagatggtccttcagaggggcggaggccctcagggcaggcacatgcggattgccgagtgcctcgtcggcgatgaaaccggcattattgtcttcaccgcaaggaacgaccagggtactttactttctatatcctcctcctctcttttatctactactcctcttctagactactcctatctttattcattctgtcattgatactcgtcttttgcttatgaaagatacgtaacagtaagtcttaatattcccacaatagccaaccgtgaccagcaccagagataatgcttgtatgattagttccctttgtattcatttctcatcatcttgcttattcataacttgatgctgtaactcatggagattgttccacatatattgatggagggcttctgctaaattttttttttctggttcaccagcaatcctttaacatgataataacttgctactcccaaatctccatctccatctcaacatgaagtctgctcttctgtctaaagtgctaccttgactacaagttttcacccatgatggtagtattaattggtgtcacaaatattttccagtcctttaatggtacttgtgtaacttatgctaaatagatgagaacgatttctttgtataaagatatcggtcataaaactaataagattggttacgtgttctgggacaactcattttcccacacaaggagcatgtattccttggtgaaaattgagcttgtacactggcgagcaagtcatgttgactgtatgttgatttcataattataacatgtactccctccgtcccataatataagggattttgagtttttgcttg

SEQ ID NO: 86275 - DNA, 594 bp, Oryza sativa
taggacaaacaaatggagcaacaatgcggcaccgcagagatcaacaataccaggggcaaacattaaatcggggacaccaaaaggttccaatttgacaaaacaacattgtatagcaaccatccaatcaatgcaatacatcaaatccaaatggtcaactttcttcaagatgcatggtcattggtcagtgcattaaacatctgttggaataccaaaaattttcagtttctgtagaataaatatggtcagtacaccccacatggtcaggaaagcctcttgtgtgtataacactataactggggaacaagagcttctgctgcccctgaaaaattgacaggggaggaagaaaaactggtagtgacacgagcacactaccaagaactgaacagaggttccatatctctgttgaattcagtgcatccatcgtatacatcctcacaatcttagcgagataactgtgtgagcagaatcaaaacaggaagactcctctttccaagaaatacagatctcaagctgcttgatggcattaatggagaattacttctggttcaccaaatcagcaccactgacatacctagcaacgaatgaaatcaaccg

SEQ ID NO: 86276 - DNA, 506 bp, Oryza sativa
gggactgcccctttctatgcccaaattcctcatgatcgtcacgaagagaagtgccgagtcaaagtcaccttgaacagtaatagtgaagatattccctcagtgatgttcgaagccggaggaagaaactacatccatacatgtcaggaggtggcaaggatcgccataggagagctccttgatcgctacagtgatcagttggccgacactgagtatcgctaccatcctcgccaaccacagggaagtgaccgtggcagctaccttgagactgagggaattgagaatgatgctaccacaaggcatttggttgagatgctgtgggctatggatgaaacccgtgcggagactgtgttagcagcccaagatcgtgaagaccggaatcgtggtaagatttgcaagcttgaggacaaagtggatcgtttggagaaggaactagccgcattgaagggagaagcaccaccgcagaaggccaggattcgtcttaccgcaaggaagagagctctatttgt

SEQ ID NO: 86277 - DNA, 522 bp, Oryza sativa
ctcgttgaatgttgctgcagtgccagctttagaaagattacagattttgtaatttgctttttgttgtaaaggcggtgctctgacgtactgcatttgtacagtttttccccttttccttaatatacatcggtcagcattcttcgccgtcccggcgaaaaaaaagattgaagattaattgtcccagaaacaattgaacacagctttattaatcattccttccaaatgcatcaatctgtttttgacttattaaaatcattatacaaatatatatatatatatatatatatatatatatatatatatatatatatatatttatttatttattttgcttgcattgctgatgtataatttcaccacatagctagtaattaagtaatgggagcttaattgcagggagtagggagcggcggtccgcagaggcacttgttgtggaagaaggagtactgatcgaacctcgcggcgccggcgggcagatcggcgcagaggcgggtgtagctgacgttgaagtcctgcaggctg

SEQ ID NO: 86278 - DNA, 617 bp, Oryza sativa
agcatgttcctgatgcacgcagaggaggagatcctgaagctccaggcgcaagagagcatctgcctgtcttgtgtgaaggaggtgactgagtacttccatggtgaattgagcagcggcgacgaagggcacatggcgagagtttttggcagtgtgagggagttccttgccatgctggaccgaatctgtaaagaagctggagaggagatgaagagcagcggctggatgatgggtagagactggaatatggctgccccaatgggaatgacaacgccttgagctgcagcaatgctggcatatttgttatgttacggtcatctcatctctttgttactaataattttgtagcatatatgaatggagattatgtttcctagcgtacaatcaatggcacctataactatatgtatgtaatgtactccatcttcttgtataaagtactactagtagcaagcataccggtatggtatggatcttttctattttatcattccttgggtatgtctattttgatgataatgcttagcggtggtttattggttcttgttcttcatctctagcgggatgaataagctcaaaattagacataatttaatggtgaagttttctataggtaggta

SEQ ID NO: 86279 - DNA, 3075 bp, Oryza sativa
tgtgatgttcttgtagaagaagtagcagatcatcgccgatatcctgctgtaacaccagtgaccatggaccagcagcagccgctccaggaacctgaactgcgcgatggacacgtcgctcgccatcaccgcctgcatcccttccgcgccgctgatcccgaccccgatgtccgcctcctggatcatgcccacgtcgttggcgccgtccccgatcgccaggctcaccttccccgtgctctccttcaccagcctcgtcaccagagccttctgcttcggcgacgaacggcagcagatcaccgacttgcagcccaccgcaaggtccatcaacgcgcccttggcatcctcctccagggcatatgtcagcgacttcccatcgatgatcaaagcaaaggcttcgccaactaccgatccatctatccgcttctttccctcgttgatttgcttcaccacgttttcctttgatgccttcgcaacagccgctttgtcgccaccgcctttctccagggcgatgatatccggttgctccagtgtgatggttatctgcgtcataccttgtctcagtagactgcacgcatacccgatgttgatggcggtttccatcttgtcgcccgtcagcacccatatcttgataccagcttgtgcaagtttgtcgatgcattcaggcacctaacaaattataaaatcatgaatgacaacagctatatatcagcaaaccatgcatgcatgatccatgatgggggaatcgaagatatatagatttttttttttactcagcaaaccacttacccccttctgtagtttatcctcgacagcggtagcaccaagaagaatcaatttcctctcaagcaaatccgcagcctcttcaatcatttcatctctatcagcactgacagagttcttggctgcagtgaacttcctgtcgaaattcgcatattcggcctcatcaagttggcggtatgcgagaacaagtgttctcagaccagcatcagcgtattcatttatgtgatcctgggtcacttctctgtacgcacaatcactacttgatagcctctcgaacatcacactgtatacatatatagtttttgagatcaagtcaatacatggataagaattaggggccgtcatgcaagcatattgagcaaaatacttaggagttccagcagaatatatactgacctgtcagcgcctttactaaagagaaagatcttcccctcctcattcctaactattaccgacatccgcttccgagcactgttgaactcaaggacatgcaagagcttatatgatctgccaaggaaattcaggaaaatattattagttctgaatctaatttcaaagaaaaggaaacaataaaaagctcactctaataagtggagtacctgtcgacttgttttccagacgagggatctaactcatgcagaaaaacaccggtctgtgtcctctggtaaaacgtgaaaccgagctcccgtgcggcaacaacaaaagcagcctcgtcaggtgactctgcttcataagaaatcgtgcctgattcttcgtcaacttcgggtatgcacgtatggcaaacggccaacaacctgaggaacatctgaatcacaccagagtggggttggctaacccagttaccgttcatcacacgctcatccgtgaaattaaatcctttgattgcagcttgagagccttgggtgttgctggccatgtcggcgatcaagggagaaccttttcttttcgccattgctctctccacctcagtgataccacggccatacgcagttccggcaattgagcatttgatgaactccatggaattgcaagtcagagtcccagttttatccgtaaggatcgtgtccacttgacccaactcctcgttcaagttggatgttctagcatgagccggtgtgtcggtctcctcatgatacatatgaatgtcttggttgatgaacagagcctgcagaagcttgacaatctcaatagagatgtacagagagattggtatgaagttcccatatagcatcatggctgtgaagaaatgaagtattgctgatatggctgctttggttggcttgaagtagatggtagagtcgtccggcctaaggtaccatcttttcggcctgccatcttgtaggtcatctctggttgtgatgccaaagaaaaccgatccgatgactgaaatcaggacaagtgcagacaaaagcaagtagatgatccggtccatcttcctttcaatcttacttctcttggatggggctttcatagcattctgcatgacctttgtatcatggcctgtgaagatgaccacaccgtacacatactcggtgttgcgaagctttgagtctctgagaaggatctgctggggtgacagaggatactgttcttcgatttcgatgttgccaacaaaggaatagaggtgtggatttgggtcctcacaccttattacagccctgaagctattgaagctgtcatcctcctgcaagccggatgatgcctctagagattgcttgagcttgagatttgtctccccatccaggttcatggtctcaacatagcaaatggcgtcttcgtagctagatgagaggaggattaggtcagcagggaaaaactcatctttttcaaccttgacaatatcaccaacttggaggttcatccatttggtagaatggaaagcaccgtcctggagcacttttgtctttctgttgtttacctcggtatcctggatgaaacaaacaaacaaacagttggtaagatttttcagtagctagctagttcaacaaatctaaatactcctagtagtgatgaaattgaggatcagttatcatttgcataagtaattgcctattatatggagtagtatggttgatctgtttctgcatgcatatgcccttaaataaaaatgggtaaaattgggcgattgcttgctagcaataatcggctagggaactactagtactactccctagtcctactggagtgaggagtatatactactggaaatactagattagtagctgttgatcgaatggaaattaattaaggaaatgaagggaagaaagtgacctgctgcttcctcctccagtcttcgat

SEQ ID NO: 86280 - DNA, 961 bp, Oryza sativa
acgcatgccaacggtgcttcaagttcgtcgcctcttcctgaagaggcgcttgttaatggcagtgacgccggacgtagtgagatcgaagaacaagcagaagccatctagaaacaatttgttttaaattgggacgagatgatgttgagaagctggaatatgtatttattttggatcagtacgggaacgcctactgtggtaacagaagatctcgatttgtggtcgagtttatactacactacgtcaaataacaagtgttgctactagctgtgactgtgagtaataccgatacattacattacattacatacatacacggtgattaaaacaaacaagcagacatttttacttggttatgttatgacaggcagagatggcatatgttaaggaaggataatctttgttccttcttctccgcttgatgtgtcgcttgttaatagcatggcagtcgacgatcatatcagatgtgatcgatgctatggcaaacccagtaaacgaacaagagataaattagaggcagactagtgaggaggtgcatataagcatagatccatacattcatgcaactctagagccatacattaacaagtggagtggttaacatgagatgatgcggagattagcagcagctagctaccttaattagtagatactcctaaggtaggaggagtgagtactccacagtggggaagcagatggagcttagtggcgattggcaggggtagtggcagagagcatcttgtcaactttggccaaaaggcctcgcatctctcccgcaagcgcaagctttgctccatggtcatggctagcggtagcagtagctgtaggcgagcggcccagcagtgaggagatcatcttctggagattgttcctaacatccgtgagtgggagcctgattgttgttgttggagtagaagctgctgctgctgcttctttcttcttcttcttcttggttttactagta

SEQ ID NO: 86281 - DNA, 641 bp, Oryza sativa
aatgtcaaaaattatggaatcggagggagtagtaatggtggaaggttcattgtctattgaggagaagcattgctcccttttaagtatttttttttattttgatcttcttatgtttttgttgctattgatatggtattagtatctcatgtagtgctcagctcagcttcaactagtattcaattgtgtttctgttaatgaaccctttcaatctatttggtgacagctgcttggcagagtatttaatatcctgcgtgagaataatcctgatcttgctggtgatagacgaagaactgttatgaggcctcctcaagttcttagggaaggcacaaagaagacagtttttgtgaacttcatggatttgtgcaaaacgtatgatctcacttttttaccactccataccatatgctctaggcctgcttttatttcagagaagataaattaccatgagctaactgaaatcatcgtttacacttccagaatgcataggcaacctgaacatgtgatgatgtttttacttgctgagatgggaacaagtggatcccttgatgggcaacaaagattggttataaaagaaagatttgctcctaaaaactttgaagccatacttaggagatatatcagtaagtttccttaatgtcaca

SEQ ID NO: 86282 - DNA, 2252 bp, Oryza sativa
ccctttcaaccaaataaaacgaaccttctactacttacccgccacccatccgctgcaggctcgcttccagcaggaggaccacgtctacaagtccttcttaggcatcctcaacatgtaccgcttgcataacaagtccatccaagatgtttacggggaggtacgtaccttgcctcggcgcttgtgtatacgcctttttgaagaattctgtcttaccggctctctccttttgtcgttaggttgcagcgctcttccgtgactatcccgatttactcgaggagttcaagcatttcttgcctgatacgtcaaccgctccagaaccggtaactgttcctagaggtgtttcaagcagacacgacgacaggggcccactaatgccctcggcaaggaacgcgcagatcattaaggtaaatcttgaaacggacatcttgttacccgtgttaaattgcatatactttagagaatgtttccttatacgttgacaagtttatatgacatcagctttaggataagtactgcagagaacgtaatgcggcgtaatgtaaactaccttgacaagtttatatgacatcacatcatctttaggataagtactgaaacatttaattgacattagctccatgattcggggacatggatatagaatatcagagatccgctgaaacgcactggcatcggacatgaaagctactttctgtactaggatcatttttctgaatctactttttgttagacacaagttctatattttactagctatatttggtcacaaaagaacatctatggtgaaatgttgttttatccatctccagagggagagggcttatccatcaactgtcgatcgtgacttcagtattgatcgccctgatcctgaggatgatccccacagaaggcgtgttgacaagggaagggatggtaaggttgatcgcagtagaaaagattatgaaacggacgtgaaagacgttgaatatgacagcaaagatttggatggaggacaacgtaagcgcaaactagcaaggaagatggatggtgctcttgctgacacacaacaaggtggggttagcacctctacttcaccatacgacgataaggatgcattgaagagtgagtcttaatgtcatcttgtgtgaatatgtgtgcaatatggcatcttcagtgccttgcaggctcctattttccgttaactttaggatccatcttgtgttttcctccatcttagtgtatttcattaatatgtaagtaaagaaatgccttgcctctttgatgtactggattattttcttatttcttattcaaattaaggtgcatacacaaaggagttccgtttttgtgagaaagtaaaggagaagctagagcctgaagcttaccaggagtttttgaaatgccttcacatatacagccaggaaataattacaaggagtgaattgaaaaacttggtaagctggatcgatgtgttttaaaggatgattcccttatctcagggatttataagagcttgctagatctgaattaaagtgataaacctaatgctacatttctgaacaagaatagccttgctgcttttcaggtcaacgacatactgcagcactatccagatcttatgaatggatttaatgacttcctggaacagtgcgaaaatataggtaggtggcatatatagattcatttgtcacctttactttgttgggcacactttcttgatttcatgtttgaatatgttgcatttttgattcctaaagaattcctttactctgtagatgcctttctggagggagtcttcagtaaaagtaagcaacggttaatttaggaagttagaatttcatttctcatgctatttgtagagcctgtttattattagattatgattattattattttgaaatgaagggaaaacatcacaaatagttaaaatagtagaaaaaggatctgcactcaattctaaggaaggcgctacccacaaagctactacattctctagcaaagacaagtataacctatgcaagccaatatcagaacttgacctctcaaattgtcagcggtgtactccaagttaccgacttctgcctaaaaatgtaagctgatttaactctgcagtttgtgatgatttagtccataacatctgttgtttttctttcagtacccaatgcctcctgcaagttgcagaactgaccttggagcctcagttctcaatgatctctgggtgtctgtgacctcaggaagtgaggattattcgtttaagcacatgcggaagaatc

SEQ ID NO: 86283 - DNA, 738 bp, Oryza sativa
agtgctgcatcagttaagtctaatctactaagtcgtgtttagaaccataatctctagcctgcttttggattgccaataagggtttcatcggggtttcagccgatgagttatctggacgttgcatcggcttacaaggattacatacatattggatttaggcgattgcaacaaaaattttactgtttaatctaatcttgtggatttaatgacattagacctctagtcgatgtatgctttaaccatcggatcagtacttatcctgtcatattatgattagccgattggttatattattgttatatcatattatcatcagccgattgcctttatattggtatttacatcaagtgtcagaatatacattggacatatggccgatagctcaaaaccctcttgctatcggttggtatcggcatcggctggaattactccatcggcttgatagccgatcggcttattgatccgctgtttgtatatcttgtcagttgtaggatcaaactgattggcacgcccgcatctcaccaagatttggacctgcacaggagctaagcagatctcctaggctagtgtgtgtttttcgcgtcagcagggaccttctccatttccttgaccaagtcgtatagcgaggacaccagcgtggtctcgtcgccatgcgaagggatcttgaccttggcgcaaagctcctccacaaccttgtagaggctggtttagttcttgcggagggcctcccggatggac

SEQ ID NO: 86284 - DNA, 529 bp, Oryza sativa
taaataagacaatgaaaaattccgtaaattcccaaataccaatcagtagataaagtcagagaaggtgaaaaaaaatatgtattaaaggatccttacatgtccatcagcatccaacaagatgttctcaggcttcagatctctgtgcataattccattggcatggagatgggctacagcaaacaccatttcagcagtgtaaatgcgtgcaagctcctccctgacaaacaaaaggttgcttaattaaatgttcatgcaaagcgataggaataaacataaaataatgtaatgaaataacctaaccaaaccctgttggtaaagctgaaaaaaaagatggccccatttatgaagtccacacaaggtaaagtcggtattttgtctgccaagtaaatactgggtttaaaatttgggacaagactgaaaaatataacatgcatgatagcttgccaacaaagaacccccagagatgataaatgcttccctgaaaggagtacctcagctgtacaacaaaaggatgatcaactttagtcag

SEQ ID NO: 86285 - DNA, 636 bp, Oryza sativa
tcaaccatgaaccgaattatcaacaaattatagcaaaatgtcttaaattagtgtggcatcacatacacagattttaatgttagcaaatgccacagattataaaatgtaatcactgcctggagagacatataaaccatattggaagttggaagactaaaagttattgaagctatatatcacaccaacgtacagcagagtagagaaacaaagttttttttttctctcgaacacgcaggagagttgcatatcattatattaagataaaagagttaaaaaggactcatgcatgcccataacgggaacaaaggctataagaactttccaaagaaacaacaaaaaactacaccatgacttagcttcatctctaacatcctgcatgacggaattgaaattagctgaaacctctccaaagacacatccacctatgtttccaaatcaaccaagccaccaacacaactaatgagttaaaacccttgcgatgttgcttagccactttctgcaaagcttaaagccaccacatggtgaaaacagtgtcatcgggaccttatctaaggtgctgcaagccaaccaaggacaaaactgagaaccatacacttcttgtgaacacacataaagtgagcaagtgctgcacattct

SEQ ID NO: 86286 - DNA, 3417 bp, Oryza sativa
aactgagctacccgttcgtccaaggacgtagaacgtgtacccgcaccagcgatctcggccaacacctcccgagtaccagcctcaagaaggcgccaggcctccgccagcatttcctcctctgacaagggagcagcgggcggcgacaagatcggagatgtcacgaggacggtggacggagcgggcgttgcggcggtcgcaggcgacacgctggtcgcaatatggtcctcgctttgtgccgaggacgctggagagggcctgccaataaaaacacaaggagtcactgtcgaacacaatataaaatcggaattccgagaacgatagcttgagatttcacttattggtcctggccttcttcagcaacttgggagcaagggggagatcgctagtgccctaaataaaaaggtaaataagggctatgttctcgtcataaaacaagatatcttcggagtaaagagtactcaccttggggaatgagaactggtgcctgggggcagtgtcacccactttctcatagtgaccatgtgttgctgccactcggccccaatccgaccactgtcgttgtctcctgagagactttctccttcaaggaggcggcggcctggtgatcagcgagtggcccgatggcatccaccagggcagtgccagcacgagatgaagtcacttcgcttcccaaacctagagaagacaagttgacagaatcgaattaggcacttacgttgataatggcggacttctcggcgtccgcgaactcgtaaaaggtgttggacggctcaccgacaccggacgccggacttatcaacacttaccccacgcgttgggacaccgtcttgtcgctgagatctgcgaaaggagacaggaccatttcaagataatgaatactacgacatcaaaagaagaacatacacggtgacgcgagaacgagtaccccacgtcgagatctacgtcacgtcggcctcccccctgtagtcaaaggcagggtgagcgtgggcttggagcggttgaatccgccgggcaatgaagtcttgagcgatttcatacccagtcagaccccgttctcgcaggctgctgatggtgttgacaaattcttggagggagggagtcagaggaggcttggaggtccaatcctgagaacgctcaggcttgtcctctaggacaatcaaaacagggccgatatcttttatttcaagaaagaaccattttgacctccattagctccagggtgaagggcactagaaggggatgtaaaccgccttcatcccatctcagagacggaatctacagcatccttagattatgttggactccatccaccagagctcatagtagtatcggaagagatcaaggaatggcacgaccccaacataggcttagcaaagatgagcaaaaatgctcagaaaagcgatggagttggggttaaggtgcaaaagtgaaaggccgtagaagttcaagatcaggaggagaaattcagatggtggaggcaagaaaccacaccgaataaaattctctacaactaccatccgacctaagacgggttggggattagtacctccttcctcctgctccaggtgttcacggccggggagtgctccttccacctacaacttcttcatccctgcggtgtcggtgttggacgccccgagatccatcgccatcgtaggaccgccggagaggaagaagaaagctagggtttttcaggaagattggagaatccgagagtccgggcgcaaagagagttggaaaggctttttggcaaacggacttgaaatggatcaaaaactaccttatataagtgcactacttgacggtttatttttcgagggaaggagagatattgccaccgaaaatttctgaagcccgttactgacagattgattagacatcaaattaaattcacttatggacggttgaacttcctccaatgttatcgagaactcaagccaaaggactaacgaacccaccatagtttacgaagccgaaggactcaagccgaagccaccgggagatctcgtcgatcaatctcgacaaggatctcgccggtatcgtcggatttatctgttccctttgtactctgtggctttccatatcaatcccatataaactagactagtaatattaccttacgaggggcctgaaccagtaaaatccttgtctttttgtctgctttgatgtcatatgacgtagatcctcgtaccaacgtaccccaataccctatttatcctgtctacgagtatccctcatcgacaagtatatcacgggaatatcgggtaatggataactcatctttaattgtgctaaagaaaaaaaagtaaattacagattgtactatgtattcttaaaagttttcatattatgtcatcctttaaccattcttttcatttacaaaacaactaactttacatttcaatttggaccaccctattccatccatctccaagtctgatgactcagcaaccactctgcacaataactctctctctctctctctccattttcttttcccctttgatagttggggaaccgctagatccagcaagaaggagcccggatctagcgtcctcgctcttcttcatcgggtcgactcctacctccctaagtccctacaagcccgacaccaccgacatcaatggcgaccataacaatagtgtgcactacgagaggggaggagaaaaaaagggtggctcatggagaaagagcggtggtggcggtacgtggagtgacaattagtggttgctggtggtatgagaagtttgtagtcgacacaatcgctaaccgagtttgttattttttgatatgtgggtcaccggccattataaagaaatagatagttttgaagtaataaaaatattgagataaaggtgagagtactcgtctatgatacgtgggttcttatatgtctatgacatatggtccagggggaaattcttaattaccaatagtactccgagtatcatccccttcccttggcggcgtaaaagaaaatcccccgtctctttggcctcgtttgttagggctccaaactccaactcctagctctaaattcctactccagtgggagctaactcctcgggaaagagaaaattgcatatctaccatcgcataagatgggattcgctcaaataccattacttaaatgggcttcactgaaataccatcctcgaccaaggtgtctttgctcaaataccatcctgggcgaaaatgccccttagctcttcttcttcctccctccctccctccaatcgctaaattggtcgccggcggtccgtcgctcatgtcgtcattggccggcgagtcaaagcagggtggcggcgtgcgacggcggccgaccgagacgacacaagcgaggcggcgcgcgatggcggccgatgagtcggggcgtctcctccccccctctctctctctctctcttgtcgggatggc

SEQ ID NO: 86287 - DNA, 1152 bp, Oryza sativa
caggcgaaagcaagaagatttgaaactgttgtgcatgatatttaaccaagacattagaagattggccactcaggtatgtgtccagaccaaaataattgacagggacctgaaatatagtgaattccatgcattgacttgaattatgcattctatttaatttgactaggttatcagagtgaaatggtcactgcatgctagggaggagataatttttgagctgctgaagtatctaggaggcagcaccacaaaatcattacttgaagcgataaagaaagacgcaagacaaatgattgaagagcaggaggcagttcgtggccggctcttcaccatccaagatgtgatgcagagcaccctccgtgcttggtcacaggtatgagctataaaatgaccttctgaatccttgtgcattctaaatgaacatcaaatccttatatcctactactgaacagacaatatgacactatgaatctagttatttagttagtgatagctgaagtgtcatgtgtgaaaactaaaaactctgttggtgtgctactcaggagaagagccttcgcattacgcataacctgacaattttcggtgggtgtggcttggttctgtccatcatcgccggattgttcggaatcaatgttgatgggataccaggagctgagaacactccctacgctttcgcgctattctccgcgctgcttttcttggtaggactcctgctgatcatcgtggggatagtctatttcggactgcagaagccgatcagcgatgagcaggtccaggtgaggaagttagagctccaggaactggtctcgatgttccagcacgaagccgagacacacgccagggtgaaagaaggggtcttgaggactgacttgcctcccagagctgccgatctcatatgtgatgataatggtgattcacgtctccttgtttgtgactgttgaagttgaaatagccaataggtctagctgctttgggtcttcagttttttttccctgtttttagcttcatttccgttttgcatggtcgagcacgatctgggctctctcgccttcccggatcttgcgcagttaagccggactctcgtcgcgcgcttatgtaggagtccactacattttcagttgtaattcccttattagtagtccaatgaaataatca

SEQ ID NO: 86288 - DNA, 1457 bp, Oryza sativa
ttgttcactattgaccatatactctggttatggttttgcagagggcaggcagaaaaagagttcaaggttgaagttgagtctattggtcatgttaggcacaagaatctggtgcgacttctaggttactgcattgagggaagctacaggtaaatctgtgttttgttagttagcctttatattttcagttgatcgttcatggatctgcaggaaattgtatatttttcttgcagtgactgctacaatatgtcctcttgctgttacacagccttcaatgtcacaagtcaattacaacttaagaaagaaacaaaatgttcaagtctggcagctcgacatggtcatatttaatctattcagcaaaatatattaactgataatgataccaagtactggtataatggttagaataatctgtctttttagatggtttatgtacttaattatgcaaagcactatagaactcgaaaaatatgcaaagggcccacttcaaagcctagaagtgtctttaactgttatcctactctagtatctgcatatcgtgtttccatagatatgctttggttctaaattttctgattctgaaccatttgctgcaatcctgaaatcttaagttagcatccaggtaataagaaacctccacaacgtcagcttggtctgctgttaactttggtacgcaatatttatccatggacctgatatattgctagagttctagaaatggagaacatttaagaggatctacccgccttagtaaaaatgggtgttcggaatgtacactcaccccaccagctaactgaactagaagtttctgatattgatagattgtctgctttcttaatcaaacacaatcatatactgtataaatgtattactacagaggcatattcatagaactatagaagtccattaacctatatcaaactaagcttttccgtgaatctgttaggtttacagcaaaacatcattaggcttctcacgttgcaggatgcttgtctatgaatacatcaacaatgggaacttagaccagtggttacatggcgcaaggagtcaacatggtgttcttacatgggaagcccgcatgaaaattatccttgacattgcaaaagcgtaagaaatgaactatcagtgattctgatttctccctttgtatatgagaccaagcataaaatttgtaaacggaatgctgtgcagactggcatatttgcatgaggggatagagccaaaagttatccaccgtgatatcaaatcaagtaatatccttattgataaagatttcacaggaaaactttctgattttggattatctaagctcttacgtgctgggaaaagccacattactacccgagttatgggaacctttgggtaagctactaagctctcgttttaagttgtaattttcctgattgagttgcaggggctgtataaaatactgatcaacatgaaattcatgtttaactatc

SEQ ID NO: 86289 - DNA, 1923 bp, Oryza sativa
agacatattctcagtcgtgattacatgacactgaaggtctgtaccagtttacctgttgacatccctttactttttattgatcttagtcatcaagaagcattgattatgttggatattacttggctacatcatgcttcagttatccctagacaggataaccagattagcagggctacctttagatgatcatctacatatctgcactgcattgcatatactgcctcagatgtttcatacttcatttttcactattatggtctctatattcattgtaactgctatggtttacattctgggaagctggtgatttatactattttctgtagccatagaggtgttatttttctgcagctgttacttcgatgtttttgtgttcatataaattttttccttttgttccagctttgggatattaacatgaactctggtccagttgcaacattccaggttcatgagtatttaaggcccaaggtaattctgtacatgttaagatgaataatccatacttctttgaggatcatgaacaataaactatttcactggagtaactctgattcatgtattgcttcctgaaactgcagctatgtgatttatatgaaaatgattccatttttgataagtttgagtgctgtcaaagcggagatggattgcgagtagcaactggttcttacaggtgttgcttttgctcatctcagttatggtactgctcggtctccttcatgtgaactaattgttagttgatgtatgctctttcagcaacatttttcgtgtgtttggttgtggcactggtagcaatgaggcaacgacacttgaagcaactcgaaaccctactaggtaatccttctcctatatgaataatggaagctaactttatactgtacacatctgctgtttatttctgcctgtaaaactaactataatagtgttcatctgatgcgcctctaccagtcccatttgctccaatgaagtggagtatttcaaattcagctattggcactaaccatcttttccactcttatttgtctaatgtgtaaccaggaggcaacttcagaatcccacaaggcctgctagatctctaagcactctgacaagagttgttagacgaggttaccttcatgatgtgtagcatgtttaactttgtagaagctcgtcatttcaactactaattttgaatccttatgcaggtgctgaaagcaccggaatagaggccaatggaaattcctacgatctgagcacaaagttgctccatctcgcatggcacccatccgaaaatttaattgcttgtgccgctgcgaacagcttgtacatgtactatgcataaacaaggaggggataagaagagcgacagtatttttggtagctgctcccggtgagaagtgttttaacccctggtgcagcagagcagggagttgctggtagtggtgttttttttgggccggtcacatgctgttcttttgagtgccatatagagctgtccagagtccaagaggaagtgactcgatcattcccgggaagcagcttgattctgattattttttttcgaggggaaaggcctgtctttcccttataggttcatttagatttaaaagataagatttctagttcgacatttggaaggaacaagaactgttgggaatctgtggttagatgataaggggatgatcttccgttgtattcatgttgaaattatggtcttgtaacttcaggacagaggcactgaagcttttgataattttgtttttacaaaagtgatatttctttcctatgtgccgtagcttttctttcctaccgaatgcctgggtagcagtccgtcgttatgcgacgtaatgcaaaatggatgagcatcaaaaccagatgcagacatgtgccatcttttctgctctcccgacttgtctaagccctttatttgcttatgatttgtat

SEQ ID NO: 86290 - DNA, 2184 bp, Oryza sativa
cctccgactccgagccgaggagctccggtcctacgccgcggcactccagggctgcgccgccagccgcgcgctccgccgcgggaaggccctccacgcgcgcctgctccggtccgggccgcgcccggacgcgttcctgcacgactcgctgctcaacatgtactgcaagtgcggccgcctcgcggacgcacgcagcgtgttcgacgggatgccgcaccgggacgtcgtcgcctggacggccatggtctccgctatcaccgcggcgggagatgccggtgctgccctccggctgttcgccgagatgagcgaggaaggggtcgtccccaacgggttcgcgctcgccgcggcgctgaaggcctgcacggtgggctcggacctggggtttacgcctcaggtgcacgctcaggcggtgaagctggaaggtttgcttgatccatacgtctcttcttccttggtcgaggcttacgtgagctgtggcgaggtggatgttgctgagagagccttgttggactcgccggtgagaagcgatgtgtcatggaatgctctgctcaatgagtatgctcgggatggtgactacgccaaggtcatgcttgtttttgataagctggtggaatctggtgatgagataagcaagtatactttacctactgttctcaagtgctgcatggagctcggtcttgcgaaatctggtcaggctgtgcatggtttggtgatcaagagagggctggaaacagatagagtgttgaacaattgccttattgagatgtattcaaagtgtctgtcggctgaagatgcctatgaggtctttgccaggatagatgaaccagatgtggtgcattgcagtttgatgatctcttgtttcgatcggcatgacatggctccagaagcattcgatattttcatgcagatgtcagacatgggagtcaaacctaatcaatatacatttgtcggcttagccatcgttgcatcaagaactggtgatgtgaacctatgtcgcagcattcatgcacacattgtgaagagtggattttctaggacaaaaggagtgtgtgatgccattgtaggtatgtatgtgaaaactggtgctgttcaagatgcgattctcgcctttgatcttatgcaggggcctgacatagcttcttggaacacacttctctctggattttatagtggaaacaactgcgagcatggtttgaggattttcaaggagttgatttgtgaaggtgttttagcaaataaatatacttatgtaggaattttgaggtgttgcactagcttgatggacttgaggtttggttgtcaagttcatgcatgtgttcttaaaagtgggtttcaaggagattatgatgtttcaaaaatgcttcttgacatgtatgtgcaagctgggtgctttacaaatgcacgcttggtatttgaccgactgaaagaaagagatgtgttctcatggacagttgttatgtcaacatatgctaaaactgatgaaggtgagaaggcaatagaatgcttccgctcaatgttgcgagaaaacaaaaggcctaatgatgccacattagctacctcgctaagtgtttgttctgatttggcgtgcttgggcagtggcctccagctgcattcatataccatcaaatcaggatggaacagttcagttgtttccagtgctttagttgacatgtatgtgaagtgcgggaacttagcagatgctgagatgctatttgacgagtcagacacacatgacttagttgaatggaatacaatcatctgtggttatgctcaacatggtcatgggtataaggcattggaagccttccaagagatgatagatgaggggaatgtacctgatgagataacatttgtgggtgtcctctcagcttgtagccatgcaggattacttgatgagggaaggaggtacttcaaattgctgagtagtgtgtatggaattactcctacactggaacactatgcttgcatggttgatattctggccaaggctggaaaactagctgaggctgaatctcttattaatgagatgccattgaccccagatgcatccttatggaagaccattcttggagcatgtaggatgcatggaaacattgagattgctgagcgagcagcagaaaaattgtttgagtcacaaccagatgatatatcttcttgcatattgttgtctaacatttatgcggattt

SEQ ID NO: 86291 - DNA, 3979 bp, Oryza sativa
tcctgcaccccgatcgtggagtaaagaaggaaccagggtgcagctggattgaaatcaatgggaagttacatgttttcctgtcacaagatgggtgcgctaaatactaaaatttgagtggtgtatttcacccatcttggtcctgcaatctgaaatgtcaatgcagtcacaggccaaaaaccggttccaggtattatctagttctgatgaatcttttttaagagaattatcattgtacatgatgcgtgttcagtatccaatctacataactctgctaattggtgaactgttttatctgatttaaacaggctaatcttagggtaaactatactgctggaaacgtagatttgtctgaagacttatatagttgcccacttaactggcagtaactcagtaagtctcaatccatatagttcaatctcatgctatccttcactttcagcaaatctatctgttaaatcattgcatcctttttattacagcacatatcaggataaatgcagactgaggagagttccttagtcgaggcatatggaaatggtaaggcaatattgcctgccattgtgagtaaagaattggttacagattaatgtggcacacgaagagcctgtcctacttcagtggatactggattgctcatatcacatttatattcaaattgggatggttgtgcaggtgggtgatcaacttgttgaccaacttaagtaaggtctgttcgagttcctcgccattattccatggatgaacctcggccttgagaagctgtttgttgctgctgatgagattccagagggggtatttctcctttggcatgacatagtccccttcccctagcttaagggaggggcaataatctcctctgccatcaccaatgtagatgaaatgccttttaccattggccgtcgcctgaatcctctcaattatcttgccctgcacatgataaagctacactttagcgggggaccatgcatgctttccattattcatatccctcttcatctgaataaatgcactaagattttagcgcaaagaaactttaatacttataattgttgaacaatgcaatattcttatttgttatgtgtaagattcagattgcataatccatcacactctttgctttatccatgatctatctatactgtttcttttggacagatgatgctgtttcttttgtctccatcagccacgtgcatcggggcggacgcgctaaaggctgacatgaaaaatgtgaactgacctgtcaatctgctggtgtcctactgtccataccttgcacatgttctcggggcagaggctgcatccatggggcgagctgtcgtcggggtcgtggaacggcgagatcctcagcctgccgttgccgtcgacgcgcgccgggttcgtgctgatctccgagaagcatccgaggacgccgtggtgctccagcacggtctcgatgaagaaggcgttggcgtcgctcgccaccctcaaatcacacctgcaacaaacaacacaacaggtggaacacaaccaccaccaccaccaaagattatccatggcgccatcagagctttagaggtggatggattgatcattgatggtgcggtaccctaatgccgaggccgtggtgatggcggagaggacgtgggcgtcgaggggggcgctcttgaggcagtcgcggatgtcgtcggccgacctcccctgggcgtgcagctccaccatcatcctgtcctggaagaagccacccatcctcgcaggttcaatctatgcatgttcttgtgttctgtgtgtgtgtgcgcgcgcagggtgatcgtaccatgagggggttccagcgcatggtggggcggaggcggcgaaaggcgtcggaggcgccgagcttggtgatgacccagtcgtcgctgtcccactcgatgatggtcctgtcgaagtcgaacaccaccaccaccccgcctccggcggcggcggcggcggccgtgtcgccgtcaacgccagcggccatctgagctgctccgacggtgaccgggggaaggccggaagggtcaagatggagtcgcggtcgccagacgaacgcacggcggcgcctgactgacgccaacgtttgcaagcaaatttcctttgtgacttctttggtggcgtggcgtccgtgtcggctttatataggcaaggccgcaaggcaccccgcaccccggtggtggttgttgggccggtggcgacttgttagggttctactctacgcgtccaccacaccaccgcaatccgcaatatgacctgtcctgtgccgtgttctccgtttgcccgcgctgccgtctccaggctgacttgcctgcctccctcctccttacacatgtttgctctctgattctgtatcccatggtaccattaattagtagatcgatcgtggtcatcgatttttagtacatctgtttagcgatcatctcttttatatttaatctatataaaagcctacctggaaccgacaggtattgtccgtctatagtaactacacgtcaaccactgctactactgaggattggaactgggaagtgggaatagcctccatggacctattaaattgagcatcaatattctttggaagctctgagtttctcgttgttgctagtgctgtagacattatttttatggtttgaccgataagatgcaaaggtctacctctccgttccaaaaaaaaatcaaactctaggtttaaatcaaaagccagtaaaaataacattcatagacatagtatagacataacaagcaaagaggcaaaaaaaaaaaaaaaaactaaacttaaacttcatgtcacgattacatgatagtagatgtcatgcataaatttgtggtaaacacaatatctaacggaactgttttttttcccttcgaggagacatcccctcgttttgtgcatgtcgttcaaaaaattataaaagttttctaaaaaaaaattatcaggatagatcaatatatgatatatcttctcgcaaacatgcgggttaaaattcgatttatacaattcaaaacaaaaataacaaattttaccgtgatttacacgttctattcatagtcaaatttgttatttttgtttctacttgtataagttgaatttgcatgtttgtgaagtggcatatcacatattgatctaccctactatttttaaaaaaaattttggatgactttttaagtgacatgcagaaatgatgagatatcctcttaagggatgaattgagttttccatatctaacacatacaagcttcttactagcaggggctaagcatctcgaactcgcatagacctcagcagtttatgttactaagagcaagtttaatagtatagccaactactggctccaaatcgtctatagtcaatttagtagtcaattcatacaatagttacctataaatatatactatacactattaatatctggtcccacctatcatacacacattatgtcttgaagcccgtactgcagctgaccacaaatctgtagcccgctgctcatctctcttctttcatctcctccatatgtgtttatagctggcttatagcctgctattgtacttgctctaatgcttcggcacgcttatctccagtccctgcatcacgcggttgatcatgtcgaggccagcctcgagttgcatgaccacgcgcttctccgcgagcagttccggcgtgaaaagccctttccacacttcataccaagccatcgcctcatctagccgaggcctctcgcccattaggtaccgatagttggcgtacatccatttcttgaagaacccttgtatcaaaagtggcaccatgtactttactggcacgatggatgcccacctcataacaagagggaagaagttgttgttttgtagccaagtcattcttaccgagatctcgagatcatggagagccttcctcatgtgaggcagcacatgccgcttgatgtgttcgtcccagctcattggatcgaacacctttttccatggcaacgcaagcctgtagtcgtagtca

SEQ ID NO: 86292 - DNA, 691 bp, Oryza sativa
cgttctctctgtagcgtgtccatggcacggacctcctcggcgtcgacgatggcctctggctctgcttcgccggtgccccgctcgagctcgggctctgtaggcggccccatgtcataattcgagtcgctgtcgtacggtgactcgaattttccaatgcctcctttcccatactttatggtcggcttgatgggatcgataatcccgtggccgtacttgccgaggccggcgccttcctcgtagttcatttgagccatcaacctcgccactatctggttggtcgccaggctcccgggctgcggcggcaacgggggatagtaggaagtgcagtaagcgggtggggaaaacaacgatagacgatggtgatccgtgtcgccggagctcgcccgcacaaagtggatggtgggcacgcatttgcttgcaaccgccgtagtttcctgcacgccactagtctcggtgttggaggaggatgcatgaggagtgccaagatccggcgtttcgcttgtagtactctcgccatggggaagaccaccaccttggtttctcccctcgtcgtcgacggaggccatggaaacaaccgtgttactccccttgtcgcctgttggaccgcctccctgccgccggtgtgaccgcccgccagttagaccgctgactcgcctccggtcaaaccgtcgggatcgaaaaaaacacgtat

SEQ ID NO: 86293 - DNA, 1961 bp, Oryza sativa
cgccgaccacctcgccgaccccgtcaacaacaacgcctgggcctacgccaccaacttcgtccccggcaagtgagcgccgccgccgccgtgctgccatggcgacgcatcgccttcagctaagctagctaggttgacgacgatgcgcgtctctgcaggagagtgtgcgtgtgtgtacgcggtgcagtagatgtacgtacgtgtaccgtatagatgtacgtattcgtgtggaccgcgtggatggatgtacgagtattggagagagggtgagatctgtaccggtagtgtgtatttctgtgcaggttctgaacctgatcaatgaaatatggtgttgtgaattaattataaaattagcttgtttaatcctgcgtgctacttaatgatataataattcttctgataattagtaagagtaatgaagagattgcaagaaaattactcccagaacagtatacgaactgaatcaagtataaaatgatcaaaattaacctgaacatgctttaactgttagtattttgaacgaaaattaattgatagtatgcacacgctacaattttatattcccaaaatgtaagttataagttgacaggttggggtagttaggtgaagtctgaaccttaccactcaaatttaaaagcactggatgcatcatatatgatgatttttacttgaagcaacactgcccatgctaagatttgcttcctaccgaggttacaataatttaggtggatagtgattacactgcattgacaaggaaatttgggtataatttcatctagaactttctattacaactgctaagctagcagtgacagatacgtatagttgaaaaacactttgtgaactttctcagaatatggccaattctgagaaacttagcactgtctggtttcacccaacttgtagtggttggaaagttacagttacatcgacctcaatacccatgtgaattgggaggaaaattacaagttacatcaacctctctgggctcttgtcatgtgaatgtcacatgatcatgagagggatcgttcaaggaagtagtgaagtactacaacaaagttctagctattatcttatatacaaagtctgatgaaaacaccacagcgacgtactccctccatactcgtaaaggaagtcgttatacggtctccaaaacacaactttgacttcttgtttatataaaaatatttattaaaaaatgatatatgtatacttttatgaaagtatttttcaagacaaatctatatatataatttttacaatttcaaactcaacaacttgaaagatattcaagatttatatttttaaggtttgacttaaatattgttgtaaacgacttctttgtgagtatggagggattatgtgataatttggaaagatcaccttgttacgttacctgcctctgaaaagggctctgaaatgtaccattccgtccagtttcttcttcagaactgggcatgctgcgacgaacctgctgcattcgctcctatcttgggctgcatgaatcaaagaaatcagcagtgttaccttgcatggtgagagaacagtttgatggatggatgtgctctgctgacctcattgttttgctcctacagggtgtgcaaagggaaaccaagtggtaaccttgaagggttggctcatcttttagcttcagatgagaagaaacctcccagtttgcacactgaacaaatcaaatgagaaaaacatgaaggacataagttgcagattttttgtggtatgattttaaaagttctaggtttgggccatacttctatttattgttatttttttacaacaagatcaggagatgcgtgcttccatacaatgagtaatccttttgttttcaaagaaaaatcttggctatccttattttatttttattttttaatgtgaacagtaggaaatatacatataggttaaaattaagcttgttacaaataagttaaaaatgtacaaggttcttg

SEQ ID NO: 86294 - DNA, 2818 bp, Oryza sativa
tggactgcagcaaggagcagcacttgctccggcacaagttggccggggtaacgaagccatgggcgccgccgccgccgcgcacgaactcgaaggcgcagacgaggccgtcggtccacaggccgtcggacgacgaccacggcgaggacgcagaggcatccttggcgccgaagccgtgactgagctggtggtggtggtggtgctgcttcctagcgtcgccgccgccgccgccatggcggacgccgtgccagagaggctcgccgttcaccatctctctctagtgaagccgcagcctctggggcggacgacggcggcgacgagatgtttttatttatggggtcgtcgcgtgacggcagcgtctgggggtgggccccccacgttggcgcttttgcgcgtcgtgggccatacgtgtcagtgagagcgagtgagtacgggggttggggcccacgagacacgtggcgttgccacgctgctgctgttgcagcttgttcggtggcgctagaatgcgtggttggtctcgtgccccgtgcccgcgcggtggatttcgaccgttctttttcaaataaatctgtccaatttctccactaccggatttgttccaagattggtgcaggcataatgcgtaaaatatcaggtcttcacgcgtggggtatgaatggatcccgcctcttttagggcagcagcagggcgtcgcacaaaagcaaaaaaacaagtttatccacgtaggagaaaaactcgaaaaaaggagtcaagctcctcactcctcagtgcacgtgcacgcgtaggcgtgacttcaggagcgtaattttttaaggccggtcccgccacgacttttctccattttcaattcccaggcccgtctctctcttcatcttccttactcggctccttcccatctctctctctccctcttcaagcggctgagatttgcaagcgacgccagcgacgagcggtggcctctcccctccggtgccggtggcggcctctcccctctcctctccggtaccagcacggcctcccaacagctcagcgggacggatctagcggcgctggcgacgagcggctgcctctcccctctggcgccgacaacggcctctcccctcatgtgccagcgcggcctccagggagctcagcggggcggatctggcggtgccgacgacgagcgaccgcctctcctctctcccctctaggctccggtgccgcctctcccctctggcggcggcgcgggcatcgacgcttctcccctccctctcccttcttcacctcttctcttgtgggcccaaaagttgtgaaatgacgaagagccgaggctccgaactatgcctaggtggagaggaatctttgagctagctagatgagggagaatgacacctaggtacactgtgaatgactttacaagtgcgcctcatttatcactaagttagaattgtttttatgtttgaaacccaattatatacaatttattaagcgtagttacaatataactggggtgtaaccagaacctacttagttatttagaaatctgttgacaatgataaaggtagactcgggagggcgcggatagccgcgcattagatttgcattgttcgggggttaagacccagcttgtgatttgtgaatcagcgacaacgagcatgacgaaatattgactgctacagagatgcaacaattgagtatgctttcttttttttaaagaaaaaaagcaagtgagcgtgagtaaaaacaacaaaagaaaacgctccatccgtcccaattaaaacccaataataaaacaaatgaagtactatatcactaacttttgtaagataaaattataaataagtaaatgaatagcaaggtgagcataactcagctgattaagttactcgtggcgaaactagcccatccgtattcatatcttgaacttaacacacgtgctcgtatttacgttgcaggaaggctccatggtaactccatcgattttaagatatatggtcccaatcttccggaggtatttatagggttagggtacgtatttgtgccttcataagatgagtgtgctaggtttacatgggtaggccgtatgccgagtgtagcttcatacgggtaagtgagcgcgtattgtgagcacctatgtttgtactttgttttaaaaagtaattaaataaataaacttccgaaggtgtttatactttataagggtagggtgtactgtgtgtgcgccttcataaggataagtgtatgcgtattgtgagcatctatgtttgtattttgttttaaaatataattaaataaataatctgacaggcgaaaaagttgtaaatgattgaactcatacaagtagaatgtaagtggctaacccgtgaacctgtatacccatttataagtcaaaataagcagctttgtattttttttttgcaaataaatggatttcacagttagccatttacaccttaccgatcaaacgtttctgagagacctgatcgacaggtgaggatcttctatcataatatcattactattagtcactggtatccttttattgtctcacacgtactatggtgaggatgtgaacctcctgatcaactaggtgttgtcccgtggcaaacagacagtagttagcctagcaaaaaagtagacagttagtcacgcataaacgggctttttacagaaatatcacatgcaaattgaaagaggccattcaccaacttgtactgttacttgttcgtcgatcatcatacgtaaattcctttgtttacggtcggtccttttcctcacctgaaaacactatttttggccgctacgaaaaccgatgatgatatgcctcatcagccatcaggta

SEQ ID NO: 86295 - DNA, 1856 bp, Oryza sativa
cggcgtcatctattaaaaaacggaggtagtactttttaaatttaaatcacatcaacttatttaaacttatgtttatgtttatgtaagcttatgttgttaaagctattttacacatttatttttacttattgttatcataataaactctcgcaacaacgcgcatggtttaacctagtaaaataaatggtggggtacacttatataagaccgcgactatcctcaagggtaatgaatgtaaaaaatagcgtgtcgtaataaaatcaattttttattttggattttttaatggaaaaataaaattctgattttctaggtctaatgaataaatgatagagcctggttccaattctggcaaaacaaaaggcaacaagcttaacttcttaattggaagaactctatgatctaattagacgttaaaatagattagtatccgatgtagggaaaaggctgcattttctatgagtagacctttgatttttttttagaaatcctaattattcttaaagtgtggggaacacttttaagaatatttataaaatcgggaaatatttttaaaagtgtggggtacaattttatgtatatttctaaaatcaggataaataaacagtcatcatgaaattatcgttgcctgaagaggcatcacttttttaatttaatagagggaaacacctatttcgagacatgtcatatctataggagagctactttttttttttaaaaaaaaaactcatgcattttattaattatagataactaggtacatatcacatgagttatccctagcgggaaatcaattgcaagtaaaagcagttttgcataaaatgtcccttgaagatggccaaattaacataagctcctgaaaattcgcaggaaggactcctaagaaactagaaaaagcaataagtccttctcttctctgtcaggtagcaagctagatccatggctgcaacgctgatgaagaaaccaagagtgactgcagatgaagatactaagtatagttggccacatcgcctgagtcccgacgacctggcccaaggcatgagaatttggcccgacctaggcaccgcccgacccgctagggtcaagcccatgccgacccggtatggcacaatgaaaaaaaaacagttgagggatccaacatagacatactttcagcccatttgaggcaaggcccaaagataagagggatacaaaatagacttaattcaaccatataagacaacccaaagagatgagggagggaaaatatacttattttatagagaagcataatgggttgtcgtgccttcgagccaacccggcatgacccaagtcttattgggccatgcctgggccatgggtgcagcccgtggacaggcaagggccggctcggcgtgtaggtcgggccatgccggctcgactaacctcggcccaagcccggccgttcctaggccgtgccgggtcgggcgaaccatttggccatctatagatacaaggaagcatatccaaaagggacctccgcttggaggttgaggcttacatgacaaaaccatgaaaacttggcttctctctgatgatgcaccatcggtgacgaagaaggcttgcatatttgtggttgcctcgccggagatgaaccaaatggcgatgtaaacttgtcttacttccaattgaagtcgtccctggcaaacccagaaaccactccatggatggatttggttgggaaccatagatgatcaccgggacaagagaaacatgacgctgacaaactcttgcactacacaaaagtaccaaaagaaaagagaaaacaaagaggaaaacactactacgggaagaacccgactacctggactcccctgccccatcactggcgactggag

SEQ ID NO: 86296 - DNA, 943 bp, Oryza sativa
tcctgcaccccaacggcgtcatacattaaaatatggagggagtagatctgtgtaatataatccaagtttttctcagaacaacattatccaggttcagcgtactctaatcgttgccataatgaactgagagcgcatcgccaagtaagaacagttgtgaagaggaaaaaaatgtcattgggcccatgaccagtttaggatgtttaaagggggaattactagatatattaatactacgactattaaaaccggtacataataactcccttaactgttttcaaggcgattttcactcatgcttgttgaactggagagaacagggtgacaagggggaggagctcggcaacgactacgttatggagacgatgaggagttgaagtggagagaacagggtgacaagggggaggagctcggcaacgactatggcaagggagaccggtgcgagggaataacgccgacgatgcctatgagggagtgacatgaggagtcgaagtggagagaacaggggtgcccgaaccgaggtggagaagggggtggcggcgtagcggactccacgacttacttcctgctctagctactgcttcaagtagtgtcttcgcacgcaacataagtcttttctgcacattttatcctcactcgtgtgcactggaaagaatttcccggtcggtcacccatcccgcaattgcttcaggccaagcatgcttaaccttagagttctttggagatcggcttctgaaaaagaagttgcaattaagctgtcacatcctcacccccttaagagatcgacgtcgtcagtcaaccccaagctaggaatgtctcctcttggccacgtccatatgtccagtgccagcgcatgtaccatgcagtgtgatcactccgagtccacaccagccatgcgcactatgcctgtgcaactgcaacacacgcgcccgtgaaaccgcgagag

SEQ ID NO: 86297 - DNA, 2491 bp, Oryza sativa
cctgcgccccgaacctggggccaccattgccaccgtcgatggaggagcgtgtgctcacgtctctcgccggagcttcaaggctatgaagcgagagcttctggccatggcccctactcatgaggcgatgcgtcgggcgcggtggtcggaggttgctctcactttcgaccagaccgaccacccaccgtgcattgcccggggagggcaggttgcgatggtggtttcccccaccatctgcaacgtgaagttgggacgtgtcctcgtagatggaggagcggccctcaacatcctttcccccgcggctttcgatgccatcaaggccccggggatggtgctccgaccgtcccagccgattatcggtgtgacgccggggcacacgtggccattaggtcacatcgacctaccggtcaccttcggtggacccgccaacttccgcacggagcgggtgagcttcgatgtggcggacctcagtctgccctacaacgcggtcctagggaggcccgcgttggtgaagttcatggcggcggtccactacgcctacctccagatgaagatgccgggcccgggtggccccatctctgtccatggcgatcttaaagtcgcgctcgcttgcatggagcagcgcgcggaccgcctcgctgctgcgtccaagcccgagggtggtgacgagaggcttggcccttctgcccccaccgccccgaggcagcggatcgtcacatgcgacgaggtcccggtcaaggaggttgccttgggcgacggcccatccaagaccacgcggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctagatgcatactctggttaccatcagattcgcatggctagggaggatgaggaaaaaactgcgttcattacccccgtaggaacctattgtcatacatcaatgccttttgggttaaagaatgcaggtcctacttttcaacgtactactcgaatttctttgggtagccaaataggacgtaatgttgaggcttatgtcgatgacttggttgtaaaaacgcgcaaccaagagaccttactctcagatctagcggaaacttttgaaaatctccgctccgcccgcataaaactgaaccccgataagtgcgtgtttggtgtgcctgcgggcaagcttctcgggttcttggtctctgcccgaggcattgaggccaaccccgagaagatacgagctatagagcggatgcgcccccccagcaaacttagggatgtgcagtgcgtcactggttgcatggccgccctaagtcgttttatatcgaggttgggagagaaggcgctacccttatttaagctcctcaagcgctcggggccgtttacttggacggaggaagctgaaaatgccctcgcccagctgaaggcgtatctcagctctcctccagttctagtcgccccggagccaaatgagcccctgctactttacttagcggcgaccccccaagtagttagtgcagcgttggttgtggagcgcgatgaggacaatcctcattctgcgtacccccactctgtgccgacttggcccgggagcaggcagggaggagaggcccccgagtcgaacggtggcctaaggcccccgacgaccggagtcggccctctgcccgcttgtcagacggtgctgagtgcccccgaccctcaggaaggccccgaggccactgcgggaaggccgcacctaccaccctttgaccccgaggctaaccctgtgctgattcgacccgggagagagcagggagaagaggcccccgagccgaacggaggcctgaagcccctgacgatcggagctggccctttgcccgcgtgtctgacgacgccaggagcccccgacccccaggacggccccgaggccactgtgggaaggccgcacctgtcatcttcggaccccgaggtcatcagcgcaggagacgagtgtgccccgagaggccacttggacgaagaacgccccggggatacggcccctagcagagaggatcggccccaccgaagggtgcagcggcctgtctactttgttagtgaggccctccgggacgccaagacccgataccctcaggcccagaagatgctttacgctattctgatggcctcgaggaaa

SEQ ID NO: 86298 - DNA, 1210 bp, Oryza sativa
cctctccgaacggagacgttctcagatatttggtccgtctcgactttcgagcgactaacaatatggcagagtacgagggactccttgccggactcagagtggcagtcggactggggatccgccgcctcttggtattaggcgactcccagctagtcgttaaccaggtttgtaaggagtaccggtgctctgacccacagatggacgcctacgtacgccaagtgcggcgtatggagcgccatttcgatggaatagagcttcggcatgtgcccagacgggataacatgatagccgacgaactctcacggctcgcgtcctcgcgagcccagaccccaccgggtgcctttgaagaaaggcttacccagccgtcggcgcgacccgatcccttaggggagacggatgcgcctgaccggcccccgaggcccgtcggagtccaggcctcgggacccgaagggagcgctccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgctgacatccatgagggcgagtgcggagcccattccgcctcgcgtaccctggttggcaaggcctttcgtcaaggattttattggccgacagctctcaatgacgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgaatatctgtatgttacgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagac

SEQ ID NO: 86299 - DNA, 2977 bp, Oryza sativa
ccgcgcgctaccagcagagcttgcggcgctaccatcagcgccacgtccgggcccgatcactctgcgtcgacgacctcgtcctacgccgcgtccaaacgcgtgctggattgagcaaactctcaccaatgtgggagggtccgtatcgagtgatcggcgtcccccggccgggctccgtacggctggccacgggcgacggcactgagctgccaaacccgtggaacatcgaacaccttcgtcgcttctacccctgaggggggggtcgagtgtcaggtttcgggctcgggctaaccccgcacccccctcgggtgtgccgggttagccgggggctaccacacatgcacagttttacttttcttatttcagcatttcaataaaggaagtttcaatttcctaaaggttgtgtctgtgccgtttttccttctgaagaatcttaacttgaaataaggtcactcgtgctcaaccttgccctcgggggctcggttcggtcagctaaaatcgccaaacggggcccagaaccgagccgtgccccggggcgtggtgaactccgggggggaatcggcaaaaacccacaatcgggtcacccatacccctcggtcaccacgttcccggcctggccagtctcgacatgtggatctccccaggcactagccccgacccgagccattcgaggactgggacttgggcacgagcccttatttcaagctaaggcgcaaaaggaccatggcacagatcatcctcatcgtgtatatatagcaaaataaagttaacatagaaattttttatcattttttgattgcagattaagttaatttgtacacaaaagaggcgtgaaggccttagaagaaaggaaaagaaaaagttggagattggcgggggctcgggggctcattccaacgcgcccgggtcgccggccttgtcgccaccgtcgtcctcaccgctggcgtcgccctcctcgtcggagctgggggcgaaagcaagccgaggggccgacccctcgaagccgttgacgatgtggtcggcagcatccccgacccgcgcgcgcgcgtcgtcctcggtcccgggagggaactcctccagcgccatccatggagagaagttggggtcccgggcctggtaactcgccagcacgagttcgaccgctccccgcgcgaggtcccttgaggatgacttaatggtcttctcaagctcctcggggagttgttcgagaacccaggccatcctgtggaggtgcggagcgaggccttccagattggtggggggcaccgtcgtctggcctttccagaggcccgcttgccgaccggcgcgcttcaggcgggagaccgcatcccaaagcatgtcgggcccaatctcgcccgccaagcgaagggcctcggcctccccggtgaaggagtccagcgctcgctgcatatcggcgacggtgtgttcggcagctgcgaggcgggcggctaagtcgctttcgcccgcggccgccccaccgatatgcgccctcgcgtccagctccttttcccgcgccttgaggtcagcagcccgctgctccagtgcggctctctcggtgcggacgcattcaagattgaggcgcgcctgctcctcctgcgccgcctcgcgaagggacaggctgtccgccagccgtctggtcgtggcctcggcctccttgagagctcgccgcgcgttcagcgagtgcatcctcgcggaggcggagcgcggactcctcctcggcgcaggcggcctcatgcgccgccagcgtcgcctctcggagaccagcggcggcctcacggtccgtcaagcccctctccacggcgccggcgtgttcttccagcgccatggcacgggcctcaagggcctcctcgcgccgccgagacgccgcttcagtctccgttacccgccgctctcggacagcggcggagtcaaggaccccttgggcggcgtcgagcttttccttcagctccgcctcccagcttgcgtgctgaaggcggagggtgtcttgcgcctcgatcatcgcggtggtagcaatgagggcggccgctcgctcctcctccacctcacgagcgatctccgtcagcgccgccttccgggcttcaagctccgagacgtgacggcggtgagctttgcggcccacctccaccatggcgtccaccgagcgccgcccctcctcaacgcgtgcccatgcggcctcgagctccgctcgttccgcgcgcagggcctccacttgggcgctgaacccatctagcaccgcggtgtttgcggcggccaaggcctgcagaatgggctcggcgctcagcggggcgacggaagatgaggagaagagccgccttggagagaaggcgatgcggctcggccccccggaggatgcgctgggctcggggatgtcccccgggcccgtttggtcctgggcgtcgcccggtgaggtaggcccaggcgatgcgcccgcggcctcgtcgcgagccgcctcggaggatgtcgcctgagggccgcccgagggagtgggcccaagtgacgcgccagcagcagctgtcgcctcagcctggcgaacccgggcggcctcctcccgggcagcttcttcggcttggcgagcccgggcggcctcctcccgagcagcttcctccgcttggcgaacccgggcggcctcccgagcggcctcttcagcttcccgaaggcgatctgcggcttcacgccggtcagattctcgcctccgctcctctgcggccgctggatcttcggcctcggaccggccggacttggggtggcgggaggaatgcgacgggacattgctgaagcagaagaaaaaaccagaagacgaacaaaatgagtaagaaaaaacttacttttgggagaaagatggttgcaaggagagtgagacgaacctgcgagggggtcggttgaatgaccactttggaggggaaatcagatttccccggcatggttccgtctcccccgtcttgcggagccgtttctttttgcgctccccctcgggctgcga

SEQ ID NO: 86300 - DNA, 669 bp, Oryza sativa
acaccatctaggcacaagctaggtagagctagaaggatggctatgagggccatatatggagatgaaatatctcagtacaaccaattatgggactatggacaagaattgacaacctctaacccagggagctcattctacctgaacctacattctggttgcttccatactttgcatatgtcattcgatgcttgcaagagagggtttatgtctgggtgtagacctatcatttgcattgatggatgccatattaaaacaaaatttggcggccatatcctaactgctgttggtatggacccaaatgactgcatttttcccattgcaattgcggtagttgaagttgagaagctggagttggtttcttgacactctaaaagaagaccttggcattgacaatatatctggacagtgatgactgataggcagaaggtatgacttcgtctgaattttcataatatacataactcacatttcagttcctaactataattatttctaattcgtttccaggggcttgttccaactgtgagaagggagtttgctgatgctgaataaagattctgtgtgaggcatctatatcaaaatttccaagtgttacataaaggggagacactaaagaaccaactttgggctattgcaagatctagtaccgtgcccgagtggaatgccaat

SEQ ID NO: 86301 - DNA, 7123 bp, Oryza sativa
tgaggatttaaagattcggagatgttctgtgatatgtgatgatttggatttgggaggggatggtgtgaaatcaatattcaatgttaaaaacaatgaaaaagagaaaaaaaaagaaataatatctttagtcccggttgactaaagatgctcccatctttagtcccggttggtaacaccaaccgggaacctggactaaagatcgatctttagtcccggattcgtacttctggttggaaaaccgggaccataggggggttacgaaccgggattaaaaagcacttctccgccagtgatagctcatgttttcactttgggctagagtttctttccttctcagatcaccacccgactgggcactgcctgcacatcctaccatcgccggcaccgtgaaccctctgctgctgctgccgccggctgctgcaaggtgtgaagagcaacagcaccgctgaaggaagatgaagcaaggagcaaagctgcaggaggcagcaatcggtatagtataggcataggcatatggagcttgaaaggttttttaacatatcgaggcctcacctgctcaccatgggcttcttccttcctcattgtgttgccattgcatccagactacgggatgagaacacacggcctagatatagccgcgttggtgaggtgctaggagcggacaagatagagatcgaaagattggggaggtctaaactgaaacaaaagttattttccctagcccaaagtgaaaatgttggttgcatcatagtccaaagtaaaactttagtaataatacctagcccaagatgcgattcactcttaatatccatataaatttagacacattgtaactggacccactaggaaagaaagggtttttctaggcgacccaaaatctattttcgcgtgcggaaggccggctcgtctgcttaaatggtctatggaaatccgatttttatgtacgagtagcgcacccgcatgcgaaaatccgatttttgtgtgcggattcttatgtcgttcacacatacaaataaaaaaccgaaaaaataaaaaaaaactcaaaaaatcaaaaccctaaggatcccggcgatggatcgggacgtcacggagccggcggctccgctccaggccgattcctcctcctcatcgtcaacgtcggtgccaggtggggacggggattgtcacgcctagaaattctcgaaacagaatttctaagctgaatgtgcattaaatccctgtccaggaccagccagggtacacaaacgacaattgttgacatacagacccacgtcttacaaaaatataaaagattacaaatgcagcggaaaaggttaaagcgagctaaaccgggaagcttgacttcagcaacgggcgactccactccacaggcaaaccttgacggcagcggcgaaaccaacctctctgagacggctccaactgagaagaacttcaactctggtgtgggggaaaagagagcaagactgagtactacccactgtactcagcaagtcataccggaagaggaggtatgatacaggatataaccaaaggaagctaggggttcttttgcataaagcaggcatttcaaagcagtagttgaaagcagtaaaacagctgtagtaattaatcaatattaaccaatcactgtccaacgctacaccacgttgcaacagacccaaccatctacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaatggggaaatcgtgacaagaccctccacataaccctcccctaaccattcacaccacgctaaggtttcacccccacccctcaaaaggtagtgggcggtcccctcttgcgccgcggtgaatccggcagctggacaaccgaacacctcggccgacccaactccatcacgcccaccctcgccaccggtgcctaggaaagggtcgagctatacttcagatcaagcagttacccactcccgcttgtggaaagcacggtaagtctcccagggtttcccgtgaaccggtccttaactgccatgggtgcgaccagcaaaaccatgcacccacagcccaccattcagtgtattttaattaactaacaccattgcggtggcaccaatctaaagctatgccaatagacaaagtctatgtaataatgtagtccccatttgtgtactagttgaactaagcatggctaagcatttcctaaaccaacatctaatcattttgatacccaagttatcaatggcatagggtaaccaatatgtggctgaggaataggacccatcccacattacattgtaaaagaatgcaacatttaatagaaatgcgggatattggtaaattgggtacaatatgatcaaacgtattgcatgacttgccttgctctcgaactgatgagacctcagcaacgtcttcgagaaactgcggatcgacgaaacggccgaaacctacgcgacaaacaaagcacacaagcaaaacatgctataagactactgaaacaggaaacaaaaccatttttaatggattctttgcatttttcttgatttactgagacttgaatggacttaaacggagctcggatgaattacttatgaattttagaagataaactgtgtttttactaataaagaaaaagtccttaattaattattgcgcaataatacccagggctgacgtcatccaaggggggggcggcgccgacaggtggggcccatgagtcagcggctccaaagggagggaggtggcgcctggcaggtgggccccaccaggcggtggctcaaaggggaggcgagggaggcgccggccgggctcggctcgacctcaaggccgaccggccgaccaaggcgaggcagcggcgaagcacggccaccgacggcggtgaccggcggtgcgggaagcggcggcgacggccgaaaggcggcggcgcatggccggagcagcgacgtggccagcgctcgcgggaagttaaggaaaggagggggggagggaggactcaccggcgacacggcggccggagcggaagacgaaggcggcgacgacgacccgacgagaggaggggcggacgagtggtggcgacacctagaggaggggaggagaggagttagggatggagaaagcgaccgcgacgaccaaaatggctggccggagacggaggggaatggatagctcaccggctcgcgagggagatagggttccggtggggttccggcgacgcgaggcggtggccgagatggcccacacggcggcggagctagcggcggcggcggcttggcgcggcggcggccctagtggcgacggcacgcggccggagatgggcggcggcggcggcgctagcggcgagcggcccgcgaccggtaggaggcacgggagagcgcggcgaaaaggggaaaagggagagggagatgcggggaagctttataggggctcgaaaggggcggacatggccgggaaaccccccaatttggccggcgacgtgggggaaaagagagagaaagtggggggggattcaaatcgaatcccgcccatttgcgggcgcgcgtgcgggccgggagatgcgggggagagagcggcgacgtgggcgcgaggtgcgggcgcggagtggaggcgcgcacgtggagaaggcggcggcgcgggcggtttcggcggcggttgccgtcgtggggcgggcggctggaggaaggggacgacctgacaggtgggccccacctgtcagcgtcccggagagaggggaaggggaacgggccggcccaaaggaaggaggccgagcgcgggagggagtgggccgacggcccaatagagaaaaaaaaaggaaaagaaaaagaaaaggaagaaaggatttttcctgggattaaaaattgcactttggtgatttttaattggttaaaattatttccaaggctctgaaaattccactaaaaatcttgttaatgcattggagcatggggaactcaagaaaaaattccaccacgctatttccgattattaagtgcatttattaactagggatttagctctaggttaattaagataatttcttcgggcaatttatttaaccaatttttaaagcaagaaaagggggaaacttcagggtgtgacagggatggcgccgctcccgagatgcacgccgccagctcctggccaccgctcgccgctcacaatcgaccactgccaaagtcacgtcgagccgatgcccacccgctgcctgccactatccggagtcatgccgcctcccgctgcccaccgaagttgcgccgagccgacgcccgcccactcctggccactgcctcgtcggcggtggagccgagccagccgcctgccgtgcactgcacgctgcccactaggaggggagaagaggaagaaagggaggagacagagagagaacagaggagtgaaaataaaagggaaaggaagagagagaggaggtgataaaaattgaagtgggtgagagggaaaaaggagaggtggggagaaaaagaatatgtgaaggagagtgaatatttttgcgtgcgggccacttaataggcctgcttgtgaaaatatgctcatttttgtgtacagccccttaagaggcccgcctacgaaaatagatttttgcatacgggctttttaagaagtcgtatgcgaaaatgaaggtcgatttttgaagacacaaccaattatggtatgtctgcaatctcaaggcattcccgtattgaaaaatcatttatatagtagtgacctattcgtgaatttattcaaaactcaacagcttataattgtggaacagaatggtattgccttataattttctcccctttgtgtttattttcagcccagtaatatctacctctagtagtctttgatgtgtcccctcaggaagaagatagaatcacattgcataagaaggtatagaggaaaggcaggcattgatatgaacagctctccctgcttgtgtcaaactcctaccattccatccactcagtctcttctccattctctcaagtagaaaatttaacttaggagtaagaatcttctcaggtccaattggcaaacccagatatttcataggaaaaactccaatggggcagttcaacatttttgcaactgtctcagtttcagcaaccttcaatcccacagtggaactctgaaactcttgttatgtggaaaggaaaaaaaagaaattctttgatcagaaacctgtcagccattttgatccttagttatataaaattattgattaatgttgtgttttattacatagaaaatacaggaggaatatctgaggaaaactgatggtaaggtgatcatcaatcatgcagttcagaaagctgcagaaatcaatgacttgaaattgggaggttcattagaaaagtgcagttcaaactgcttaaaaaaaataaaacgggtacaggaacagacatgcatggtttacaaaatccaaaatctagtttatccttggagaaatcttcacatataataccgatattttgtagttgatatctaagttgttgtcatagaaacaagctattgtatatacacaaagccatgttaacatctatcaagaattacataatgtaatgctatccccttaccatttccgccaacctatatatgatttcttagtgcattctatgagttagcattgccaaatagatgatgttgtgcaaatcatgatggagaaatgaattcccagaaaaaactactcctattagaattcaggtgtttagtaagagggcatcgccaaaataattgctctgaggtttgtttctagcattggaccatcctgcacaagtgattcactatcttacctctcctccgcttcattaagaacgattgactttctgtggagcatccagttaattggtcaacatagtaagctacattaagaatggtgaagaatcagattaagcaatggaacaaacggtgccatatggtatttgttactgacacttgacgcatgagatacattatattcatcaattagttaagaagatcaggtaaaagaaatcaacggatgaactgtccccaattttccttcgagattaaaaatcatcaaataatgcatttctagaaaatatattaaaagttaaagcaatttaatcaagtgaattaatgaggaaattaaaattttcttttaaaaataatggctggaaataattgttgtaatattctcgtgctctaaaatactctctgaaatttcctgtgaattttcggagcacaatatctaattgtaatgtcacaaagttcatttcatcaatttaattaaatggaaaacaaattaaaacccctctctcctccttgggcctttttcggcgcatgtcttcctcttctccctccctcagcccgccgcccctcttcctctctcgggctggcctcctcttcccctccttcctcctatcggccgccggcccgttcgctctttcctcaccgtaaagtccacttcacgtccctcctctctcctgagccgccgacaggtgaggcccacctgtcggggtcttcctcgacctccagccggcctccctcccgcgccgtcgcgtgcagcgccgcctcctccgctcgatccggccgttccgttgctccccaaaattgattgcaaaaacggatttctctctgtctccgctaacttaaccccaacaaaccctcatcagattcgtggtttatccatcgaattttttctcctttttatccggtgtacttgggataaaccccagtttttccctcaccgaattcctcaaatgcgatccgatctttcctcctgtgcctataaaaatccttcccccgtgctctcctcgaccttttctcccaatttcccgagctctccgtgccctaaaaccaccccgccaccatcgccatctctccgccgccgtcgccaactccagccgcgttgcgccgcccgacgccgacctgcgccgccatctcctccggctccgcaagtacttgggctacatcggccactggttcctttgcgccgaatcccgccggaagcccctcgtcaccgtgcacccgaggttctcggcctcagtcgcgcct

SEQ ID NO: 86302 - DNA, 4093 bp, Oryza sativa
  unsure (1)..(4093): unsure at all n locations
caaccggccacaatcccagtcggactccacggcactcgatttccttcgtccttcgcggcatcggacacatccgcctcggagccgagcacccgcgtgggccgttccctgctgcttcctgggccgactcggctttgcccaccaaccgaaccgctgctgctgcagcacacgtgcagctactgctcccaaaacagccatcaccacgcattgctcgccacagtacacatacatatatgcatgctacagtacctcgccgtactgtagtatcagatactcctctccattttctttcaactcccgtcgcgagcaccgacgcttgcacacgtaccacgtgaaacccgaccatgtgccatcttgtatccaagttcgtcactcggtatccttaaccgtctagacctcaactcctccctgagtctaatcccgatccccaccgttgaccaaatttgtccttcaagaattctgactctactcaccttctcacatggtatcccgatcgcactagacctctgctcctccctgagcatagtttcggtcctcagtattgaccaaggctaatctcaagtcacctgcacataatcagataaaacaaccgtttctagatacaaatatcacaacctgacccacattagtcacacgcactcacaccaacatccacacatcttttcattgattaaatcatttgtaaagccaattattcatcacaaaatattaatcatcacaatgatttcacagaaaaggccatggaaacaaccgtgttgctcccctcgtcactggatcacgggtttagatcccaccacaaaattttttaccatgtcacattgaacgtttaaacacatgcatgcagtattaaatataggctaaaaaattactaattgcacatattgtgactaatttgcgagacgaatcttttaagcttaattgctccatgatttgataatattgtgctacaataaatatttgctaacgatggattaattaggcttaataaattcgtctcgttttgttattaaacaacatttaatactttaaatgtttatctgtatatccgatgtgatacccagaacaaaaacttttggaaactaaacctggccttaatacgagctaccacctgaacttcagtaactcctatgacgttaacgtttggttcagatcctttcacgtgaagcgcagttataataatggaaatccggcccctcttgtaaattgctaaataatggaaatgcacttatctattttccttataggaatcaatttccttcatattcagttctaaaattttttctagtattctagcacagttagtttgccatgtttagctctcattcttaacaagatagatgccccgcacggttcatcttgtaaactactccctccgtatccgtattttaatgtatgacgccgnngacttttcgagccaacgtttgactattcgttttattcaaaatttttgaaaaaatatgaaaatatttatgtcatgcttaaagaacaatttgacgtcatcaagtcataataaaataaataataattatataaattttttgaataaaacgaatggtcaaacattggacaaaaagttaacggcgtcatatattaaaatatggaggtggtactagttttgttgagatcaatccctcttctttttctccctccgatctctaatccagtagaacgtgtgcactgggacaacagattgtgacaataggttccttgtttctagcaaggaggtaagtaaaagccattgcgtgatggcaacttgggtaaagaactggctgctaattaaccaaagcatggtttgctggttagtaggctacagctgtaatctgtgagtactggcattaccaaatccctctgacgaaagctgtgatagcaacgttaattaaaggcaagaagaagaaaacaaaaacaccggcatgacatgacatcaagccattttaacctgtctcttagatttaaatttaactacggttatacccaaacaagttttatgttgttgcaggccttactgtttttgaccacgtgattagtgtcagttcgaggaaaagataggtcgttatggtagctttattacagccttttggattcataattaaactacccatctttttaccgtacgtgttctcttgatcatgttgggattgtgagtgaagctcgaggtgccagcatgtggatcgcactgcacgattcgatttgacattaacttcttgatgttttctcattaaacaaaactattagtatttccgaagcaccttggaaatttccggaaaacaccagcatcggaattcaagttcaacaccacttcaaatatttccgtaagtacctttggaaatttctgaaaaaagaccagtacttaattttgcttcaactaacagctttggatattttcgaaaaagactagtacttaattttgcttcaactaacagcttcggagatttcccaagtcaattggaaaattctaaaaaccactagtacctaattcagccaaatcaacaaagtcagaaattcccaaaactcgtttggaaacttccgaaaaagaccggtactgatttatgcaagttcacatcattttggatattttcgagaggccttcggaaattttcaaaaaagacccgtaccttttttcgaaggcaaatgcagttcgaaaaaaaattccgaacttgatttttaaaaactccataaaacaccagtacacacaaatataagaaagagaaccacttcaactaaaactcttttgagcacttttctcattcctatatatcaaggcaacatccccttgatagcatgaattttctattgacccaatctaatgaaaatttacaatttactaataattttttgccgttttttatcaaaactccacacataaggatattgcatcgagcatcatctcatggcggactaatattccttcacacattctcaatcgcaaagcattaatcctcgctaatcgatttatcattaaccatcaaaaataaatagggtcagatgcacttttagaacatacattgcaacgtcccatttcttaagaagcctttgtagagcatcaaaaactacgagcaatgtggctttcttataatttaacgaatatttttgtgggaaaaaagattcttcgcatacttagggcctgtttggtttccagtgagtccctgtcatattggatgtttggacactaatttagagtattaaacatacactaattacaaaactcattccatatccttggactaattcgcgagacgaatcttttaagtctaattacgtcatgattttgacaatgtgatgttacaataaactttttctaattatgaattaattaggcttaaaaaattcgtctcgcggattagctctcatttatgaaattagtttttttattagtctatgtttaatactccaaattagcgtccaaacatctgatgtgacatgggttaaaaaattttagccccatctagacacctgcttatactctggactctttcaccacgaaagtaagcaatttttgtaaacaacaaaaaaaactgttgcggatatctaatcatatctgttagccacttcactagtcaaatcacatatccaaagaaagcatacatgcttttccttgataccttgaagaaacggttgattatacatttcacaatgtaatatataattccttttcttttattttggtaaatatcaatatgcctttaaacacgttcatacattataaccttaccggttagtacttcacagatatacatcacacaaataattagtatagcaatcagtacgtagtaggatttcaaagcagggtttatgattccgacagtaatttccgtttcgggcactggcggaatttgaaatttcatgaaatccggtgaaaaaccggtaaattccgaacaaattttataaaccgaaaattgaatataaattccctgagtttgccgataagttctcgaaaaccggtcgattttggcgaaatcccgatcaaaatcatcgaaatctcgatcagtaagtattttcctttttttaattccggtcggttttggcccatgtaaggggctgtttggtacagctccaactcctaaatattactccaggagttgagtctggagtggagttg

SEQ ID NO: 86303 - DNA, 914 bp, Oryza sativa
taaagcgaatagcagccgatataagtaaatcgagatactaagactaaattaactaagatatatgatagattaggtgcttacacttacaagatcaaagtgtcgaagccctagccccgccgatgcaagccgccatgataagaataaactcgtcgaaaaagtagaaaaggttaaaggtggtgatgtgccaaattgtattgatcgtagagatagtttacatggaccccgagtgtacatatttatacccatgggtagacacaatacttgctaaacaagaaagaaactttcctaaagataaaagggaaacataaagtccttatatgacactaaacaccctttcctaaagataaaaaggaaactaacggacttttcctaattaatagatacactgccatgccgcatcctccttgaactcggtctcttctggataagcttttctttaatagattaatttccttaaccaaatatagcaagaatccggctatggcgacttgacgactcccatcagccgattccaggattctgaagccgatactgactctagccgatgatgacttcggggcttaccaaatttcactgttaacacagtggtagtgaaaaaaagaatgatatgacgaaattgtcttcgacaatgttaacacacacaaagcaactttgtcgtagagtttgttatcttacggaccttatcatctgacaatggtcaccacaacgacactctggatgcttctgccatgtgaggagtcccaggggatttacctgccattctaatggttctgcagcaattcatcattcgtgctcatcctttcgcctgaggttgtccgatcttctttcactacgtgaatatcaacgtgttccgtcgttatgtgggttctccgtatctacccactcaatgaagttgcacaccgtacggtatgtct

SEQ ID NO: 86304 - DNA, 730 bp, Oryza sativa
  unsure (1)..(730): unsure at all n locations
tcgacttcatgcggtaaatttacctgctgtgaaaaaacatcttttttgaagatttcatgcaacgtgctatctaatacattgagatgcagttgacatttatcgtccttcagtgccgcctggcactcccacttcctgctcctgtttggtttcaccccagtggtgccgggtgggttttgctgactcagttcagaaatatgcggagactgaggccaagagaggcacaaagaaccaaagctggagtcggaaatcaggcttctgccatcgtcctgtatctgccttgaatagatttgcaacgtgtcagagctgagtggggtcaatttccaacagaagagaggctgtgacaccaggagaaaaccccgagttccttcgttgggtcctcaagccaacagcgttattgccggcgtgtcccatttctcaggaaggccacactgtgggtgaaaagtgacagctggggaggcagagagcctgggtttgagttgagcctcgagaaagcactaaaacctttctaggcctcactttcctctctctgtgaagcggggatagtaatagtcattgtccttgatggaacggtgtcccacccctccaaattcaactcctcctggaacctcagaatgtgacaaaaaaaaaaatggcgtcattttaagtgtaattagttaagatgaagtcatactagatgagagtgggcctaagtaanggtggtgngangagtcgtatgcaatcattnnccatg

SEQ ID NO: 86305 - DNA, 741 bp, Oryza sativa
gaaatatgacatcttctaactactccatcagcttaaagaaattacgagatcagttcaaggagatgccagaaaatgcaacaaaagaacaaattgaacattacactagggcattcattttggatattcttgggtcaatgattttcccggatacatcaggagatggagtgcctgcaatgtacctgcaattccttcaggatcttgataaaccaaaggagtacaactggggggcaacaactcttgccgtgctatatagacaattaagcttcggtgcagaacgagagagattggagatggctggtccattagtgcttctgcagcattggtgttggtcgcggttgagaccaggacgaccagtggatcaagataggaaccctattagttggggagagccagaccctgagagttgtcctacatttggagcaaaatggtgtggccaggaactttatcctctgccacataactcgggtgttgcgttttatcagaacttgctggatcaagttcaagacaatgaggtctcttgggaaccatataatggactattgatgtccatgccaagaagagttagagctgaacgtgctttctggtatagtcgagtacctctcatccatttttggatcattgaatttcattatccagatagagtgatgagacaactagggagaaagcaaaccattccacctctcccccacatgatgagagcaagcttcgtcaactccataaaataaatcatacagggaaacc

SEQ ID NO: 86306 - DNA, 965 bp, Oryza sativa
catgtcgctaatgttgcagtaaactgatagttctgtcactcaagttacagttttctgaaatttactccttacataatgaacttctaattattgttggtttagtggttaaaaagtgattactccctccggtttcatttttattgacattttggacaatgacacggtctacaaaatatatctttgaccttatttttttattataatatacacaataaataaatacatgtttatttttattatagtgctttgaaagacaaatctatacatgttgttctagtttctttaaactaaatatttttaaagttattgatagtcaaagttataaaaatttgacattaaccttgtctaaaacgtcaattattatagaacagaggtagtagtggataagaaatatctgtcacctagtgaatagatggatctctcttaacctctttctgtgtctcttaaggtaggggattaggctcttgtttgaggagattatagtgcctgcagctcccctcagacaatccggattctcatccaaattctaaaaatttatagcaatagaatttttttaaaaaactagaagttagaaatcgtgaaaccccaattttctatattccaagcaactaactacttactaatgttcctctgaattttctatatagcagcataaaaattgtgcctccaatagttgtccttgcatgtgtaatttatatatgagttatgggtcccctaacaattaaatatggactaaccaaacttttagtagtggcatacgaccattttcttatgagcacatttcactaaattagaggcattttaactaaacaattgtaaaactatagatttaaggtattgtttcataaaactatagatttaaagtattatttcataaaactatagatcaatggtaaatttatgacaaaactatagattaaggcttaatagcactaaactacagatttaatattaaagttatcaca

SEQ ID NO: 86307 - DNA, 684 bp, Oryza sativa
ccattggaccaagtaatcctccaagggccattgcaagatcaggaagcgtatgttggcccatggatgggcatctttgcaaatgttccagctgagaaacaaaggaggatggagctagtctgatgcagcagctagctaatttcaatccctcgcagtttactgctgtgctctgctccgagggtaggtatactggttatgcagttgtcggtttcagcaaagattggattgggttcacgaacgctttggcattccacaactacttcaaatcacaacgtctgggtaaaaaggattgggcagcacttggacaagagaagtacatctgtggatggatggcaaaagaagaggactacaaatctagtgacccagttggtaggtttttgtcagcaaatggtgatctgaagaccgtgtctggtctggaaaatgacctgtctcgcaagactgagactctcatagctaacttgtcacaccagattacagctaagagcaagtatttggtggaactggaatgcagatgcaatcaaatgaatctctctgttaaaagggcaatggaagaaactgacttgctgcacaaaagttacaatgaaggtacatactacaaactgttcatatgaataattctcatgccatgggcatatgattgctatgttgttgtctacttttattgccaatttgccagaataataatat

SEQ ID NO: 86308 - DNA, 3234 bp, Oryza sativa
aaggcacttgcttggggaggatcttggaccactcagcgtcaaagaattgcagcagctggagaaacagcttgaatgtgcactatcacaggcgagacagagaaaggtttatggcattctgcagtcctttgtttggaaccaaaatacttctgtttctagcctaccctgttcgcttgttatttgtccactgatttggatataggtgcaatacgtgagaagcaataaaatatacagtatgtctttagtttgtaggtaaagttatatatatttataaatagacaggaggtgtacgctagctatggaatatccccttgctaaagtttatataaagagcacctaactaatttgtttttgttcatggaagtgaacataataactgggaatgcttatcctacattatctaaagagaattgcataaaattgtttcaatctctagctaatgcatggtggtggtttggtagaaagccaagacatatttcacttagaatattgataccttattttatggtaaaggtcaactgatgatatttttaaagaagtgtgaaagctactatgcagcataagtaatccctttgtttcataaatttgccctaagtcattatctttaaccatcaatttctggaaatttgtgtagtttaacaaaatgtgaactgtacattctgtaaggatttttcatgttgtgtatctaacaacataacccttgtggtgttaaactatagtatcatttttttagaaactaatggtcaaaaatatatataagtgtttgaattaggacaaacgtagaatgacaagtaatttgaagcaactgggcgtagcatgtatcttgataaattcaccctattctaggcacgaaggtgatgcatacagtggcactaaatttcatataaaagactatctaagtatagaatagaaatatagaatggctagcacgcatgccctttttctttatatggatacatgtgtagtgacagggccgagcaactgcaacattaatctaaactgtcaatttcagatatactactacttatggctgcttgtttaggctaattaataattatatgtttactcttttcaaaataaaacacttcaaagctgcatgacaatcccgtcaacaaggatagtaatgacaatgagtagctgatgaaataatatggcttcaattctggagtttcaggaaaatttagctgctaaaaaaagaataagtgaataacccaaagaaaatagaactttgaaggatagaggtagagagattaaatatacactagtattcattttgtggtgcgtcgtacatgcttcaaaatctcccaaggaccataaaagatcccaagaaatagctaggtagaacacatgaaagttcagaaactggatataatctacacttcattatattactgtcaactcaatatgactgtgcttgaatggtttttgtgcagacgcaactgatgatggaacaagtggaggaacttcgcagaaaggtacattatcaatccaaagtttctcaagcatacatacagtatcagcattgccatgggcgggtgacttcaggagtgctagctactagtgataatctaaattaaaccacgaaatgacttggctagctttgacaatgcatctatattgccagcaaggctgctagggtataccgcatgcaagttaattagggtagatcgtgtagcctttgactgtataactaaagaaatggtagcttcgttcttgcgagagatttctttcatgagagttgttacatattatactatctccaatatatttttcttgtgccacaggagcgtcagctgggtgaaattaataggcaactcaagcacaaggttcttattcactcggaaatctgttatgccaatgcggtgcacatataattatttattgataattttcattcatatattctcatatccaatgctgcagctcgaggttgaaggttccaccagcaactacagagccatgcagcaagcctcctgtgctcagggcgccgtggtggagaatggcgccgcatacgtgcagccgccgccacactccgcggccatggactctgaacccaccttgcaaattgggtaagattaatcaagaaaagccaagaccagaaatgcatatacttataacttctagctcaaatgcatacagctcgatcacagcatccgaactagtagaactaatgaaagattctcatcaaactgactgtgtatatcttgcttccattatattatctgaaaaacgattatgttactaggtatcctcatcaatttgtgcctgctgaagcaaacactattcagaggagcactgcccctgcaggtgcagagaacaacttcatgctgggatgggttctttgagctaagcagccatcgatcagctgtcagaagttggagctaataataaaagggatgtggagtgggctacatgtatctcggatctctctgcgagccacctaatggtcttgcgtggccctttaatctgtatgtttttgtgtgtaagctactgctagctgtttgcaccttctgcgtccgtggttgtgtttccgtgctacctttttatgttttgatttggatcttgtttgaaaataatcttaccagctttgggtaaactgtttattacgtactctatatagcatatgtgaccgacgacaacggtttcattttagatgatgtgtatggatgatttctttccaaaatcacatctttagtataagagcaattttaccatccaataccaaattttatactagaaaatattttgggatatcaaaatttatggtacctccagtaccaaatgttgaatggtaaactttcataatatacaagtcactctaggatatttaagacaatttttagttttttcttattgttgcccttgttaaatacatgagaaattttacatcacttaaaatgtatcaagaggtatcaaatttttttaatacaaaatttagtactttctccgtttatatatgaatgtggacaatgcttgaaagtcttataacctgaaactgaggtagtgtatcgagaagtacaaaattttacactaaaatcccagtacttactcaataactgtaaaattactctaaatatgtactccctctatttcagattataagttgttttaactttagtcaaagttaaactgtttcaagtttaaccaagtttgtagataaaagtagtaacatattcaacacaagacaaatatattataaaaacatattgaattatagatttaattaaattaatttgg

SEQ ID NO: 86309 - DNA, 2939 bp, Oryza sativa
ttcctaggaaattaaatcctctaaaattcatatggtaatccttaattcatttcaaataggaccttagagtgggcatatccttaaaatgtgcactcacgcagaagaaatagtcggtcgtggttatgcaggtgtaggagtgaaaatggggtgggtatttcccgcccgcccgcttgaccacattatttcgggacaaattccggtcgaaaattcgggtacctgggacttttcatggatatcgggtccaaatacgagtcttttttggcggatacgagatcaggttcgggaacgtagtatccgacggatacggattatccggtaaataatccgggtattacccggataattatacggatattacccgtattatatttttgtgaggcactttttggtactatatattggttctattataaaaacaaccttcataaaacactgccaaaacaaccttcataggcactttttgtgtgtttagttcacgttaaaattggaagtttgattgaaattgaaatggtgtgacggaaaagttggaagtttatatgtgtatgaaaattttgatgtgatggaaaagttgaaagtttgaagaaaaaaattggaactaaacaaggccataaaatatgggttaggatatagaaaagatgagatctcactaatatgtgttaggatatggaaaaggtgcgtaagcagaaagccggtaacgttctagtagttgggtgaaccggctttacccaccagtttcttagctaactccaaatatcttcacataaaaacaaccttcataaacactgccttcttagataaaagaacaaaatttaaacgaaagaatgctgttgtgcactgactcaatgcaatgaccttttagtatagtcgtcctctatcacgtactacctgctcgtcatctagtatacgagggccatcgctgtcgtggatgtcacatggatttctcgtgtggcccgaggaatggatcgtggccgcgcgagcaagtagttgtagtatccccaactatgaaagtgggagtagcatttaatatgatcaagaaaggcaaccaacaatcgccttggcaccctgaaatatgccaaattgcaaaggtttttttaagctatgtaatcatgcggagcaaagcaacgtggacagattcctaaagtaaagttgtccctgcgaactgagaacacatgaaaagaccctcaaggcggttctgaactggagtaaacaccctagcgatgtgtttaccgctaataaaaagttgtggtggttacttggttatctccgcaagataccccggtatcaaaaaacgtaagcatgtacgaatctgtggcggcaggtgaagtacagttgtagagaagtttctctctcttcaaccgcgagtccccgcaccaacggattcagactccacatgactcgtcagaaaaatcagggattcaaccatgccatggaatcaggagctgtttccacaaaaacacccagctaaacacgctaggccggctgtttcgtcccgatcgtgcgcagccggcggcgccgcacgcgatcgtgtggtcgtcgcttcgcttggaaacgcaccgcgttggcgcgccctgcctctcccgttttttcccatcccttcacacaacaatcacaccaccacgcaagttctcacctcgtcattacggattttacacttgcacacgcatccaaacctttcgccatggagtacacgatcgccctcccggctctcctctcatttactccgtactatttgcgcactaccggagcggaggagtgggccccacatccacggcagcgaaggctcaggtcccacgcaccgattcaccggacgtggggccaaactgtcagcgtcactgctgccgtatgggtgtggatccacgagtcagtcctttcttttttattattcggggagtatattaacgtcagggtgggccgtaaaaaggtaggcgttttattagggggaagccattgaatggcgcaagcggtttatagccgctgtaggtaggattcctccacggtaaggttcgttccatccaaaggcctttttatttctcctttctctgtgtctcgctcgtttccattgagcctttgctctcgcgtctctcgtgtctcgtggtgtttttggtcttggccttcctctcgccatggacccggcgggtgcgccgtggtgcgaccctcgccgagggtacggcggctacggtgttggatcggcggcgttgcaggcggcggcgcggcaacaatcgcagcagccgcgatctgatggtgcgggaggcgcgggcgtcaccggaggcgtgctcaagaggagcctgggggagatggagaggtggcagcagcagcggcaggtggcggcgcagcaggccatgtacctgcgctcggtgaggcagcgcatggatatcggcgctgtgctcggtggggccgcctcctcgccggcctatggcatttccggcttgtcgtctggttttggcggtatctcgcagcagcagccgtcgtcgacgatgtcgtcgttgaccaccgcgtcgcgcacggtgatgccagggatgcagcagcggcggcggatgatggccgttccgaccgcgcagaatcaagcggtggcgagggcgcccgctgctaggccggcaacggcgaccgaactggtcttgttgcaagagctggagaagcagctgctgggcgacgacgaggaggcggacgcggcagggagcggttgcggctctggtatcacaagctccgattggggcgacacgatccagaggcttaactccgtcaccgccgcgtcgtcgccgtcgcttcccctgccgaccgccgtgaacagcaccgcgctattggcgcggtccccgacgaactcctcttcgtccacggcttcgtcgtcagcgtccagctcgccgccgatctccgcggcctcgtcgcggcagcttctttccgaggcagccgctgccgtcgccgatggcaaccagggctgcagg

SEQ ID NO: 86310 - DNA, 501 bp, Oryza sativa
gccccgcaagccagcgcgcgtgcccgagccacgccgctcaaaccgccgcgccgcccgttgcttcccgcgcgcgcgtgccgtggtggccgaccgcctggtcgccgccgccgtcagcctctgccgcgcctgcccgcgcctgtcgcccgtgtcgccgctccgctccacaccgtcccgccgtcatcgccgtcgtcatcgcctcggccccgccactccgcgcgcaagctgccaaaggacggaggcagagctcctcctccctctgccgcgtcgcccccgctccctcctccttttctcgaagaggcaagggacaagccctctttcctctccctcttttcccctttttcctcccgccggcgtcatcctcctccctcctccctatcgccgttttggccgcgaccgccgagcgctagccctctcctttgaccgccctaagttggttcccaaaccgacattgccatcctataaacccaagcctccccctttcctttcctctcccattcgcct

SEQ ID NO: 86311 - DNA, 580 bp, Oryza sativa
tgcacattgacaatatgtatgaaaactattctgcatgtcgaaatacatgcagcgttctgacattactagcatctatgctgagctgggattattagaaatgctagctagctagcaatgcataatatgtccaaatacagatgaaacttggaggtggcatttggaacaggcacctcgttcttcttgtacataagaccctctcttctccaaccaacagcaccagtaacttgtagagtggcattcggaacaggcttatctgaaggctatcagtgcagagaacaaaaaaaaaatgattcagatgctttcacacaaaataaatgagcaacaaactatttgatgtgactttttatccggttatcttatttcaatgtcacatttttctcaccttggaggaaaatggcgaccgaactccttcttgagttatatacaattttaagatttcaggtgagaggttttgagggtaaccgaagtccataatttctgcacagttagatgagagagacagttctacaggtaaatagaagcatccacagtgcaaattgatgaaacaaagtccaaaaataagatgtcccttaccatcaag

SEQ ID NO: 86312 - DNA, 4374 bp, Oryza sativa
  unsure (1)..(4374): unsure at all n locations
tttgcgacgcccacttcttctccaagctggatctccatttcgggtaccatcaggttcgcatgcacccggacgatgtcaacaagacggcattccgcacacaccaaggccatttcaagttcttgttcatgccattcggcttgacgaacgcgccggcgacattccaggcgctgatgaacatggtactcgccccattcttacgccggttcgtcctggtgttcttcaacgacatactgatctacagcgggacatgggccaacaccttcagcacattcgggcagtgctcagcgtcgttcgcgccaatcatctcatcctgaagcgctccaagtgccacttcggcgaacagcagatcaactacctcggccatgtggtgttcgcaaacagggtggccatggatgtgcagaaggtgtgcgcaatggcatactggtcgcaaccctctccgtgggagccgtccgcagcttcctcagcctggctggatactaccgtaagttcattcgcaactacggtgcgatcgcagcaccattgacggctatccttaagcgcgaagcattccacttagggatgaaaacagtcggaaacgatcggaaaatagcctcaaccatttctgtaaccatatttttctcggaaacgatatcggaaatatcgaaaaaccggaaacggaacaatacggacggaaacatatcggtacagatcggaagtcggtaacaaatacggaaatattaaactataaaaatatatatttaactttacataagtatgttatatgtatacataagtatagacatgccctataaatatcgatatatttagaatacggtaattaccacattataagaaacggtaatttccacgagaatacgataaatacggaaacgatcggtataacagcaaaaccatttccgttttcatttccatattttttgccatttccatttttgtttcggtcgattaccatttccatatggctcggccggtagaaagtcgaaaatgaacgtcggtcggccggtaattaccgttaccgttttcacccctaattccattggacgccagacgcagcacaagccttcaccgagctcaagcatgccctgtggatgggtcccgtgctgcaactacccgacttcatcatgtcgtttgtcgtcaaagacgatgcgtcggggtccaacattagagtcgttctacaccaagggacgggcccactagccttcttcagccgggcagtagcaccacgccatgccgggctcgccgcctacgagcaggagttgatcagccttgtccaagccatccgccattggcgcgcatacctctgggaacgggcgttcctcgtccgccccgaccactacagcctgaagtttctcttggatcaacgcctttccacaatctcgcaacatcggtggtggtaagcaagctcattggttttgactttactatagaatatcgaccgggtcgcacgaacgtcgtggcggacgccctgacccaccgcacgaaggacgccgagctcatcgccttggcaatctccgagctgacgttcatggcatttgacaacctccggagcgagtagggatggcaatttgggaggggagggaacgggggacatatttcacccgcgggtgacctctcctctcccgtacgcgcacccacatcacataggcggaggcagcggagcacagggcagcaggggcggcgcactgcgcaccggcaccatgcacccctcgccgtccgctccctctcccctcccctcctctctcttccagcctcccaagtcccacgaatcggcaccacgcactcctttggtctcgtcgtcccggtcgccctctccctctcccctgcggcctctcgactacctaatgcggggccctagtcgggttgcggggccctagaggggtcggggacggggcctgatttggcccacatctccagtcggggccaggggcgggggatgtagtcaggggtcgggggcgaggccgtttcagcccaactcggccccgccccgttgcgatccctaggcgtgaggtgaccacgaacgaggacctagccaagatcgccgctgacatttccagtggcacgctgggttggttgggctagccatgggctttccgtggcggccttatccttcgcaatgaccgtgtccgtgccgacgtcttccccgacactgcccgcgctgtcgccgccggccccaccaccggccacgaaggcgtcgagcgcacacttcacaggctgtgcacggacttcttcacgccccatgccaagcaagtcgtccaagaattcatgagcacatgttcaacctaccaacgcaacaagaccgaacaccttcatccggcgggcctgcttcagtcactgtcggtgcccacgcaagtctgggaggacatcgccatggacttcatcaaaggacttccccgcgtgcacggcaagacaaccatcttcactgtggttgaccgcctctccaagtacgcccacttcattctgctcggccacccctacacggtgacgatagtggcgcgtgtgttcttcaacaaggtggtccgcctccacgccatagttattaaaaccggaccggagaatgaaccggtcaagctctcggttcactggtctagcggttcaaccactggttaggccgatccaaccacgattcgatgtattataggatgcaaatgtcttagaccaacaaaagtgaacagatggtgtggtggctagcgcgtgcagcgctcaaccacatgacccaaggtcaaatctccccacaccaacgtccttttccaccgatttttggctgagtttgctcagcgggcctcacgtcagcccatcaccaaaagacagcccggtctgaccactccggtttaaagcccggtttacataaaaattgaccggttcaaacggttttctccggttcaattacacatccgatcttttaaggggaccagaccggctgaggccctagttccggtttttcccggtcggaccgtcggtccagtccggtcttcataactatgctccatgcatctcaagatccattgtcagcgattgctgatcgggaccatgttcaccagcacgatgtgaatgtaactattacacatggccgacatcaagctcaacgtgagttcagcttttcatccgcagtgcgacggccagtccaaggcagccatccgagtcattagcatgtacctcaggtgcctgaccnnnnnnnnnnnnnnnnnnnnnnnnnnatggcttccgtgggcagaatattgcttcaacacggtgttccagagctcgctgcgcacgacgccattccaggtctgtgtgtatgatcacggcacagcacgtgtgcgcgctgtcaatcaagccctcgtcgagcgggacgaattccttgaggaaatccgggaacacctcctccaagcacaggattattggaagctctactacgaagagaagcattgtgatgtcaccttctaggtctgtgactgggtctaggtgcgtctactccatcaccaagcagcatcccttcccggcttctgtccatagtggaaaaaaccagaccgggccggtggttcaaccaggaaaaaccgttaccagaggtctttctggttcggttaaaaaaaagtcaggacatgcatgtgacccgctttgaaccggctgaatcggacggtttttctatgaaccggccattaaaccatcaccgggcagactctcaaggcccatttagcctgcaaagagcgttttggttggcaaaaatcaaaggcccatttagcctgcaaagagcgttttggttggcaaaaatcagaggaaatatgcacctgtgggggttcgacctctggtctttaggatagaagcaagcggcgtagaccaccgagccatccaagcagttgtgatttagcaattacatacgttacacatatatgtattaaatcgcggtttgaccgtccggttcacggttggaccggcgaacccaaaggtcgaccgggtcacccaccggtccggtttttcctactatgcttttgtcgcaacaagttggcaccatgctactacggtccctaccaagtcgtcactcgcgtgggcgatgtggcatgtcgcctcaagttgccggccggtgccaagatacatgatgtattccacgttgaactcctcaaggtgttcaaggacacaccgctagaccagctgcctgcgttgtcggcgctctcgaacgaaagagtgctcccgcttccagctacggctgttcatggtcaattgacgcgccggagtatgccatgtgctcatccaatgggccggcaaaccggctgtcgatgcaacgtgggaagacgaagatgagttttgtcgcacctatcctacgttccagcttgaggacgagctgtttgcgaaggaggggagacatgtcatggtcggcatcacgtattcgaggaagcgaca

SEQ ID NO: 86313 - DNA, 691 bp, Oryza sativa
ctcacgccgaactggctgaagtcgacggggtcaggcaccgatggcgggtgggcgctgcgcacgagcgcccagttgacgccctcgaagaagggatgctgcttgatctcggtggcgcccctcctcgacgcgatcctcttgccggggtccttcaccaggaggccccggatgaggtcccgcgcgacgccgctcgccgccgccggcgccgggaacgcgccgccgtcggggaaccggagcggctgctcgacgacgttgcagagcgtggcgcggttgctgctccccttgaatggcgtcatgccgtggaggagctcgtagaggaacaccccgaacgtccaccagtcgacggcgctgccgtgcccctcgccgcggatgatctccggcgccaggtactcgtgcgtgcccacgaacgacatggaccgcgcgtccgtcggctccgcgttgaactccagcggcgagccgtggaggagcccgaggtccgacttggacgtcttgcggctcctctttgggaggatccgcggcaagaacgccgacggctgcatgcagccgacgccgacgccctcgccgtcgccgccgccaccggcggcgaggcccttcacgacgccgttggcgcccgcgtgcaccgacgacgacttcaccagcatcgggcacacggagcaccgcagcgacaggtcgaagtcggagagcatgatgtggc

SEQ ID NO: 86314 - DNA, 3751 bp, Oryza sativa
caagtaggaggcagtgtgcatcaccaaggatggcttccagaattatttcagatttttaacattctctaggctggacaaggatgttcaaaacttcaaccccagcctgcaaaactctgtagctgacgtaatatcccagtgcctcatggcattcatgggttgcatattgctaccaggtgtaatagcgaaattgtatcgaaactttgaaagtactactatcctatgataagagtagcaatatcagattgttgatttactggcttgattactattgagccttgacactgcgacattattggtaatgctgttgctgaatgtattatgaacaacggcaaaaaacattagactggtactccctccgtcctaaaataaaatcatttttggcttcatctatttattccaaaataagtttatttttaagcaagtagaggataaatgcattaggaatagataaattgagaaataattacattgatatttgattgagggtatttttttaattttgtattggtatatgtgtaggatagatgaaaaataaacttattttgagacggaagatcattttcagaatgtatacaagtatacaaccaaactttaaaaatgctggacataaagtataggctaacgttattatgattagtcatttgaaaattgaatcaaacggcaacaccacgcatgcaattgtgttgatgccagataaaggtggtgacaccctagttatacatctatctctactacagctttggatcatcatcacttaaagatcagcaagagaaattgaaactggtaaattctcatcaaagttgggtttcttcattgatgataaagctgctttctacaccatgttcaaaacaaaaattccttgcatcatccagcaggaaagttctgaaaccacacgcatttcaacaaattaatggagaaggtacatcccgtttgcatgttccttcaattcttcgctacctgctctattatcttcctctaacaaagatgcagaagagctaattaaagggtattcttttgacaagatgcaaaagagctgatgaaagggttaaaaaaaaactaagagagtataatctgttgcaacttgcaactagcaaaatgacagactaacttagcaacatatggtatgccagtaacatcaagattgttttttttcctcgaatgccatcaagattgttgcacaatgcattctgacggcatgaagccatcaagccatcatctatcactggcaaactccaatctgaaggaaatgcctagagtcttatgctattaccgcaggtggggaggccttgatccaaatggattgcttccaggagtagctggtgaaggaattgtcggtgaagcctgcgatgctctctgaaaaagtgaagacatcagatccattgtcgtatcaccattttccattcttctgaattcaatatattttgggggaaaatagaaatttgaagaaaatacatatcataaatgatgggcacaaatgaagtataaattaaatgcaatttatcctcaaagaaacaatttgaacctggacctcatcctagaattcgccagtttccacacgggcaagttaaatagttagctgactgagattttaccctatccaagaagaatatatggacaataatttacagtattgctcttcaggtgtcttaacagaagtatagcttgtactagtatgttacaatattagatgctagttcatatgtaagttaacattgctaacataagccatagaatggatgtggatcctgctatgcactaatgcacatgctacttccattcaatcagccacaatttgatcaaacaaacgatcatcaattgactgcagcaacaaagttatacttcttatatcatcaaacaagttcttttcttcaaaatggaacatatactatctagaagacccctctggcctcccctttgctctcacaaggcagctacctgcatcctacatctagtttcaggaaaaacaaaaaccaagcttagcgtatcagatagaagacacgtctgacctcccatttgctctcaaagtgacaaggcagctacatgcatcctacaaacatctagttttggaaaaaaaatattaaaaaagctaagtgtattagattctctagcagacccctccagcagtccggcctcccctccgttgttagaagcaagcgacctatatgtgtacttgctacagtggcacttcatagaaatagagaattctattcattatctaactgtaactccggatgacaataaattactaataaattagtacagtcaagaaaataacagaataaattgtaagttcacctgtaacattcctggttgagtgatataagccatgaactgttcctttttcttgctgaacaaatccttaacttggttcaacaaatcttcttgtctttttatatcctcgagaagcctttccttttcccaattcttatgtttaacttgctcctccagttcagtgatagttacgggtaagtttgagaccccaagatttgcagttacaggaaattgtattcctaagcttgcccttcaaaagtaaggtcatgtataatcattaacaaaaagaagaggtggaattaagcttaatatgcttgttacagaacagtgcaaattagtgttaccagactttatgtagtaagcaaaccagggtaatgtatcacgcatatactcataaaatgaaaggacaattaaatatcaccgaaggacccacaatatgcagaacactaatgatcaaataaaagtatatgatgtgatgttaaaggataaatccatataattgcatacctattacctaggcagaatgagccattaggtcttagtatagacccatcaagagaaacagcaccatcatttatcaaaggaatagcatttcgcaattcagctctagtcttatagacttgcaactgagaaaacaggctgtaaaataaagtttccctaagaccgtggcccccagctgtgagacaactcaaatttgcctggtccaaatgtatcatatttactgcaaaaccaagaaaaccaggtgggaactctccactaggcaaccttggtttatgcaaaagaagtttcctctgaggatcatcgatcataaaatcaccagaaaatggcctgcaaagtgtaatagttataatgttgaagtgtccatccagcagagtccaacttataacggcacaatgaaaacacaccttatattttcaagacaaaagacagtgaatcttccatctaaaaattttccaattgtgcgacctagtccatgaatgccactggttttatcaaccataccttccttgtcatatgtttcaagaccctcgacaccatcataagtcttgcagacgacaccaagcatattgtccaatcccaagtactctgagagtaccctataacaaattcatggtacctcaaaagtaaacaaataattctgcccattaactttgcaccagttggtgcaataaatcttattatatgtcaaaacaaagagagaataatgacctgctgaggttgtcattatttatttttcccaaggtagctacgacaccaaggacatctttcatcagtggcagctttgatgcatgctgataatgacgaatcttcagttggcatataatcccagctgctgtctcgtcctgtttgagtatactttgaatagtgcgttgttcagcttcttcaacagatgtgtcattatttgcaattgccgccatcgatgaataataattgcctattttaactgagaaaagttccagggttcagcatataaataggg

SEQ ID NO: 86315 - DNA, 1154 bp, Oryza sativa
agagggagcattctgtgcagcagcagcagctcatccaactcttctgcttctgtggtgaccaaggagcaagaggcagttgctgctgcttcctcctctcaagaggaaggagtagcagtttctgagactgaatttgtcagctacagggatgaccccaacttcaggtaaatatatatgcttcatacttgtgtgtatacgtttgttttctgagatggagcttcatgtttcagaatctataattggcatgttattagcatcaatcagtggttcttggcttccattttaatgtcagaataaatccttggaatttatgtggaaatgggttcctgaatttgatataatggatattagatttgttttgttctccgtaccaacgaatggttccatggtctagcggttaggacattggactcttaatccccctattttttttcatcttattcatatatattggctagagtggctgtgtgtgtctctctatatatatatatatatatatatatatatatatatatatatatattggttggagtggcaagcactttttttccattcatctctacatatattggcttgagtaacaaattcatgatttgtaagccaaagctcttttttgtctttttgtaaaaaagaaacttctgaagattgccaaaaaaaaaaactactttatgtacatgtagtaagattcttgtatcaaagaagagagaaattcaaaaataccagctcaactttttcttgcaccttcttgacaatgccgtgtgcgtaactgcgtatgtatatgcaggggatgcagagggtgcgggcgggaggaggtggagaggggttgcaacggcgaggggcggatccagggcggcatagccaccgtccccggcttcgggtggtggcctatcaaggcgtaccggccgtgccccggcttcgtcgcctccggcggccggtaccggaggcaggggcagagcatggacgatgtggcttccggcagagggaagaaggtcccctccaacaacaaaaaaaatacaaaaggtattactactccctccgtttctttttttatgatgttggttatcatcgtacattttagaatggagggatttcttttttatgatgctggttgtcgtcgtacattttgggatggagggattttttgtttttttataatg

SEQ ID NO: 86316 - DNA, 976 bp, Oryza sativa
ggctagctaacacggatcgccatggcggcaacatactgattcgtaaggatgagaatgggcagattgagctgataccaattgatcatgggtattgtctgcctgaaagcgtaagtattttgttttgctttgaactgcattttttgtactgaaaattgaaatctatgatcacccatagtcactaatcgccataaagagttgctcactccatgtcaaaaatataagctgtataagtttcttacactgtcttcagtgcaaaactttgacctttaattccttgtatagtattaatatcaataactataaaattgacataacgtgaatgtactttcaaattcaaatcttatgatgccacatgcttgacgctaaacatatgtaccgctagttcaattattagtcaatgtttgcaaatgttggcttcctaaaattgcgggaggcttatatttcaggatagagggagtaattttcacgaccacacactatgtacacattttaatataatatccattgctaaattttttgtcctaatttggttactagcaatgattgttttctcatgttgtaaacaatgtttgaactattttagttttagtaattgatttgacttctaaacaatttatagtttgaagactgcacatttgattggctttactggccccaagcacgccagcctttcaatgttgaaaccctggactacataaagtcacttgacgaggaagaggatatcaagttgctcaagctcaatggttgtgaaccatcatctaagtgtgttcgtgtttttcgtctaagcaccatgatgttgaagaagggtgctgtgagaggtctaactccatatgagatcggtaacatgttgtgtagggagaacattacaaccaaatcaaagattgaagagattgttgaagaggcagagcatgttgttcttcctgggataggtgaaaaggcattcatggaagccatctcaggtatcatggatcgctat

SEQ ID NO: 86317 - DNA, 1057 bp, Oryza sativa
aatttctccatattatactgtgcttctactggttctataaggaatttcaatatgatggccattaaatggaacccactattcagaaaaaaaaagtattctagaatgttttatgtaaggtgtttacacaatatgcagaacaaaactactgaaaattgatggtcacaaagcatgtctggtattagatgataaggtgcaccaacaaagcgaaaagcagaaaagaacggattgtggtgaaatgtgaaaaatatcctgataaattacattggaatactgccttatatcagtgatgtgcacttattctcttcttaatttatggtctcatcaaagtaaactttttttacttgtgtttcatatggatgcaatcaagtctcaaatcatgaggaagcaaaacaaagccttcctatgaaaacatactacaataaggtgctcaagggaaatgttttcagagaaataaggtgtagacaagaatgtattacctcagcctcgcgcaagtgcatgtagatatcagaagcaagagtagcacacaactgcggatcctcgtagttattgtcaacatcacaaatttggtcgatttccattggggaaggagcatccttcttccacttagtttctgcgaaacaaacaagggataagatcaatcaaccattccaatagaatgcaccatatagcacaaatttttctagctataactgtgcatttcagcaaccaaaacacaccttcgacatctctatcctctgagatacgcaggttttcgtttgctcttcgctgcaaggaacctagaactgaggaggaatccccattatcaatgtactcaaattctgggcttttcattgagtcacacgtcgacatcgtctcgtcaaccgaaactgaatctcctgaatgcataggggagacgaagctgctgcagggtacagtgacaggtgccagtgcagcagtcggcacaatgctaggcactttaggaggaagaacagactccttctgtgtggcgctctcatggcgggatatggccggagccggcttggcggaagccgatttcaccgccgaggcccgattcgtg

SEQ ID NO: 86318 - DNA, 1224 bp, Oryza sativa
tttttaaaacacaccgttttgcacaagttccaaactcccaaacctcctatcaaagtgctccatccggtcttaaaaacaaaggtccggtttcccacacaaaaatgttacaccctttcacatcaaacgtttgaagtattaaatataagctaaaaataactaattgtacagattacgaataatttgtgagacgaatcttttaaacctaattgctccatgatttgacaatgtggtgctacagtaaacatttgctaatgatggattaattaagtttaataaattagtctcgcggtttactgacggatactgcaattagttttattattagtgcccgaacaccccatgcgacaccctatataatacccgatataacacgcaataattttacactcttggatctaaacacccccaaagttattttggatactacattccaagttcaaatataaaactctaatggcaggtacaataatagactataagtcagctacaagcttatgtggtgaagataagagaggagatagaatagaagcgggctacagatttgtaaccagctgcagcacggactcctaaacgctacggtggtgtttgaatctcctgaagataaagataaagatgaagattaagtgtttcacgtaaaacgaggtggtaataacgtgtgactaattgagttttaattattacaaacttgaaaagtggattaatatgttattttagaacaactttcatatagaaagttttcgcacgaaacgcaccgtttagcagtttaaaaagcgtgccactttaatccaaaatttaattcacccctttcatgagtttctaacgggctctacgtgtgtatgacaagtgggaccagtaattaatgatgtagtgtatatctgtagttaactattgtataatttactattagattagctataaatgatttggagctagtagttagctatatactattaaaattcctctaagtagcaaaggccgtgttcgattattagtgttagaaactaaccctccagcacgtaaaacaaaacggttcattaatacataattaattaagtattagttatttcataaaaagtgagttaacatgatttttcaaataactttcatacatatatttttttttaaaaaaaaacacaccgtttaaccatttgacaaaagcacacatgtgaaaaacgagagagataagtaggaaaatacgatgaggaatatttcctccgtatcaaa

SEQ ID NO: 86319 - DNA, 978 bp, Oryza sativa
aagttagtgtctgtcagcaatgtacattttgattcagcattctcagctctggtttcagctttcaaatatttttcctttagatcatcaatcacctgctccatatcagacattgaagacttaaatatactgtgccgttcgacaatagcctcaatcgatgcttttgcatgcagtaactgagtttctgactccttaagcttctcctccagtaagccagccctatctgacccctgacttttgagggattttagctcctcatcgagttgtatattagcgtgagaaagttgtttgcactttgcttcagcattctgtgttctactttctgctctgaaaacagcatctttaatatcattaacaatattttcgaatgtgctcatctcatcttcgccgacttcattttctcctgttgatgcaattgtcaatggcaatccagacttagattccctcagccattcctctagcggctgaattttatcctgcaaagtcaagaactcagagtccggttgggcttgagtcggcatcacttccttttcactgtcttgtttcatcttctctagagtgctattagaaccattcgattctgtcaagctttgctctaactttgatttaaggtcaccttcccgacgaattgatgcacttaggtggaactgtattgtattaactttaccgataagttcctttgacgctccaagaaacaattcagatgcattttcagctgcaaacattctttcagagatcgcttcaacagattcctccaagaaatacgattcatgttctacatgatgcagcttaagcttgagctcttccacaacggactccgaatcatgtaacttctttccgagatccagttcacttgctattgactgatttaacagctgcagagtatttctttgttcctcggcaggcatggctgagcgagatgaaccatgaccattttcgtatccaccatcttcactagttcctgtacaaatgcaattgtca

SEQ ID NO: 86320 - DNA, 1788 bp, Oryza sativa
tgcaggtcgctgaagaatatcgtcttgttcctgatacattatacctgacagttaactacattgatcgttatctttctggcaatgagatcaatcgtcaaagactgcaattacttggagttgcttgtatgcttattgctgcgtaagatctgactagcaatttttttaaatgtgtttctcagtttgcatctgagttttgtgtactgattttggcttgttcctatatcagaaaatacgaggagatatgtgcacctcaagtagaagaattctgctatataactgacaacacatacttcagagatgaggtttgttttgcatatctgttaacattgctgtgtttatgtccatgactaacacatagattatcaggttttggaaatggaagcttctgtcctgaattacctgaagtttgaagtgactgcacctacagcaaaatgctttttgaggttctattctctttcatctcatcgatgtctatagtgctggaatgaatcgaactctaataactctcttattgcctacaacaggagatttgtccgtgttgcacaagtatcggatgaggtgctgctctcttaatcatctcctgcttgctgcaattccataatagttatatggtgcattgcattaacagcttttcatcgtgcaggatccagcattgcatcttgagttcctagccaattatgttgctgagctatcactgctggagtacaatctactttcttaccctccttcactagtagcggcatcggctattttcttggccaaattcatactgcagccaacaaagcacccttgggtaagtggtggcatcatcgtattgaactttccatacatcttttatatcagcattcaaataaaaaaattacaagagctaacatatgcttctcattgtaaatttgaagcagaattccacccttgctcactacacacaatacaagtcgtcagagttaagcgactgtgtaaaggcattgcaccgcctttttagcgttggtcccgggagtaaccttcctgcaatcagggagaagtatacccaacataaggtataaacggcatatcctccccatttcttcagttatctgtactgtttctaatgctgatcttctgtacctttgcctttgtctgcagtacaaatttgtggcgaagaagccctgcccgccctcaataccaaccgaattctttcgcgatgcaacatgctgaactagaaaaataaaccaaggattagttacagttgctgactgaattcttcctccagaggcatgctgattgcccccctgttctttcaggtggtttggctgagtgtagatctaagatcgatgctgcagctgtgtgtggtaacttttatggtactgatgttctttcttctttctcctcctgttcttttacctgtacctagtagatctatggttttcagtacattgtacatcttgtttgtaatggcatgattcttggaaatattagctgccaatctgacctgggcgtctcccaggttgatgtatgagggagtctctgttcgtgttgctcttgtgaaattcccaataagagcaccacattttttaatagtgctcattctgaataagttattgatcatgtccttgctatcaagtgctagcgttcttgatgtttttagtcaaaaggaatatttggacgaattgcttctcatcttctacacatatcggctttactttttcttttttcaacttgttctgttcttctgttgacagatactgcatgcagctgatgtgatcgacttgaacatggtgattcagcgagaagcttagtagatcattgtat

SEQ ID NO: 86321 - DNA, 13209 bp, Oryza sativa
tggtacagtagttcatcaggaggagagaaaagagcgaagggaaaaatgagaagcggtgaaaatatgtggtggggcgcgagagttaccgcgccgagacaagtgaggcgcgaggcggaagtgggatggcgcggtccgtctctttttcccggatgaatcggtcccgaatattgaaggaatattcccttttagagccatcccatcccttctagcctctcaaccaaacacacctaaaaatgggatgatcccatcccatcccgggatatccctccaaccaaacgctaccttaggttgtgaaacccacgcacaactaggggtgaaagtggttcggatagtttccatccgtccggaccatttttcggattcggatagtttcggtcggaactatccggaaattctcggattcggaaatgaattcggattttttttctcggaaacgaaaacgaatacaataagggtactatccatctccgtcggaatcggaaaacagtcggaaactatccggatttttttcggatatccacagacattgagcaaattttagaaaaaacacgtatatatacataactttttcatgcggaatcaaacggagacaaactttatatcaatattgtagagatcgatgagatctacaacattcttattaactattttattatttgagatcatttaagggtctaaatattcattataatataccatattaatttttacaaaatctcatatctacaattcaaacgacatctgatggagatgtgttccatatcaaagttgtagagctcaacgggatctaccactttgtagtttataacatttgtatttgaaagcatttaaagtataaaacaaacattacaagtttcgaagatgtgaagtaaaataaataacatcttcaatttatacaatggtaagtaagttatacatctagtaaaaggtcttgggaatagaaaatgataatcatatttgcatatggatctctaagaggaatagccatgaaaatcgattttcacatacggttgtgggaccgtctacaaaattgacgatataaatgttggagatgttgaactaaaataataagcgatatctcttactggatccagaaactcaatttgagggttttttatataccagtaaatattcgctaccgtattcgttccatctcgtattcgctccgtatctgtatttgataatattcgatttcatttccgtatccgagttttcgattatgattccgattccaaaaaaaaaaatgaaaacgaatatgataaagctagtttccgtccgtttccgatccgttttcatccctacgcacaacctgcccctcctgcctccaacttgcccttaacccatagacaatagtctacgtggtcggtggttccaccaacgggtggtaaaaaattaaccagaaatagtaaaacggaccgaagaagtgttggttttttcggtgtttggttttgccttttgttttgtttatagtgaagctcagtctctagtttgcaaaaactaaaagccccgtataaaccgagcatgctagcacagtagcacctctctagtatgggcctgtttgggggagctttagattttgagaagcagttgtttggtagctagcttctgagaatccggaaaagctctgaaacccagcttctacaccttctggcttcttagttcatttttcagaatctgtaactacagattcccagaagctgtggactgcttggggcagcttctagcagaagcagcttttgggaaaagctgcagctgggagaagctccccaaacatggccctagccttttatgtgcgcagcccaccaccttgttgaaggctttcagcttgcccacttactaactagcaattaaaccagcacatccaccgttgccttatgaaccctagccgccactcgtcgtacactcacaaagtttacgcaggtggccaagcagccttgacggtgactgcgaccgggggaacagaggtgggaggcagacgaagatctacgtaggtggttttcggtggaactgaacccggaaaagccaaaccaacaatactaagagaatcaatttttctggacgagactccctttaggttgcaggcctgtcataattgctcccgcttgaaaaaatcgctcccctgtagatagtgaccccttaagaggccctcatgagaaaatagattttcgtatgctggcaaaggggagtgcaagtgtccccccacacattttttcccgcacaattttttctccttctcctccttctcaacaccgcacctttttctcttctccatcgcacctttttcccactccctctcttcatctctttgttaacactaaaatttgataagattctttagtggattcggttaaggaaagagcacaatcagtcgatggaaagcttatccagaagagtccaagttcaagaacgaatcataagacttgtatctattaataaggcggagtcagttagtttccttttttgttagtgtctgattaggatttgtatcttttcttttatcttcaggaaagtttgagtcgtgtccagttaggactcttatcggccaataggtataactatgtacacccaggatccctgtaatctatctctcgatcaatacaactactctcggagcatcaccaccctctttttcgagggttttatcaccgtcagaacttggcacctgacacgggctgcatcgcttcgatctccgacataggggtaagtcataagttccgccggccatgtcaattgtatcggttatgttggtgttgtccaaggctgcatcgctttgatctcttggattgctctagttcggttggtatatttttcctacccgatatttcaattctatatttaattacattgtgtttagatatgcatcgtttagttgggactgtctcggttaggtctgatcttctgtcttagccaatatatctctacaatcacaatgtcactttagatagatttgttatatccatcacattatataaatttatcgactcattgagtattagattatcatatacaatttaatgtttcatcagttaggtccaacctgctaaattgttattgacaatctaaatcttgttaggccgataggttcatgctaatgtttcattgtagggttagctgatcttatctgatgtgttaaatttatctttgatggttttactattttggttaaatttaatgcatcattaccatgatcggtgtcatattagcttattcaaatctatcaggcaattatcaaccttatgctgcatcggttaggtttgacctatcgggttgtggttgtaagttagatttttttaagtctttaagcatcaatcattgtttcatcggggtttcagctggtgagttatcttgtcggtgatatgggcccggaggtatcaggtttagagggaggaggctcccccgagggggggagtcaggcccgaggtagggtggcggccactccttcctaaagactggatggaggaggctgccccccgatgccacgtggccctcccccgaggggagtcaggcccgaggtggggcggcggccactccctggccgagactagagggagaaggctgccccaggcgccacatggccctcccccgaggggggatcgggcccgaggtcgggcggcggccgccccctcctgtgactaggggttgggctcccccgaccccctctctaggtcaccatgtacggtgggttaagtgtccacctccaggtgcccacctacccgcatttatggcagcccgagtagtcgcgccgtgccgcatttaatatggtgtgcaatgcactcaactggtctgtgaccggtcgaatgaccgatgggactggggtagtgcgcctgtgcgctgctcgtgtgtcaggcgacgtgcagcctgacatgtcccatcaaatagtgatggtgagaggttctcatcctcctatcccagccggagtcggtcccccgctctggtcaaagcaaggctcctgtttcccagtgtaataggagcccagaagtcctcacccattaaatggtgactgacaggggcaccccccgtgtcaggcggcaagatttgacaggcctcatcatcaagatgacgtgcgcttgcttcccaagtcaagagacaggacatgcatttaatgcaaagattgtaatccttctccactaagttatgtttttgggcccatgtggtaaccccttgagatataaaaggaggtccaggcctagtaggagggggggctagagcccctgatgatcaacaccttctaccccaacaaggagatcttataatttctcacaagatcagctaagcataggagtagggtattacgcttctcagcggcccaaacctgtataaactccttttgtctcatcaccttggagggggataactccctcaagatgacacagcttcgctcaacaaaccctcgaatctcacccgctgccctcggcagaactcacaaaggggggcctcacggttccccggtggaggagttcattctccgacatctggcgcgccaggtagggggcgcgttcgtgatttttgaggttctttcgagtgccggtgtgacgagcgtcgcggcgccaaagcgggggaaggcgcagcctcctcaggagtgtcgcgccaccccaggcagaaggctaggcccccccacatcctcatcgaaaaaggccagcggccaggcttttgtggcgagtcttcgaaatgtccgatggcccccaaagttccggcccagcctcactgagaagtacgacggcggcgtcaacccctccgagtccctccagatctacacgatgatcatagaggcggcggggggtgatgatcaggtcatgacgagcttcttccccatggccctcaggggccaagcgcggggttggctcatgaacctgctgcctgcctcggtctactcctgggaggactcttgcagttgagctccaggtgccgtcgaagcccgggaccccctgtgctggctcttccgcagcggctagctttggtctcgccggctggctacggtgcctgacccggctcaactaatcgtcctttcaagtttcaatggtcgcaggcttcccaaatggttaggaacccatggtgggaggccctcttcgagctaacggtttgaaaggtcgcgacatgcaagcaaggtttgtgtttgcttcattcatacaagcgattatttgctataagtgtggggggctacgattcctagctccatcctagccctacgacgagctctgggcgccgtccacgtctggggccccctgtgctggctcttccgtagcggctagctttggccctgacggctggctacagcgcccagcttggcttgatcgtgggtgaagattgttggctatggaaaatttagtcctcgcactcgtgcgaagataatcgtttgcatagaattattatggcttatatttatctctcatctcatcctcgcggtcccgcggtacccatgtgtcgcgcgctcgtttgccccccttggtaacgaaaagtttgtattcgctttatccatccaaacgattttttgctaaaagtgtggtggctacgattcctagctctatcctagccctgcatcgagctttgggtaccgtcgacgcccggggccccctgtgctagctcttccgtagcagctggctttggccccgtcgactcgctacggcgccgagcttagcttgatcgcgggtgaagattgctggctatggaaagttcagtcctcacactcacgcgaaaacaatcggttgaatagatgaagtagaacacgaacagaggttaacaaaaggcaggggcaagcgaggtacgcgacgtgaggtcgcgggcccgagagaatctaacaacgtttgctgaatgtatacagaaaataagtttacagcctaaggtacgggctggcgagtcgccctcaggctggggcgaaaaaggcgcatgggtcctagtgctagcaaagaaagaagaagataccgggcccacatatcatcagactaggagagtggcatcaaccttgaccacctggggaaagttttggttagggctaacgccgggggctactgtcggtgatatgggcccgggggtatcaggtttaaagggaggaggctcccccgagggggggagtcaggctcgaggtagggtggcggccactccttcctagagactggatagaggaggctgccccccgatgccacgtggccctcccccgaggggagtcaggcccgaggtggggcgacggccactccctggccgagacaagagggagaaggctgccccaggcgccacgtggcctgaggtcgggcggcggccgccccctcccgtgactaggggtcgggctcccccgaccccctctctaggtcaccatgtacggtgggttaagtgtccgcctccaggtgcccacctacccgcatttatggcggcccgagtagtcgcgccatgccgcatttaatatggtgtgcaatgcactcaactggtctgtgaccggtcgaatgaccgatgggactggggtagtgcgcctgtgcgctgctcgtgtgtcaggcgacgtgcagcctgacatgtcccatcaaatagtgatggtgggaggttctcatcctcttatcctagccgaagtcggccctcccgctctggtcaaagcaaggctcccgtttcccgatgtaataggagcccagaagtcctcacccattaaatggtgactgacaggggcaccccccgtgtcaggcggcaagatttgacaggcctcatcatcaagatgacgtgcgtttgcttcccaagtcaagagacaagacatgcatttaatgtaaagattgtaatccttctccactaagttatgtttttgggcccatgtggtaaccccttgagatataaaaggaggtccaggcctagtaggagggggggctggagcccttgatgatcaacaccttctaccccaacaaggagatcttgtaatttatcacaagatcagctaagcacaggagtagggtattacgcttctcagcggcccgaacttgtataaactccttttgtctcatcaccttggagggggataactccctcaagatgacacagcttcgctcaccaagccctcgaatctcacccgctgcccccggccgaactcacaaaggggggcctcacggttccccggtggaggagttcattctccgacatatctggattctggatgttgtttaagtgttgcattagcttataaggattatatacaagttggttttagccgattgtagcgaaggtttaattgattccttaatcatttggaattgatgatattggttttctagccgatgtatgttttaatcatcgagactacatttaatattatttctatatcaacatcggtcgattggttcattagatattttgcttcgttacatctatactggccgattggtacattggatatttatttattactttattattagctgattgtctttatatcattgtttatacaagtatcagagtccacatcggacatatagtcgattgttaaaaaccctatcgatatcagcttgttggtcgatcggctctttgatcatccatttatatatctagtcagttgcatgatcaaactgattggcacatcaacatctcaactataatttaggacatgcacttgagctaaatagatctcccaggcctttgtgtttttcacgtcaacactcttcccctttcctctcccccttatgttctccggcggctaaggcggagcaggctagagcgagctgagtgagaacgagctggcggcggcaggttcggatgggcaacaatgatggcaagcggtgacggcagagctcaagggcggcttatttggcaatgccaccctcgacagttactacggggacgactatagcagacggcgacgacaatagtgagctcgacgacaatagttcctccactcgatgcactatcaattacattacgcgatagtcccttagttaattgatttgccagatttaatttttagccatctggacatagtacaatgctatcactctagagtttttcagctttctgatatattttagtcaacgttttatatgcctagatgatttcatgttattgcgtgatggtataaagatcttctctttccacaatgacgtatatcagcaaatgaggttaagtcaatgggcctgggtctatattatattatactactgccgttctatcttaagttatttgtttataagatactaattgataaaattgaacaaataataaattatatattattatttgttttcaatagtaagttatatcttatgattgttatatatatcttcctcttattaatttattgatttgcctcttattttgtgccatagataccccaaagttattttgctatgtttcttggtgtattagtttgtgtgcatcagttctgtctcatgcaagacatgtttatcattaattttcttgtcaaatcagattaattcaatcatactccattcagtttttaatagatgacacgtaaacttttggacagcaatttgttttattaaaaaaatcgtacaaatatataagatatgtttaaagtacttttttgaaaaaacaacacataccaaaataaataataattacgtattttttaataagacatatagttaaatgtgtgtttaaaagttaatagcgtcatctattaaaaaatataggtaatatgctgtaagctattaattcgtgtagacactgtcattggttccgccttacactcagtggtccatctaaaaaatagtccatagaatttattgttatgcaaagtaagaaaacgctgataagatcaatcgcaatgggttgggttctatttagacctaatcatcatccaaatagtattaggacaaaatatttgttggtttttttttgtgcactattgaggttgggtcctatcctaatactctcttggctagacactgctccctccgtttcacgatgtaagtcattctagcattttctacattcatattatatatgtagattcattaatatcaatataaatatgagaaatactaaaatgacctacattgtaaaacggaggaagtactactttaaggatcttctctatacatgatattttttacctataatgtgtgtcctttgatgtgcatgcatactccctccgtcccaaaaaacctaatctaggattgggatgggacataatctagtacaatgaatttggacagattttcagttcagatcctaactaggttaggttttttgggacgaagggagtatgcttatagcttatttatagcatgctattatagaatgggtctagccctcgtacacagagtacgataatgcattggatggtacatacttgtcttacaagagatattcttgcaggctatgaagcattatttattgttggagtcctagctctagtggtggttgttgtgtagattattgtctcatgttttatgtggacaagaaggagcaatgacgacttagatcttaaggaaattgggggacctaggcagttcatataccgagatttgaatgttgcgactaacaagtttttgaatgtgattgggcgtggtgcctttggcgtggtctgccgcgggtccttaggaggctatgaggtggcggttaaaaccctaataaatggaaggaaggacttcatcgccgagctcagctcaattggtggggtgaagcacaagaatcttgtcaggctcattggctggtgcaggcaaaataggttcaacattgttgatttcatattctggtggaggcatgacaaaaagaataagcttttccttgtgtatgagctggtgagcaatggcaacctttgctaaacgcctacacgagggagtactcgaatggacaacaaggtaactaactaatatacacacacgcatgctttatatatatatatatatatatatatatttatatatatatatatggtacaacttattaaattcttttatatatatgtatattaggttcataataataaaggatatcgccaatgctcttctatacctccatgaagaatgccacccgtacatcttgcatagagatatcaagccagacaacatactcctggacaacaacttcaatgccaagcttgctgatttcgggctgtcaaggatcgccgaccccgacaacaacatagtgaagacgacagcccatgggactaagggttatattgatccactctgcatgagggacgcgaccattgaattcgatcgtagctctgacatgtacagcttcggcatggtcctgctagtggtggcatgcacacaaggcacctccagggaacaagtctggcagctgtaccaggacaaatctctcctgcaggctgctgatgacaatttgagaggccagtatgacgagacgcagatggaaagagtactcatcctaggactctgttgctcccgccttgatgatgctaccaagcggcctaccatccgtcaagcattggcttttctggagcacggcggcccaatgccaggcctggagtcattgatcaaccctcgatcgaatctctaaaaattgatgagcaagatgcaattaatagcacttaattgggtccatggatacgtactttgttatactccatttgcgtaattttacctatgccgatgcataatgtgcgacatcattgtcctcatttgttatggttactcatgcagcttccccttcaggttattctcacaaactagaaaggtatgtgcgcggggcaccttatttaattaatgttacttgaattttagttatgaatacttatgtgtggatgagtatttcttaaaatatttttttactctattctgaacatgtttttatcaataatttgtttgaggttgttgtgaacgtcgcttttaattttcttctaattacctttcaaacatataaattctaaaccaaaattatttaaaccgtgtggtttttaatttatgagatactattgtttcacaacaatagtgctacttcatatggaactattacgtgtaccatgtgtgtgtatttttttttagaaatcagcatatattactttggagttatagatgtctattttatctgtttaatggcagacttctatttacttcttctccctcctcttttttttttctcatatgatctcttatattatgtggagaaaatgaatttagtttgaaataagagcggaaataattagtatgtttagagaatttataaatatttaagcaccatagactaaagtatagactaaagtatacttttgttaagtaagttcttattatgacgtgtatttttaatgcatgaattcttatattaactttagtattgtttatattccataattaaccaaacttagtatatacaaaatacccacacaccatacgtatttaatagaaatcaaaggggataaaacacaacatgtactccatccgttattttacttattatttagggtgtagtctacaaattatacatgatttggtaaatagaattgacattttagattatccctgtatagtccgaatagattggaatccacatgataagtatatttatatgatcatataatccatattgttaatttttatcatgatttgtcgtaattctcaattgccatgcaaggctgtgacttgctacttgttgatattgtaaatctaattaagtcgagcatatttgtgaactgatatgggctgaatagagtgcacactacatagtaagcatatttatgtgatgatattagccatatcattaaattgttttttcacgatttgttataattctcaaatgccatataaagcgcaaagatatgacatgtttctggttgatattgtaaatctaatttagtggtacatattattatatccgacaaagaatatatagtgatatatactccacactgtcattttttttataattttcatgtccgtttggattacacacaaagaataaaaatatgacctaaaatataattttttatagattaaagtatagttaatatagatcataaattaagttaatggtaaataatataatttagtaaacttttttttcaatcatcttagatctaattttagttatttatgattataatgtgatatatgacactataacctgtgtttttcgtgtttttttgtctgtgagatataacacaaatggtcaaatcatggatcaaaataatatttattatttttttctaaataaaaatatagtaaatatggattgatttaaatgtaaagaatataattgtggtagaataaaaaaaattgtatatataatttaaaagttacaatagtttatttattatatttatgtactacatttatctcaaataatataggaaaaaatgagttaaggagagggaagaggggctccacattatctgcaattagtgagtatggctggttagttaagtatggtggaacttaaccacctaggtttaagatgtagtcttgacatgggtctcatatttatggctaattatttttgtagtaggcgacgttcccatcaatagcgaggtgcttgtggtgacttcactaatttgaagatatatcattggctcagtctctcgaatatgttttctatggataagtgcacacgcgtgtatatgaactcttgtgtttgtactatgtttctcttaaaaaagcggcatgcattacccttccaaaatgattatctaaaaaatcaattagcaaatttctgtcggcaaagcacgcagtatcaagatgtctcgactaagtgctcaaaaatcaactgacatcacccaaatacccgatgttagtgaatatattgtccaagagccaagagctttgatatatcgctttgttgtagaagctagtagcaacagatcagaatacgaacaacatcaccaaggagtagtataaaatgggaaaaagtacgaattacacccccgaactatcgcggtcgtctgaattacccacttgaaccacaaaaccgaacatttttcacccccgactatacaaaccggacgaattaccccctcgacccaatccacgttggttttggtctacgtggcgtgcacgtggcagtccagtcagcgttttttaattaaaaaattgtgggacccgcatgtcatacacttcttactctgtctattctctctctcttttctctctcgcgcagcgcgcacggcgaggacgagcgcggggacgggcggtcggcgacagtggctcgcggcggcggcggccgagcaggtcgaggagtaccaccacgccgagcaggtcgacgagcaggaggaccaccaccacgccgcgcagcacgacatgagtagcgaccccgataagctccagggcg

SEQ ID NO: 86322 - DNA, 1545 bp, Oryza sativa
acatggcaggcaatagtagttgatgagtttcaggatacaagtggtatgcaatattatcttttaaagacactagcatcccacaaccgcataactattgttggtgacgaagatcaggtgcacaaattatggttcatccatcatcctataatttgaacttgtgatatctgtttatttactagtgttttcagatgcaatatgaatttattttcattctattcttctcattttcagtccatcttcagtttcaatggtgctgatgtctctggctttgattcatttcgtagagattttccaaatcacaaagaggtaattacggcatctctgtaggagtttcctaacatgcactttgtctttgatgcacaatcttgattctcagcttgatgtctgttaattgtgttttcgtgctgatgagtttaggtcagattgagcaagaactatcgctctacacgggcaattgttgaagcagcaacagctttaattcacaacaacactaaacggcaaagccacaaacttgctgagaccgacaatccctctgggaataaggtgtccttaaagatgccacatattgcttcttcttgcatcattccagttacttattctatccatcattttgtatagatcattgttaaggagtgccacagtgaagattcacaatgtgcatttgttattgacaagattattgaaaccacatctagttcagttgaaggatgtcattttggcaaaattgctgtcctatatcgcagacaggttgagaaatcttccacttattgctgaaccatattttttggttgtgtttatggtctaagttacctgtacacagatcactggcaaagcattccaggcgtcattccgcaacagaaaaattccttttaatattcatggtgtggctttctacaggaaaaaggtgcttggattaatttttactcccaatattatcgcggactagcaatttcttgtgatttcttgagttgctttcttactgccaaattatcaatttataatccttggttctattaacattttaaaacatgaaaattactggtaccttttcaaattaatactttagttgttgctgaccataatttttctgtgtatatgatatgaagcattgatttggtaaacacaagtgcactatcatctataattattcaagaaaccaaccatgcaggctgattttgtttttttcaccaaattattttgggaatgttctgtgttattatatggtgtattgtgggggccaagggtcttattagtttttgaccataaagtttgtttggttgctgatcgtagtttccttcttttctagttttttcttcgttgtgtttaaccctggcccttaagggcctgtacgagtctttctagactcactcccctatcttcttaatataatgatgcacagctctcttgcacgttcgagaaaaaaaaggtggtattatggaccggatagggtaagggtcaaaagactgagggataactcaccctctaatagtgccagcaaggcttctccttgctgagttaagagaggctttgaggcttagagctaac

SEQ ID NO: 86323 - DNA, 2158 bp, Oryza sativa
ccataacaattcttccaaatgacagaattggcattttttatcacccttcctccaaccttttttaaacaagttatctttagtcagaatcttgttcttagcaaacaaccaaataaaaatcttaattttcaaaggtattttgaatttccagactttcttaaaagggaacaccacctgtttcattttgagagctttataaaaagttctcacactgaacttgccatctttactaatactaagttcccaccaaactttatctctacaatgtgcattgataaccagggagtcccaaccagccttgattttgttctagtccctaagtttttcactatgctaatgctatcaatccccttttggttaatatttgcaattgtcaccattttttttcacaactatattataagagcaattttatggtccttgaggaggtactatgaagtaccattttttctattataaatttggtacctcatggtatctaagtactatgaggtaccatgaggtaccaaaatttactaaaattttggtacctcatggtacctactcaaggaccgtagaattgctcatattataaaggtcaggaaattggtcacacaaaggtctactcctatccagctgtcctcccagaagagagtatctttcccattgcccaaaatttgtgtaacatgtttgtaaaacagatctttaatctccatgatgccctgccaaaaatgtgagataccaggtttctgttttactgcagacaaaggttttcctttcaggtatttctctcttagaatatcttgccaccacacatcctcattttcaattctccacacccattttcctaacatggctttattcattatatctagatccagtacccccagatacccccccccccccgatctctaggtgagcaaaccagaagccactgaacaaggtgaaactttccaataccctaatcttcttgccacaagagcctccttttaaaatagtccatcctatccctaacaccctgtggaagtctgtagaaagagatcatatacaaagggatattggttaggcttgaattgattagcaccagtctccccccaatagactggattttgccttgccaacatcctaacttgtgttccattttattttcagccatcttccagtctttgttcagaattcttttttttgtcaatggggatacctaaataggtcatgggaagctctccacctttacaggtgaaaatctaactgtacagggattgcttctccttagcctccccaaaacaaaacacttcacttttgttgaaatttattttgagaccagagagctgttcaaacagacacagctagtatttaagatgtttagcttgttcaagatcatctgacagcaagaaaatcgtgtcatcagtgtattgcaaaattgcaaccttgttatcatcatttatccccaacccctctatcaactcattattcacagctctctgaaccagcactgtcaaagcttcagcagctagattgaaaagcaaaggggataaaggatccccttgtctcaatcctttatgtcttgaaataaggcccaatttgatcattaaccttaacagccacttaccctcctgtgatcacattcatggtccaatcacaccatttatcaggaaatcccttagcatgaagcattctataaatgaaggtccaattcaccttgtcatatgcttttcaaagtctactttgaataaaatccaatttgtttgttttgatgcactgagttaagaatctcatgtaaaataacaacacccttcatgatgaaacgactcttcaagaaggcagtttgatatttggagatgatgtaagccataatgtcattgatcctattcatcatcacttttgttatgattttaaaactgacattcaaaaggcatattggtctatacttaacgcatgtggctattacggtagctcctttattgtgagtatcttacactcgaattgcacaaaaaaatgccgagataggagcaattcaagaaattctaatctgcacgcaataaactggtgcgcgctatttaaccttttcttctgcaagggacacaatggaacactatatactcctcatgtatagacattaacaccgcaacagccgtgcaaaagggtgtagatcttgacatattggatgctttacggttaggat

SEQ ID NO: 86324 - DNA, 8992 bp, Oryza sativa
ccgtcgccgcgcggctccgccccacgctctacttcctccgcgcgctcggcgtgccggacctgccgcgccgcgccgacctgctctccttctccgtcgaggacaagctcctcccgcggatcgagttcctcgagtcgctcggcctcccctcccgcgccgcgcgctccatggcgcgccgcttcccggcgctcttctactacggcatcgacggcaacatgcggcccaaggcggagtacctcctcggcgacatggcccgggacgccgacgacctcttcgagttcccggagtacttctcctacgcgctcgccacgcgcatcgcgccgcgccacgaggcctgcgccgcgcggggcgtcaggatgccgctgccggccatgctccggccgggcgacgacaagttcagggccaccctcgccggctgcgtcggctccacgccgccgcggaggcggtcgccgctatggcacgcctactgggtggacgacgccggcgaggtggaggagatcggggcggcgtcgcagccgtgacacgcgacgcgacgcgagcgcggcatgtgcattatttagtagtaagtagcgggcgttcgttgcctgtgtaagctgtgcataacccacattgtcatcatctcagtaagtaacataaatcatccggttgatttctcctgttaatcaatcatcaatggaagttcttatagttcacactgatataccttcagctaatggcaatgggtccccattacactctttaaggagctccctctatttacttttgatagtcatattttatattggcacacagactaaggataagtaattctacttatcatccatttaaacatgctactagtcattcctcgtaaacaagcaattcattaatatttacatttctcaatacccatgtagccaatcatgtgtggaagaatggagagtcacgcattaaatccgagaaagtcattaagatgatttcagatttgaaaatatgactatcaaaaataaatttttcagatttaaaaatatgactatcaaaaatagatgaagggagtagtatactagatagatttcttagatcaaaatggaacaagttagtcgcagttctgaacaacctacatatatagctctcaatctctcatcaatttgagtcattccaatttttataggctcaatacttcaaatccgttttggtagtcatttcagttacactggcagctcaaaattttcgcttttgcatcagtcagacttgtttgatccaactccagactccagtgcaatgtttatttcaccttgagaagtcgtgtatcttcttcagaacttccctatgaatgctggatccttcagctcgtcctacctcaagcctgccttgatttaataatttctttctttcttataaactcagaacgtgtgaagccacaagaagagccgtttatctctctcatactgcatcttttactgtttacttaatctttttaaaaagtaaagtgtactttggactaccttttgttacctcaattttacatcgaaccatcatttacttaatctttttttactgtggatttttttttcatttagaccatcaaaactctttttgtgagcacatcggtaccctatgtcggcacatcggcattttggactaggttagatatgggtacacagacgcattagggtggtccgacgacgattttgataatttggtccttttaccaaacttattttacaactagatcttgataaaaactaaaacaaaaatattcctttacctcagcatcataacccttggcgttgagactcaatatctcagcaccaaatccatttagtgatgacacctctaacgtaaaacttaaaatggtactacacgcaactagataagcaagtgaatgtggtgcattggtaagtggtcttgttttgtcattaagatcatagtttgaatcgccactgtcgcatgattattatttttttttgacaagaggctgggagctattccgaagtgataaaaccaaactgagaaagtcatggcagtgaaaccgaagaggtggcgccaagatgttgggtgtcagtacccaggtccataaaactaaggtagaggttcgattttggttatagttttatcaagatctatttataaaaataagttttatcaaaacgtcaaagtgtcaaacttttcgatggtccgaagtataacaaagataaacatataccagtcaaaagtaaaagaatgagataaatctagtctaaaagaaaactaacgttaaaaaatctcgaattataattcattttttatttatagtattaaagaatgttgcagtttatggcgactaaattaagatcagacagtccactcataaaaaaagagtcatgttcatcttgagccgtaaacttgaccaagttcattgcacctttgtgtagcagaaacggaaattaagatcagacagttcactcataacaaaaggagtcatgttcgtcttgagccggaaactcgtccaagttcaatgtacctttgtggagcagtggagcagaaacgggaatatcatacggagtacaaaacagtgaatatagatgaagatttgtttagcaggtgaaaatatgtcccagtctctaatgtatacacggtaagacgatggagccaaaatgtcacggtatcttgttgcgacacaggaatttgcgtaatggatcgaacaacccagataatgcactttctttttttcccccttagaaacacgctacaaacgctgagctcacaacaatgcatgctcactccatgaatacgcacaagcactctacccctgtaaacacttttaaaagattagactattacatcttaatattaatattaacgaagtcatcacatatttctagctatttaatggatgtaacatctacttctcaaagcatagtaattagtcgtaaatgccaacactgtaggtcaagtctaaaacttaaatctagataggctggttctactctaaaaaatcttagggcacgctcattttgatgtcattttaaatcatatcattattcggtaaaattaacaaatacgtataagtttattattagatactggtaatacttaggaagttttggtaacatcacatttagcctatcctaccaaaatttagcaatattattaaactaaaattttggtattactaaattttgaaaagagttcattttgatactaattgtaacaacataaacgatttttgtgtacgagaccttacaatttttataaacgggcaacaatttgccgcatttagaaaaattaagtagtattttcacatacggctacttaagacgctcatatgaaaaaaatcgatttttccatacgggctcttaactggtccgcatacaaaaataagctgtactattcgataatatttgattcctatttcatatccggatttctgattccaaaaaaaaaatataaaaaatatgatagagctagattccacccgtgattcgttttcatcctagcaaacctcgcaaaaccgtcattcgcgaaacgtcatgttgttgtgtacttattatccgtttggagggcagggccggagggcccgttggcacatactggtcctgtgggcttttaagcggcgtcgccggtggccacgcacgcacccaactctcacctactctgcttctgctgccctcctgcatcgactcactcctccactcccgtgtcgtcgtcgtcgtcgtcgtctgcttcgtcggccgccgcgcgccgcccgcgatggcgtcgtcgggggacagcagcggcaagcagcggagcgacgaggagtggcgcgccgtcctctccccggagcagttccgcatcctccgcctcaagggcaccgagtcagtatccatctcctccccttcttccccctcctcccgtcgcagctgccagccacggcaatcttctctagttattagtcgccatgttcgcccatccatcatccatgtgttatccatggggaaagattcgattccccatcgaggaaaaatcgccgcgcttattagccgcacccgcagttttgtgaatcgatgatccgtgcgatgctgtcgttcccttcctgcctgcctcatctcctcaatgggctcgtgatggatggattgctgccgtggggatttgtcgattgagattggattggatggagctagatgttcatcaaatgttctcgatttgttgtgttattgggtgtttttttttcttttttgccacaccacgagtgattctggccctctaaagtgccattgactttgttggtctacttaactatgcttcatgccaatgcttattggagcctcctataaactactgcaagttggcctctcctcatataattagtatataagccaacatgtccaagttgacttacgatagataccaaggaatctggagggcataggggatgtacggtcagtggctgagtgccacttgttaaatctatattttagttataagtctgttcatgcctgatgggattcacaaaccaatataacagagccattttctgaaaccatgatataatgagagtgtgtgcagaaagaatgacagagctgatttgagtgttagacttcccaaaattacagattcatggaattagtttcattgcaagttctacaaaattctaaattggattctggaaggtgactagagcgctatcctaatctaacaaagggatgtatttgtttgtatcactattgttttccactatggggatgcaatctaggctctttatatgtccactcctttatacaggcactggttcctggtggaaaatatacaggcgctggaaacgggttagtacatgtttataaatgatttcaagtgtgtgacacttggaaatggaatggttgccctctcatagagtttagttgaataggaaattaaaagttagtgctaccttcaacattccttcatgtgtacataattagacatccatgtgtagtgttaattgaacagttgttatggaccaaaacctgtttgacatggcattacgagctttagacattcaaggtgcaaaactgcatatttttggaagcttatgctgctccatagcctgtgtctcgtagaagaacagaacattgaattatgtggaactatggatttactggtgcaagtccattctcaattactaggttgattgaactctgaatgtgttatggttatagggaccagggcagcagcatcccagcccttagttatttaaattagaagtatggttaaattggaaagggttagtttgggccttaagccattaggaactggaataagtaagagttccaattgttagggccacttgcacaaatataagttaactagaaaagtacccgtgcgttgcaacgggaagaaaagacaagaaaattgagagaaatagagtgtggttggcagatggcctagtgagatgggttgggattccaatttctagcaatggatagaaaagatatatacctttctttatgataaaacttaggttgtcgattttattttaaattctctctgatggttgcaaattagtcctaaaatcttgtagtcgcagttgcatggcatttaattttctcccgcttgtcatcttttgtcttcattgattttactgcttttgtgtgagctaagatctttttttctattgagccaatatatttttcatcctcatctgtaagagagaaattctcggtgtcatctaactccggcatatcaaacttgaactataatcaaattaaccatctctatgcccattgcccatataaaatttgatttcattgttcaaatcatctgtctcctaacccatgcattgatgcacacgttaccatatgccatggaaaagtaatcggtcaacccagtaaacaatatctagtcaaatcttgaacagtaacgggcctaaatcaaactagcccaaaatttcccttttcttttcgttctatttttttcttctggccagatggctcctcgccacctcaaatgaatacgtagtatttttattatgctgaaattgctaggccgttaggctgaatcggattgctcgatccagcaatctcacgacataggaaaaccgatgtgcactgtgacaatgtaaaaaagaaaacagaaacgattcgttagcgcgcaagtcacgctaaactgacacagacgggccgaacatgcggacgatgtacacaggactcggaaacaatgaatgaggattaggacactgcctcggaggatcggactaattgacggacgaaccaaaaaattgtttgaagcagattttagaatatctcaagttctccctcgccttgttgtccctgacttcctgcacgcgacgtccttgttgccacggttctcttccactggctgccgggaacaacacctccattgaaacaatcactactagcccataacaaaatgaacggtcaattgctaggtggattgagctctgattgaatggtcaggctgtttagattttcctcaattatcgtcacttgagaggtaagctgtttactgacggatatatgttggaacactgcatatggcatgttgtcgggtaaaatagcgtagttattaagaccatgaccgctttgtttgttacttgatgtgaaatgatttctagaaatgttgctactatgctgaagcagatgtcctttcaaagatattactaaactctagtttccatccaggttacctggaacaggtgagtacaacaagttctatggtgatggggtctacaactgtgctggctgtggaacacccctgtacaaatccacaaccaagtttgattctggttgtggctggccagcattttttgagggacttcctggagccataaaccgaacagtacgcttgcataaccatttactaaatccttaaaaagttctttttttctcgtaaggaatactgaattttgtattgcgtttttgtagccggatcctgatggaaggagggtagaaatcacgtgtgcagcttgcggtgggcatttgggtcacgtgttcaaaggagaaggcttcaagacgcctactgatgagcgtcactgtgtgaacagtgtttcgatcaagttcaccccggcctcctaaatcctttcccaggtcattattattggaggtgaattccccagggctaaagctgtggaaagcactacaaaataatgaataaaatcacagagacatatcctgtttgtccatatatgaattcatctcctgttaatttagctgtaaacttgtaacttaacattgctgggaatggtaaatgaatgaataaatgaatctggttcattagttactgctctgtatttcacgttgctttgttcaattattatattatattcaaaccatatggttaactggttaagtacaaatgtgggtgtggccaacaatttcttcaggtaataataacttaacttagcaaagtactccatgctcattcaaatcatccttcgtactatatcctagtggggttgtttctcagatgtattgcacttgcagcacaatatcagtttgtctttggttcgccaaaatgtactattctgaaacaacttgaagtacaattgattatattttggccaaacaggtagtggcagaaactagcttccaggcataccaagattttctgcttaattattgctcagataaactgtgtactccacccggatttagtatccgtacagtagaggatgcggtgctgatggcgacggccaacgtgtgcatatggtcccagtgttcgtaatcgatcggagaggagcagttagatgagcatgcatcatcaacttttcacttcgtcagtgagggaagggccctcatgtttaggaaattgaccaggattattcagctaaatgaacagtcctgacaatatctcccttcaattacttccagattgcagctttgcaagcgcttggccttcaaaagaaattttgaactttgtttccttttcaccccgattacatgaacagcaggcactgcgccatcatattcaccacaaaagcccacgatcttagcttcattaacccaagagaaacttcaaactttctattgctacacgtataagaaagggatctcctatggaacatttggcaaaaaatccctttgatctcaactattttttgattgtatgattgcatcaatagtatattatccttccggagaagacaaggagcttccggagacagaggaagagtccgagtacgattcttgacacggctctgataatccaaaattcgatagaaaacccatcaaattcctgtcaatgattgcatcgcaaaaccaattataaaagttaccaaatgaagacattacttgctgtatcaattataacaataatcctgctttaagtaactatccgtgctgaagcatatccgtgtttctgggatgcaggaaaatcctgccaaaaatgcgactctgtgacagctttgattgcctgataccgaccgtgtaccgtggctgtgtgagtgttacacaaaccactggaaccagtacgtattttaaccaatcaaacggctaaaaattgcacttatatatgcacatgtacacactacggataccaaacgactctttaattacgtcattacgctactacgacgaggaccatctaaaccgacgcacaaagtactcactcatccctctaccacgtatagagagcgagagctacgtcgtcgaacactctaggcgcgtgtaacgcgtgttcaccgcggcggcgtcgccgtcgtcgacgtccatggcgtccacggtgaggcgcgcgttccggtgcctcctcgacggcctccgctccctgccgccgcgccgcccccgcgcgggcgccggcggcggggccgcgcggaggtcatccaaggcggcgccccgcgtcgtcgtcatccgccggttcagcggcaagctggatcgccgtcgggccagcgcgtcgggagggccgccgaccccgcctgcggcggcggcggcggcgcccgtcaccatccgcgtggcgacgttcaacgccgccatgttctccatggcgcccgccgtgccgtcgccgccggatcacgacgactacgacggcgacggcgaagggtgctccacgtggcgcgccccggcct

SEQ ID NO: 86325 - DNA, 953 bp, Oryza sativa
gaatgaacccggcctccaaaagtctagccacctcctcgcggatgaaggcttgacgttccggggcttgccgccgcactttctgccggaccggccttgcacccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcctggatgggccgtcgcccaaggcaacctccttgaccgggacctcgtcgcaagtggccatccgctgcctcggggcggtgggggcagaggggccaagcctctcgtcaccaccctcgggcttggacgcagcagcgaggcggtccgcgcgctgctcaatgcaagcaagcgcgactttaaggtcgccacggacagagatggggccaccggggcccggcatcttcatctggaggtaggcgtagtggaccgccgccatgaacttcaccaacgcgggtctccctaggaccgcgttgtagggcagactgaggtccgccacatcgaagtccacccgctccgtgcggaagttggcggaaccaccgaaggtgaccgggaggtcgatatgacccagcggccaggtgtgccccggcgtcacaccgatgatcggctgggacggccggagcaccatccccggggccttgatggcgtcaaaggctgcgggggaaaggatgttgagggctgcacccccgtctatgaggacacgccccaacttcacattgcaaacggtgggggaaaccaccatcgcgatctgtcctccccgggcaacgcacggcgggtggtcggtctggtcgaaggtgagggcaacctccgaccaccgcgcccgccgcgtcgcctcatgggtaggggccgcggccagaagctctcgcttcatgtccttgaggctccggcga

SEQ ID NO: 86326 - DNA, 1071 bp, Oryza sativa
caagattacacgcggtggacaagaatgaccgatctgtgaccggtctgacactaatcatatcgtcagcgcacagccgtgttcccacgacgcgctcacccccggcggaagtggaggtaggtatgggcagtcccatcggagtgtcattcgaacagcaaccgtgctgatctccgcccattctagagaaaaagaacagtccagtttggaaagagaagggtgcatgtggtatccccttgaagtataaaaggaggaccttgcccatggggtaaaggggattgattcttttcaagattaggaacttagaacgggggagaagagagctcacacttgtagctcattcatacatagatccaccaaaacacaggagtagggtattacgcttctgagcggcccgaacctgtatagatcgtcggtgtctcgtgttttctggctggcagacaatctttccatatacagagagagagagagagcttgagatttcaccctaagcccccggccggactggcaaagggtcgccggcctcgtcgccaccgccgtcctcgctgctggtgtcgccttcctcgtcggagctgggggcgaacgcgagccgaggggccgagccctcgaagccgttgacgatgtggtcagcagcatccccgacccgcgcgcgcgcctcgtcctcggtcccgggagggaactcctccagcgccatccatggggagaagttgggatcccgggcctggtaactcgccagcacgagttcgaccgccccccgggcgaggtccctcgaggatgccttaatggtcttctcgagctcctcggggagtcgctcgagaacccaagccatcctgttgaggtgcggagcgaggccttccagattggtggggggcaccgtcgtctggcctccccagaggcctgcttgccgaccggcgcgcttcatgcgggagaccgcgtcccaaagcatgccgggcccaatctcgcccgccaagcgaagggcctcggcctccccggtggaggagtccagcgcgcgctgcatgtcagcgacggtgtgttcggcagccgcgaggcgagcggctaagtcgctttcgcccgcag

SEQ ID NO: 86327 - DNA, 1705 bp, Oryza sativa
attcctgcagcctctgggctgagcagtaccgtgcgaaacaggtgccgtaggtcgaggtcctgctccgacggtaggcgcgcgaggccgtggttgtaccggaccagctggaggtacgacgtccacggcgctgtgacaggagaagacgcgcatgaccgcacgcatcttctcctgcatccggtcgaaggtcaccctctgctcaacgtcagtcaagtgcaaacctctgttcaacctcatttggactgcggtgatatcggcactgatatcccgtgcggcatcagcctatgcaagatggaaataaaaaattcagtagttgtcctatattatgcaagataaatgaaataattgtaagaagtaatacaaattggacgtaccgccacgaagtagtctcggtcacggtgcgtgggatacgcgtccgtgacagcggcaacgtgcggctctggggcgtctggagtgaaggtcacacgcgcatgagtgcgaggaaggtaccagcgaaggtagacacggtagttctcctccgtgtgtgggaagagcttgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaatccgcctaaaaatttagaaatgaacaatccgaactcacgagtggtcggcagggaggacggtcggctgcacgttgcccggaaacacctgcctaagtccgaactgtctcatcacacgctgtgggcagtgaggctcaacgaaaatatcgaacaccatcggcaggatggtgagccagtaagcctggtcgcgtgtgcacaaggacgaaagtcctagcggtgctctcgcagcgacggaaggtgccgagctgtgcaccctcgactgctgacaggaacgagcggtggttcctgtcaaaaccacggttcaacagcgccggtgtgtcgtacaccatacctgcatcaaataggttgatcagaaacatataaataattagttcaacataagtaataaatgttcataagcgaattactaacacatattaaacaagagtacaaataaacaaaagtgtttagtccgaacactcatcacgataatattatgatacaacaccgaatagttcgcaatactactagtacaacaatagtcggaggtactcattacaacaacattgaattgaaattacacgatagaagtatttagtccgaacactcattacatcacaacagcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattggga

SEQ ID NO: 86328 - DNA, 1769 bp, Oryza sativa
tatccattgatagtgtggttttgtgaaactacactaccaaaatatatgtacttaagtgtcaagtatcaaagtgtgtgcggttttctgcaacttggaccacaaaacgtgtagttttgtgaaatttactctaaacgttatggagagatttttgaaagttacatacatgttacattatagttacagtgtaattacactacgattgtattataattacatctgtcaaatttttggtggaaaatttgtcgacaaatatatagcaaattcgtaaccttgtatattttgagacgacataatcttccaaggcccaattgcaatttgcaaaagaacacaaggacaggcgggccttcagggaaaggccacatttaattttgcagaggtcttgcaagtccaatgaagaaccagcccatagctgaagcgagtgttactgggccatcaaaaagcccatttatctctgttacattccgacaagaatatgctaaaattgcgtcagttcactcggagctagtatgtaatgtatgtaagcaaatccgttgattagcagattcactgattcagtggttggttttgaggaagggcacttgaagaggtgaaggaaccagtgcatggcattgccaataatatactgtcaactgctctgttttgcaattagaaaaaaaatgtgctaacctaccaaaacaaccacctcttcttagctcccttgcgcttgagaattttggctttctcccttctccatcccacggaccagtgcttccatccttttcctgcaaagacaaaaacagaacagcgaaaacgcaaacttgacacgcaaaaacgaagatgtaagcccatttctgaactcaaacaattgaaattttcatctggagtagccattcaagaagcacttaacgtatcagtgtataatttgttcaatatcctaatgagcatgggtgtaaatatgttgtaacagttcattctgctctatcaatacatacgaggcaaaacttttgccctcttttcaagagagagagagagagagagagagagagagagcatgggtgggataaggccccttaggcctagtcgggatttcttgctgtctcagatgatagctgaatattcttaattgcgaagtaaaagaaattgacaaggcctttattttcagatgtttacatattgcaatacaaaccaatcatctggatgtgaataaagaaactattcaaatgcatatggattatataacacaataattaagcaccattccttcactagtttgtcaatatttgaagtacatgttcacaagttacaagtgagcccattcgactatgacagagatgataaaaacacatgaacaatgcaagatttaatacctcgtatcctcgagctgtccatgcaagctccatctctggcgaaatccctccatgccctcaagcccactagcaagaatcatgcgcctacagaagtacgagactacatacaagcagaactgatgaaatcatgccgatgaattattaacaaaaactcagtacacctgatgatttcttttgtccagtttaatctaatcaatacaattagaaaaaaagtctgtaggcaataggtagtgttcttaaaagcaaaagtctgtaaatcattttatacggtgctgaagagtggtcacaaggcaatttaacgtgtgcttggctttgtccctggtgctactcattgtctcgtatgcctgtagaacagcagaatgcgtagtattggttacaagtgtttcacagagcatcggcttaacttaactaaacagtaaacac

SEQ ID NO: 86329 - DNA, 1379 bp, Oryza sativa
tcctcgcaggacctcgtttgccttcgagcgcccctagcttcggagcagtgcgacctacagcaccggtttcgcacggtacagttcagcccagatattagttcatttttgtttcagcttttgcacgaatatgtcaccatgttttaactgcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgtcgatccctcgcccacacggtactttactttttattactactgttaaatacttgtacgaaactgatggtccttgtccagcaggatttgcagccgggatcttcggtactggggcctcttcgtctcacgccggtaggactggtcctactagccagttctacgacgacgacttgcacagtgcacaccaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacaccacacacgaaaatggaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacaatccaaatatgccctaaaaaataataaaattgtattttaccagtcttggagattttaatcttgtatagttttcaatataaaaagatttgataactattgatatttatac

SEQ ID NO: 86330 - DNA, 1018 bp, Oryza sativa
gcataataggccagccgtgtaggcggagcaccagtcggcggcgacggaggcagcccggcggtgaagtagtagacgcccaacagcggcggcataataggccagccgtgtaggcggaggcaccaatcggcggcgacggaggcaagccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaagccggcggtgaagtcgtagacgcccaacagcggcggcataataggccagccgtgtaggcggaggcatggacgcccatgaacggtggtgtgaccaaccaaccgtataggcgaggacaccagtcggcggcgacggaggcaggccggcggtgaaagcgtagacgcccaacagcagcagcataataggctagccgtgtaggcggaggcaccactcggcggcgacggaggtaggccggcggtgaagtcgtagacgcccaacagcggcggcataataggccagccgtgtaggcggaggcaccaatcggcggcgacggaggcaagccggcggtgaagtcgtagacgcccaacagcggcggcataataggccagccgtgtaggcggaggcaccaatcggcggcgacggaggcaagccggcggtgaagtcgtagacgcccaacagcggcggcataataggccagccgtgtaggcggaggcatggacgcccatgaacggtggtgtgaccaaccaaccgtataggcgaggacaccagtcggcggcgacggaggcaggccggcggtgaaagcgtagacgcccaacagcagcagcataataggctagccgtgtaggcggaggcaccactcggcggcgacggaggtaggccggcggtgaagtcgtagacgcccaacagcggcggcataataggccagccgtgtaggcggagg

SEQ ID NO: 86331 - DNA, 1801 bp, Oryza sativa
tggattgcattgttaaagtacatttttttattgcagaaccaaggaattgatatttcagacaatgagttgcttgatttcatatctgagtctagcacaatgagtaaatccctagttgactatggagaacaaaaatcatgtgctgtaacaacagcaaaaagactagctgaattcctcggggattcaatggtaaaagacaaagggctgcattgccaatacatagttgcccgggagccacaggtaagtactgaatagttcaacaattaacatcatgcacttacccattcctttaaattttgatagttacggtaccatatttcaattttggatagtcacggcatgttcctttcagtgggcaaatattccctttattttgttttcatggaatttgtttattctagttttcatgatttggcttgcttttttccaatattcctactgctttgttgacttgctgaaatcatgtagggcactccagtgagtgagcgtgctattccagtagctatctttgagacggatgctggtattattttaccttcaaatcatgtttttgcaagagccaaacttttcaatcacttacattctcttgctatccttgtatcttacagaaattgcaaagttttatttaagaaaatggtgtaaaatctcctctgaagcgagcatccgatctattgttgactggtcttactataagcaacgcctaagctctgctattcagaagattataacgattcctgcagcaatgcaaaaggcaatatattttttacttgttactttgattatattatatactttttacttgtcccctttgattttccatgacatttgtgaaatcatgttgctacagatttcgaatcctgttcctcgagttcttcatcctgattggttgcacaaaaaggtcagagagaaagatgatcgatttcgccagcgcaaactacgtgatatgttcaatcctttggagaaggacaggggggtgcagaatttggatgggacaggagatatggaagatttattaacgctggatggtggtatgagaaaaagtcatgtacccaatggttttggaaaagaaaataaaccaaacgacgcaccatcaacagaagctggttcaaagcatagcaagaataaacaaaaatctataactaggtcaaatgaaccccttgccgtacatattcaaaatgatgctgctgatgaacaagttgatagaagtactgattatcaaggatggcttgatgctaagaagagaaaatggaaatatgttcgtgagcaaaaaaagcgtcaaaggtatacaaatttatgttgtacacaaattccaactaatttatgcttgtaaatgatactccgttctacattttaagatgttttggtctcttcatccttgtctagattcactaacatccatgtaaatttggacacatgaacataggatctatgcatatctattcaaaacccaaaacatcttacaatgtgaaacggaggaaggacttatagattcagttcatttagcattttgttcctctcctagctctcaaacagactactagactaatcctggacttgacttcaagtttgtcatagtaatatgtagcggttttaggctgatgatagtaagcttacattttgccagcgtgaatcagccttttgagcatcgcattaccttataaatcctaagttacattgatatgatggactggtgactatttttctttgtattgtcactgttaatataatggagattacactaagtaaactaaacagctaatggagggaagtcaatgtttatgtttcctttttgcatttaccaggt

SEQ ID NO: 86332 - DNA, 1997 bp, Oryza sativa
aggctcaaaagattcgtctcgcggattccaggcgagttatgaaattacttttttcattcgtgtccaaaaaccccttccgacatccggtcaaacatccgacgtgacacccaaaaatttccttttcgcgaagtaaacaggccgtaaattccatgatgtttgactcagaagccaagtaggagtagctcgaataactggagaaggaaacgcgattatttatatttggaaaaagtacgaaatctatcgcggtcgaccgaattaccccctgaaccacaaaaccggacattcttcacccccaactttgcaaaccagacaaataacccccctggctcaatccgcggtggttttaatcctatatggcagtccagtcaacaattcatttataaaaaaataggtggcccccacctgtcagtttctctctcttctatctctttcccaatatctcactctctctctctctctctcttcatcagtgttccatgagaggccgcacctgttagggccgtcgccgccgccgacgtccagaccggccgccgcgccatgctcaacctcatcgccaccgggatcaccggcggcgccctcgcataggcggcgctcgccaaggccgccaagcccatcaagctcggccccccaccaccgccctccggtgaaggagaggttctacatgcagccactgccaccagcggaggcggcggcgagggtgaaggaggcgaggcggcagcgggcgcgggctattggcggggcgtgatgagctaaggtcggcgctgggggtgggtgcggaggcgggcgcgggcggcgggcgggcgcggaggcagctgcaggtggcggggcggaggtgggtgaggaaccgatgacgacaactgggcggggcagaggcgggtgcgggcggcgggcgaggagctgaggacggcagcggggatggttgcgagcggcgggcgggcgacgaggcatcttctggcggcgggcgggcgaggagcggacgccgatgggtggccggcggcgggtgatgcaagcggctcttccgcaatcgcgcctccgtgaggcgcctgccgatcccgggcgccgatgacgagcacgtcggactccatcgacgacgacgacgagaagctctgcccgcggttgtacctcttcttgacactggcggcggtgcccacggcgagcgtgggctctagctccgccgcctcctcctcgtcgtcgtcggtctcctccacgtcctcctcctcggggctctgcgtgtactcgaccgccgacacgagccacgggccacgggcagaccgcgagccacgggccgccgtctcgggcgacgccgcctcacctcgcgcttccgccccgtccgcccccgtgcaccaccgcccaccgccccggggcgctgtcgccctccgccgctcgccaccagccgcgtccgccgctgccacttgcgtcgccgcccacatcctcccctgcaccaccccacgaccgtgagagagagagattgaagagagaggaagaggggaagggcatgtgggtctcacatttttaaaaatagaaaatgctgactaggttgccacgcgtacgtcacgtaggacaaaacctcgaggggggtaattcgtctggtattgaaagttccgggtgaacaatatatgatttttgggttcagggatgtaattcggtcgaccgcggtagttcagaggataattcgtactttttcctttatattactggtagcaacgcatagaaattttagctggtctggctgaccggccggccgagagctgcagagaaatttcttccattctgaaataatagatgtttaaaaccatgctcaatcacacacacacacgcgtgtaatattaagatttaacatgtgaaaatggcaccaattatatatttctgttgtagtgattttagcttgtcatttacatcatagtctaataataggaacatgtttctcatttctttaatcatatatacgtaaaatcatttaaaaatatacaacagtgtgaaaatatttttaaatgatt

SEQ ID NO: 86333 - DNA, 3071 bp, Oryza sativa
attaataatagactgtaagagatcagcccctaaaacaaaaagaagaggagacaagggatctccttgcctaacccctctcttgcagtaaaaagactttctaggaacaccatttaagagaactgaagaagaagcagaagtaaagattttctcaatccagcctagccattttgaatcaaaccccttatgcctcatgacatccaaaatcacagaatgctctatagtgtcaaaagccttttcaaagtcaagctttaacaaaataatttctctcttggatttctgacactgatgcaaatactcaaaagaccaagcaaggcaatcttggataatcctagctttgatgaaaccatattgattttggtgaattagactaataataactgattgcaacctgtctgctagaaccttttttattagcttgagagctatactttgcaaagcaatgggtctgtaatcattaaccttctcagggtttggctttttaggggcaagagttatgaaactcctattcagactttccaagcagagagtaccttcacaaaactgagcacacaacatatagaaatcttgcttgatcaaagggcaacatttttttcataaagaggccattaaacccatcaggtccaggggccctatctataggcattttattaacaactccatcaatttcagagatagaaatattatcaaacagattgataagtgattcacaaggtgataaaagctgactaagctgaaaatgcattttgggcttagaagttacccccatcctttgctgaaaagtctagaaaatgacagcagccttctcagcatgcccagagagagagataccatcattagatttaagatgagtaattagatttcttttgtatcattctgtagcagctgcatgaaaaaatttggtgttctcaccaccaaacctgacccatctaacagtacatctcttttgcaatataaatgtatgtatctcatatatagaactgctttccctttgataatatttctcagattccactcagccaaagtaagatccctgagttcgtctattctgtcaatgaaagaagtgaccaaagagcagtttttaataaccaaattaagcctgggcaaacccttgctccacttttttaagcccttccttaagcttttgaacttgagagagatatttttagctgaatcctggcagttcccattaccacaccaaattgaagagaccaaataaaaaaaaaccttcatgctccacccaaaaattttcaaacccaaacagatttgttttggggatagaagttacaatttgaaccacacaaggtatatgatctgaaacgactcttgagagagatttgactaaagtatttggatatgaggaagtccaagaaactatggtaaaaaaccagtctcattgctcaagcaggggagaatcttgcatattactccaggtataggccttccctttaagaggaatctcaagaattcccaaattactgataacctcattaaaaaatcattatatcattcatattagcaccatctctatttctattgtcaactgatctatagaaattaaaatctcccataaggatccaattctcattatcaggaatatctaaatcatgaagccattgcacaaaggccgatctatctggttcatggcaggggccatagactactactagagtccaacattcaccattatgcttggaacaaaattgaattatgactgcagatctagagatgctgatgacattagcagagaacaaagcaccaatccagcaaactaaaatgccaccagaagctccaactgagggagagaaacaaaaagaatcgaaccgttttggggctaatttctttatataagcagtgtcaaaaaaatctcttttagtttcctgcagacagaaaactgaacaaccactctcctcaatattttgcctaaccgtcctccactttccttcagctctatgattactcataattaactagaggtaggcagggaaacacacaatataacaaagttatactgctggaaagataacaatgcagaggaaagcagtcttaattgactgtagaaggaacgacaaaaggaacagcaagtagcaaacctgcacaaccagaggggggaattattacagccaaaaggaacatgaaggacatgagacttagcagacacataaactctaaaccaacaggaaagaatcacacttttattcttgactcctaaaagagactgcaactggaaggacttaattgttcccatcagattcatttggagcccgcgtcttcaaaaggtcaatttgggacacctcttgagcagaagcaccacacagatcaactgccatttttttgcaaaagaggcacgagcagtcagcaggcgcaccagaagcatcttcagtggtagacccttcctcaaaatccgagtcttgcagatcacaaccagagaacagaagacctacctccttggccacttgcttcaatttcttaactgatttacctctaggtttcccaatgccctgatttggatctggctgagtgagaaattcatctttgtgcccatcatttaaagcagacaatctagaactccttcttaacccaacagttgtgattggagtgtcaatccgtatttttggactcttaactggagcaggaagcacatggaccacaggtgggactataaccaaatgagtaagcataagtactggcaattccgattccattccctgactatagcccagatgctgcctagaagaagatgattcaccaggcatatatggtccaatactgagagcagcccaaaaggaagaatcttgagtaaagtgtttatcaaacatggtatggggaaacctctcacaaagataattatataagtcagcatgaacagaatccttatgaaccacaatactcttgtctggagaggttaaagcctgttcatcagtagatatgctgactgccgaatccgcaatacttgcagagctagcagaagggtaagtagatagagagcttgcagagcttgcttgcaaatcaatcaacaactgtgggacaagaggcataagatgttcatcgacctgattacctccctgattatc

SEQ ID NO: 86334 - DNA, 1425 bp, Oryza sativa
accctcacgaacctgctttacccaaggcctacgatagtttggaccgaactgccaacccgacctgggttcaagctcgtcccaagccaacccaggccaaccattccatattttagttgttgagcaaattttaagaattaaaacactgacttgggtgcattgctaggcttgcccatatccgagggctgggctattcgaatagatttactctgatcagaggtgtacatctttacccacaagacacatctttactccgcattccatggccttggaacccgtcgtaaagatgtgacataacccttcacccatcctagccgtgaacaaaagtaccgacccaaccctgcctacggccggtatcccgggacaggcaggccagggttgagcccctagcaacaagatctagaccgggtgcgccacacacataggggtgagaccacccgcgtactagtccagtgccatggcatctcgactaacgggcaccgacccgtgtagtcttcatttgcctagacatctcgattaccgagccgcagctcgcgtagccttcatttgcctcagagatatccatcgtcgcaacgacttcatccatctctatccgtgtccttttgttcaggactagactgagcaccgagttaagccttacccattagacatgtggttagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataatccaacaattccatagtgtccaaatgatatgagaattcccaaagtctaaagttataaaaccacctaatgttgcctaattattcagcgaagcatctacctaaatttatactagtggaaccatgaatagagtacccactagttggggtttttattttcctagggtgaacaaggtaataataacaatagcaataataatgtcataacaaaggtaaataggcatggctaaataaaacagtggtaacgcgggaatttaaacaaagcgataatacaataatttaaatcaaaataattttataaactgggattcaatatgctcaagggtgatgtgacttgccttgctcgctttcccaaacgtcggcttcaacttccacgaagagcggatcttccgaagctgcagcgtctacacgaccaacggaaaagaaaaggcttttactctaataaactccatacaacaagcaggaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaattaaaaat

SEQ ID NO: 86335 - DNA, 1431 bp, Oryza sativa
atccacgtcaccggacatgaacgacgagcccatcgctgcctaccactttgacctctccggccttggccttcggcgccatggctaaggatggcaaggacgaagagctccgtaaggccggcatcatcgacacgcagttccgccgcgtcaagtgcaagtatcctgccgacaccaagatcaccttccacatcgagaaggcctccaaccccaactaccttgcgctgctagtcaagtacgtcgctggtgatggtgacgtcgtggaggtggaaatcaaggagaagggctccgaggagtggaaggcgctcaaggagtcatggggtgccatttggaggatagacacccccaagccgctcaagggccccttctccgtccgcgtcaccaccgagggtggcgagaagatcatcgccgaggacgccatccctgatggctggaaggccgacagcgtgtacaagtccaacgtccaggccaagtgagcattttaagcaaggaagaaaccagcgtacgtacgatccggcgcggctgcctatatatatatatatatatatatattatatactatatatgtgttgctgcatgcttgcatgcatgcacatatatatccagagaaatattttttaaacgaaataatctataaatttctgagctaggattgtggagcatatacacgccagcactataatggcgtctgctctcccatcgaactggccctgtgacaatggggtcatttgtttttgcccacaatattttctgctaaattcattctctgattttgcgtgagattatcatgagaagcagtaaccatgttgtgtatccttttcttcacgtcaaattgcactgcgctatttatttacgctgatttgtgaatgttttgtatggccatcatatcggaccgggaatgcaatggaccagtgcactggcaacgttaattttgggctaatagccaagcctattggacacaactgcttagacctagggagtatatattgctctccaatgcggaggctcgaccttatcctctccctctgtcagtgagtgaaaaagagcagcccctcttttcctccactagatcccctttcttctccgtcttcagtccttttaactatttctaatcaggactccaattggactatattctggcatggtccttgtgattttgctatcgtaaaaggatagtttcgctgaaaggttaattaaaatgctatcctaaactaaggggtgttcactaaaatgctattttaggtcttttgggttaatactaatgtttttgctctatttccaatttgtgttgtgaccaaactacccttgccttaggttaatcagatcgaatcgatcgaatccagtcggcttcggcgcattgcgttgactgaggactgaggagcagcggcgacaccgtcgcgcatccggcatcgggtccggccccggcgccggcgccgg

SEQ ID NO: 86336 - DNA, 5155 bp, Oryza sativa
atggaaatgggaagaaatatgtatggattttattactggtttacccagaacgtcatcaggccatgactctatttgggtgatagtcgacagacttaccaaagtggctcattttattccggtaaagacaacctattccggaagtcgcttggcggaattgtatatggcaaggattgtgtgtttgcatggcgtccctaagaagatagtgtctgatcgaggcagtcagtttacttcaaatttttggaagaaacttcaggaagagatgggttctaagctgaactttagtactgcttatcatccacagacagacggacaaaccgaaagggtgaatcagattttggaagacatgttgagagcttgtgctttagatttcggtggaagttgggataagaatctaccttatgcagaattttcatacaacaccagttatcaagctagtttacagatggctccttacgaagcactgtatggtcggaagtgccgcactccgcttttgtgggatcaaacgggagaacgtcaggttttcgggacggatatcctaaggaaagcagaagaaaaggtaaaggtcattcaagaaagattgcgagtggctcagtctcgacataagagttatgccgacaatcgccgtagagatttgagttttgaagaaggagactatgtgtatcttcgtgtcacgcctcttcgaggagttcatcgttttcacaccaaaggaaaattggcaccgcgttttgtgggaccttataagattgtcagtagaagaggagaggttgcttatcagttagaattacctcaatctttggcaggagtccataatgtgttccatgtgtcacaattgaaaaaatgtttaagggtacctaccgaagaagctaatattgagaagatagaagtccaagaggatttgacttatgttgagaaaccaatccgtatcctggaaacaaatgagagaagaaccaggaatcgagttatccgtttctgcaaagttcaatggagtaatcactcggaagaagaatcaacttgggaacgagaagatgaattgaagtcagctcattcgcacctgttcgccagttcttccgaatctcaaggacgagattctgtttaaggggggtaggtttgtcacaccctgaaaatttaaaatttataaattgttgtttaaatggaatttttagaaataattttaaaagtcttgaagagaagatctagttttaattaataaattccaatataaaatgggcccagataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaagtcggcccaaaacccctctctctctcctcggcccagttcggcccagtccgccgcgcgcgcgccctctcgctgtcgctgacaggagggtcccgcctgtcaggaccttcgtcctccttcggccgccgccgccgaaaccctagtttcgcgccgccgccgtttccttccaaatccggccattcctttccttctctggtcgaatcaaaagaggggaaacaatctccgggatctcctctacctttttctcctttggaatcttcggctaaatcggtttggaagttcgtggaatcgagttcgattcggatcgacctctttccttcaagccgcgagtttccttcgccgttgccgccgtcgtgggcctttgccgccgcctccgagcccctttaaaaggaccctcggtgtctcctctacccgccgccaccctcgccttcgcctctcgtcgccggaagagctctagcgccgtgtgccctagctttgccgtcgccgccgccgctccagccgtgcgccgccgtcgcttcagccgtcaccgtcgctcgggaagaccgtcgtcgtggtcgccgtcgcgtcgccgttctcgtccgccccttcgccgttgccggagatcaccggagcttcgtcgccgtcgacaacccgaaggtttccgccgtttcctcctcgtcgtcgtcgtcgtccgttgttcttccgccgccgttttggtcaccggtgtgttcgccgcgtcgtcctctacgtgctggtgccctccgtttgcgtcctggtgccgccgttcgccggcaagcgtgcgccgcccgagccgtccgttccgccgagccgccgccgctgtcggtgacgtcaccgctgacgtcatcggggtcgtccgccgtgagccggtcgtggaccattcgatctcggccgtccgttttggattggttcgatctcggccgtccgttcgtgtgaaccgccgcccgtgcgcccggtccaccaaaccctagcccgctgacgcaataatccttcttttccttttcaaaaataattcattattgcgtcataattcaattttaaccgatataagtgttttaatccgatttaatctttaaaaattcataactaattcatcttagctccgatttagttggttcaagtctctaaatttttctaaaattgagatttacactttaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaccaaccctttgagcatgttgatcctatttaaagctattgtttctattcaactattgcatctattttcgaatgtcattgggtggaattgacctattctttgttatggcccttttgtacttgattaccttattccttgataccttgggttattacaatttgactagttgagctttatttatattggttcaactagatattagatataattgcttagccctgcttagaaacattagcacacattcgggataactaatgactcactaatatttcatgatggtttcatgatagttcacgatggtcaatcgtgattagttaattaattaatgtgccaactaaaacctggtaatggtgggttgtgagcacatggttttgttggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactggtaataatttgattagctcctggtttggaatggtatattcctggtttggagatagaactgtgcagccggggtggttgttcagaatggttgggcctatacaacagggtatgttgtatagcgttggattaatattgtttaattacttaactgttttatcaaattctcaaatgtttgctaaatgctgcttttgcaaatgcaaccctactatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattgtgtgcctcggctgattcctggacgagggttcacacacatgtaagcgtttagaattttggatagaaattccgactggttctaataactccgatgatgaaaaaactgacaccgattgatgttatattgtagcagtgattctgatgatgatggaggcacaatttgtataatactgatgaatttatgctgtgcttgatattccaaacttagctcctgatttcttaaaagtttttatcaaaccttgttgagcctaaaacccgcaaaagttattaaaaaactttcagtcctcattgactaagccaaaaaaatcaaacaaggcaatgataaatcgagtaagcaaattgaattgataaaaatcacactccgttattattatagtagcccccaactgataactcaaggaaaggcttgatgttagaagtcaaagaggaaaatacaaaagtaatgcctaagcataaaaacgacgaagatgttcaatattccaagagttgtcgatatgagtactgtcctcacgtttgagtcgataagaacctggccgagtgacttcagatataactaacggtccttcccacaagggagataatttgtgccgatcccgtgtagtttgaatttttctcagaaccaggtcgccgactaaaaaagctcgtgagcgaacattgcgattgtgataacgacgcaacccttgcaagtaccgagccgattgaattaaggctgcttcgcgggcttcttccagtcggttgatatcatcaactcggtcttctccatagcgctcctcgctgaagttgcgaaatcgtagagattcaaattccacctcactcggcaacattgcttccgctccataaactaggaaaaaaggcgactagccggtagctcgactgcgagtggtgcgtagggaccaaagtacagatggcagctgttctacccacttgccggcataaggacacaatcggtcgaaaactcgcgcttttattccttgaagtaccatgccattggcacgttcaacctgtccattgctcatggggtgcgctacagaggcataacaaattttgatgccgaagtcctcgcaaaaatctttgaatactccgcctgtgaattgggtgccgttatcagtgatgatccgattgggtaccctgaa

SEQ ID NO: 86337 - DNA, 1398 bp, Oryza sativa
gatcgcctccaaggagccccagaccaccgcggagctttttcagctcgcggaccgtgtggctcgcaaggaggaggcctggacctggaactcctccggtaccggtgtggcagctccggccgcccccgggtccgccgctcggtcagggcggtgggacaggaggaggaagaagaggtcggcccattccgacgacgagggtcacgtcctcgctgtcgagggcgcttcgcgggccacccgaaaggggaggcctgcgagcgacaaaaagaaggaggctggcgctcccagcagggagcgcccgaccggcaagtggtgttccgtgcacaacacctccctccacgacctcgcggactgccgtgtggtcaaaagtttggctaagcggacgaggaagtgggaggaggagaggaggcaggagcgccgtgtgggcaaggccccggcgactcccgccggcaaccggcgaggtgaggccaagcagaaggccaccgccgaggacgtcgacgatggcgacgatgacctggggttccaggagcctgaggccaccgtcgccaccgtcgatgggggagcgtgcgctcacgcttctcgccggagcctcaaggccatgaagcgagagcttctggccgcggcccctacccatgaggcgacgcggtgggcgcggtggtcggaggttaccctcaccttcgaccagaccgaccacccgccgtgcatttcccggggaggacagatcgcgatggtggtttcccccaccgtttgcaatgtgaagttggggcgtgtcctcatagacgggggagcagccctcaacatcctttcccccgcagcctttgacgccatcaaggccccggggatggtgctccggccgtcccagccgatcatcggtgtgacgccggggcacacttggccgctaggtcatatcgacctcccagtcaccttcggtggttccgccaacttccgcacggagcgggtgaacttcgatgtggcggacctcagtctgccctacaacgcggtcctggggaggcccgcgttggtgaagttcatggcggcggtccactacgcctatctccagatgacgatgccgggccccggtggccccatcaccatccatggcgacctcaaagtcgcgcttgcttgtatggagcagcgcgcggaccacctcgccgcggcgtccaagcccgcgggtggtgacgagaggctcagcacctccgtccctgccgccccgaggcagcggatgatcacgtgcgacgaggtcccggtcaaggaggttgccctgggcgacggcccgtccaagaccacacgaatcggtggtcttctggacgacaaataggaagacgcgctcgtctccttcctgcgggcaaacgccgacgtcttcgcctggagaccggcagacatgcccggggtccccagggaggt

SEQ ID NO: 86338 - DNA, 11541 bp, Oryza sativa
ccgcctgacgggtctgcgatcccaggggctcccgggggccatggtgtacggcgactactttcgtcgccggatcgcgccgctccagcggcgcgccaggggcgcctggaagtacaccaagtccgaggactacatgaggacccaccagggggtcaaatgggactgggtccctgaagacttcaagatggtgatccaacgggtgctgaatctcagctccgtggaggcatccctcatcccccaaggtgtcctccccctctgcagtgatccagagcgcgccaacatcctgatcatcatgcaggcggtcggggcgtcgggggagcaggcccctcgaggccacgatggcgcgggcgggagccgcaggggggaacaatctaccccgggagggggtcatgcttctgggccccgcgacgggggtccagggggcagccgccctgccgacgcccggggaaagaggaagcaggagggtacctcttccccatctcctccccaagggggcggggcggtacgtgccagcagcaggcgcccagagggtaccgcgccgacgtcgcagcccgagggggagcgaaagaagaagcggctccgcaagatgggggggaccgaaccatgccggggaaacctcatctcccccccaaggtggtcgtttagcctacctcctcgcaggttcgtccccgcgcccactgcggccgtattcattctcccatctcccaaggcaagttttcactcacccgttttttgtcttctggtttttcttctgcctcagcgagatcccgtcgcgcccccaccccccccccccccgccattccaagtccggccggtctgaggccggggagacggcgaccgcggaggccaggaggcgggaagctgaccagcgagaagccgcggaccgccttcgggaagccgaggaagctgcccaggaggccgtccgggctcgccaggctgaggaagccgctcgggaggaggccagactccgccgggccgaggagtccgtccgggaggcggaggcggcgcacgcacgccaggcggcctgccaagcccccgacccgactccgcccgaggcgacgacgacttccgaggccacccacgacgaggccgcgggcgcaccgctcgggcccgacccctcgggcgacgctcaggacgagccagcttcgggggacatccccgagtccggcacgtcgatcggcgggccgagccgtgcggcaccctcaccgaggcggctctcccccatgccttccgctaccccaccgagcgcggagcccctcctgcaggccttggccgccgcgaacaccacggtgttggacgggttaagtgcccagatggaggtcctgcaggcggagcgggcggagctcgacgcggcgtgggcgcgcgtcgaaaaggggcgacgctcggtggaggccatggtggaggcgggccgcaaggcacaccgccggcacacctcagagctcgaggcccgtcgtagggacctggcggaggtcgccagggaggtggaggaggagcgggagactgccctcatcgccaccgccgtgttcaacgcggcgcgggacgacctctgcctccaatacgggagccgggcggcggagctagagaagaagctcgacgccgcccggggagtccttgatgctgccgttgcccgggaacggcgggcggcggagatcaaggcggcgtcccggcagcgcgaagaggcccttgaggctcgcgccacggtgctggaggagcgcgcccgcgcgaaggagagggacctggcggaccgcgaggccgccgtcgccatccgggaggcaacactggcggcgcacgaggccgcctgcgccgaagaggagtccgcactccgcctccgtgaggacgcgctcaccaagcgggagcgagctctcgaggaggctgaggccgcggcgcagcggctggcggacagcctgtccctccgcgaggcaacgcgggaggagcaggcgcgccgcaatctggaaggcgcccgcgccgagagggccgcactggatcagcgggccgctgagctcgaggcgcaggcaaaggagctggacgcgagggcgcgcagcggcggggcagccgcgggcgacagcgacctagtcgcccgcctcgcagctgccgagcacaccatcgccaagctgcagggcgcgctggactcgtccgccggggaggtcgaggccctccgtttggcaggcaagggagggcccggcatgcttcgggacgccgtctcccgtctagaccgcgccgggcggcaggcgggcctctggggcgggcggaccgcgaaatacgccgccaaccaggggggcctcgcccagcgcctctcagagatggccaggaccctccagcggctccccgaggagctcgaggagacgatcaagtcatcctcgagagaccttgcccggggggcagtggagctcgtactggcaagctaccaggccagggaccccgacttctccccgtgggcagcgctggacgagttccctcccggaaccgagaaaggcgcgcgcgcgcaggtccgggacgccgccgaccacatcgtccacagcttcgagggtacggcccctcggctcgcgttcgccctcgactccgacgaggaggttggtgacggtggtgcggacgacagcgacgacgaggcttgcgacccgggcgcgtcgaagtgagcccccaggcccccgccaatcttaaatagctttttcttcttcttccgaggccttcgggcccccttcttgtatagactaatttaatctgcaatcaaataaagaggaaatttttgtgtcaatttcatttgttgtgtgtatgagacgaggatggtctgtgccgcggtccttctgtgtcttggcttgaacaagggctcgtgcccaggtcccagcctcaaacggcgcgggtcggggctagtgcctggggagatccacgtgtcgagactggccaggccgggagcgcggtgaccgagggttatggatgacccgattgtgggcctttgccgattcccccccggagttcaccacgccccggggcacggctcggttctgggccccttttggcgattttagccggcccgggccaccgagggcaggatcgagcacgagcgtgctaattcaagtcaagattcttcaaaaggaaacaatggcacagacacagtccttaggaaatcgaaaatgcttttattgaaatatggaagagaaaaaagataagtatatgcatgtggtagcccccggccaaccctgcacgcccgggggggtgcggggttggcccgagcccgagacctgacacccgacccccactaggggtagaagcgacgaaggtgttcgatgttccacgggttaggcagctctgtgccgtcgcccatggccagccgaacggagcccggccgggggacaccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcgtctctgcgaagctgatcttgatcagcctcgcaatacatggtggcccgaggggacctcagggtgagctcagatgggagaaccgcctccgcgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttccgcgttggcgcgctccacttggccattgcttctggggtgggcgggggaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctaaacggacccaggatatcgagcccccagacagcaaacggccacgaaagaggtatggtctgcaaggcctgggccggctgatgggtttgcctggcgtggaactggcacgccctgcaccgccggaccaggtcgaccgcatcgttgagagccgtcggccaatagaaaccctggcgaaaggccttgccaaccaaggtgcgtgaggcggagtgggctccgcactcgccttcatggacatcggcgagaagctcgacgccttgttcccgaggaatgcacttcaggaggactccgttagccgcgcgccgatagagggtcccttccaccagcacgtagcgcttggagatgcgctggacgcgttcactcccttcgcggtcctcgggtagagtcttatctgcgaggtacgcctggatctcagtgatccaagcaatcaatctaggggagctgggagcgctcccctcgggtcccgaggcctggactccgacgggcctcggaggccgttcaggcgcgtccgtctcccctagggggtcgggtcgcgccgacggctgggcaagcctttcttcaaaggcgcccggtgggatctgggctcgcgaggaagcgagccttgagagttcgtcggcgaccgcgttatcccgtctaggcacgtgccgaagctctatcccgtcgaaatggcgctccatacgccgcacctggcgcacgtaagcgtccatctgcgggtcagagcaccggtactccttacagacctggttaacgaccagctgggagacgcctaacaccaggaggcggcggatccccagtccagctgccaccctgagtcccgcaaggagtccctcgtactccgccatattattggtcgcccgaaagtcgaggcgaaccaggtatctgaggacgtctccgttcagcgaggtcaacgtgacccccgcaccggcgccctgaagagatagggagccgtcgaactgcatcacccagtaggcggtgtgaggcagctgcgaggggcccgagctggcctcgaggacggagacgggctcgggagctggggtccactctgccacaaagtcggcgagggcctggctcttgatcgcgtggcgtggttcaaagtgcaaatcgaactcagagagtttgattgcccatttcaccacccgtccagtaccctctcggttatgcaagatttggccgagggggtaagacgtaaccaccgtgacccgatgcgcctggaaataatggcgcaacttcctcgaagccatcagaatagcgtaaagcatcttctgggcctgagggtatcgggtcttggcgtcccggagggcctcgctaacaaagtagatgggccgctgcacctttcggcggggccgatcctcttcgccaggggccgcatctccagggcgctcttcatccgagaggccacgcggggcgcactcggcttctgtgccgacaacctcggggtcagagggcgacaggcgcggccttcccgcagtggccccggggccatcctgggggtcgggggcgcctggcaccgtcggacaagcaggcggagggccagctccggccgtcgggggcctcgggccaccattcggctcgggggcctctcctccctgctctctcccgggtcgagtcgacacagggtggggatgcgcggagtgagggttgtcctcgttgcgctccacgaccaacgccacgctgaccacctgcggggttgccgccaggtagagtagcaacggctcatctggctccggggcgaccaggactgggggagaactgaggtacgccttcaactgagtgaaggcccgctcagcctcctccgtccaggtaaacggcccggagcgtttgaggagcttaaataggggtagcgccttctctcccagcctcgatatgaaccgacttagggcggccatgcagccagtgacgcattgcacatccctaagcttgctgggggggcgcatccgctctatagctcgtatcttctcggggttggcctcgatgcctcgggcagagaccaagaacccgagaagcttgcccgcaggcacgccgaacacgcacttgtcggggttcagctttatgcgggcggagcggagactttcgaaagtttccgcaagatccgagagtaaggtctcttggttgcgcgtcttcacaaccaagtcatcaacataggcctcaacattacgtcctatttggctacccaaagaaattcgagtagtacgttgaaaagtaggacctgcattctttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctcacggatgaatccggcctccagaagtcgcgccacctcctcgcggatgaaggcttgacgttccggggcctgccgccgcactttctgccggaccggccttgcgcccggccgcacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccgtcgcccagggctacctgcttgaccgggacctcgtcgcacgtgatcatccgctgcctcggggcggctgggacggaggtgctgagcctctcgtcgccacccgcggacttggacgccgcggcgaggtggtccgcgcgctgctccatacaagcaagcgcgactttgaggtcgccatggacagtgatggggccaccggggcccgacatcttcatctggagataggcgtagtggaccgccgccatgaacttcaccaacgcgggcctccccaggaccgcgttgtagggcagactgaggtccgccacatcgaagttcacccgctccgtgcggaagttggcggatccaccgaaggtgaccgggaggtcgatatgacctagcggccaagtgtgccccggcgtcacaccgatgatcggctgggacggccggagcaccatccccggagccttgatggcatcaaaggctgcgggggaaaggatgttgagggctgcacccccgtctatgaggacacgccccaacttcacattgcaaacggtgggggaaaccaccatcgcgatctgtcctccccgggcaatgcacggcaggtggtcggtctggtcgaaagtgggggtaacctccgaccaccgcgcccaccgcgtcgcctcatgggtaggggccgcggccagaagctctcgcttcatggccttgaggctccggcgagaagcgtgagcgcacgctcccccatcgacggtggcgacggtggcctcaggctcctggaaccccaggtcatcgtcgccatcgtcgacgtcctcggcggtggccttctgcttggcctcacctcgccggttgccggcgggagccgccggggccttgccctcacggcgctcctgcctcctctcctcctcccacttcctcgtccgctcagccaaacttttgaccgcgcggcagtccgcgaggtcgtggagggaggtgttgtgcacagaacaccacttgccggtcgggcgctccctgctgggagcgccggcctccttctttttgtcgctcgcaggcctcccctttcgggtggcccgcgaagcgccctcgacggcgaggacgtgaccctcgtcgtcggaatgggccaacctcttcttcctcctcctgtcccgccgccctgaccgagcggcggacccgggggcggccggagctgccacaccggaaccggaggagttccaggtccaggcctcctccttgcgagccacacggtccgcgagctgaaaaagctccgcggtggtctggggctccttggaggcgatcttctcgagcatgcggttgtgccgcacgccccccctgaacgcgtagatcaccgcgtgagcggggatgcatggtatggtgttgcggacttgacagaaccgctgaatgtatgagcgaagagactcatcgtcccttcgctgtaccgcatgcaagtccgcttcttcacctgggcgcggatatgtgccctggaagttcatggtgaactgctggcacaaatcctcccaagagtggaccgacgcgggtggcaagttcattagccaaccccgcgcctgacctttcagggccatggggaagaaattcgccatgaccctgtcgtcacccccggcggcctcgatcccggtcgtgtagatctggagaaactcggcggggttgacgcttccgtcgtatttttcggtgatggtgggccggaaccttgggggccaacggacgttccgaaggctcgccacaaaggctcgacagccggcactgccaaccggggacacgggggggctggcccccgtgcccggaccgaagtggcgctccggacgaggaagcgtcctccgttgcgtgggcagcacgacgaccattacgccggcgctcgatattgaggcgggcatccggccccccacgcacatcttcttgggtcggaggcgttgacgagggaatggcggacgaacggcgggtaacggccgccgctcgccgcgccctccgccttgacgacgcggagccggcggtagcagcgccagaggccttggtggcggaggaccgcccgccggtgcctaggcgctgctgcgccgtcatgaccaagtcggccacgtcatccagccaacgtcgggctggagtctctggatcggggacgacaggcgggtgacgcaggagcgcgcccgcagcctggagcgcgccctggggcgtgctgccatcgccatagacgaggagacgacgctccccgtctcgctgtccttctccatcgcccgtgggcggcgaagtcgcggatctttcgaccccctcgagcacctcctcccgcccaagacatcggcgagagggggacggtggagtacgagctcgacgacgcgggttctgctccccgtcgtcaccgctagcgctcggagagaggttgtgcgccactgcccgttcgaccattgggctgagtgggagaagcttggcgcacacgaaagaggatgagggcttagaaagacacacgcgccccctacctggcgcgccagatgacggagcatggggctcctcaccgggagaccgcgcaggcccccctttgccggttcggccgggggcgctaagtgaggttcttagcccttggtatgtggaatgttcgcgagagagcaaatgcacaagacacgggcgatgtagacaggttcgggccgctgagaagcgtaataccctactcctgtgttctgatggatctgtgtgtgaaggagttacaaagagccggagagcaagagagttcaaactctcgaacccctctcttctggttctggcctcccatcctcggtgggcaaggtcctccttttatatctcaaggggataccacatgcaccacttctacctactctttttttgggtggggacccaccctatcttgaccaaaacttggctcgcatcttcgcctaaaagctaaatgatagcttgtccttgagtgaggcccagcgccgtcactcgcccgacacaggggatcaccctgtcattccttcattaatgggcagagatttgcaatggccactgtccgaatgaccctccgatgggatgggtcatacctacctccactccgccggaagcagatgcaacgtgggagcacggttgcctgccgatgacgtgaccggcgtgagaccagtcacagaccggtcattcttgtccaccacgcgtcagtttagcatgccgcacgtctgcccttcttcatacaatgacttccttgtaatggttgcgatgaagcctggtatgaatctagccgggactgacgtgctaactccaggagttagcacaccggctccggctagggacgagtgcctagaggctctcatcattccgacgggacggggcgaggcgtgtgacaggccgcctgttgccacctaacccgcgatctgaccggtctgtgaccggtcacacactgcgaccggtcacggaccggataagcgtgcgctgcgctgcattaaatgcggcgtggcgcgctcgtccatcccgcaataaatgcggttaggtgagtgccgctgtgctcacctaacccacacacgtggcgccaataccacagggggtcggggcgccccagccctcggggccgaaacgggagcagcccgacccctcggggagacagagggaggggaggccacgtcaccctcgggcccgacccccccccccccccccgagggggtcaggccacatggttgaccgcggctgcccaagcctctagtcacgatactctcggtcccatgtcaccgacaatgtggtatccattaccatggtagtagcccccgacttcaactcaaatgaatccacgttttatccgttagcgttgtcatgctcacttggtcgttcttgacaacaattgagaagacgtgtagtactcaatatcattgaaaaaaattaacggtccacaagtgaatttgaattgaagtctacacaactaccataaacgggcctgaaatcaacgcaaatgaacgagttgatgttctcgaccgaaaaccttggaataacaatgtcgttctcgcttgatcattctcggacgagcgagaatgtacggagtatatgactaagtcttatgtcttaccgtaatcgagaatttgggttgaactcaagaattttcatctcggcgggtacaccatcggttcattccgtagtctttgtcgaactccaccaaccgttctcgagtaatcgagtagtcgtccaaccgttctcgagtaatcgagtagttgtccaaccgttctcgagtaatcaattacttatagaatctacgacaaagccctgaaatatgactttcctgaaatcaatacttagaacagattgttagatacaaatagttcccgagcgaacgctcaagggtaacacaatataatataaatttaaaaattgaaaataaattgaatttgcacatgccaataaaagaactgagaatttgctcaaagtttaccagtctgagaatttgttgagcagtgatgcacatgaactgagctataatgaacttggaccaaattgctccttaggtttgcacaagccaatctcttttcttttgaaattccctgtcgaccttctttgtacgcaagaaatttcatactaaaaaccatcatgaaaattcatgttttagaatagcaattttttgttgcaaaatttcctctttattctataattttagttagttattaggatcaccttcttccttttgataacttcaatattttggatttactatccctattgcttacttggcaggtaacagttcagtggttccgaatcatgacgg

SEQ ID NO: 86339 - DNA, 1938 bp, Oryza sativa
cttttatgtttaggaaagtttctttcttgtccgacaaggacttgtatcaacccatgggtataaatatctacacccgaggtctatgtgatctatctctacgatcaatacaattcagcgcatcgccaccctttttacttctacttttgttttttacgttccggcggaacttggcacccgacgcggggctgcatcgtcttcgatcttcggcgaagggataagtccaatgttccgtaggcctaggcaattctatcgtttacgtcggcgtcgttcaaggctgcatcagtacattcgacctcttggattgctctggtttggatgatatttttgtctacctatttatcatatgtctatgttaatctagtcttagcaaatcaatttatctctatcggctgcttctcgttttagggtttctgccggtataggctaaatcgtgttgttagattagattagcttagacatctaccaccctaaaaatcagtcaacgacttgattgtctagatattatgtttcttttcatacttagtgctgcatcagttaagtttgatctactaagccgtgcttaaaaccataatctctagcatgcttcttgattgccaataagggtttcatcggggtttcagccggtgaattatctggacgttgcatcggctcataaggattgcacatacatataagttggatttcgccgatgacaacaaaggtttcactgtttaatctaatcttgtggatttcttgacatcggacctccagccgatgtgtgctttaaccttcggatcgatgcttatttatcatatcattgctagccgattggtttatactggattatattgcaatattatattatcatcagccgattgcctttatatcatcatctacattggacatatagccgatttatcgaaatcctatcgctattggctggtattggcatcggctattatcgatatcggctgagattgctccatcggcttatcagccgatcgactactttgatctactatctgcatatcttgtaagttgcaggatcaaactgacttgcacgcccacatctcatcaacctttggacctgcacaggagctaagcagatctcccaggccagtgtgttcgatttttttgtcaacacttgtgggtaaagatgtacacctctgatcagagtataatctattcgaatagccgctccctcggttatgggcaagcctagcaatgtacccaagttagtggtttacttcttaaaacttgcttaacaactaaaacgtggaatggttggcctgggttggcttgggacgaactgggacccaggtagggttgccagttcggtcggaatcatcataggccttgggttatggcaggttcgtatgggttcacggccttgagtaataatattgtgtagctctaggattatatttacaaaataactttgggcaactaagtgacttttaaatgctatttactgcaaaacctaaccctatattattaccccttgtacccccttgcattaatcatgcatctccctgtgtgacttgctgaatactgtggttgtactcattcttgctctatctctctctctttcagtaggagaagctttggagaagaagtctgttgacggtcgttatcgatcagtttcgaccgttcatactaccaaaataaaggagaactagtgatgcttgcaatggcataaatctgttagaacaataatattccactagtattaggtttactaacttttttacagagaatgatcataaagtggaggagaatcgacattaactcagacgataaatcaatcggacgatgtcgggaaccagacatatgaatagatgggccaagaactcagaactgacacgatgaattgggccaaaattcagaagtctgcgaagtggagcaatagaggaggccaccagccgaaattaggctggattggaccagccctaggttcgg

SEQ ID NO: 86340 - DNA, 1516 bp, Oryza sativa
agcgcataaccaagtaaaagaacttacataaggaaaaagataatgagaaaacatgaccattgttttagtcatttctcctctacttccctttttcaaaataaaaaaaataaaaaaactaaccattcttttttagaattaaacataaccattgttaaatcaaaatttacgtatcagcgtatgttcccacaaatttttatttttgttttaggtctaaaataatatgggatcatgctaattgccaagtgtagttaacatgaaagtagtgaactaatacacgaacaatttgtccttttcttttggatataaacacaaatcttcgtttcatttgttattatggaaaaaaaactagaacatatgcagtttatctcctcttagaaccaaaaaagaaagactattcacataccatggttccgatggatgcacatctattggaaaatcaggatgttccattgggatgatctgatcaaatgacacatcgactgaagttaacgaaataataaaatgaatgggttttcaaatgttataaaagtatgcaacatgcatggttttggtgatacaaaaacaactaaaacttatttcacctgatcttcctctcggtcctcctctttctctttggaacaagaactgttatggtgatcggcttcatgattttctttggtctcatttaagttcaaatggcttggcaatttgctctcaagagtgacagactcgttgttgtgtgagggtagcttctccaaggcatggtctatcggcagctaaatgaggtccaaattaatgaagttaatagaaattctatcattggtgaataaatatgcaggtcaaatctataggatccccttcctctctgagaaaaaaaatgtaaataattattttgtagtatatagttataaaattgtacactcagcatcgcaggcatgaaaaatgagcaatagttaacaaggttggacctcgataacgcatattaaattattaaatagagcttacttcacatgatttagagcaggttagatggtacaaaactggaattggtcattccgtcattacacttttgattccctaaaaggattactctcatcaaaatgcagttccaagatgtaggggaaatagtgaaacagaggttgttgattcatggaaatcactaatgaaacaaggaatatattgtgaaaatgaatgtaaactcatcccttgatacattatagtttttcttatcaaatagatgacaaatacgataatgccacatcggcataagcaaaatgattcctctgcattatattcctccaggaagaacattgcgctgtagccttttataaacaaaacacacgatagtaataattaattacctcaccaatgatagcttctttctcgttaatttgattgatgatttccactatattaggcctattttccctatcagtctccatgcatttcagcgctatctcggtgcatgtcttcacttgctggcaatatgcttccagtaggaaaccattccttcctgtctctaacctagttttccaat

SEQ ID NO: 86341 - DNA, 1140 bp, Oryza sativa
  unsure (1)..(1140): unsure at all n locations
caattattaagagcagaaaataaatttatctcatctctatgcttttgatttattccgaatagtacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaaatatgatataacatctgtagcccccgactcactactcaatggaagaccaattggtgtagtgaggcagaggaaaaggaaaaaatatcatataaagaataaaataaatgatgacttagctttgtaatattccccttggtgatggcagaagtggccaatgtgggaacaaagtcgtccatcaataacaatgaagacaccagttggcggcgacgaaggcggtcgacggtgaaagcgaagatgcccactaatggcggcatgataggtcagcncgtgtaagcggaaacaccagtcgacggcaacgaaggtgagccaacggtgaggatgtagacacccaacagcggcggcataataggccagccgtgtaggcggaggcaccactcggcggcgacggaggcaggccggtggtgaagtcatagacgcccaacagcggcggcataataggccagccgtgtaggcggaggcaccactcggcggcgacggaggcaagccggcggtgaagtcgtagacgcccaacagcggcggcataataggccagccgtgtaggcggaggcaccactcggcggcgacggaggcaggccggcggtgaagtcgtagacgcccaacagcggcggcataataataggccagctgtgtaggcggaggcaccactcggcggcgacggaggcaggccggtggtgaagtcgtagacgcctaacagcggcggcataataggccagccgtgtaggcggaggcaccactcggcggcgacggaggcaggccggcggtgaagtcgtagacgcccaacagcggcggcataataggccagccgtgtaggcagagacaccagtcggcggcggcggaggcaagccggtcggtgaagacgtagacgcccaacaacggcggcttgatatgccagctgtat

SEQ ID NO: 86342 - DNA, 1752 bp, Oryza sativa
acgtagacgcccaacaccggcggcataaaggccagccgtgcaggcgaggacatcggtcggcggcgacgaagggcaagccggtcggtgaagacgtaggcgcccaacaacggcggcataataggccagccgtgcaggcgaggacaccagtcggcggcggcgaaggcaagccggtcggtgaagacgtagacgcccaacaacggcggcataataggccagccgtgtaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactcattacgtttaaacactctgcccgactagtcatagccaccaagcactgggagtcggcctaagcacttcccaaacatgcatatgagtgacataagttcgtcattaatggaacaaagtttcacggatcggagtttactactcgggtacttttgcaattattaagagcagaaaataaattatcttatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtagtccatcaataacaatgaagacaccagtcggcggcgacgaaggcggtcgacggtgaaagcgaagatgcccactaatggcggcataataggtcagccgtgtaagcggaaacaccagtcgacggcaacgaaggtgagccaacggtgaggatgtagacatccaacaacggcggcataataggccagccgtgtaggcggaggcaccactcggcggcgacggaggcaggccggcggtgaagtcgtagacgcccaacagcggcggcataataggccagccgtgtaggcggaggcaccagtcggcggcgacggaggcaggccggtggtgaagacgtagacgcccaacaacggtggtgtgaccaaccaaccatataggcggaggcaccagtcggcggcgaagtcgtagacgcccaacagcagcggcataataggccagccgtgtaggcggaggcaccagtcggcggcgacggaggcaggccggtggtgaagacgtagacgcccaacaacggtggtgtgaccaaccaaccatataggcggaggcaccagtcggcggcgacggaggcaggccggcggtgaagacgtatacgcccaacagcagcggcataatacgcccaccgtgtaggcggaggcaccactcggcggcgacggaagcaagccggcggtgaagtcgtagacgcccaacagcagcggcataataggccacccgtgtaggcggag

SEQ ID NO: 86343 - DNA, 2787 bp, Oryza sativa
gtgcgttgactaccgcgcactcaatgaggtcaccatcaagaacaagtatcctttgccaaggattgatgatctgtttgatcagttgaaaggagctactgtgttctctaagatagacctgcgatcaggctatcaccagttgaggatccgcgaagaggatattccaaagacagcattcatcactcggtacgggttgttcgaatgcacagttatgtctttcggactcactaatgcacctgccttcttcatgaatttgatgaacaaggtgtttatggaatttctagacaagtttgtcgtggttttcatcgatgacatactaatctactccaagtccgaggaagaacatgagcagcatcttcgactggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaagtggaccccaccaaggacagtcactcaggttcggagtttcttaggacttgcgggttattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcttaatcctgcctgatcagacgaaagatttccaggtctattgtgatgcatctcgccaggggctaggatgtgtgttgatgcaggatggcaaagtggtttcttatgcttcacggcagttgcgtcctcatgaaggcaactacccgacgcatgatctggaattagccgcagttgttcatgctttaaagatttggcggcactatctcatcggtaaccgttgtgaggtatatacagatcacaaaagtctaaagtacatcttcacccaacctgatctgaatctccgacaacgaagatggttggagctaatcaaagattatgatatgggaatacactatcatcccggcaaggccaatgtggtagcagatgccttgagcaggaagagttactgcaacgtcgcatgggtagaggaactatgctgtgaggttcaacatgatttggaacatttgaaccttggtatagttgagcacggattcgtggctgccctagaggcacagcccacactggtggagcaggttcgcatagctcaagcaagtgatcctgaaatagcagagctcaaaaagaacatgagggtcggaaaagcccgaggttttgttgaggatgaacaaggaacaatctggatgggagaaagattgtgtgtacccgaaaacaaggaattaaaagacctgatactaaccgaggctcatcaaactcaatattccattcatcccggtagtactaagatgtaccaagacctcaaagagaagttttggtgggtcagcatgagaagggaaatagctgaattcgtagcactctgtgacgtctgtcaacgagtaaaggcagaacaccaaaggccagcaggtttgctacagccacttcatattccagaatggaagtgggaagaaatcggaatggatttcatcaccggtttgcccaggacgtcatcggggcatgattctatttgggtagtcactgaccgactcaccaaagtggcccacttcattccggtgcacaccacctactcagggaagaaattagcagaactctatctggcaagaattatgtgtttacatggtgtacctaagaagatcgtgtctgatcggggaagccaattcactggaaagttctggcagaaattacaagaagaattgggaacccggttgaatttcagcaccgcttaccatccacaaacagatggccagaccgagcgagtcaatcaaatactagaggatatgttgagagcctgtgcgcttgattttggtggggcatgggacaaaagcttgccgtatgctgagttctcgtacaacaacagttaccaagctagtctgcagatggcaccatttgaagcactgtatggacggaggtgtcgtactccgctcttctgggatcagacaggggaacgccagttgtttggtacagaagttttaaatgaggcagaagagaaagtcagagctgttagggaaagattgagaatcgcgcagtctcggcagaaaagctatgcagacaaccgccgaagggagctcgctttcgaaacaggggattatgtgtatctccgtgtcactccgctcaggggagtacatcgcttccaaaccaaaggaaagttggcaccacgctttgtgggaccatatcgggttttggaacgtagaggtgaagttgcttaccagctcgagcttccctccaacatgctgggcatccataatgtgttccacgtctcccagttgaagaaatgtttgagagttcctgaggaacaggcaagtccggatcaaatcgaaatccaggaagacttgacgtatgtggagaagccaactcgtatccctcgaaaccagcgagagaaagaccagaaacaaagtaataagattctgcaaggttcagtggagccaccactcagaggaagaggccacttgggaaagagaagatgagttgaaggccacccacccgcacctgttcgccagctcttccgaatctcggggtcgagattccgtttaaggggggtaggtttgtcacgccctgaagttttccccctttttgcttgctttaaaaatttggctaaataaatcgtccgaagaaattatcttaattaacctagagctaattccctaattaataaatgcaa

SEQ ID NO: 86344 - DNA, 1137 bp, Oryza sativa
ttgtggcagaggggacaccggtctccgagcccctctccatccccgaggccagctcgggcccttcgcagctgcctcacaccgcctattgggtgatgcagttcgacggctccctgtctcttcagggcgccggtgcgggggtcacgttgacctcgccgagcggagatgtcctcaaatacctggtccgccttgactttcgggcaaccaacaatatggcagagtacgagggactccttgcgggactcagagtggcggctggactggggatccgccgcctcctggtgtgaggtgactctcagttggttgttaaccaggtctccaaggagtaccagtgctctgacccgcagatggatgcttacgtgcgccaggtgcggcgtatggagcgccattttgacgggatagagcttcggcacgtgcccagacgggataacgcggtcgccgacgaactctcaaggctcgcttcctcgcgagcccagaccccaccgggcgcctttgaagaaaggcttgcccagccgtcggcgcgacccgaccccctaggggagacggacgagcctgaacggcccccgaggcccgtcggagtccaggcctcgggacccgaggggggcgctcccagctcccttagattgattgcttggatcgctgagatccaggcgtacctcgcagataagactctacccgaggaccgcgaagggagtgaacgcgtccagcgcatctccaagcgctacgtgctggtggaagggaccctctatcggcacgcggctaacggagtcctcctgaagtgcattcctcgggaacaaggcgtcgagcttcttgccgatatccatgaaggcgagtgcggagcccactctgcctcacgcaccttggttggcaaggcctttcgccagggtttctattggccgacggctctcaacgatgcgatcgacctggtctggcggtgcagggcgtgccagttccatgccaagcaaacccatcagccggcccaggccctgcagaccatacctctttcatggccgttgctgtctgggggctcgatatcctgggtcggtttagacgggccccgggcgggttcgagtatctgtatgtcgctttcgacaagttcactaagtggcccgaggcttatccggtcatcaagatcgataa

SEQ ID NO: 86345 - DNA, 4774 bp, Oryza sativa
ggaaaaactgaatgctccaagttctcaaatttatattgatattaatgaaataatcagctaacaatgttttcatgtcataccagggttatgatactttagttggccagcgcggtactcagctctctggaggacaaaaacagagaattgcaattgcaagagccatcctcaaagatccaaaaatccttttgctcgatgaagcaacaagtgcacttgatgtggagtctgagaggatagttcaggaggcactaaatagaatgatggtagaaagaaccacactcgttgtcgctcatcgtttgagcactgtgaggaatgttgattgcatcacagtcgtccgcaaaggaaaaatagttgaacaaggttgaattaacttgaaatgcactgtttttctattatagaaaatttctgcggtcaaccttaaatgattcattataccaaaacatgtcctgcgtacacaggtcctcatgatgcactggtgaaggatcccgatggagcttactcccagctaattaggctacaagagactcatcgtgatgaaaggcataaactaccagattccagatcaaaaagtactagtttgtcattcagacgatcaagaactaaagattttctcagcaagagcaacaggtattccttcaagagccccttaggattgcctgttgatatacatgaggatggaatgacaagcgaacaacaaaaggttgaccactctgacagtaaggccattaaaaaaacaccatttggacggctttttaatcttaataagccagaagtgccagttcttttgttaggttctatagcagcatcagtgcatggagtcattttgccactatacggtataataatgccaggtgttctaaaatcattctatgaaccgccagatcagctgcgaaaagattctagattttgggcattgatgtctgttgttctgggggttgcttgtttgatttcaatcccagcagaatattttttgtttggaattgctgggggaaagcttatacagcgtgtccgtacactgtcatttcaaagaattatgcaccaagaggttgcttggtttgataagccctccaattccaggtgcgctactctaatgtacttttgctattttatcttttataaaaaaatatttacatttaaaccaatgctaagaggccatcttatttcttacagtggggcacttggtacaaggctctcagtcgatgcgttgaatgtccgccgtttagtaggagataacctggcccttatagtccaggctgtagctacactaatcactggctttgccatagcttttgcggcagattggaggcttgcactgatcatcacttgtgtaattcctttagtgggtgcacagggctatgctcaagttaagttcttgaaggggttcagtgaagaatctaaggtgacacattacagcttacaactgtaaaaattgcttgctgttttattgagaatgatctagacaagtgatctagaattaaattgattgccattataatgggatctcattatacaggagatgtatgaggatgcaaaccaagttgcggctgacgctgtaggcagcatcagaactgtagcatctttctgttcagagaaaagagtggtggcaatatacaacaagaaatgtgaagcctttaaaaaccagggattccaagccggattcgttgaaggaatggcctaaggttcttcaacctggaggtattatctgactaacggccttggcttctatgtgggtgcaaagttcgtaagtcagggaaaaactactttttcaaatgttttcaaagtaaaaaatcctaaagtatttcaagtaccaatggcctatatgaatattaattctagtatcattcacaaatgggctggatgcttttcaggttttctttgctttagttttggcagccgttggtgtttcgcagtcaagtgcattgtctactaatgcacaaaggcaagggattctgccatttccatttttagtattatcgatcggaagtctaggattgattcaagtagcgacgagggagcgataatggaaaacgtcactggcagcattgatttcaataatgtcagtttcaagtacccatcacgccctgatgttcaaatattcagtgactttaccttgcacattccttcccaaaaggtatacttccacattcacctatttgtcttcctttttcctatttcttgaaactagtgcatgcccaaaatttccatcagaaaattaacttgattattgaactatttacataatacaactagtaacatacttcaaaatagatgcgagtgtgacccatccacttccgtgacatcatatgtgttgatacacaactttacattttattttttgcatctcagcatttccatgcactgaaatagttatgactaaaccttttccttccttttctacagaccatagcacttgttggagaaagcggtagtgggaagtccacgataattgctttattagagcgtttctatgatcctgattctggtaatatctcactagatggagttgaaattagaagcttaaaagtcagctggttgagggatcagatggggcttgtaggccaggagccagtgcttttcaacgacacaatccgtgccaacataacatacgggaaacacagtgaggtaacagaggaagagatcactgctgtggccaaggcagcaaacgcccatgagttcgtatcaagcctgccacaaggatacgacacagtggtaggtgagaaaggggtgcaactatctggtgggcaaaaacagagggtagcaattgcaagggccatcctaaaggaccctaagatactgctacttgatgaggcaaccagtgctctagatgcagaatcagaacgtgttgttcaagatgcattggatcgagtcatggtcaacaggactaccattgtagtggcacaccgcctctccacaatcaaaggggctgatatgattgcagtcctcaaggaaggaaaaattgcagaaaaaggaaagcatgaagcactattgcggatcaaggatggtgcatatgcttcacttgtacaactccgctctaattccgagtaaaatgatgtatattttgatggtgtataacttatttagccataaattctagctacttgtgatttgagaagttgatgctaaactagagggtgttctttggtagtttgttactttgttgcatgaaagacctatggttctgaacgtatgatcttggtagccacagacagtaaattcaactgtgtctgtgtgtacgcactaactatgatggaataagccttgtggtctttggtctttgtggtccttctcttgcttttaggttgtttttccccttttaggacagcatcctttcagttttgcttttagcatctttcggttttgcttttagcatccctaggacagcatctagcatctcctttatgctttattcagtttggatgctctctaggacagcattgcgttcaaattttagactagtgtgggcagcaattagctagcagccatccagccagctatggctatatatatatgtatccaacctccctcgggaaggtatggcttttgtgtttagtgaatgaagaaaaccagaaaattgccccatctcgagtgccatcctcttctcaatgagagtaaccattgaaattctaacatctggtatcagagccacactttcctgtaggctaaacatctcttgttccaccccttcccaagctcggttgagctctcagccagcagcagcagcagcaccggttgctcctccttcccctttcccttccccctctccacgcagcagccccccggaggtgcgccatgtccgacgctcagtctcggcgttcggtcgcctcgagcactcggcgtcagcaggacgccgagctcgccgcagcagaagagcgcaggcgagcaacggctcagaccgctgcagcagcagcgagggcggccagactggcggcagcggagttggcagcaaccaaggcggaagcggaggcggaggcggcggaagatgcggcacgtgcggcggaggtagaggttgagaccttgcgcagcagcatcaacggctccatcgccggcgacatcaccgccgacagggagcttgaggagctggcaagaggaagggcacgggagcgagcagagcggtgggcagcagcccacctccacggcggcggcggcggcccaagggaccgcgcgcccgccgacgggaacccagacgggcgcaggcgtgccggcggcagcccggagctcgcacgcggccctcgcaggcagcacggctctctctcccctgaccggcgccatggtcaccacggtgtccagacggtggtcagggactttggtcccggcggtgggtggcctaccctcaccaaaaccaactacatcgagtgggccgcggtgatgagggtgaggctccaggtgcggcacatgtgggaggcagtccggtacggtgacgtcaactacgacgaggatcggcgggcactggatgccctcatcgctgcagtcccgcccgagatgcagttctcgctttcccagaagcggactgccaaggaggcctgggacgccatcgctgcggcacgcatcggcagcgaccgcgcccgcaagtccacactgcaggcactccgcaaggagtgggagaacctggccttcaagccaggtgaggatgttgatgactttgctctccgtctcaacactctcttgcagaaaatggtgcagtacggcgacgacacctacgacgaggagagagctgtcgagaagctcttccgctgcgtccctgagaagtcagacagatcgctcgctcgatcgaatctct

SEQ ID NO: 86346 - DNA, 11304 bp, Oryza sativa
aatagagaaaaaagaaggaaaagaaaaagaaaaggaagaaaggatttttccttggattaaaaattgcactttggtgatttttaattggttaaaattattcccaaggctctgaaaattccactaaaaatcttgttaatgcattggagcatggggaactcaagaaaaattccaccacgccgaattcaattattaatcgcatttattaactagggaattagctctaggttaattaagataatttcttcggacgatttatttaaccaatttttaaagcaagcaaaagggggaaaacttcagggcgtgacaaacctaccccccttaaacggaatctcgaccccgagattcggaagagctggcgaagaggtgcgggtgggtggccttcaactcatcttctctttcccaagtggcctcttcttctgtgtgatgactccactgaaccttgcagaatctgattactttgtttctggtccttctctcgctggtttcgaggatacgagtcggcttctccacatacgtcagatcttcctgaatttcgatgtgatccggacttgcctgttcctcaggaactctcaaacatttcttcaactgagagacgtggaacatgttgtggatgccaagcatgttggagggaagctcgagctggtaagcaacttcacctctacgttccaagatcctgtatggtcccacaaagcgtggtgccaactttcctttggtttggaagcgatgtactcccctgagcggagtgacacggagatacacataatcccctgtttcgaaagcgagctcccttcggcggttgtctgcatagcttttctgccgagactgtgcgattctcaatctttccctaacagctctgactttctcttctgcctcatttaaaacttctgtaccaaacaattggcgttcccctgtctgatcccagaagagcggagtacgacaccttcgtccatacagtgcttcaaacggtgccatctgcagactagcttggtaactgttgttgtaagagaactcagcatacggcaagcttttgtcccatgctccaccaaagtcaagcgcacaggctctcaacatatcctctagtatttgattgactcgcttggtctggccatctgtttgtggatggtaagcagtgctgaagtttagacgggttcccaattcttcttgtaatttctgccagaactttgaagtgaattggcttcctcgatcagacacgatcttcttaggtacaccatgtaaacacatgattcttgctagatagagttctgctaatttcttccctgagtaggtagtgtgcaccggaatgaagtgagccactttggtgagtcggtcaacgactacccaaatagaatcatgccccgatgatgtcctgggcaaaccggtgatgaaatccattccgatttcttcccacttccattctggaatctgaagtggctgtagcaaacctgctggcctttggggttctgcctttactcgttgacggacgtcacatagtgctacgaattcagctatttcccttctcatgctgacccaccagaacttttctttgaggtcttggtacattttggtactgccgggatgaatggaatattgagtttgatgagcctcggttagtatcaagtcttttaattccttgttttcgggtacacacaatctttctcccatccagattgttccttgttcgtcctcaacaaaacctcgggcttttccgaccctcatgttctttttgagctctgctatttcaggatcacttgcttgagctatgcgaacctgctccaccagtgtgggctgtgcctctagggcagccacgaatccgtgctcaactataccaaggttcaaatgttccaaatcacgttgaacctcacagcatagttcctctacccatgcgacgttgcagtgactcttcctgctcaaggcatctgcaaccacattagccttgccgggatgataatgtattcccatatcataatccttgatcagctccaaccatctccgctgtctgagattcaaatcaggttgagtgaagatgtactttagacttttgtgatccgtatatacctcacaacggttaccgatgagatagtgccgccaaatctttaaagcatgaacaactgcggccaattccagatcatgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaaattttcttccttcttcaatagctgtgtcattggcttagcaattttagagaagttctcaatgaaccggcggtaataacccgcaagtcctaagaaactccgaacctgagtgactgtccttggtggggtccatttggtaactgactccacatttgctggatccatagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccacgacaaacttatctagaaattccataaacaccttattcatcaaattcatgaagaaggcaggtgcattagtgagtccgaaagacataactgtgcattcgaacaacccgtaccgagtgatgaatgctgtctttggaatatcctcttcgcggatcctcaactggtgatagcctgatcgtaggtctatcttagagaacacagtagctcctttcaactgatcaaacagatcatcaatccttggcaaaggatacttgttcttgatggtgacctcattgagtgcgcggtagtcaacgcacatccttttggttttgtctttcttctccacaaagataaccggagcaccccaaggcgacgtgctcaggcggatgtatcccttctgtaactgttcatcaacttgtttcttgacttccgccaactcgttggctcccattctgtaaggcctcttgtggatcggtgcagttccaggtaccaagtcaatccggaactcgatatccctttttggtggcattgttgtcagatcatccggaaaaaccactggatactctctgactatgggaatatcctccagcttcttagtggttttctccactgctacctcttgttcttcaccagcagcctggtttaaactaatccctggcttccgcggcactggagactggaagattaccacctctccttttgcattggtcaacttgatggtgcggctggcgcaatcaatcactcctctgtgccttgtcaaccaatccattccaagtatgacgtctaggtccttggattcgagaagaatgaggttggctggaaaaatcgacccttgaatttcaactgtcacagatgggcagtagtgagttgtggtcatgccacctccaggagtatgcactcgcattggtatcttaagcttcactaaagataacccatgtgcaccagcaaaacgcttggaaatgaaggaatgggttgcaccagaatcaaacaatatttttgccggtgtcgagttgacaggaaatgtgcccaatataacctctggtgctgactgcgcctcctccgcagatgcatgattgacccgggcctgaacgaacttgggtccagcacgtcttggcttcgagcactttccaaccatgtgtctgggtttgttacaattgaagcagagttcgggtttttctcccaacctcttgggctgttctggcagagctggctgaactgattgagctggaatctttagtgaactcggagtagggttgagactgtgctgctcactgttgttgtgactgccactatggtggttcttgttgaagctacccgggtggtagggacggtactgccggataatcatggtggaaggtccaccctgatgtcccatcgtgaaacgaggcttctgactcttcccctggggagtcctgaactgagctgccttcctcttacggtttattttgttacagtgctcctcctgacggatagccttatccaccagcttctcaaagtcctcataatctctagagatcaactggttagtcaattcatcatcaagaccagacagaaacttctgctgcttctcggcatcggtacgcacgtcctcaggggcgtagcgcgcgaggcggttgaactcatgcaaatactctataactgttctggttccttgttgcagggaacggaactctctcttcttttgtgccacaattccctcgggaacctgtgctttattgaaactatgacgaaactctgtccaagtaacctctgccccagctggacgggtcaccatgtagttgtcccaccaaatagaagcgggaccttgtagctggtgtgtagcaaaagcaaccttctcctgctcgttgcattgcaaaagattcagcttcttctcaatggcatgaagccagtcgtgggcctcgattgggttggtggtgcttgagaaggtgggcggcttgacacgaagaaattctaacagtttggactgaggaggtggaggaccaaactgcaggttctgctgctgcagctgtgcttgctgctgcacctgctgcaacacctgatggtactgttgctgcatctgttgcatcatcattgtcatcatctgagtctgattgtccaacacctgagcaattgttgggttctcgggcggtggggacggactgttgtcagatgcactgttggcacgtgctccattgatcggcttttcgctgccactggcgttgttcgagtcgcgtgaaccattccttgtctccatctgaggggataggtagaaatatgagaaaaggaagaaaaacagggggctcagaaactaatcttgcttatgaatttaagtgcaattatcttaatcttgattaaaacactgaaaaagaggcacgcaactcctaattgaggcagtcataccactgacacatgatatcgaccgccgactaacccacaagcaacaaacctaaacacgaaaactagcaagcaaacagactaagaaagcgataaagctaagggcggcgactctgaagctcggggcggcgcttgcaaacgagggataggactgacatctaaagtagacaagggataggaaccaattcatgctcaaatccaaattaaacaaagcaaaagaagactcaaataaataaccgagcatgatgatttttatgcatagaacatttttcatgaactcaaataaagacactaatgcaactaaacaataaattaatgcatagactagttgcatggaaaatgatgcgcataacattgcccccatcgaatatagacacgacctaatgtataacccccaataaattcccgactgactgtcgaataaactccaactaaaatttttctaaagccctagactgagctaatttttttttttaaaaaaaatccgatccgaaagaacgaccaagatttttcccgcaaaccaaagaggcaaaactccaaattttcccgaaacaaatccaagtgaaaaagggcatatgcatatgaaaaggggttcagaaggctcttaggttttccagttggcttgtcctacggtcaaggtcggctctgataccaacttgtcacgcccagaaattctcgaaccagaatttctaagctgaatgtgcattaaatccctgtccaggaccagccagggtacacaaacgacaattgttgacatacagatccacgtcttacaaaaatggaaaagattacaaatgcagcggaaaagataaaagcgagctaaaccggaaagcttgacttcagcagcgagcgactccactccacaggcaatccttgacggcagcgacgaaaccaactatgacaaaacagctccaactaggaagatcttcagctctggtgtgggggaaaagagagcaagactgagtactacccactgtactcagcaagtcataccggaagaggaggtatgatgcaggatataaccaaaggaagctaggggttcttttgcataaagcaggcatttcaaagcagtagttgaaagcagtaaaacagctgtagtaattaatcaatattaaccaatcactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaaaggggaaatcgtgacaagaccctccacataaccctcccctaaccatccacaccacgctaaggtttcacccccacccctcataaggcagtgggcggtcccctcttgcgccgcggttaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaattgccatgagtgcgaccagcaaaaccatgcacccacagcccaccattcagtgtattttaattaactaacaccattgcggtggcaccaatctaaagctatgccaatagacaaagtctatgtaataaggtgatccccatttgtgtgctagttgaactaagcatggctaagcatttcctaaaccaacatctagtcattttgatacccaggttatcaatggcatatggtaaacaataaaaggctgagtagtaggacccatcccacatgatattgtaaaagaatgcaacatttaatagaaatgcgggatatttgtaaattgggtacaatatgatcaaacgtattgcatgacttgccttgctctcacactgacgagacctcagcaacgtcttcgagaaaccgcggatcgacgaaacggccgaaatctacgcgacaaacaaagcacacaagcaaaacatgctataagactactgaaacaggaaacaaaagtatttttaatggattctttgcatttttcttgatttactgagacttgaatggacttaaacggagctcggatgaattacttatgaattttagaagataaactgtgtttttactaataaagaaaagtccttaaatcaatttattgcgcaataaagcccagggctgacgtcatccaagggggggggggcgccgacaggcgggccccgcttgtcagcggttcaagagagaggaagggggcgccggcacgtgggccccattggcagcggcacaagggagggaggtggcggcggcatgctcggcacggctcaagccggccggccagccatggggcggcggcggcggcacgcgcggtcaccggcggtgaccggcggcgcgggagacggcggcggccggcgcgaaggcggcggcggcggccgaagacgacggcgcacgcgcggagggcggcggcgctcatgggagagagaggaaaggaaggaggagaggggattcctcaccggcgagcacgacggccggcgcgaaggaaggaagcggcggcgacgaccggcgatgccgaggtgcggacgggcggcggcggcacgctaggagaaaacagagaggggttaggggtagggagagcgaccacggcggctagagcggccggccggagttgggtggaaatggagagctcaccggcgtgcgagagaaacggcgcttcggcgacgattggcggcaaccgaatggtggccgaggtgcagcgggctcggtgagcgtgacggtggcgactacgcggcgcggcggtgactctagcggcggcggcgcgcggccggagatgggcgttattctgtagagctcgggtgcgcggcgcgagggcggtagacggcacgggagagtgcggtgaaaacgagaaaaagcgatagaaggacgcggggaacgatttataggcggagggggaggcggacgtggccgggaacccaccctattgcgccggcgacgtgggaaggtggggggagagagagaggggtgggattcaaattcgaatcccgcccatttgcggggcgcgcgagggcgggagaggcgggggagaggcggcgacgtgggcgcagcgcgcggggtggggtggagtgggcgcgggaaacgcggacggcgacgtgggagcggcggttgccggccgagcgcggtcggctggaggaaggggacgacctgacaggtgggccccacctgtcagcgtcccggagagaggggaaggggaacgggccggcccaaagaaaggaggccgagcgcgggagggagtgggccgacggcccaatagagaaaaaagaaggaaaagaaaaagaaaaggaagaaaggatttttccttggattaaaaattgcactttggtgatttttaattggttaaaattattcccaaggctctgaaaattccactaaaaatcttgttaatgcattggagcatggggaactcaagaaaaattccaccacgccgaattcaattattaatcgcatttattaactagggaattagctctaggttaattaagataatttcttcggacgatttatttaaccaatttttaaagcaagcaaaagggggaaaacttcagggcgtgacaaacctaccccccttaaacggaatctcgaccccgagattcggaagagctggcgaagaggtgcgggtgggtggccttcaactcatcttctctttcccaagtggcctcttcttctgtgtgatgactccactgaaccttgcagaatctgattactttgtttctggtccttctctcgctggtttcgaggatacgagtcggcttctccacatacgtcagatcttcctgaatttcgatgtgatccggacttgcctgttcctcaggaactctcaaacatttcttcaactgagagacgtggaacatgttgtgaatcccaagcatgttggagggaagctcgagctggtaagcactttcacctctacgttccaagatcctgtatggtcccacaaagcgtggtgccaactttcctttggtttggaagcgatgtactcccctgagcggagtgacacggagatacacataatcccctgtttcgaaagcgagctcccttcggcggttgtctgcatagcttttctgccgagactgtgcgattctcaatctttccctaacagctctgactttctcttctgcctcatttaaaacttctgtaccaaacaattggcgttcccctgtctgatcccagaagagcggagtacgacaccttcgtccatacagtgcttcaaacggtgccatctgcagactagcttggtaactgttgttgtaagagaactcagcatacggcaagcttttgtcccatgctccaccaaagtcaagcgcacaggctctcaacatatcctctagtatttgattgactcgcttggtctggccatctgtttgtggatggtaagcagtgctgagtttagacgggttcccaattcttcttgtaatttctgccagaactttgaagtgaattggcttcctcgatcagacacgatcttcttaggtacaccatgtaaacacatgattcttgctagatagagttctgctaatttcttccctgagtaggtagtgtgcaccggaatgaagtgagccactttggtgagtcggtcaacgactacccaaatagaatcatgccccgatgatgtcctgggcaaaccggtgatgaaatccattccgatttcttcccacttccattctggaatctgaagtggctgtagcaaacctgctggcctttggtgttctgcctttactcgttgacggacgtcacatagtgctacgaattcagctatttcccttctcatgctgacccaccagaacttttctttgaggtcttggtacattttggtactgccgggatgaatggaatattgagtttgatgagcctcggttagtatcaggtcttttaattccttgttttcgggtacacacaatctttctcccatccagattgttccttgttcgtcctcaacaaaacctcgggcttttccgaccctcatgttctttttgagctctgctatttcaggatcacttgcttgagctatgcgaacctgctccaccagtgtgggctgtgcctctagggcagccacgaatccgtgctcaactataccaaggttcaaatgttccaaatcacgttgaacctcacagcatagttcctctacccatgcgacgttgcagtgactcttcctgctcaaggcatctgcaaccacattagccttgccgggatgataatgtattcccatatcataatccttgatcagctccaaccatctccgctgtctgagattcaaatcaggttgagtgaagatgtactttagacttttgtgatccgtatatacctcacaacggttaccgatgagatagtgccgccaaatctttaaagcatgaacaactgcggccaattccagatcatgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaaattttcttccttcttcaatagctgtgtcattggcttagcaattttagagaagttctcaatgaaccggcggtaataacccgcaagtcctaagaaactccgaacctgagtgactgtccttggtggggtccatttggtaactgactccacatttgctggatccatagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccacgacaaacttatctagaaattccataaacaccttattcatcaaattcatgaagaaggcaggtgcattagtgagtccgaaagacataactgtgcattcgaacaacccgtaccgagtgatgaatgctgtctttggaatatgctcttcgcggatcctcaactggtgatagcctgatcgttggtctatcc

SEQ ID NO: 86347 - DNA, 5888 bp, Oryza sativa
ccgttgcattgggttacacaagaagatattacgttgtagatgtttattgcatgaaagagtaatatgatctagttatttcgttgacagatatgtcgaccaaacaaatattccaagtttaccatggaccaggaaacgtccgttacgggccactggggtagatctgtcagattttattgtatcagaaaggggaattgatagaccggctgagaggagtgtaccttctataaaaggatggttaatgaggggcttgagagttgatccacagacaagtgacataacaatcaatgttatagtaagtcgggcaactgagggtttttattgggaactaatgccagttcaaaactctcgaatgtggagatggtatttggaaaatgcattgcaacgcgggtggcctctagctttggttccgtttgttcacccgaaggatccaggtgtgcagatgaaaatggatgatggcgagggaccaagtgctgaagtaaatgagacttctgtggaagaggtcaacgcacgagaggacgggggcgtagtagctccagtgggcattcaaccaggtggagtggccgacgagggggagactgtcggtgccattgtggatgaaatggagagggaggattctgacaacgagcgtgtagaggaaggtgattcgtcagatgatgagacggatattaatccagcagaatgggctagtgaggatttttctgggcttatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtcgaaccggtctcaatataaagttcggtgtgttaaggaaaaagatggttgtccctggagagtgcacgtgtataaggggaaatggaagaattattggacagtgtcagtcgttaccaagcatacatgttttctacctggtgttcagaaataccacaggaacattacatgtgcatttgttgcatctgagatatatgcgcatgtcgtcgataatctcacatatgaaccaaggtcaataatccgacacatcgaagagacatacaagtatactattagctatgccaaggcctggagggccaaacagaaaataatagagatgagatttggaacttacgaagcctcgtatgacaatttgccacgcctgcttggtgttatcgaggaaagaaaccctgggagctcttacgaagtgaagaaattcccctcaattgaacatcctggcaagagtgtgctgcaaagggcgttcttagctctacatgcatgcaagatggcatttgtgaactgttgtcctgttctctgcattgatgggacattcatgacaggaaagtatcggggccagatactaacagcaataggggtagatgggaacaatcaggtattgcccttggcatttgcttttgttgagagtgagaataccgacagctggtactggttcctgaaattggttgaaacaaaagttgttggtatgaggccaaatgtgtgcctgatacatgataggtacgctggcattctgcgagcgatagaaaagttgcagtttgggagtatggaacgaggataccccggtgtttgggaagatgtacagagtaggtggtgcatgcgtcatatgggagctaatttcttcaagcaattcaagaacaaggagctcatgaacatgttcaagaggctgtgcaaccagaaccaggagaaaaaattcaatgagctttggaagagattagatgagttgacagccaaatgcagtgatcagcgtgcagcggctccatcgaccgccgttgctgaccctcctcaagctcttggacctctcccaacggatagtccaacattggttagaagaactggattggagattcggaaattttctcaatggattctgcatgaaccaaaagagaaatgggccaaggcgtatgacacaggtggtgctagatatggaataatgacaacaaatttggtagaagtttacaattgggtgatgcgcggtgtccgtggactgccactagttggcatagtggagttcattttacatgggacatgcaggtattttagggatcggttccaggcagttcttccctctatgccgaacaacagcattttgtttggaactttcatgcagaaaaagctagaggagttgcgtaaaaaggccatgaaacatcgtgcactagtgccaggtacccaacagcacaggtttgagatactatgtcaagataaggcaggcaggggtatctaccgcaagagagtgaagcagaagtgtgttctcaaagccgacggcacatgtcattgctcttgtgcaaagccaaagctgctccacaggccatgcacccatgtcattgctgccgcagcggagtgtggcataccagatgcagtatatgtgtcacagtacttcagtaagcaagcaatatatcatacatggagcggcgagatttatgggttcggcatagctggggaggtcacagagactaacgatgaagtactcaatattcctgacccatcgaagctccgaagcaaggctggaaggaggaggactcgtcgcatccacaacgatatggacgagttggaggctggcaaggtgaagcgttgcagcaaatgcgatgaacatgggcacacctacaagcattgtcctaaagacaaggagaaaccaagtgcggcggaggcaggactatcaggatcagcagcagatggagctcgccctacgggtgaaggcactacctccactcgaccacgtcctaggcgtcatcgtgccacgtctggctacgtggtgtagttcttatgttctatgttggcatgtggctttgtttgtaattcgtttcgaacttatcgatgtgtttatgtttcgtcgtgtaatgtcagacttcggcatgtcatgtcttttggtctcgtgatgtaacgtcagactaaggcgcctaacgtctttaggtatgctgatgtatgtcggacttcgacacgtaatgttatgatatattatcgagctctacatatatgttaaattgcatgtcatcgttatgtaccattagtaacgtttgctatatttaaatagcctgtactcttgttgtacataattattctcatgactttattactatttcataattttgcaagttatcttttgttttacattactactttctgaattgttctaacacgaaacactatattttccagagatggcacgtcaggatacacctcagttgttggacccggcgatagatcaccgacaccggtctcaccttcctgcggtgcagggggctcagcttgggacgttccgggcacggacgtgcggtgagctactcacggttcacgactcctttatcgagaggtacgaacagtgtatcactataagttagttgcgctgtaatattttttataatgacgcattaatttgttattgtaggctgtgtgaggccggcctcctaccgatgtgtcggctggtggaggctgctgccggcgacgcggacccggccagacgatggattgacaggtccccgtccagctgcgcacgttcctaggccgactccccctccgcacggaggtaagtatttttattactatttctgtacatgcctcgcacatataagtgagccgtttcacttgccgattgcttcagggtttcgtgcaccgttcagcaccccgccttcctcggctaggccttctgttgtgccccccacaggtacttaaaaaaacaacattacttcgacaatcaatttacatgcattttatgtcttagcttacaagggtcccgttgtcgatgtgtaggtttcgcctagttcgctatgacgcaggccgcgcacttctcccaggctgcagggtcagcgtctcaggcagctgcgtcgacctcgcactcagcgcagttctagcagtacaccgggacttcgtcacaggtagccggcacgtcgagtcagggtccaccactggaccatgctgggacctcttcggaccgcttgctgccttccaccttgctcttcgacatcactgacttcgacttcgcttcaggctcgacagaggacgtcatcggcccctcacagttgggaggcgcaccgccggtgcagacgcaggaccaggcgcaggccactcctccgcgggacactcgtgctacccatgctgtgccaccggatcgtttcacctactcccaggaccatgtgcgagcacaggcccggaggaccaagcgtggtcgcggcgcggggcagggccagtagagcagtcttctctttgtttatttgcttcactttccagtactgtatgcttgtgtaatgactacgttgttgttatatgtgcacgatacctttcggcgcatgcacgatacctttcggcgcatgcacgactactttctgccgcaccgatgcagcctcctttattcgcgtgcgatacgagtattttcccgccatttggcgcatacaaccaatgtaactttcggcgctgatcaggcatgtaactttcggccccaatcaggcgtacccaccataccccaccacgttcacatgtcaggggtatcactcgattttttgcgcctatataagtcgccttaacgagtgaggcctcacaatctttcagaactcagtcacattcagtactctcttccccacttgcttcattacaaatccgaccggctttcgtcaatggctagacgccggagtgttgaggatccaaactggcgtagcgatccttgtgtatacctactaccaccttggtgccagcgtcctctctgcctatgcggtgatcgatgccaactaatggcttcgaggaatcctgatattcgaggaaggcgcttttttaggtgccctaactatgaccgtgaggtattttattatctgcatatgcttattcattccgtatgggcaatcgctttattctttgtaacactactctattcagcagacccgcactacggcttgcgtatacatcgagtgggtcgatacagaaaatcccgttctcgacctaaccacttgtttacaagaaggtcgctggtatttcgcatccgaaagtactgagcaatacttacagagaaaagcggcttatgaacgataatatcgtgaacaacagagtgactggcgggtgctaactacggcactccctccatgggaagcccgtccaagatacaggtttagtgatcgttgtcaggttcttcgttccataaagcctacaacattgggtcgaaggttctttgtttgtccaaatattcttgacgacgatttcatggtaagaatattttgattacatgaatccttattttctcacaacatttcctaactttgctcgttttacatctattctttcctcttaggaaccactaaggagatgtcaatacagagaatggatagacaccagaagggttctaactctacctagtcgtgatgtgcagcttgaactaccagagcaatacagggttactaaagtgcggtttgagagaggagagggatcctcacgtaggggttagctattatcggacaacttggcatattgaaatttctactgtcatgcttccttgtcccattactacattgtcgttgtgttcaactattgcactacctccctcctagttcgaatctaatatcatgttcaaattgtactactatttcttcatgttacataattctccttgtttaagtccatataatgtttctacgacccagactgcgataggcctatataaattatccgagtactaatacgtcgaataaggtacaaaataatacctcacttaacatatgaaattgcgcaacaaccaacttcaatacatttttataacaatattaacaagttttaccaataaatacttctttatttattattaacataacatagaaaaatcttttggccgtacttttacatctgggtcc

SEQ ID NO: 86348 - DNA, 784 bp, Oryza sativa
cttagctttgtaatattccccttggtgatggcagaagtggccaatgtgggaacaaagtcgtccatcaataacaatgaagacaccagtcggcggcgacgaaggcggtcgacggtgaaagcgaagatgcccactaacggcggcataataggccagccgtgtaagcggaaacaccagtcgacggcaacgaaggtgagccaacggtgaagatgtagacatccaacaacggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtaaacgcccaacagcggcggcataataggccagccgtgtag

SEQ ID NO: 86349 - DNA, 7107 bp, Oryza sativa
gatttttcattttttcagggcaaacaaggttaagtctctggcccataagactactcggtactcacgcccagcatggtacagcatgtgttgtactttcaagttgtagtacctgcggtgcattcattaggtcgagccaacccgactctgtgtacaggagctcatgtcagaccccatttagccacacctacccaaaccgctgagtatgcaggagccaacatgcataatcaagccactaagacaaatgtgagcattagatgcacgttcactggtgtagcaggcactggcttgtactatcatcactgtacatgagagcacaggggagagacaagagaggaacaacattggatagaagaacaaggaaacatcactctcactaacatgttggaagtggcactagccaagccaaaacaacatgaagtaataatgaacacatggttttctatttttctgcaacagaaatttctcaaccttgaggttaattggtaacattttttatgagatattattgcctagacctagagttgtcttatgctagcaaaaaatgagcttttcttgtacttcttgttacacacttaactagtggtatgtaagttgtgtacttgtgacagtttgccaacagaaatcagagaagaaacttttggaggatccaaatcctaatagtacggtgtgacaaatgtaatccttcaaacaagttggcaatcttctgaaaatattatctaatttgcaccaggcgaaagcattagtaattgacaactttcaaatatgtactgaaaaatagtgcaatatttcagtaatttacctcaacataaaaactaaatgcaagcttgcaggtgagcaaaacgacccaaaagaagacatacctgttgcatccaaatgaacagtcatattcaattcaaaggaaaacaataaattgaaaaggtgaagcacttacttaataatggacaatatatcttcatgcataccacgtgcaacatataatcttggctgatatgtggcaaaacatcatgtaagcgctaattatgctcaacactcaaattagttttgtatgtgtgcatcatgttaaaggaaatatgaaacgctgacctgaatccaccacataataagaccaattacacgccagtttgagcgttccatgatattctgaagttgtggcaacaagaaaagaaaggcagccaaaatgtccgggactatatatatgatgattgcaacattatatactgacgggttatgccaatttcctacccaactattcaggagttttccagcaccagatgggtatctgatggaactagaatatgctaatggaagaattattatccaagcaatggccacgaagaattttaatagatatctgactatttgtatccagtccatattcccccatgcttggaaagtaagcactatgtccagagttactgcacgagtagaaaataggagttatagaaatagcatagctctttgaaatgaatactatgtagtacaacaaaatagttcaacctgacaaaatgaaaagcatttagaagagagtactacacctttaatgaagttgagtagagcagctgttataaagacacttaaaacacttctgaaaacagttgcatcagcaagcgcagaaagagatccagacgaactccatgatactattagcattgcctggaagtggaaattcaaggtgtttgtgttgcaagtttaaagagttgaaaagattctgatgtacttcagaaagaggagtcacctgaaaagctagtatgaaaaacatccacattcgattaaaacttctaaatatgtgtagaaatgtgcggacttcaacaaaattcgttttgggctttgttgatgtagtgcgctgtaagaagaaaaaacaaagaaacattagctaaaaagcaactagcgtatactgtttatttcaagtgaacatgaaacagttccaagatctgaatacttatcatcctaaaataatctttccatgcaaccagccaatcacatactgtcaaattaatttctttccagccaatatttttcacttgtattagagcaaaatctgtgataagttctctgacacaatatttcaacagaacgtgatttggcacaggcatatttggattgaatggaacagatttgtcttaagatgagattctggcagacaggtcactatggaaaacagttactccccttaatgtaggctcggaaacagcgaagaaatcttcaaaagagttagtggtgaattcataaaaataaggttagaaatgacaatgtctagctatgtattaagctcctttccacctctagataatttgtaactagtattttcttccctgacggcaggggctctcctgtattatattcctttctagtaaaatgtatatgctatggctcaaaaaatctcttaagacttaaagagccccaaaatcatttgaaagcgagcacaagcttacccaattgtgaaagtcacttaacataaggacaagtctagttgcttaaattttctttttaactaagaactagccttcttgcctaaggtattgaactatagtcattgcagactgcctgttaggaacacaataattttgcaggatatagtatgattcctcaaaataaaaccatcaaaacatgccactgattataagtatcattttgactgttctcaagatcaaagttctattcatacattcataatgaaactataatgttaaattctattatctaaaaatgatgaaatcaccatgtggttcaccaaactattggtgcgatctccctaataagacaaccagattctatccttttgatgagggaccacacatttgcaccatgctgacattaatcaaatcaataataactgctacttaccccttgataaaagaagtccgctgtaaggtcccatggccagttaagccttgcaaaacatttctctgacctgcgtggaagaaaacgaaaactcacagactgaaaaaataaacaaccacacagaagattatgagattaccaaaagtgttcgttcaaatcgtcatagtttctccaagtagagtggccagctgtaccacctttactcttatgtgcttcctttttttggttaaaataagaataacagtttgtaagcacaagagcttctcctgcaaggaaaaattaagttatttatcaaactttaaatactcactttctgcaaaaccttgtagataggttcaatggcagttttcagaaatgatccctcttcttcaaatcctggtggtgattgaaaattattttcttcgatcattttgtgcaactgtcttgccatctgccaaattatcagaaagtaacagtcaaaacttatatacaggagaaataagaaaaccataaaatagatattgcaacttatgtgatggttcatgatgaaagatggtttgaatggatgttgtagctggttggatattattactaattcaccttgacagcttgataacacattcatggcttcaattcaatcacctcacaaattcattattaaggtatgcttacagttgaaccttgatgtaggcaaggattgcatcacatggaataactcccatagtcatattatcatttccagtagccatgcaatggacacaagatctacaatgctagcagtaatattgagctatttccatttgcttggactgaatttgttcagaccataaagtccaaaataatttgtgttgagcccatacggcatcgaaatctagaagaagataaaatcgaacactcttgctagcatgcctcagatatttcagcagaaatttttttcgttgtgtaaaatggcatatttgtgatttataaagaagcaaatgtttaaggagcaccaaccccacattaaccaaaagtacatgagactgttaaaataattcatagaataaacaagccagggtcagttcttgaatttctgaaagcgtgaactggcatataatttaatgatttgttgaaaaagatagcaacgaaacattatatatgtaaattaaataaatcaaccatgattaacaagttattcaaactggaatacaaaaataaatgaaaatttagattggaaaacccttttgttccaacagatacttacatggtggaatatgtctagatcaaccatgatcaagaagttatttaactagaagcccttacagaagtaaatgaaatcgagcatggaaaacccttccattcaagccgatacttacatggtgaaatatgtagcacaggcactcaggcataaaacgaacattcgaggcctcaccccagataagaagatacaacccaatgtgaaggagcattaattgttgtttattttgtgtgactgtctcaacgttcctgattccagaaaacagaataatggtatttgaagacattaaatattgaaggatattgagaagagaaataagcaaaatcttcataaactgttgaacgtacatgatacttgaactaacatgcaaatagctacaccatgattggtagttctgaagtatctttttccataatttattcacagtgtcaacctgaaagttaacatgccagcatactgttagatttcctttttaatgtgaataccaaaattggtagctcgctaaagaaaagcacataataaacttaaagcatgaaagcatatatcttttaaatgaaacagaaagagcattcatcttaccagaggatggtcttgcccagcagtccttgtgccaatatttgcgagcagcaaaaccaagttttctctttgattttccacatttgatttctatagtgagaataattaagttcaaatgtcacaatgtttaaatacggttgtcaaacataataacatgcacataaataaaactgacatgtggcagaaaataacattgtatcacttccatttggaaccagcggaccatatacatagacgttaaaaattttacctgaaatccaaatgctagtgaaagccagtcaagtaaatctcgtatggatttattcccatccgtgtgcatagtagacatgtgtggcattggaaggccatcgatgctatttagcgcatcaatagcaccttttatctatatcatttacatcaagaataccatcattaataaaaggttttatatacaggtagaaatagtgtgagcaaggagtcaaacataggtgtgaagaattataactaacctcatggagttccacaattgcctcagatgaacctggaaagttcaggggaataatgttgtacttgtagttcttgaaatgaacactcttctcctcaatcactttcgcaatcttcatcacctataacacaaagtttggaaggttgtagagaagaatattaccagtaacaagtgaagcacagggccttaagcaacaatatgcaagaagtacctcagaatcaactttgttgtttgtcacatctcttaacacttcataaagagcagatgccacttggtaacgtctagccacttcctcactgagcattcaacatcacaaaaggtggttaaaacagatcatcaataaggaaacagctaatcagtgcattgatacttacaagtttctcttttctgatatcctactcagctcagcacaataactcttataaaatcgttgaatttcctttgcatcattgcccataacttgggtgtcgtcctgttaaacagagagtaaactcaagggttcatcactggagaaaatattatgagaaagaaaacacttttaaaatggaacataaagataattttaatcaaagtaaaggtaatattgcaaacataatcacaacaggatcattttagagttccatgccaaggatgatacacagtcatgactcatgaatgattgccagagccgttattggctatgtaaatataggactctatatgtttgactgcttcaaatgccagctgaaaagaatatttttccctaatatcaagataaatgaagtaatgaaagaacgtatttggcctcatgggtcacggcaatatattaagcagccatttgaaagagaataaggttttaatgcccctggagggcacctgctcccatttgtaaggttgtaaatgactagcaagattatctacatcgtaattgttctttatagaagacttatctaatatctgattccgaagagtaagaaaacaagagttaatagacagtgtatttacatattaaccagaacaagggtaagttcagtaccagaaaatatgcactaaggctgtttcaacagaaactcaaagagaaagatgcagattttatctacactgagggagggtacctgcaacattacaatttcagacatacctgatctagcttaactgacatgtatgttttgaactgtcgaactccacgttggactgatgatggatccattctttggactttgttgtacgcatatcggcgaccttgatacaaaaatgcatgtaggaacaaaactcatatcagaaagacctgtacatcacaatacatgaaagaaggaaccaaatagctgataagataaacaaacacggaagcaaccacctagtaccaaatcggttcatgaatcatgatgcactatggcatgcagtgaacaaatttctagttagcatttgtatcaacaaaatgaattcatgattacttttataaaactgtcgtgtgtattgcacggtatacccaactactagctgtcccaagtaaatttacacataaaagtgcagtatttgttgagagttcagcttctcatgacttcatctaagctttgatggaagtgaaggattaaaccatctgctctctgaaaaaaaaaactactcaaatccagcataaatgtgcctttgcactcttgtacactgaaaagcgagaactcctatcctgtcccgttataaagtaggctatcaaaccctggtatgcatatgagttactcaggccataattagtcacacaatcaccagaggtgcatgtcaacatgaatgtctgctgtacacaacaagcatgggtaaacgttccaacgaaatatgaatatcgagatcgcaatgtaggccaaacagtacaaagtttagctgtataattttcaggacctcccgctaataatctgtcaaggtgtgaaacaaacaacccaacccagccaactcaatagtatgcactatgcagcatggaaatggtttgcgcttgcgcccatcatattcggggggatccact

SEQ ID NO: 86350 - DNA, 1437 bp, Oryza sativa
aagaaaacactgtgtcgggcgacaaacactttgccctcttcccgatgataaaaataatatcctttcgtttccttaggataccccacaaagaagcatttatctgatttaggtgtgagtttgtctgattgcaaacgttttacatagacctcacagccccaaatctttaggaaagacaaaatgggacgcttccctgtccatatctcatatgttgtcttatccactgattttgatggaaccctatttagtgtgaacgcagctgtctctagagcgtaaccccaaaagcttagcggcagatcagtttggctcatcattaatcgcaccatgtccaacaatgtacgattcctccgttcagacaccccattccactgaggcgttcctggcggagtgagttgtggaacaattccacactcctttagatgattgccaaattcaaggctcaagtactctccaccacgatcagatcgtagatacttgattgtcttgcccaaatgattttgtatctcattttgaaattccttgaacttttcaaaggactcagacttatgcctcatcaagtagacataaccatatctactaaagtcatcggtaaaggtaataaagtacccaaaaccacctctggcagttgagctcattggtccacatacatcagtatgtactggtcccaatagttcacttgccctttcactttgacccgtgaaaggtgcctttgtaattttgccaagttaacaagattcacatgtctcaaatgattcaaaatcaaacgagtgtagaagtccatctctatgaagcttctccatgcgtttctcatttatatgacccaagcgacaatgccaaataaaagtgggattcaaatcattaggacgttgccattttgcattaatgttatagactgaacatccatcaagattcacaatgtataagccattcatcatgggtgcatggaaatagaaaatgtcattataatagactgaacaaccattgtccatagatctaaaaccataaccctctgcttgcaaacaagaagcagagataacgttcttacacaaagctggaatgcaataacaattatttaactccaaaactaatcctaacggtaaagataatggcatagtgtcgaccgcaacagcagcaactcttgctccattgcccacgcgaatgtccacttcgcctcttgctaagctcctacttcttttcagcccctacaacgatttgcatatatgagcaactgacccggtatcaaatacccaagaatcagtagaggaagtagcaagattaatttctataacattaatacctgaggtggaactctttccatcctgctgcttctgcttgagctgctctaggtatttcttacagtttctcttccaatgacctgtctccttgcaaaagaaacactctgcatccttagcgggcactgtcttttgaaccttgggctta

SEQ ID NO: 86351 - DNA, 2643 bp, Oryza sativa
tcaccaccttggagtcggtgcccatagtctgtgaatatcccgacgtattcccagaagaattaacgagtatgccaccagactgagagattgagttcgccataaaactggcgccaggcaccgcaccaattgcaaaaagaccctaccgaatggcagctaatgagttagcagaagttaagagacaaatcgaagaattggagagtaaaggttatgtgcgacctagctcatccccttggggagccccagtgcttctggttaagaaaaaggatggctctgagagaatggtaatcgactatagagccctgaatgaagtaactataaagaacaagtacccgttgccacggattgacgatttgttcgatcaacttaaaggagcaagagttttctcaaaaattgacttgaggtcaggttaccaccaactgaaaatcagatctgaagatatcccgaagaccgctttctcaacgcgttatggtctatacgagttcacagtaatgtccttcggactcaccaatgctccagcgttcttcatgaacttaatgaacaaaatctttatggaatacctggaccagtttgtcgtggtgttcatcgatgacatcctgatatactccaagaatgaggaagaacatgctgaacacctgaggctgataatggaaaagctcagagatcatcaactattcgcaaaattctcgaaatgcaaattctggttagaccgagtagcatttcttggacacgtgatctcctccaacggtgtcgaagtagatcccagcaaggttgaagctgtacttgcttggaacccgcccacgaatgtgtcagagatccgcagcttccttggcttagctggatattatcgaagattcattgaaggattctctaagctagccagacctatgaccgagctgttaaagaaggaaaagaaatttcaatggtctgcagcctgtgaagacagctttcaagaaatgagaaaaggttgaccactgccccagttctcaccttgccagatatccgaaaagatttcgagatcttttgtgatgcatcaagacaaggcttaggatgtgtcctaatgcaagaacgaaaggttgtggcctatgcatccaggcagctcaggcctcatgaagtcaattatcccacccatgatctcgagttggcagccgtggttcatgctcttaagatctggaggcactatttaatcgggaacagatgtgaagtatacaccgatcacaaaagtctaaagtatatcttcacacagaccgagttaaatatgaggcagagaagatggctggaactaatcaaggattacgatcttggaatccattaccatcccggtaaagctaacgtggtcgctgatgcgctaagtcgcaaggtctattgcaacgtagctcaaatatggcctgaccaagatcgcctgtgcagagaattggagaagttgaggctgaccgtggtacagtcaggtgtccctgccagcttgacagtacagcctaccctagagtcgcaaatccgggaagcccagaaagacgacgaagggataaaagagttaataaaaagaatacaggagaagaaagacaccaatttctccatagacgatcaaggcacggtttggtgcggtccacgcatctgtgtaccggccaagaaggagttaagagatctcatcctaaaggaagctcatgagtccgcctactccattcacccaggaagtacgaagatgtaccaagatatcaaggcatacttctggtgggctggaatgaagcgagatgtcgcagaatacgtagccctgtgtgacgtttgccaaagagtcaaggcagaacatcagaggccagctggtctgctgcaacccctatcgattcccgagtggaaatgggaagagatcggaatggatttcatcatcggtttgccaagaacccccagcgggtacgactccatttgggtaatcgtggaccgactcacgaaatcagctcatttcgtgccagtgaaaaccacctttgatggaaagaaactagcagaactctacatgacccatgtcgtatgtagatttggctgtcccaagaaaatcgtgtcagaccgaggcactcagttcacctcaaggttctggaagcagttgcatgaagccctcggaaccgatttaaatttcagtacggcctaccatccgcagaccgatggtcagacagaaagggtaaaccaagtcctagaagacatgctacgagcgtgtgccttggatttcaaaggcacttgggatcgttgtttgccgtatgccgagttctcatacaacaacagctatcaggccagcattcaaatgtcgccgaatgaggcaatgttcggaagaaagtgccgcactcccttgtgcttcccggagctgctcccttaggtgctgaatctcgaggtcgagattcttgttaggggggttggtctgtagcgcctgttccgtcgtggcgcctagcgggaaaattatctcttaaaaaccctaattgcgaaatttgtttctttgcttgttgtctagtgtccgtgccatcccaagatctcaatccccgatctatcatcgagtccaattccgaatccaatccttccaaattaaattcctccgcaaaagtctattttgcctcccccgggggtcgatgggccgatttcctcccggcccatctccccctgggggcg

SEQ ID NO: 86352 - DNA, 9052 bp, Oryza sativa
attcctgcagcccggtaatactggagtagcgttatagcacgattgactgatgtacagatgtgaatgttctggtgttctgaaatggtttggatgtctgcactgatgaaaagcattgctgagaagaattgcgcctggtcggatgctctgcacataaaaagggaaaaaaaaaagaagaaatctatgtctgcagcctatgcaacagctttttttttttacctctaataggacagtgtatgctggagaacaactatccggtataagataatcgatacatggtctgcaaccacctggatagacatgcgtaggtacaatggtttcatatataagaaacaacagaagtggtgattctatggcacaaatgtaagcagattgctcaggaaggaagtagtataagcggaatagatatagtactattaataagactatgtcttatcacttgcagtgatatttgttagaacgtgcatatattacagacaccaaacattgctgatactaattcatttatcatttggctagctattaggggtagtgagcccgtaacaggtaaaactaatatcgattggtctaatggcttgcgcaaaagaacatttctcttttctatgttggcactgcaaaatagattgaccaaagtattttagctttgcttcaatcagggagagaagtatgcgcgttgccatgccaggtgcaaaaggtcacttcgctctggggatatcacatgggaggctcaagtcctgaaacgaagaatgtaaagcagagtcacatttttgctataacaaatgaggaggcaagaaatacatagttgcttgagtatagttggtcacattttggcagctctggtggcagcttgtctacgaacagtgtgtgcacaacagaaggcttgcgacgatcatgttcatcaggagatgagctacaaatggaagttgtttgagtcatgaggaaaaagagaagaaatcaaagtaaaacatgaaattttccattggcactaaccctccatggccaagattctcatcagccatagaagatttacgttttttatctagatgtgctatagctatgacctgataaagtattaatggttaggaaggtctgacaaagacatatgcatataattgatgtgagtataaaatatattgctagcctgtggagtaggtggtgttgcctcatgctgatcaccatggctgtcccttgtgtcctatacaaaaaggatataatctaagaaattatggtaacttagatgtaacaggtcacatatccttataagacaacacaattagattatacctttgtatctggaagcacaaacggcgtagaaggtggcatagattgagtagaagacaaaacgatggcatgtggttcaactgcattagctgatgttgagccatgtccagaagagcccatgcaagtatcatggctgggtagacaaattgcatggcttggatctgggtggggtagcataagggaatccacctggtaggatacccgatttctttgcaatgagccacgtgacacactagttctaatgacatattgtctgccaaaaattgctttgatctctggtggtactatatctcgtgctccatgaacagatgcaaccaggttaagaacaggcctgccaatcaattgttcaccgatttctccaaagaaggtaaactcagcagctttggcttgatcgtttgccaaatccgatggatcgatacccatgataactactctgtacctattatagaaggcagttcagacagttctcaatacacatggattgaattgtagcatatagattggtttatcatgtaaaatacttgagaaaagctacatgtgtgcatatgataagagcaccttgtttctattgcatcagtgctgcatctcgggcatttatatgcgtttccttctctagctgtgcctctcttataggtgctgcatgctatataccaccaaggctcagcaggaaccaagtccctgatgattatattgacaacatagctattgccctggttgacatgcgaaaaatggaacaagtaaaggatggcgctaataacatatgatggaaataatgatcactagtagcgctgaggtaggttatattaccaaggcctcatggggattaaggtcacaaatatcagaaactttgacatttatagcttccttttgaccgaagttagcctctatcatcctgaccacctgtgggttaccgtgaaggcttcaaatgtgaaagaagttagtgctctggtttgtaggttagggaaaagcattgatctacatgacacataaggtagcgaaaaaatatgttgaataaagtagaaggatgtctatgtgtatgaaaagagcagagctaagtggcacctgcttatgagggagattgtttcctggattggtgcgttaggataccatctacagacagtgctaccctgtagggctagctggcctgtcaaagacgaaagaacacatcatgtgagttagaacagtgaaaatatgcaaatgagataggagggataatagaacaggaatttatttcttacggtctcgaaatttaacagttaaaccaacaaataacatgacaacatgtccattgtctgcttgctgctgcaagttttcagcgtggaattgtgtagcatggggaccccataacgccacgacgacagtttctctgcaagcacataaaagaactaagaagtggaaaataatgcagatgactttttaaccatccatatttgctactaatcaagatgccagagaatgttcgtctagaaaaaaaaggagaaacatatatgtttccaagaaatcgatgatgcacatgaaaaaagcaataatgatctatccgtgcataggttgctcattttggatggtagctttcactcacccagaacagaaatatgtttggaataggtaacgtatcgatacgcacataccttccattggttatatggtcattaagcacagctttcataacacctgcataagaaacagtctgcactggcccgatggctgtcattatgcctatagcatctacatgggaatatgagggaggaaaactgtatatgagtaaatgagggcagcaagctagaaatggagaagattaataagcaataatatagattgatctgggccaaggagacttacctgaaataatatctttcttgtaagcccgagctctgagttcatcaaaagaaagaattttgcaggcataagatgggaacgtggatggtggtccagtatcttctgtaacggttgtgtgagcagtgaactttgccatcaacagtcgatcaacaggcctatactgggggcgtgcctcggcgacttcgaagtatttgatgtaatacacagcgccttcctttagcaaaggcttgaattgaacaacgcggcgtcctgggatttgcgcatccatcatgtcgccctgttgatgtttcaatatgtaagagggtgcggaggcaaatagtgtgcagagaaagaaagcatgtactcggtgctatgcctgctcatcaagcaggactaaatcaaggcgcaaaatcttgtcaggctcattagctgtggtgaactccgagaagcgggttgcccgcactcgtacgcgccaacggtgtgattcctgtgtgacatcctttaggagactgtaatccatctgcagggcatagaaaacacatcatgcaggttagaggggaattatacaaacaatgttctgcatgatatgaaggcgcaaagctgtaattgctgaagggactatggtggagcatataagttttttagttttggagctgagaattattttcagtgcagggcattttaataaatcatgtctaaaagcagctgatagtaacaagagagaaatatggaaattaagaaagaagaatcgataagcacgcatgaaaggcactggaacaagcaagtgatcaaacaggaacaacacatatacgaacacaagctggcagtaaaggctaaacaaaagggaacaacaaaataggaaagctgcaccgacaaatgggatcacagaacaaagagcttcacaaaagagccatcacagtgctgcagagatagccacaataaaactaatctacagcaacgataatatttcgttgtagacgatgttcttggtggtggaacaaggatttccatcatcatcttctatcaataacttgagtccttcctttgatgtagctcgcgaaacagcaacatatagctatccatgtgtgaagatagggttcttgaggtatacaccaacatttcctaatgtctgcccttggcatttgtttattatcattgcataacatagtctgataggaaattgcctgcgctggagcgtgaaaggccacttcggactatttccacttaggacaatccgtggaatacagaccagctggccaatatttgtcccagtcatgattttgccctcaaaaataaaatcaccaagtcgagtaaccagtaatcttgtcccattgcaaaggccaagtgattggttgatgttgcgaagtaggacaactgctgaaccaattttcagggatatgtgatgttccgggaagttgtttatggatatcgagtttagaaattctatgggatacaacagatcaaaatccgcagctttctcaagtgtatttgcaatagtgtcgctgctaagatagtcctttgcttctccaggtactttggcaagcatcatatcattaacctcatcaacaactgcatttactagacagactattgcgcgctgagcaagatatgggatgcagtcatagttggtctgaaaatctgggtagacagcatcaattatagctgtaatcttgtcaccatgtggagtaagcaacaattcctcaggtatctgtatctatgtctgtcacaccccaaagttctttcccaagcctaaattgaagttataaatggtctcaagagaatacttgtgtaaagcaagagtaaaccttaataaattaatgcaaataataatcggaactgacatgtggaacttttgagttctacatgtcgaaattcgctaacaagatttttagtgaattttcagagccctagaaataattttaaccaattaaaattgagcaagcaatattttaattccagggaaaatccttttcttcctttttctttttctttttcccccttttcttttcgagtgggccgccggcccattctccttcctcctctcccctccgctgggccggccgcctacctcctcccacccgggacgccgacaggtgggccctacctgtcgggcccgtctcctacctcgcaaccgccatcgccgcacccactcctccgctttccccgcgccccacgccgcgtcgcccgtgcccacgccacgtcgccgccccctctccccgcgtcttccggccgcgcctgcgcacgagaggggcgggattcgattttgaatcgccccccaccttctctctctcctcccccacgtcgccggcgaaatcggggcgcctcccggccacgtccgcctccccctccacctataaaatgctccccatgcccttctctctcgttttccgctctcaccgctccatcccgtgccccctaccgagctcgcgccgccgccgcttgcgccgccgcccgccgccgcactccggccgtgtgctgccgccgctagagccgtcgccgcgctaagccaccgccacccctagcttcgccgccgcaagacctttcccggccgccgctttgcgtcgccggaatcccaccgaaaccccatctccctcgtgtcgccagttagttctctctcccctccgactccggccggcgtggatggtcgccgtgagggtttccctctgtcttaattcctcctctctttttccctaggtgtcgccgtcgcttgtccgcacctcggcatcgccggtcttcgccgcctccctcgttttccaccgccggccgttgccgcccctccggtgaggtctccctccccttcctttccttccctttttttcccgtgcgccgccgccctcttcgtgcgctcgccgtcgcgttcggtcgtcgccgctcgcgccgccgcctgccgtccgtgccgccgtttgccgtcgccggcggtcgcatgcgcgcgccgccgctttgccatggccggctggtcggcttgatgccgggcctggccggtacatcggcccgtggagctggggccgtggggcccgcttgccagccgtgccccccttgagccgctgccgagtggggcccgcgtgccggcgccccttttccctctctcccgagccgctgaccggtgggccccgcatgtcggcgcccccccttgatgacgtcagccctgggaattattgcgcaataaatgatttaaggactttttgttatagtaataaacacagtgaatcttctaaaattcataactaattcatccgagctccgtttaagcccattcaagtctcagtaaatcaagaaaaatgcgtagaatccactaaaaatggttttgttctctgtttcagtagtcttatagcctgtttgtattgtttgctttgtatgtcgcctagattccggttcttccgacgctccggtgtacttcgagatagtcgccgaggttcctccagctgcagagcaaggcaagtcatgcctgtcacttgaacatgttgatcctatattgcaaatgctctattgtttttcttcaaatactgcatcgttttataatgttactatgggatgtttacctattgttacagccatgctattttggtaccctgctcctttgttagctcgggttataacatgaatagacgttggactaggagttgcttagccatgcttagttcaactagcacacaatggggaaatctcatttaaaatatagactgtaggttcatatgataatgttggtttagtaccaccgctttggtgttggttaattaaaatgaatcacatggtgggctgtgggtgcatggttttgcttgtcgcacccatagcaattaaggaccggttcgcgggaaaccctggaagaatttatcgtgcttaccacaagccagcgtgggcaacggctgggcttgtagtgtagcttttctctagctgacgcatccaggcaagggtgggcgtgatggagtttggatgggccctgcgacggcctatgcggcttccggattcacctaggcacgagaggggactgcccatcgcccgctggggacgggggtgaaacctgaggtgtggtgtgcttggctagagggggttatgcgaagggtcctatcacggcctctttccggtatgtcgtggtggcatgtcggcgcacggaaacgtgtcgtggggctgtcttgtgggtacaattgtacacctctgatcagagtaaaactattcgaatagccgtgcccgcggttatgggcggtcaaccagattcaccgtgattagactcaccctagtttagtcttttgaaattagatagtataggtggatggttgggcctgtcgcaacgtggtatagcgttggacagtggatgattaatattgattaattattacgactgttttcttctttaaacttctgtttataaatactcgctttatgcaaatgaaccactctagctctcctttgataattccctgcatcatacccctattccggtatgacttgctgagtacagtgggtagtactcagtcttgctctatttttcccaaccccagagtatgagtatgtgtcagatggaggtttctccgaggagtaggcttcgtccgtgccgttgaggatgcctgtggagtggtgttcccgctgcagttctagtcaaggcttagctcctgttgtctttcgtttttccgctgcatttatgtaagacttttatgatgtttgtaagacgtggatctgaatgtcaacattgtcgtttgtgtaccccggccggtcctggacggggattttaatgcacattctgcttggaattctattcgggaatttctgggcgtgacaatgtcttttcaacctcaccctgtcgtctatccattggaacacgtccctcaccaatgtcaagaacccatttagcgaactctgctagctcatccttggcttgctgcgagagcgatggattatgtagcctcatgttaatggtgaggtgtaagacttcaacatggttccacaatgcagatttaaccaaggaagcaggcaccacatcagctcttgtaccttgctgaatcactggcaagacctgcctaaaatcaccaccaagcaaaattgctttacctccaaatggcttatgcgcattacttgcatcatcagtggactgaatatcccgaagagttctatccagcacctcgaagcatagcttgtttgtcataggcacctcatcccatataatcaatgatgccttcttaataagatctccaagtattgtacctctacgaacaccacacatggactgatcatgtatatctataggtattcgaaagcgtgaatgagctgtccttccaccaggcatgagcagagctgcgactccagaagaagcaactgcaagaacgatctcgcctcttgacctcagccttgccataatagcattccacaagaatgtcttttctgttccaccatgtctagatataaagaaaatacatttttccttatgagctagcctgtcaaagaccttgtcatatatcttcttctggtcatcattcaagctggcatacatggacatagactcttcatggaggctgtcttggttgaaactaagctcttctaaaataagcctatttcctgcactggtatccgaacattcagctggtgtcgggagatcgaatgatgagattaataagccattatttgagaaaatgccatccaattctttgagcaaggtgttctgtaacataacatccggaatagctctacgctgtactccaagagctttggttagcttgtaagcaaaatcatctgccatatacttccagtatttatcaaacaaaaccctaacatcacctacatcacaatgtgctagaacagtcatgaataggttcctgagttggtatgcagtagcccagataactgcctcttcaaagagatgaacccattcagcatcatcaccaataagaccacgtgcctggcaagcttcacgataggtgctatatgtcacaccttggtatgtcctgacatcttcaaaagtcatgcaacc

SEQ ID NO: 86353 - DNA, 16095 bp, Oryza sativa
  unsure (1)..(16095): unsure at all n locations
gtggggcaagtacggggcggagatccgcgtgtcgcagcagagcgcgcgcgtgtggctcggcacgttcgacaccgccgaggaggccgcgcgggtgtacgaccacgccgccctccgcctgcgcgggccgtccgccacgaccaacttccccatgacgccagcggcgccgtcgcctcctccctcgcgcgccacctacgccggcgcggcgtccgggtacgacgagtccagcgacgagtcgcagctcgtcggctcgccggtctccgtgctccgcccaatgccggcgcgcgcaacggccaagaaagaggccaagaaagaagacgactccgcccccgatatcctcggcatctccgccggcgacggcttaatctctccgttcacatgcgacgtcctgaatttcccaccgcccgacgaggacatgtacggcggcggcatctctttcggcgagccgacaccgccacccatggtgttcgacgacgactgcatggcgcgcctcggccacgcccccaacgacgacgagcacccggtgacgagctcgtccttcctcgacggcgatctcggcgacctgccgtcgtggacgaaggtggacggcttcttcagcgacgtcggcggcgacgacctgttcgccgccgagccgttcccggcgctctgagactgacagttttgtcgcgagctttgtctacgtacgtacgtgtgcttgtgtagtgtgtgtttaattaattcgtttattattagcgattgcaaatatttcttgtgtcaccgtgagatcaccggagatcgccgagggaatacaaatatttcttgcaaatatatatcaccggagatcgccgggggaaatgcaaatatttcttgcaaatatatatcaccggagatcgccgggaatgcaaatatctctttgcaaatatatagcggcggagatcgctggcaatgccaccggtgacggcagcaaaccggcgtaatatagaagacgcgccggcgtaatatagaagacgctgccgatattatctaaccttcggatcccatgcataaaaagtgcatctggcgggttcggagataaaaatatccgactccttttgggcttttttcctttttatgttttctttttctatggttggaccatgtttcccgcttggttctccgtgcccagtgtagctaacgggccgatgtaattgtgccgtccaatgattttagacccaacgtgcaccgtgcgaaatagaataagttcactttggatctctgatcttgacaccaaattccacttggtgctatcagtctgtttctacagtggcaccgactaggacaagaaattgggctagattaaaagcccataatttacacggacacgaaagttttggcccatgttgatgaataaggtggaatcgaaccctttcgaattatttttcatagttttcaaattaggaggattcggagattaaaacatcggccctcttcattatttttttctaccttttgccatcatggcctgataactttgggacaactttggttaatcgactcgaatattacggacgcaacaatcgttttaatatatcagcaggcttatacttgaaaaaaatcagcaattgcaagcacatacgtaattaagctcgtattaattggcttgtaatttacaaattttcccttgttttcctcaagttttgcccttttttgctgtcatcgtaatttacaagtattacgccttacaaatgcacatgaacgaatgaatgggtcgacgaattttgcaagttattaattgatgattgttgtttgattaaattcaccacgcttcttcgtagtggccacaatggcggcgacggaggctgtgacgaccgacgacgcgacgatgatggtagtgtgtagtgtgtgtttgatttattcgtttattattagcgattgcaaatatttcttgtgtcaccgtgagatcgttgggggagtgcaaatatttcttgcaaatgtatatcaccggagatcgccgggaatggaaatatatatcgccggaggaatgcaaatatttcttgcaaatatatagcggcagagatcgccggcaatgccgccgatgattgcggcgagccagcgtaatatagcagtatcttatctcagacgccgtcgacattatcgcgtgaagacatggatgtatcgagcagttagatacttagatcgccggatcacatgcaaaaaaaaaagcatctgcggggttcggagataaaaacttcgaccccccatttggacctttttccttttcttttaatttcgtttttctcatcaggttggatcggcagtgcggtgattttagtcccagtgtgcaacatccaaaatccactcggtgctatcaggccatatccatagtggaaccgaccaagcctagaaattgggctagattaaaagcccatagtttacacggacacggaagttttggcccatattgatgactaaggtggaatcgaaccctttcgaattatttttcttggttttcaaattaggagggtttggagattaaaacatcgaccctcttcagtatattttttctacctttttccataacggcctaataactctgggacaactttggttaatcggctcgaatattatggacgcaacaatcgttttaatatatcagcaagcttatacttgaaaaaaatcggcaattgcaagcacatacgtaattaagctcgtattaattggcttgtaatttacaatttttcccttgttttcctcattttttcccttttttgcggtcatcgtaatttacaagtattacgccaaatgcacatgaatgaatgaatgggtcgacgaattttacaagttattaattgatgattgttgtttgattaaatttttcacgtttcttcctagtggcgacaatggcggcgacggaggttgtgacgacggacgacatgacgatgatggcagtgtgtagtgtgtgtttgatttattcgtttattattagcgattgcaaatatttcttgagttaccgtgagatcgctgggggaatgcaaatatttcttgcaaatgtatatcaccggagattgccgggaatgcaaatatatatcgccgggggaatgcaaatatttcttgcaaatatataacggcagagatcgtcggcaatgccgccgatgattgcggcgagccggcgtaatatagtagtatcttatctcagacgtcaccgacactatcgtgtaaagacatggaagtatcgagcagttagatacttagatcgtcggatctcatgcaaaaaaaagcatctgcggggttcggagataaaaactccgacccccgtttggacccctttttttcttttaatttcctttttctcattaggttggatcggcagtgcggtgattttagtcccagtgtgcaacgtccaaaatccactcggtgctatcaggccgtatccatagtggaaccgaccaagcctagaaattgggctagattaaaatcccatagtttacgcggacacgaaagttttggcccatgttgatgactaaggtggaatcaaaccctttcgaattatttttcttggttttcaaattaggatggttcggatattaaaacgtcgaccctctttagtatttttttctacctttagccatcacggtctaataactttgggacaactttggttaatcggctcgaatattatggacgcaacaatcattttaatatatatgcaggcttatacttgaaatgaaaatcaacaactgcaagcacatacgtagttaagctcgtattaactggcttgtaatttacaaattttcccttgttttcctcaagttttgccttcttttggagaataaaatggaattttaggtcatcgtaatttacaactattacgccttacaaaggcaaatgaacgaataaatggatccacagattttacaaggtattaattgatgattgatgtttgattaaattcacccacgcttcttcctggtgtcgacaatgatgacgatgatggcggcgacgaccgacgacgatggtggtgtgtagtgtgtgtttgattaatttgtttattatttgcgattgcaaatatttcttgtgtcaccgtgagatcactgggggaatgcaaatagttcttgcaaatatatatcaccagagatcgtcgggactgcaaatatttcttccaaatatatatagctggagttcgccgatggaatgcaaatatttcttgcaaatatatagtggcggagatcgctggcaattccgctgataatggcggcgagccggcataatatagcagtatcttatctcagacgccgccgacattatcgtgcgaaggcgtggaactatcgagcagttagatcaccgaatcgcgtgcaaaaaaaatgcatctatggaatctccgaacccccatttgaacctttttctttttcttttagtttccttttctcatcaggttggatcgaacgtgaggtgattttagacccagcagtgtgcaacgtccaaaatccactcggtgctatcaggccgtatccacagtggaaccgaccaggcctagaaattaggctagattaaaagcctataatttacgcggacacggaagttttggcccatgttaatgagtaaggtggaatcgaacccttttgaattatttttcttggttttgaaattaggagggtttggagattatggggctgtttggatgctatactaagtttgtcaccattcaccatacatttataccacacttgcctaagttgtggctttaaaaaagaaatccacactttgttgagttgatgacgtgtagggtcataatatatgagaaggagttttgccacaagtatggctatgaaccaaataatagactaactttgtcaaacttgcctaatataaagtgtggcaacctatggcaaactttgggagcaaaccaaacaacccctaaaacaccgaccctcttcagtattttttttctaccttttggcatcacgtcttaataactttgggacaactttggttaatcggctcgaatattatggacgcaacaatcgttgtaatacatcagtaggcttatactttaaaaaacagcaactgcaagcacataggtaattaagctagtattaattggcttgtaatttacaaattttcccttgtttttctcaagttttgcctttttttgcgggagaataaatggtattttaggtcattataatttacaagtattacgccttacaatggcagatgaacgaatggatggatccaggaattttacaagttattaatagatttgttgtttgattaaattcacccacgcttcttcctggtggcgacaatggcgacgacggaggcggcgacgaccgacgaggcggcgacgatggcggggcggtagcggacgaagaagttgttcatccgcttctcgtggaacaccttcaccttctcgacctgcacgtccatggccatgaacaccgacgggtaggtggcgtacccgtcgatcttcttgatgagctcgtgcacctcgccggcgcccctggacccgccgcgcacgacgccggcgcggcggaggatcctcacgtcggcgacctcctcgacgagctcgttcatcagttggaagtagcgggtcaccggcttgctctgctcctccagctcccgcgccaggaggttcctcgccaccgtggccagcttgaagtcgaacaccagcgccggcagccgcagcgtcgcggcgtcctccttgaactggaccacggcgcggccgtcctccacgccggcctcgagacggacgcccgagcggcggagctccttcgccgtcgggatcctcgacgtcttgccgcctttcacccctcccgcgccgccgccggcttccgacgacggcggaacaaggctggcgtgcaggcagtccaggagcgtgagctcgccgaagatggcggcgtcgtcgggtttcttggcctgttcgtccttggagaagaacggcgagtagtacgagcagaacgagcggatcacgccgtcgaaattcgcgcgcgcgaatccgagcttgtattcccggagcgccttcgcgacgtcgtccttgagccccgggatgtcgccggcggcggcgtggaccgccgcctcggcgaggtcggccacggcgagcaggtgcttgatcgggagctggttctcgagcttgatcacgtccgtgacgatgtcctgcatgtgcgtcgccttgaagctctcgtcgacggcgtcacgcctggcggcggccgcggcggcgcccttgccgccgccagtcgccgccgccttggtgagccgcgggaggaagccgacgacgaggaagatggcgtcgatgacctgcttgttctcctccgtgccttcgtcgggatgctgcgtcctcttcgccagctgatcatcctccgctttcttcttatcctcgtctgacacataatattcgagtaaattttgtcaaattgctccaaccaactacaacgctcttgggttcgtttgaactccattaaaacacttccttcgtttcaattacaagtcgtattattttttttctaattatcagcatttacaatactgaattagtcccattaaaactaacatttaatatgcttgttttatattgaaaatattgctataatttttataagcttgatcagaacgactttaatatataacgccgttgatttattgataaacgtttaaccatttatcttatttaattttttttgtaaatataaaaaaattatgtcatgcttaaagaacttgacgataaatcaaatcgcaattaaataaatgataattacataattttttttaataagacaaatcgtcaaatttatcttaaaaagttaacgtcagcaataaaataggagttaaagtatataagaaataagattgaatgtgatatttactacttcctcagtttcacaatgtaagttattttagcatttcccacattcatattgatgctaatgaatctagatagatatatatatatttagatttattaatatcaatatgaatgtgaaaatgctataatgacttatattgtgaaacgaaggaagtagtacggactatctatccagattcatatctaaagtagtgaaaaaactaaagtttttcatcatctcagtgcgccacatcatcaattaaatacagaccatccgatggaagaaagattcattttgaaccgttggatctggagtgtgtctgaggctcagtaaaattctattgtcgcttccatctcacgttcaagcaaagaagcacaggcttcaggaagcttcgcccatcttcctgtcactcccgtacttgccatatgtgatcagtgatcggtggtaaccagacaaggatgagtctcctctgatgtaaagtcagaggaactttgtcactgacatgtgggagtgacaaagtccctctgactttacgtcagaggagcgcgatccagcagacaaatagtctacttatatgatgtgtgttaatatgcatatgtaaaagtgtagcaagtcttcttttaagcatttttgttaagtactttctctgtcctatattaagattatttttagctcatcccatttatctcaaaataaattgatttttagtaataattatatcaaagtttataaaagtaaagaataattgcattggaagtagataaagtgataaatagttatattaggatgagataaagtagggatattttagtcttttgatgtttgtattggtatgtgtaggatgagtgaacaataaacttattttggaacatctgtattactaatatgcatttgtactaatttttttaccaggtatgcatatgtacaaattactccctttattttaaaatgtattgagatatatataaatataattaccttctcaaacaaactttccaatattatacttttaactactactgttttctttcgtttattatcaatacctacaaaatcgacgccatataaaaatagtcaaataaaaatctaacaatactactttattatataatgatataaaaatcaaataaaaagtcataacattaatcacatatccaaacctgtacttttaatccattcattagacaagtttttatgttttgatttttctcaaaataaaaatgccttatatattttagaatagacgaagaaaaaagttagtattcctttatcatacaataatactctattgtcataaatatataacgtttgttttttcttgagcaatctttcaaaattttttccatcaaggagatctcaacaacagggcaccgttggactgacctatatatacacatattttaaacgggtcttaatagccacacaacgcgtggcttatgtggctagttaatagtagaaaatgttttattcagttatatgtccttatattttgggacgacgtaagtatttaacaagcctctgaccttctgaaagggcctgcggtctacgtggtgaagggtcggggtggacgtgggggcatcagtaggcggcgaggttgaggaggaggtcgcgggagaggtgcctggtgtggtcgtcgacgtggtcgccggtgacggactcgtagacgagcgccgccttgacccagaagctgttgccgcggtcgatctcgttctcgaggccggcgtgcgagaggaggaccctcctcggcatgaactccgacgggttctctgcacgcatccgcgtgtacgccgccgaccccagcatccccgccgccgccgtccacgccgccatggctttgctcgtgcgtgcgtgctctggttcgatgggtggtggtggtggtggtgatggtgagtttgattgcgtggtggatgggagggaggagtatttatagcggtgtcgtggatgtggggggcgatgggcttgcagtaatccctttcgtgacgtggttacttaactggagggcagctgacgtgacaggggagaagaggaatgtaggagtactagccaatggctcctacagtagtactagcagcaataggcacgttgctgcattgcattccgccaacttttcttcagaacaagatgagtagtgattgatacacccccattccaaaataagcttatttatagttttttttaaccgtttaactatccgtcttatttataattatttttataattattattattattattattattagatgattaatttatttcttttaattttttgtatttttttaaataagacatacggttaaacgttgaataaagaaatccataaataaacttataacttattttatgacgaaaggtgtagtcaaagaagatcaactagagaagtaaggtaaagtattaggaaatgttttttttttcttccatgtgagcatttgtaatggactattggactgtgtcccttcctctcacaattactcatttttgttttacaaaaattgcattgaagacatttttccttcccaacttaatgtccatcattttggttcgtgtgttcgaggctttgagcaatgttctctaccttggtcccagattttaacacttctctaaatatatttttgtgaaccaattataaataatgtttcatctacttccttttctcaaacaattataatatttttcattcaattttaccgttatcttgatacacgtgtctaaccccataattttataggaagaaataaatgagcagctaaaaaaacagtataaaaattagtggcgaaaaacaaaatattatcctaagatcacaaaatcccttatacattttaggacaaactaaaaaagacagaatgtcaaataccttatattgcgcgacggactgatgtacagatgtagtatttgtttctatcttgcggtcgatccgttgatggctcatgaatcatttctctctctttttcgaaggacgggaatctgggttggtcactcacaaagatgaaggattgataccttaatgagatgcctggacgtctaggtatggagcactggaggctcttctctatgccattaggccatattgcccttacagcaggttaatgagataacaaggggtaggtgatcacggcatcacgccaaggataattggataaagcaacttgatttgattacaaggggtggaaaaatgtgctgcatatgcgagtgcctgtgcctgctaacacaaggcacacctgactgatgccgcatgcttccaaacactactccctccatttcacaatataaatcattctagcattttccatagaatgacttacattgtgaaacgaaggaagtatttagtcttcaccttgtgatttccaagatctcttttgacacttgacatcgcagtagctacagcttccaaacactatttagtcttcaccttaagactcaacaatacagttacctaatggactaaaatttatcttcacacaaatataagaacagcacaggcgacaaagtattaagcaaaaaagggtacaactgtaattgatgggagctaaatcctattgattccaagactcacatttcgatgcattgagaggttgcttgcgtggtatcagccacatgtgaaaccgcttcaagcatcctcatcttattcttcactactcacaagtgccattcatctgaacctgactctgcatatggtcactggaaccatattggccaagtagcaggcctacaagggtaaccttgagtgatcgtttgcaactttgcataactggttccctttccatgtagtgtacaaagttttcattccgctcatgaaagacaggaagattgagggtcctcggagaaattcgctgcttccttcaaatccatttacatgacatatggttgatccatgaaggcccattcgaagatctgttcatactgtgaggcggcatggtcccatgtaaagtcgcttgacatgcctcgcttcattagaccctcccaagaggacttgtgttccctgtatgtcgaaattgccatccgcaatgcctgcaagaaacgatgcaaatttttagtacatactccaaaagttcatatggtgtaatgcttgtgccctgaaaataccattttcaatgaggcttttattactgattctacaatgttttctcaacaaagtttgtagctttccctaattattatcttgactacttgagtacaaggcaaaacaaaactgactagtactcacattaaattgtagacaagcaatgcaaatctttccttgtcaaatccatttttttatcagtttcatttgaagtgttcaatgacacaaaatgggccctgtttccctgtttccacattcgaagtatgtaccaaacatgcaattcaaatcatggactggtcagtcgagcaatttagcaacctaagcacatatatgcttcagggttctattccccactaattccagtttcccattaacccaccaagtgctgagccgctttcttctttggatttcaatcacgtgtgttccttttctttagtttgcttgtcaactctttcttataatatttacttaaatctgaaaactaacaagtactaggagttcaatcctactggaataccagacaataaccagaactggctggaacatacgtcatgagcctcaccttgttttatcctttttacttctggcaagaatcaaactacattatgattaccggcaagaaaaatagcagtatacgatacaaccaaaatgcatagttgaaatcatcatgctattgatgttaagagggccaatagtattgatgttgtatggcatatataatgggattaaggaatggatagaagaactaaaactaggtgcaggttcaacataaacttacccacagcattttttcaatggttagtggcgagaatgcccacctgcaatatgtcccaagtagcaacagttaaattaattggttataaattgaataatatacaaaaaaaaattgaatttaattaattccactaaaataaaataaatctgcaattttactttaatgaagcattccttaccctgtaccctgctctcctttctcagcaaacgggttaaaattctccactgtatcctgttgaataaataaaaaaaagtgagcagctctgccttgggtgctgtgctgacataagtgtcacactataggaaagcttactctgaggcctccagttccatgaacaacaggcactgtaccatattgcatagcatatagctgattgaggccacaaggttcgaatctggatggcatcaacaatatatcgcaactgtacaaaaatagaggcatcaatatttcaaatgtaactttatcagcaaaattaattgagatttcaaatgtaaatgcatccttagctgacaaatgactattattggcgaagttattttgcataccctgcagttattcggtgggaaactggaacactaaatccaacccatccacgaaatttatccctgtaccctgattctgtggatctcatccatccttcaaaacctgggtcaccagatccaagcatgacctataccaaaaaaaacaaaaggtgtcattttttttaagaaaaaaagaagtattaaaaggtgtcattgatcaatcgatttcagttggtggctaaaatatgtggataaaatttttaaaacccactcaaacactactctgttttagtctccagttgaaagccagaaacccccaacaatgaagtatttgggataagcacgtggttgcagttcatcaagacatttgctgcctacaagttagatcctactgacttaataaatggtgatccttttgtctgcatgtatacgcgtcccctggtgtctgtcagaagatgttgtttagtgtacccanaatgtataaagggtggaaataacagactggctggccaagcaggtgctccaattgatatcacactggatggttgctaataagtcatacagtggtcaagttatactactgctatctttcttttatgacttgcatatgcattttttcttatagcactaatatttgcatctgaaatactagtttacttgcatatgcgttcacaatgaaagcaatagctgcatattacattccttagattcatgataacaagctatataagtgtcaatatactactatatacactaagatctatcacattcactttctagtctcacgcagaaaaagaaaacagaacttacgaattgaatattgtcccgcatgagatctggaatggcaagtttaattagatcaatgcctttttgatagtccaatcttccaataaagccaatctgtaaataaagctaataaatccaactgcccataaaagaatactaaaataaataatttcataaatatttgtatctaaccagaggcacatcgggccttataggtaaacccagctccttctgcaattcagctttacacttggcctaaacatgaattcgaggtttcataaattagtctgtgaaagaaacgacgaggtgcaaagaaaaaaatgaaacgagatgacaatctgtatatacatggtactatacttcacctttccggacaggtcatcaacagaataatgataagggagaaacttgtctgtggatgggttccaatcattaatgtcaattccatttacaattcctacatatccagggaatagattgaattaatttgtatcatccaccctattacaatgatcagtccaagaacaaaatataaaaacccaaatataggtaccattcaatacactcttccgggagcttaagagctcattgaggccttgcccaccttcagcagttgtgacctcccatgaatacccctggtaatgaaacataaatgattccttaattgagtgcaagacaaaatgaacgaagaatttgcggtttaaaagccaaggcataaaaatagactaggatgggaaaaaaaaatcaactctaaggttaagttcaaatttcaaattttgactgtggccgtaagccaactagtagacgaaaaggaaggaatctcacctggctgacagtcacaattcgatctgctgtcacaactgcgccttttaaaaaattgactgcctcacccttgtcaagggcatgccgccttgcccactctggaaacacccattctaatgctccataccattcaggtggcaatcccaggtcaggatatgtactggcaggctccacaccctatcacattgaaacacaatgaaatactaacatactgcacttacaaagtgccattacaaaactacttaaaagatatgcaaaatgataggctcaaacctgatgtgctagattatgtatgacaagaacactgcgggcatccctgtaaacaccatatggtctatattttgcagcaagaaggctggataaacaagataaaagttatatttaaattgatatgtaaggaaaaccaatttaacattcagcattgaagtaaaaagggactaaaaaataagtgtgatgagtttttcactggcattagtatcttatccaccgtgaggaacatgccaaaacaaaggagtagcaatgtagcatctgatggatcaaaccatattcataatatgcagcgaaagacattacaccattaacctcatgttgttctgaagtgtcttagaagttagaaagcatgtaccacgcactctcttaataattataacatcaaattatggtgtgaaacaagcagtttaaatttaccacaaattagagggttgcaaactatcacctcagtcacctagtagcatgataggccatttagactacaggatttttcccaaatcctttgggtattgaattgtatctgtagaagatgaactcaaaataggcactaccataataagaaacttcgcactagctcagaaatattccaaaaaaaacataggcagggagattttcagatcagctatgaactagtgtagcacaaaactaaatcatttaaacacataaatgatgtactggactgttcatgtttttggaaatatcaaaatgattgagaaaataatgaaatgaatcgcagttctcctgcgcttttgagaaaaaaaatgattgagaaaatcctcctattcactcaatctaatattttgttcctcttatctaacatagacacacacaaacacaaagcaaacgtatgaaaaaaatggtttataagagatattcaatgttaatcaatttggttgcagagtttcagatccagaacatacactggcacaagactggcatgccaatcattcacaacaaacatgcatttctgtccatagatatatcctcccagttcaagaattaatggggcttcacacgccgcatagcacaggagtgtgtatctgaactgcagtatatagggaagtcaagtcgaatcaatgactcaatgtgatataatttagactggtcaaataggatcttgatgtaagaatacctgattatcgccaaaagcaccaaaattatctccatacaaatttccaggtctatgatatgagggatgatcaacaaacacctgaacaggagaagtgaggtgtaacaaaaaaataagtacccaaaatgcaggtatgctttctacaatcagcatgttgtgtcatgggtgatggtgctgcggagtgaacactaccaagttccaataggaataagtaaacatttggtaaactcaacaaggaatcaatcttgcaaccaaaaatgctagaaatgtttcctcctaggttatacacatccttgttccttaatgattatcatgtcatgccatctacatctattaccagttgtgacaatacatgtttcaatgtaacccacatgttcactttcaagaaataaaaatgcgattgaagtacataattcccatgatataactacaatgttactgatgactattaatgcaatggaaaagccaaacagtacaacttattaatattaagtgcttgttgcaaacagaagtcacaaatgcttgagacataaaatggatacattaagtcatatgaaggaatcttttgcattttgatctggaaacaccagacatcaaccagtgcacaagtgtatagacagtaagacatagaaacagagtacagaatatgatatgatcatgtcttcagtgggataagaacaaaaaagataagcagatagttgttttcatcagaaaatagtaaggagattgaatactcacccaatcaacagaaatcctatactcgtgaaaaaaagtaacttcatgttctccgccaaagcatggaatcttaatgtgcttctcagtgtaaaatgcgtttgcaaaatttttggtcaaggccccgttcatgtatctcggcattacaaccatcacacgatgaccacgaagagcaagagcaattggcagtgaaccacaaacatctc

SEQ ID NO: 86354 - DNA, 1358 bp, Oryza sativa
gtttggagttgatcgtaagactggaacattacttcgagattcttctaagttgtagactccctcatccattattctagtcttttgccaattatttcattgcttctttttacgttataatgcgatgttctggtgcttgcgtgcacgttctctccagccaaactcaaaaactcatgtacgctacatcccataaaatgtggtgtatgaactggccacattatcatttcatggagttggtatagccgtgtaggttgtgaactcgtaatgccatctccatctgcgtcgtatctcaataatgcaagaatgcaacctaactaaataataaaaataataataatgtttcactaatttattttcaactgtacgtctgtgcgaaagaaaaaaaaaagcttttgtggacaaaaatacagtaactagctagttttctatatccacactaaacacatcgaacatactccatccgtcccaaaaaaaaaaaactcaacatagaaggggatgtgacccctcctagaacaacgaatctggattatccttaggttgagtttttttttttgggacactgcttactactgagacaagtcctacactcctactagagaggcaaaacctttgctttggttatttaggaaaccatagttattatacttctgaccatgcagcacaggggactgaagatcttataagttggcacggaaatatttccgtgactcctgctgttttatgctgtccgccacatgggcgatgacgccggcaccggcattgtgaagccactcattcttaacctgcattgcattgatgccatgaactccagtggaaatgaaaagaacacatttaatttggtcaaaatggtatgcagtacatactactaacatacatgtatgttgttatgagcaaagtaaggccatagtgctgtatggaagttgacatctactttcttccaaccgaccctctgcaagccatggatcatctcctctgttaccagaacacagaattgatgttcatagagtgagaaacaagggagacatcaagatccagcacatagtactagtctactgaaaaaggtcctactcaccttccatcatttcgtgatattcttcagtgttttctttgtttggtctactctgtgcagcttctttggctctggcagcttgcagagggaaatgagggccatcagatgatataggcgaacaatattccatattcacaatgtgcttgtagccatccagtgaacgatgtgagggctgcatatggaggaggaaaaaaattactgaagtattcacacagtgctgcaatttggtttctaatcaaattctagtggagatcactgaacacctttgtaaggtctttttctcttcttattg

SEQ ID NO: 86355 - DNA, 748 bp, Oryza sativa
tatataaatcctccccgagctccccaccaccgtttccgccactcaccgccctctctccccgccggaatagagctcgcgctgtcgctctctctctccgccgtcgccgccgagctccggtccgccgccgtcgtcgccccggactacctcccacctcggcgccgcctccttcggtttcgccgcagcctcgccgacctcgtccacccctccgttttgctcgccgaccgccggagcgccgtcgaccccgtccacccgagccgcgccgccgccttcctccgctccggtcgcccgttccgtcgtcgccgtcgacccggggtgagccgtggaccgccgcttcgtttccccctttccctcccctctctcggccgccgctccgccgtgcctatggccgccgccagcgaccataggggcgcgggcgcgccgcctcccgccggccgtgccgatgtggccgcctccgggcgcgcctagcggctgccgcgtggggcccgaccgtcagccgcccgcgccctcgggtgcggctgacgcgtggggcccacggcgccggccggtgtgagccgggtgcacccggtacaccgtcgacagtgagactgccgcgtgggtcccactcccgtggacccggtccgcgcgccctctctcccggctgacgcaataaatctatttttaaattaaaatttaaatgaagaaattcgtaaatattcatttaaagagcatataaacttcaaatggccataacttggccatttgaactcgg

SEQ ID NO: 86356 - DNA, 5193 bp, Oryza sativa
gatgaacatggagtggttgtaaggaacaaagcccggttagttgcgcaagggttcacccaagtcgagggtctcaattttggtgaaaccttcgcacccgttgctcgtcttgagtcaatccgaatgcttttagcctatgccgctcaccatatttcaggttatatcaaatggatgtcaagagtgcctttctcaatggacccatctcggaattggtctatgtggagcaaccaccggggttcgaggatccaaagatgccaaaccatgtgtaaaagctccacaaagcgctctacgggctcaaacaagcccctagagcttggtatgaatgtctccgagattttcttttgaaaaatggttttgaaattgggaaggcagacactactctcttcactaaaaagtttgaaaatgatttattcatttgccaaatttatgtcgatgacataatttttggttctactaatgccactttttgtaaagaatttagtagtatcatgactaaaaggttcgagatgtctatgatgggtgagctaaccttcttcctcggactacaattcaagcaagcacaagaaggtactttcatctctcaaaccaagtacgtgaaggacattctcaagaagtttgggatgaaagatgccaaacccatcaaaactcccatgcttaccaatggtcaccttaatcttgatgaaaatggtaaatgtgtggaccaaaaggtatatcgctccatgataggatccttgctttacttatgtgcatctcgtcccgatatcatgcttagtgtttgcatgtgtgctcgctttcaagcggagcctaaagagtgccatttgattgctgtcaagagaattctaagatatttagttcatactcctaatcttggcttgtggtatcctaagggttgtgactttgagcttttgggctattccgattcggattatgcctggtgtaaggttgatagaaaaagcacaaccgggacttgccaatttcttgggcggtcccttgtttcttggtcctccaagaagcaaaattccattgcattatccaccgccaaagccgaatatgtcgccgccggttcttgttgtgcccaactcctttggatgaaacaaactctaaaagactttggctacaacttcaccaagatcccactcctatgtgacaatgagagtgccatcaaaatagccaataatcccgttcaacactctcgaaccaaacacatagatattcgccaccactttttgagagatcatgagaccaacggagacatatgccttacacatgtgagaaccgagagccaattagccgacattttcaccaagccgttagatgagaaaagattttgcgagcttaggagtgagctcaatatcttagattctcgcaacattaggtgataggtggttggctaatttatagtcaaacatatatcactaaaatgtaaattttaaaaataaaaaaataaaaaaaaattgtcttgagatcacttcttggtagaagatgatgttgataccaggaataaagctcaaacattccccctttatccaaaaaccccttttgtgaaaatttttgcaaaatcctttgtgtgccttttattgcgaaaatttggtttttatccccttcttgtggtgtatattgaccattgttatgtaatgttgattgttggctggtcatatgcatcataagtctctgcatgtccatagttctctattttccctcattgaactctctcttctccttgtttttgggcctgactgccctttatctgtcaggccggaagttccgagcctccctgtctggaacctccgggtgtcggggagtatatattctcagggggagttagaaaccctagtctctctcctcattcttctccctccccgacgccagccctagccgccgctacagtgccccgagtggcgattttctcttccctccaatcaaattcgattcttctccgtggattcatctacattggtggctgggaggttctttctgtgatcgattcacagtttcttctctcaaggtagcactttttgattccctctctcggttcattgtgtttttatctcgatctctaaatctgtgaacctagggagaaaaccacttggatagtcttgtttctgctaccttgcagatcaccgatctataggatttgttcacatgcattggctatttttgagacctctgttcttcatttttgccggccgaaagttccggtgttcttgcacccggaacctccgggcgctgtccagccaacctaccattcttgcttctctcaaattctgcctaactactgcactccaatttgttgattcctgttgcagtaagctctatgcctcgtgagaaaagacagaaagcctctcaggatgtgtccggtgatgagagtcctcctattcggtttcctcgtggtcgtttgggtaaagagaaagtggttgagggcggcagtggcagcggcactcgtacttctcctaggtttaccaggcaatccagcaaccgttcagttcagattcgggatgttgacagtggtcaagcaagtgatgctcctaatacaagaggtcgtgggagaggtggtggtcgcagttctggggctgaaagggcctctcatgatttccctgttggatctcgtgagaatcccgttcggctctacaagactcttggatttgacaccactcctatgcaccacattggaagacccaagtccaactaccttcatcagcttgccaccaactaccttcatcagcttgccaagtgcagaagggaccgtttgattgatccagagacacagcctgaggagtcacaggatcctcgtttcaggactttcactcaattggattggtataactcagtgattatggccagagaaaatccagtggttgagatgaagtggattgattgggcttacatgaggaagaagaacaatgaagtgttcaatcaagtgatgcaagtgtgccacaacaagaatcttggagatattcttgccttggagtatgattggaatgaggaggtcattgcacagttctatgcgacagtattctttggtactactaggaaggcaactccttatgtgaagtggttgactgagggtgttaggcacaagatttccatggtacagtttgctgagatattgggcttagaggatgaggatctcaataggcctaatattcatagtgaagcacccctccccatgatcaagactaagttcatgtatacaaaggatgctcctaggacttgcatgggatctactcatggattgcatcccaactacaaggtgttgtactccatctttcgttggtctttgcttccaaaggttggagatgctactgctttgccatccaagcttgctcatcttctcagtcgcatgcgctacaatcagcctcccttcagtgtgatgaaattgatttggtatgagattgccaacaccattcttgagcctaagcggggttgcatctatgctcctttcattatgaagatgattgagacagtcactggggtgttctacatcaaagatgggcgccacaatccttttcgtcctcgtgttccaccttcctcttctccagtggtacatacatccattccttctacctcagctggtccttcttctagtgccccaccgagatcctcgagttcttctcccatcaagaaggcacttcaggcaatcttctgtatgtgtgctaaaactgctatgaaagtgaagaagattgaaaggcatcagaaggaagatagaagagaggttgggaaagaagtgtcagatgattctgaagatgaggtctatgttgatccatttgaggcttatgaggcagcccgcaacgttgccggtgaaggtccatccacctacttcaatgaagagtcttctcaatcagatgatgatgatgatgatgaggatgacaccgaggcagctgctgaggatgctcctactgatgttgatgagggcgacaccgctgcacagtccgatgagtctcatctctccggcgataccgagattgttccctcagatggagatggagatgagtgatcctcttcttctcttcgtggtttcttgctttttagtgccttgatgccaaagggggagaaattgtgaattgaagggggtcatttaaatctttttgctgccttgactgttgtctagtcatttggccggaagttccgggtcctgtgatccggaggttccggccagacagatttcctctctattatctccaggcagatttcctctctattatctctctctctctatggacatgtaatcatattctattatggttggatgtaatgactgttagatgctttattatccttatgtcagtaagttagaccatatgaatgttgcattttgatgtgatgtagtgttcttttcatctttttgagtgattgccttgtcatctagtccttcttcttgcatttcactcattattcaagcactcacatctgcatcttatttgattgagggtagtgtgaagtttcttttgagctttccttcgtttttatgcatattgtattcatctcatttcattatatgcatatctttagggggagcttcacacttctctcatcattccaaatttaaattctattatctttttgtgtgctttaaccatgttgtcatcaatcaccaaaaagggggagattgaaggtgcacttaaaccccctagtgggttttggtgattaatgacaaggtggttaaaggggactaacgtgtttatcaagtttattcacaggagtttagtcccaaagcaagttgtgatggctaagaatgcaaggagaccccccaattcaaatgttcctaagtgcgaaaatcaccgaaggtgattagactaggtttttctcttttgaaattgagtttaggaaaatccgtactattaagaggggtttcaagtgtggttctagggtatacaaagtgctcttagtcatatccatgagtcaaaatattttttggaatcatttttgaaaaatgattttctccccgggacagagagggctacccggaggttctggccggaacttccgggcaccatttcattgcaaaaaatttcctaagtgctgcccggaagttcctggcacttttgcccggaacctcctggcaggtttccagttcaagcttgtgagtagcggctagatgacgtcacctagccgttatatatatggatttcgttcccaggtcactctttggctattccacttcagttctttcatgttctagggttttctagccactac

SEQ ID NO: 86357 - DNA, 3928 bp, Oryza sativa
gggaacctcacaaaggtaccggttttcccaacaggtacctttgagattccacgaaaaaaaaagttggctcgatgcatcagctcgattcgagccaagaagctcccttcaccccgaccaatgaaagaacattcaagaacacaaagaacactaagtcactaatcacatactaattccttcttggaatcgaatcaaccacactttacccccccaaaattaaccacaatcatcatcattgaatcacaaaaggaataatagaatcacaacaacaacaacatctaaaaacatcacagaacttccaagaaccttactcccgtcgccgttggatccaccctcggctgtcgccaccaccatcggatcctcagacgagggagggaggcgagaggggtcagagggagccactaccaccgccgccgcccgatctgccctgggagggaggcaagagggggcggagagagttgccgcccctgacgcccccaccaccaccagatccacccgcggccgccggagacatcgccggatccgctatgggagggaggcgagagggagaggaggagggggcagtgaagagagagagagagagagagtgagagcgagagagatggggaggggtgtcagtttttctttaggatcgacaactatggttcgtgaaaggtgttggttctttgttttttccaccgcgcaaggtgagcaaaagtctataggtgtcggttttaactgttccggcacctatagtgccgacctctatgtgtctttctgtagtagtgtttgttcctcatcttttgtcttcttctctcaacttgcctatgtggcttcttgattgtcatcatcttgttggtgcgagggattagcggatattaattcatctttgaatggtgaagcattcatttaagaacatcaacctctcatatgaggctaaacctaaattaaggagctgggaaatatacctggacaagggtcaagaaagacaatgatactaaagatttatatctatttcatctcttttgaaaataaaaaaaaagaataactacatctattttaaaatataatctgttcttgcacgttttttccaaaataaaaatctgaaaaatatacggcaagtgcgagtccagacagtctcacagattacagattactgtgtggcaccctgccggtatcatctgcaaacggcgtgctcaactcattacgtacatgttctgccgatcgattaccgcgtgatgactgtcagctagcgccgagtgccgccaacccgtgcaagacccggcggatcatgtcgtatctacagctcccagagatgccaactggaccagtctataatttcttctagactcggcacaatcaaacgagtcaagccaggccactagttgcattcagcaagaaaccaagagatttttgcgccgtcgtacgttacgggcgggcggagagtccgcgcgccgggtgagatcgacattctgcccattttaagcgactgccgttttcctattgtcgccgtgcgtctcggctggtacctggctgcagcctgctctgctcccccctggcctcatctccagcagaagtaagagcgtatagcaaacacactgagaatcaataggcgacgatcgatcgagcgctggacgtgcgatgacagtagtgcggttctgctccccgcatctccttctgctgttgctactggttgttactgctagtagtcctgaaatttttacattttgatcctttttgaaaacttagtttacaaatagacccctgaaaaaacttaaaccggaaatggtcctttttgggacgccagagtggttggcgccgtaccccaacatggcggcgccagccacactggcgccgtgcccgtgccaccgtggcaatagggctgtcgtggaggtgctgactaggccgaagggggctccagccagagtggcgccgcccctcataccacggcgccagcatggctggcgcgcccctcctctgcgggccccaccaactttctccctcccctcaaaattttcaccctgttctgcctccgggcaacggctggcgccccccctcccctcctagaccgcggcgaccccgatgcggacaaccccgacgacgacgactgggcggcgacgacgaatggacgcccgaatctggcgggcaaaggtagcggagagcggcgcaacgatgacgctgaccccgcgacaacgacgacgaccccgacgacgagtgggctcccggatccggcgggcggaggtggccgagagcggtgcgacgacgaccccaacgacgatcccgacgaccacgacaactgggcggcgatggggcggcgacgtgggcctcgtccctcccggatccgacggcggcgggcctcgtcccgtccagatcggcggtggcgggcctcgtcccactcggatccggcgagagcgagggtggccggcggtgggagagggagcgggagcgggcggcggcggaaccggggcgggcggcggtgggagcgggggcaggtggcacgggagcggtcggcgagctcgggcagcggcaccgccgcctgcgggctagggttttttttttggaattttatttttttctggcgattttttctctttgcatgcggtcggcttaagcgcccggattttcgcatgagggtgccctggccgcatgcaaagttggcgattttcacagacgatttcccgcatgcggttgcaccaaccgcatgcgaaaatctctcccgcccgtatgcaaagacctcttttgtagtagtgcttggcttcaagccaaattaccttggcgactggcgagttgtcttttgtgttgtgcatggccagccaatattgaggcaaggaagagaccgggccactgagcgtgcgatatttgtggtggcatcgaacgtaagatcgatgggaacagatgtagcgtggacgtggatggagtattcagtactgtctcgtcatgcagcgagtcctgggaaggatcagcctacctgtcaagcaaatacacgaatgagccttcattttactgatgggcctttgcagagattagaagaatggatttccttggccaaaatttatctatgcaatccatagtgagaaatggcacacgtacaattttttttttcacaaactcttactaacaatgataacaagcgtttgatttatatctatataaaagttataaaaaaatcgagatatacttagaatgacatatcacagttagtaagatccactaagaaaaatttagcacctatagacttttccacggtgagctaacctaaattttaacattgttaactattacaaatgagtaaatggcacattatgatactgactttcaatggctagttgttctgtcagtgtcctaagaaggcagttatgaagacggctatacaagtcacttatcgaagtctaggtgatcatgcaattcattgtttcatactatctattcctctcctaaagtgccggtggacgatggctgaaattgagttgatatgacaattattgagggcagaaatgaatcaattaaatgttagaaacttaaaaggttattttagagaagttctctaataaatccagatggtttttttcccctcaaaatcttaccatcaatgaacttggaaagcgtgataatccgtcgttggttcaaaacaacggtcctagccttccgctgaatagtcttgacagagcagcatataccacacacagttacaggtaggcttcaataaaacgcaacctaaagccccgttaaaagcggagcatgagggatccatctggtcagccagcaaggccagtagaaaaaaaaaaacagagagaaaactgtgctttaagcaggaaactaggaaggtttgtggatgggaaccatgggagctacccgttccggccttctggcactagccatcctctgcgcatctctttgccttgcactggtggacagctctgacgcaagggaagctccgcacaacagtcctgaa

SEQ ID NO: 86358 - DNA, 2964 bp, Oryza sativa
ggggggaaggcaggcgaagtcggaggaggattccttgcggctgtggcctcaactgcggttaaatcgccgttttttttgacaaattgacccttttggaaaacttatttcgaaactaacccctgccaaaaacttcaaccaaaaataggccgtcgcttcagcgccaaacacattggcgctgacgttggccgtgtcagcgccaacgggactggcgctgacattgtgccaccgtggcggccgggccgatccccagctgacgtggcagctacctcagcgccaaccggactggcgctgaggtgggacttggccgcaacccccaaggcccagaccagcaagccttctggatggcttgcgggctgggacctctgcgccagccataatggcgctgaccgtgggacactcagcgccagcccacctggcgctgaggtgggacttggccgcaacccccaaggcccagaccagcaagcctgctggatggcttgcgggctgggacctcagcgccagccataatggcgctgactgtgggaaactcagcgccagcccacctggcgctgaggttggacttggccgtttcggccgtggcccagcccagcaagccttctggatggttgggctgggacctcagcgccaggtgcactggcgctgagtttggacatgtcagcgccatttagcatggcgctgacgtcccagccctgctaaactttagcaaaactttgcacacaacagaggcaaacatcaaatcacagaaatttacaggcagtaatatatccagagaaccatacaaaacatacatccatccatcaatcccaacatcattccatacatccatagaatccatcaatacatccatatatgaagtccatatatataagaaataaaaacatcccatcgatcctcgtctatacatccagtcgagtccatacatccagtccatacatccatcgaaccatgcatcaagtccatccatctatccatccatccattgaaccatgcactcacctcctcctacctctagtgcgaggacgaggcacgtcgggggtgtacctccagtcctgcgaaggagcccgccggcgtcgtggtcgagacgggccgggctgcgagatatccggctgtgacgactctggtgcgtcctctagctgcgagggaccgagctcatccgcctcctcttctctgtcctcatccccttcttcctcctcatctccttcctccgcctctttgtcttgctcgccctcctcgtcacccacctccccttcttcatccccctcttggtgggcatgagcatgttcgaccacatcagtcgacctgcagccgagccttgctgccaacttccgacatcgctgccgtagtctctgcataaaaaataatccatgttaagttatcgcttttggaagaaaacaccgtagtttcatctctttccaacgattacctgtagggcgtttgcggagggtgccgccctctccttcggagccaggagccgtgcctagcgccactcccgcgtcgttgacggtccgcaagagctctcgagcctgtaggattgaaatgaagtaagtcacaacatatatggcattgaaatgaaataatatacaacattaatgctagaaactaaccactctgtcgcgaacaggtcccgtctcgaccgtggtacctagacgggtacgagtatcgtactcgttctgctcctcaacatcctcggggtcatccgctatgtcggctagtgtccaagccggacgtaggacaagacggtaggtcctgtggagccacgccaagtacaagtcgaactccgtcccgttgtgctgaccctggtctggtactccattctcctcgaacttctcccattgcgtgatatgatcctgatggtagtaagcccaatcagtcaccttcttgttcttccgacggtccaccctgcacgtatgcaaaatgtccaactcaaatatgtagtaaatgttgaagtgactgattgggcaagcaaaataaattgttaagtgaaattactaacttgtgtaggtcgatactcgtggagaaacggtgcgggattgtttgaagcctcccgaattgccgcatcacgcggtggcacatctggaactccactgcatagaagcagatcagtgggcaccgtagggtcttcaacgcatcctctatatggcacatgggattcagttctagctcgagcacttcctgtgcctgatatggcatccacaccacctgcagcaacaaaaataaaacacattgaagcacatttagtactatatagtaagaaaccatctttatgtgtgatagaaccccgaatagcttacatgttctggctgtaggtagtccatctcgtttgtgtagtggtagtacgccaaattcctgcggcctactactggagatgggaccgattcccacaggtgagctacagtgggacgtcggtctgcatcctggtgcggccaagcctgatgggtcctccacatgggccgaccaactggaagcatcatccacatccaaacctgcgtcacatacgttagcttccaacatgttagcaagaaattgaaatgttatgaaacataacatgcgtgaacttacctgtagcaaccaaacacagcctgctaggttcgcgtccccgccttgccttcggcaagcatcacagagttgccggtacaaccaggctagggcagccgacccccagctgaaggtacccgcctcgtcccagtccgcgagcaacggcagccacatccaagaagccatgtctccaccagagtcagggaacagaatactgccgaagatgtacagcacgtacgccctgcagtatcgctgtactgtagcctcgtctgcctcagcgggacactgaccgaagttggctcgcaaccaactcaaaggaacccctgatgtcttcgtctgcctctgaccatcaggtgccactggaggctccagaccaaggtactcctcgaccctctccctccagttccccgacgctgtgtcacctgtacc

SEQ ID NO: 86359 - DNA, 9189 bp, Oryza sativa
agggaggggttttagggttttttctttttataaaacctttttaactttgtttatttcttaacaattattatttgtgctctgaaaattccactaaaatttatttgcacatttttggaggctttcacacggattttaattattctaggcataatttaaaggatatattttagggtcgttttgggtcgttttaggcgattttggagaagttctcgatgaatcttcggcggagaagatggttagagctcatcaaggattatgatgtgggaatccactatcaccctggtaaggccaatgtggtcgcagacgcgctgagtcgaaaaagccgttgcaacactcttggcgtccgtggcattccaccggagcttaatcaacagttggaagccctgaaccaaagcatcgttagccatggattcttggctacacttgaagccaagcctaccttgctcgatcaaatccgcgaggctaagaagaatgatccagatatgcatgggatcctcaagaatatgaaacagggtaaagccgctggtttcacagaagatgaacatgaaaccctatggaatggaaatcgtgtatgtgttccggacgacaaggaacttaaacagctgatacttcaggaagctcacgaaagtccctattccatccatcctggcagcacgaagatgtacttggacttgaaagagaaatactggtgggttagtatgaagcgggaaattgcagagttcgtggccctttgtgatgtgtgccagcgtgtcaaggcagagcaccaacgaccggccggacttctccaacctctacaagtaccagaatggaaatgggatgaaattgggatggattttatcaccggacttccaaaaacccagggaggatatgattctatatgggtagtcgtggatcgactaaccaaggtagctcggtttattcctgtgaagaccacctatggagggaacaaactagctgaactctacttcgctaggatcgtaagtcttcatggcgttcccaagaaaattgtatctgataggggaagtcaattcacctctcatttctggaagaaactccaagaagagttggatacccgattaaatttcagcaccgcgtatcacccgcaaaccggtggacagaccgagcgtctgaaccagatcctcgaagatatgcttcgcgcatgtgtcctagattttgggaagacctgggataagagtctcccctatgccgagttctcctacaataacagctaccaagccagcatacaaatggcaccctatgaagcgttgtatggccgcaaatgccggacaccactgttgtgggaccaagtcggggaaagccaagtgttctggaccgatatcctgagagaagctgaagctaaagtcagaaccattcgggataatctaaaggtggcacagtcccggcagaagagttatgcagataactgacgccgtaacctggaattcgtagtggacgattttgtgtaccttcgggtcacgccattgcgaggagtacacaggtttcagacaaaagggaagctcgcaccttggttcgtgggtcctttccgcatcattgctcgacgtggagaagtagcttaccagttgaagctgcccgcatccatgggcaatgtgcatgatgtgttccatgtgtcgcaactcaagaaatgtcttcgagtgccgtccgagcaggccgattcagagcaaattgaagttcgcgaagacttgacctatgtagagaagccggtgaagattctggacagcatggagcgcaggaccaggaactgggtaatccgtttttgcaaggttcaatggagcaaccacgccgaggaagaagctacttgggaacgtgaggacgagttgaagacagcccatcccgatctcttcgccagttcttccgaatctcggggtcgagattgtcacgtcccaaaacgactctaaaatacatcctctaaattatgcttagaataattaaaatccgtgtgaaagcctccaacaattaaaaggtgcaaagttaaaagtcaaataaggcttgggggatttttgtatatttcctaaaagcctaaaatgcgtaaataaattttagtggaattttcagagcacaaataataattattaagaaataaacaaagttaaaatgattttataaagagaaaaactctaaaaagtcccctttccctccctctccctcttgggccggctcggctcatctccctccccctccctctcctctccctgcggcccatccggcctctccccgcgcgcgcgccgcttacgggcgggcccgcccgccaccatcgctgacgggtggggcccacccgtcatccccttcctcccgccgctcccgccgcctcgcccgctcctagagccgccgccgccgcgaaccccgccacctcccgtcgtccccgcgtgaaatcaataggggggaattactccccgtgatcctctccccctttccccccctatttccctctctctctcgcattcaaaccggcggatttgcccccgcaaatctcaccggcgccattgatggcggccggacctcccgcgccggtttcctcccttccccggccaccctctctcgaccgggctctatttaaaccctccccgcacctcctccgtccgtttctgcctctcgccgcccttcctcctcgccggaatcgagctcgcgccgtcgctctctctctccgccgtcaccgtcaagctccggtccgccgccgtcgtcgccccggaccacctcccacctcggagccgcctccttcggattcgccgcatcctcgccgacctcgtccacccatccgtttcgctcgccgaccgccggaacgccgtcgaccccatcgacccgagccgcgccgccgccttcctccgctccggccgcctttttcgtcgtcgccgtcgacctagggtgagccgtggaccgctgcttcttttcccacttcccttcccctctctcggccgccgctccgccgtgcctatggccgctgccggcgaccatagaggcgcgggcgtcgcctcccgccggctgcgccggctgggccgccctcgggcgcgccgggtggctgccgcgtggggcccggccgtcagccgcccgcgccttaggtgcggctgacgcgtgccggtgtgagcccgggtgcacccggtccaccgtggaccgtgaggctgccgcgtgggccccactcccatagacccagtccgcgcgccccctcccctcggttgacgcaataaacccttttaaaattaaaatttaaatgaagaaattcgcaaatattcatttaaagagcatataaacttcaaatgaccataacttggccatttgaactcggaattggaccgttcaagtctctaatttttccttaagaagtcaagaacccatttttgtgctttgttccagcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattattttgatttaaatttttgcattatcgctttatttaaattcccgcgttatcactgttttatctagccatgcctatgtacctttgttatgaccttattattgttattgttattatttccttgttcaccctagaataaacaaaaccccaactagtggacactctactcaaggtaccactagtatgattttagttagatgcttcgctggttaattaggtaacattaggtggtttacaactctagactttgggaatactcttatcacctggacactatggaattgttggattattgtggaatcggatgcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctgcggcctggtagtcgagatgtcatggcacagggccggtgtcctgctgctaggggcttagtcctgcctacctgtcccggaggtttcggccgtaggtggggttgggtcagtactcttgtctatggctaggatgggttggaaactatgtcatgtcttccgtccgtataccatggtggtatatggcacgtggttacacgtgaggaagaggtgtcttgtgggtaaagatgtacacctctgatcagagtataatctattcgaatagccgcgccctcggttatgggcaagccgagcaatgtacccaagttagtgttgtaattcttaaaacctgcttaacaactaaaatgtggaatggttggcctgggttggcttgggacgagctgggacccagggtcgggttgctagttcggtctgaattatcgtaggccttgggttaaggcaggttcgtgtgggttcacggccttgtttaataatcttgtatagctctaggatcgtatttacaaaatagctttgagcaactaagtgtcttttaatgctgtttgctgcaaaccctaaccctctatattataacccccttgtactcccttgcatttatcctgcacttgtgggtgtgtcttgttgagtacggtggttgtactcagtcttgctcaatttttgccaaacccagaagaggagcccctggatgatgaaggctttggtgtctagctcgcgcctgccgtcaagcgcctgtggtcgtcgccctagtcttccgctgtttcccgtttgtctttgtgtgtgctgggccttcgccggccatgtaataaattaactatttacgcttccgcttgttaaactctgaactgtatcaacttttggtgtaccttgcctcctgggacaaggaataatgcacgcacgtaaggaacgcccgttgggttatttccggtcgtgacaagttggtatcagagcccccttgaccctaggacgagccgtagatcccaagccttagcaatattttcaaaataaaaatcctttcttatttgtgaaaatcctttagtctctctctgtcctgctgcttcatttatcgtcaaaatctgatctttaaaatgttgcttttctcttttgtttgtagatggccggcagcatcaaccgtcgtggtctggacctgactggcttcgttttggagctgcggggcatgtgcgttgtcctggggtatccgcatggagtggactaccagggcaagcggctcccggagcaggagggtgacgatgcagagccccacgctgcttgggagattactgcagtgatcctcactggctcacccgagaggacttcgttggtagtcaccgtgggtggagattccttctctgccgcttgccagaacgccgcactcctcgccatcggcactctccaccagtgctacccgaacgagttgcagcactcgccctaccgctaccacccttgccgcggaggagcccgcgactacgccaccttccgggatgctagctcggaggatgacgctaccatcatgcacctggcgcgcatggtggaggcgtacgacgcggcccatatcgacttccatcagatggtgcgtcgtgggttggtcgagaacaacatgaagatcctggagctgcgtcaggagaatctgcagctgaagaaggacctagacgcagtggacgcgcagctgcgtcagctcaagatcgcccagggagaggtctgtcgccccaagcgtcgccgcgtctgccgcagcctgaagatcaccgcccgcaagagtacctccaggcccgagcttgttcgtcagtccctggcgtggacctgcttcgtcgagacccctcgtgctgagcccgcgcccgtggttcctcaggaggatggagcctccggcgttggcagcacggaggatgtgctgctgctcaccttccgccctggcccgtcgcagtagtagacgagcagttagtaggcttgcgtgtgtgttcttctcgtttgtttttctgctagagtcatatggggcatggttatgccggtgtgtggtataactgtgtcggagcttgtctttattttatttgcttaagcaacttgaactttaatgaaccaatttaatagcagtaataaattcaagaattatggtagtcgtgggtggttagttttaattgtcagctctctctgtttgctggttctgtgtggggttttcagatggtgacaaccaggagaagtgctgctaccggtgaaggcagtcaccccgaaggcagcaaccacaacaaccatggcagcccacctccacctcctcccccgcctccaccaccaccaccagacaccaactccatcctcacccaaatcctcgcctagcaggccaacatgatggctgctttcctccaccacatccaaaatccgccacaacataatgctccaccaccacccccacaacactctaaactcgccgagttcctccgcatccgtccacctaccttctctagctccaataaccccgtggacgcgttggattggttgcatgccgtggggaaaaagttagacaccgtgcagtgtagcgatgaggagtaagtcatcttcgccgcccaccaactgcaggggcccgcatctctatggtgggaccatttccaggctatgcagccagaggggcagcctattacttgggcccgcttcaccgccgctttccggagaacccatgtgcccgccggagtcatggcccttaagaaaagggaattccgagagttgaagcaaggcaaccgctccgtgatggagtatttgcatgagtttaacaacctggcccggtacgccctggaggatgttcgtgaagatgaggagaagcaagagaagttcttggcaggaatggaccctgagctgtccgtgcgtctggtctccggggactatctggatttccaacgtctggtggacaagagcatccgcttggaagccaagcacaaggaactggagtcgcacaagcgtcgcttggcgaatttccgcaaccaacagggggctaaccaaaaggtccgctacaccgctacaccaatccctatccagggagatcctcctcgcagcagcaacagcagcagcaacctcgctccgcgccccgacctcaattcgtggtgcgcgtcccacagccgcagcaacagcagagtcagcaagggactcgtgcgccccgtcctcctacgccagccgtgcagcctggtcaaggccgcagggacgttcaaggtcagcagtgtctgtgcttcaactgcttcgagcctgggcactttgcggataaatgcccaaagccgaggtgccagcaaggccaagcgcctccccgctccaaccacggtggtaaggatgtcatacggggtcgtgtgaaccacgtgatggccgaggacgtgctgacaactccagacgtcatcgttggtacgttcctcattcattccatccctgctaccattttgttcgactctggagcttcccacttgtttatatttgtgccattcgtggggagaaatcagttgggggtagaaaggcttaggaaccctctgctcatcaccacccctggaggggttatgacagcaaagtattatagccctgccgttcctatagaaattcagggaattcctttttcctcggatctgattcttctagacaccaagaacttggatgtgatccttgggatgaattggttggctcaattccaaggagtagtggattgtgcaagacgcactgtcactctgtaccgagggccggaacaaccggttgttttctttgcacccccaacctctgtcggtagttcagaacttcatcagataagactgtcggaaatccccatcatcagagagttcggagacgtgtttccggaagaactacccggtatgccgcccaagcgagagattgagttccggatagatcttgctctaggaaccactcctctgtacaagcgaccctaccgtatggcagcaaatgaactggccgaagtcaagaaacagttggaagagttgaaagaaaaggggtatatacggccgagtacttccccctggggtgctcctgtgatttttgtggagaagaaagacaagacgaagaggatgtgcgttgattacagagctctcaatgaagttactatcaaaaacaagtaccctcttccccggatcgatgatctgttcgatcagcttaaaggtgccacggtattctccaagattgatcttcgttccggatatcaccagttgcgcatccgtgaagaagatatcccgaagaccgcattcacctcgcgatacggactatatgaattcacggtgatgtcgttcggtttaaccaatgctcctgccttcttcatgaacttaatgaacaaagtgttcatggaatacttggatatgtttgttgtggttttcattgacgacattctggtgtactcacaatcagaggaagaccatcagcaccatctccgtctggtgttgggaaagttgcgggaacatcaattgtatgccaaacttagcaagtgtgagttctggttgtccgaagtcaaattcttagggcacgtgatatctgctaaaggagttgctgtggaccccgaaacagtgaccgccgtcactgattggaagcaacctaagacagtcactcaaattcgcagttttttgggtttggcaggatactaccggaggttcatcgagaacttctccaaaatcgctcgacccatgacacagttgttgaagaaagaagagaaatttgtgtggagcccgcaatgcgagaaggcattccaaactctcaaggaaaggctggtttcctcgccggttttaatcttaccggatactcgcaaggacttcatgttgtactgtgacgcttcgcgccaaggattgggaatattcatatcacatggacattggaatggttggattattgtggaattggattcacacctccccctctattcaaaaccctcaaaatggttttaggctgggctcggggtgcatggttttgatagtagcacctcggccacataaggaccggtcttcgggcctctgttgcaaagcactaccgtacttccacatgtctagtgggtaaggcttagtttgtggctcagtctggttataaacaaaagtacacggatgcagatggacgaagtcgggggtcgatggacatctctagggcaaatgaa

SEQ ID NO: 86360 - DNA, 1114 bp, Oryza sativa
aacgtcttcgagaaaccgcggattgacgaaacggccgaaacctacgcggcaaccaaagcacacaagcaaaacatgctataagactactgaaacaggaaacaaaaccatttttaatggattctttgcatttttcttgatttactgagacttgaatggacttaaatggagctcggatgaattacttatgaattttagaagataaactgtgtttttactaataaagaaaaagtccttaattaattattgcgcaataatacccagggctgacgtcatccagggggggcggcgccgacaggcggggcccacgggtcagcggctcaaaggggagaggaagggggcgccggcatgtgggccccacgggcagtggctcaaggtggccggtctaccgtggaccgggaccacgcgggtggtccaccgccggtccggattggccaggaggccgatcggacggcatggcggcggctaggcacggctcggctcggcttcaaaaccggccggccggccatggcaaccggcggcgacgcgcacggttttggcggcggttgccgtcgtggggcgggcggttggaggaaggggacgacctgacaggtgggccccacctgtcagcgtcccggagagaggggaaaggggaacgggccagcccaaaggaaggaggccgagcgcgggagggagtgggccgacggcccaatagagaaaaagaaggaaaagaaaaagaaaagaagaaaggatttttcctgggatttaaaattgcactttggtgatttttaattggttaaaattatttccaaggctctgaaaattccactaaaaatcttgttaatgcattggagcatggggaactcaagaaaaattccaccacgctatttccgattattaattgaatttattaactagggatttagctctaggttaattaagataatttcttcgggcaatttatttaaccaatttttaaagcaagaaaaggggggaaacttcagggtgtgacaaacctaccccccttaaacggaatctcgacctcgagattcggaagagctggcgaagaggtgcgggtgggtggcctttaactcatcttctctttcccaagtggcctcttcttctgagtgatgactcc

SEQ ID NO: 86361 - DNA, 6455 bp, Oryza sativa
tttgcaagttcgggggtcaagatttctggtattgaggttgggggatacgatttagattccgtggtcagttgagggagtcaaagtgatcttattccccagcaagaagtgagtgtcattgccacgcgatttcaaaacaggcccaggaacagaattgtcattcccgtgataactgaagatttcgtcagctcagttgtgcctttccgggagctgtaaggcggtgttcttttctcaagaaaaaaaattaagtgttttattcaaaataagttggtatttacgtatgattaattgagttttaatcattacaaactaacaaaaatagattaatttggtattttatagtaactttcatatagaaagttttcatacgaaacgtaccgtttgactgtttggaaagtgtgtcacaagtattcaaaattttatccaatttttattggagaaaagaatagaccctaagattttctctttaatagaggaaggagctcaaaattaagcaatttgctgggtagtcaacgggtgaaaccaggttacctagctataattttctggattacatagcaactgattatcggaggttgcagctagcagagctcccaaacagggtttaggtcctgttttttttccaagagttggaagaagattaaggttttcatggcacgtttttcaagctgctaaacggtacgtttcacacaaaaactttctatataaaagttgctctaaaatatcatattaatctatcttttaagtttataataattaaaactcaatcaatcatacattaataccacatcgttttgcgtaaaaaatttagttttcatcttcaagagaaaagaacaccaccttagtccacgttcggttggagaggttggaaaccttttctctggacacggaaaacagggctatttattaccatatgattattaagcattagctagaaaataacttaaaaattgaattaatatgattttttacaataacttttctatatgctacatcttgattaattagttgataaaatggataaaattaaaggtgacaaccacctcactataaaacttgctcttaaaagtttcgggagaaggtacagctacaaaaagctccaattagagctttttagctcttgtttgtttcatagtcactcttatgacaagattctttctcgttttttaatccaaaatgtcaactgttcaaaaaagtgtggcgcaatcctacttttactagttaaaggtgtgactcacctttttttattagctaaaatttatacatgtatgaaacaaaagtatagaaaatgatgacaaacttagtatggcatccaaccagaagttttcggctaagccggcttagctgccatgtaagaacttcacacatggttcttccggtcccggcctagctgtatactcgaacggtatgaagaaccatgtgaagttttcgcttagctgcatgcctacttacatcagttctttctaatgttgagacgacgacgacgacgatcaatacagtcagctaagacaaccgatgacaattttgacgattagttgtgccgtagctttcgtgggtgagctactgactgtgaatgcacccagccaccacctcgtcgtagaggcatcctgacaggtctcactcactcacggcctcagacgggacacgggcatgtgcacaggggctctgatcgactcatgccgtttttgggtaaatccgttatctgtctacgatagatgcggttcgtgatcactgatcgccgtgttcttccaaattcgcgaaacacgctagtctgtagggctcactcccgtttgctttgcatttacgcgcggtactggctgttaattatcgttcgaagttgacacttgacactcacagatcaagttggtttgtcggtgcgcattgtgaacaattcaacgagatgaatttcgtacaaatttcataggagatcgacagatcgttatattctcaccagatcgaatttttatttatttttttaaaaaaggcaataacacttctggactattattaccgctcactaggttaattttcaagctgaagcctatgtccctttgtcaaagagatatacactctcgaggctagtttcttaacgtggtgtcttcgataatgtgtgtttggttgaaaggatattttgggataaaaaatgttgatggaacttttatgcatgtttggttgatgtgcaatgatggatagggtggtcggaaaagggaatatttcacaaaggtgctggatgagtgtatatgttcaaattaatcgattagcaataattaatatatttggttgttaattactccatccgtttcacaatgtaagactttctagcattgctcatattcatatagatgttaatgaatagatatatatgtgtgtctagattcattaacttctataaatgtggacaatgctagaaagtcttactacctccgttttttaatagatgacgccgttgactttttcgcacatgtttgcccattcgtcttattcaaaaaatatacgtaattataatttattttgaaatgagttgttttatcactcatagtactttaagtgtgatttatatcttatacattcgtataaaatttttgaataagacgaatggtcaaacatgtgagaaaaagtaaacggcgtcatctattaaaaaactacattgtaaaacagagggagtaataattaacatgtcattattaatgtttgattagatataactggtcaatgttgttatttattagtatagattagggttcaattagtgataattaacatattttgttattaatattattatttttatttcatccattctcatacatccaacgaataaaaaaaaattcttaaccatcccacgataaaaaattgaataaccatatccttgaaaaaaaaactgagacatcgtactcgtaagcacgatgcccctcatcatatcaggtcgtgtttagtttccccctattcccaactttccatcacatcatatcatatcaaaaaatttcttatacacataaacttttaacttttttttttttcaaaatctcaactttttttaaacttccaacttttctgaggaactaaacacacccacaatacactgttaataaagaaaacatagacctgtcaactttatttcatgtcagccgtcaactttgtcaaactttttgtcgggctgtaaagtcctcaaaatccttctacagtattttccctagcactagcctcgagcactcgatggagtagcgcgcggagaagcaatagtggcgacccaataggtttacaataggattttattgagaacgagaatatgtcacgggagtataccaaatgacgtattcacaggacgtgaatgtagtgttccaatctaaacaaatatataccatgcgagcaattattcaattaagcgtatctctcatcttttattaccagcaaggaagttttgtaataaaaaaaatggtttacatctccgaattgccaatgagcaaataattcatattcattgtgtacacgaggtaaatccattcaaaatactcctagaactacaaatctagacatgttcatgtctagctttatagtactagaatacgtcacatctaatcaaaatactttatatttagggatagagcatactctttctctgtccctaaataactcaaaccctagcttctcaaggagtttttaagaagagaaacaaaagaccacgatgcccttaattaatgtgaatattgtattgaataattggtaggtaagggtattaaagtaataaaatttctcattttgcggattagtggtaagtataagaaggtagaagttgatttattttggaataaatttgaactcttcaagttgatttacttcctcattagtatccagaaccgttttacttcccataaaacgtgttgttttgaggtttctcaccaaaattagtatccagtgcaaatgactgatttaccctcatttatttcattcgccacacacaaaacaaaaccgccgttggagggtggggggaggcgaagagaaagacgaagccgccgtcgaggacaccgccacaagcgtgctcctcggagtcgagcacaaagccaccaccgggatgcccgcgtcaaagttgtagccacctgcatgttgctcctcggtgagggagtagacgccgtcggcgccgagcgcccaaccaggacttcgcctgcaacctcctcgttctcatccacttgcctttgcttgatgcgcatcgacatccgcttccgccgcctgtccattgcgtccggtcatgctagccagctgcattgtgatctccacggcggcgacgaccggtgaatcaacgcgcgcctgccgcgccactcccgcgttggagaggagaggagataggtgagggagagtgggatactaggattggggattgcatgagggacggggagggggggtggtggcgatggaggagttgaggcgagagggatgacggagaagtcgatgcgagagtgcgagacagcgagaggataagatcgcattaagtggtgagaggtcgctcgctagaaaaataataataaaaaagaaacgagtgattgaaggaagtagacttgagccgttaaaaactcaaaagttcgaactgacacaggcgagccgtacgcactgtagttatgtggtgcactggtcggctccgctgaccacccgtgactcttaccacgaccccgtccccggtgcggccccacctaccagcgacacacgcaggcggcttctcctgggggcttttaactatttgtcactcttacggatgttgcttaacgatttgccactaggcccacatgtcatagacacatgaggacccacatgtcattgacagggtgtggcaaatcgttaattgccatgtcacacgagtggcaaatagttaaatttccccttctcctgagctcgcggtgaacccgaccacccgccgctatataaacgtcgccccccttgccacgacacgcgcaacgcccacccatccactcgcaccccgcgccgcacaaacacaccaagaggtggtgaactggttgatcgatgcttgctgctgctgcgcgtcgaggcggctccatcggcggcaaccgctgatcgatcgatcgatcccgcgggtttcgtagcacccgagcaggtgagcgagcgagcgatcccctcccgcgcggccgcgcctcgatttggtcgcgattggtgctggattttctctctctctctctctctctctctacctttcctgtttcggtgggggttttggtggggttttgtggctcgaggtggtcggggatttctggggtgatgggagaggggctcgcgtggtggtggattgttcgctggaatggcggggaatgctgtgccgtttgggggattgatgccatggtgatgggtcgaaatgctggatggggttgagtttgttcaagtggttttgaattggaatctgtggagtttggggggaaatggggaatggggcttcgagtgcgcaaaggttttgcatgtgcggaattgcagctcgaggttttcgctggatttaggcgtagcttctgtgcgcgtgtttgtttagcgattttagcagttcgtgggctggtgccgccgcgtgtttgaatggtttagcgctttatttaccgttacagttgatgtctgcggtttttctggtgatttatgccagtttttagaggtgaatcgctgtgttttgggggaattctagagcccagggttgggtttatgggggcgagattttagctgttggattttaatcctatattgcgagaagcatgggagaactgcgatccgtcgtcagaggtgaacgctttcgaactctgatggttttaatgtggcagatattgtgaagcttatggtagcttcgttaacttgatcgacgtttttacttgtgctgctcgtgcgttgtggtagatttggcttgtgagagagcaggtggatggggtagattcagattacagagtggtttactgcatgtagcgatgtgtttgagttgtaacttgtgaggctgtaagattaaaatgttggcatgcgtggggtttttgggggtaatattttgttttgtttttgtttttgttttttgctagtgttttgacccaatccatctcccccatctttttttagtggaaaaccgctccctgttggtactactcaagtaaacttaccagaattacaatcctccaacaaaggaataataccctgtgctgtttgttgtgacaacttatctgtacatgatattgctagtttgctactgcagtatacctacatgctcacttatgtttgtttcttttagataatgtcacttatgtttgtgttttgcataatgttgataatttctcgaagaatgggtgctggaaagaagactcagaccgagaacgagttccgtgaggggatcaatgcagagggggaggatctcctgaggaaggcaagacgcctccgcggagctaaggttcagcaccctttggactacgatcttgaagtcctcaggagcccaa

SEQ ID NO: 86362 - DNA, 989 bp, Oryza sativa
aagagatttaaaaaaaaaggtatttgaatctataggaaataggaagggatgtattcaggagcttgtccaactagaagtattatacaaatgaagcctagactgagagactacgaccaatttttctttttcacctatgttatgtatgatatacacagacactaactggattagaagtgaagtaacattcgtcctaagtttaaacaaaaaaagagctgatttttaatgtttggactttgaaccgaatgactgaatgatcatgtgaccggtatgtatatcgcatccaagcattttcctaatcctcctgttgctacttgctataaattagccaaagattggcaacaaaggtacaaaacagtgttggccagaacatttcatgtcatttgtctccttaatttcactccttccaccaaaaaagaccaaaccaatgtcgagagcagagcagttgctcattgtgcttccccatcaaatgacttctgccaaaccgactgaataagcatgagcttcaagagaggatccaccagggccaccaaggctattcatacatcgcatttatcatggttatctgcaagaaggtatagtcagcttacagcaaataaaggccatctattcctcaaataatttctttcaaagatggaaatattcaacttaggggctttagattaacagaaaaataattaataagaccatcagaacaatctcaaacatcaaaatttgtattctttagcttcagatcgactaccaacttcccctgtaagcattcagaatggattaccatacccaaaaaaaacaacctccatagtccataaaggaaatgacaacagaaaacacatccatgggctacaacaaaaatgtgtttagcctgacataaattggttttggtgcactaacctggtcacaaactgggcaagtttcactccgctccatccactcaagtatgcagcaaagatgaaaatgatgctcacatttagtcatagagcggggattttctt

SEQ ID NO: 86363 - DNA, 1001 bp, Oryza sativa
ctgcaagtacgttcatcagcagcgaaaaacgagtggtggttgcagggcaatttcaggtggatcgatgaacccggcaaggacgctggggccggcgctggcgagcaacaagttcgacggcctgtggatctacttcctgggcccagtcatgggcacgctctcgggagcatggacctacaccttcatccgcttcgaggacacccccaaggaaggctcctcccagaagctctcctccttcaagctgcgccgcttgcggagccagcagtccatcgccgccgacgacgtcgacgagatggagaacatccaagtgtgataggacgacgagatgtcgtcgatcgtgtcctcttactcggaaaattaccagtcgatctcggtctcgtcatcactagctacgtctttgtgtgtgttttgtgtcgtgtcactgctgcttcgtacacgccggagagagttacataaaacgcgcgcgcgtgcacgggggagtggcgctagctttggttgcttggtggttcgtgtggggtacgtagattgctcgctctgttaattccggggctggagcctgctaattttgggcgtgtgcgtgtgccgcttgtgcatcagtctctgccgtcaaattgtgcgtgtgtgccaggtgtactatctctccagcagttgcttgttccacttcaattcacccccaaagtaattaaaaggatgtcacgttctctcccctatataaaacatctgcgactttatatattgttgtgggggttgcatgtcttgcatgtgcgttatcattccgtcaatgattaactgatgatgtcgctaatgatcgatagagcttggttgacctgaacaataccgtggggcactggaaagagtattgtcatgatatcggcccctgttgcgggcatgaacacttgttgagaaaaccgtacaaacagcactaaaacagtgtgttttcatgggatatggcaccttagttttctcttctcctcttctccacgtcaagaaatagctatacggcg

SEQ ID NO: 86364 - DNA, 1417 bp, Oryza sativa
atgttcccggcttcaacagagacatctcgcaatgtgcagttagatactactgcgactgctctagatcgatcttcagctagaggtgcagggttaaagcgttgaaatgaaacatcttttcaactattttttttctcccttacacaggttcccgtctacttgggcggcgcagttcaccggaacaatatgcgcgtcgttcgtgctcaaggcggtgatccacccggtggatgtgatcggaaccaccacgcccgtggggccgcactggcactcgctcgtcgtcgaggtcatcgtgacgttcaacatgatgttcgtcacgctcgccgtcgccacggacacgagagcggtacgcgtcgtccacggctttcacctccttgtcgtcgatcgatgatgactgaattttgccgtaaaatacatggactcttgaccggtgtttttttccatatgcaggtgggtgagttggccgggttggcggttggttccgcggtttgcattacgtccatcttcgcagggtaaatacgctagaaatcgacggcccgttaatcaatcagctattcaattcgttcattcatgttcatgaccaaaaagattagtactagctattaggaagtaattaacttggagctagtagcaagaccaattagttaatttgtagccacttgactcctgacaagtgagaggggggggggggaaaagtcaaactaacctggctaatcaacattatctttgatcgatcagtaaccaaattaataaatgtagggaaacatacatattgatcaggcagaacgtagaaactaaactagttgagcagaatatacaatggagactgagacgcagcgaaaaacgagtggtggttgcagggcaatttcaggtggatcgatgaacccggcaaggacgctggggccggcgctggcgagcaacaagttcgacggcctgtggatctacttcctgggcccagtcatgggcacgctctcgggagcatggacctacaccttcatccgcttcgaggacacccccaaggaaggctcctcccagaagctctcctccttcaagctgcgccgcttgcggagccagcagtccatcgccgccgacgacgtcgacgagatggagaacatccaagtgtgataggacgacgagatgtcgtcgatcgtgtcctcttactcggaaaattaccagtcgatctcggtctcgtcatcactagctacgtctttgtgtgtgttttgtgtcgtgtcactgctgcttcgtacacgccggagagagttacataaaacgcgcgcgcgtgcacgggggagtggcgctagctttggttgcttggtggttcgtgtggggtacgtagattgctcgctctgttaattccggggctggagcctgctaattttgggcgtgtgcgtgtgccgcttgtgcatcagtctctgccgtcaaa

SEQ ID NO: 86365 - DNA, 3900 bp, Oryza sativa
  unsure (1)..(3900): unsure at all n locations
gtcacgtgttgatgacacaactgctaccagttgtaataaggggtatccttccaaacaatgtccgggcaacaataacaaagctatgtgcattcatgaacgcaatttcgcagaaggtcatcgatccggatagattagaagcccttcagaatgaagtggtgcaatgtctcgtcagtttggagttgatatttccaccttcatttttcaatataatgacgcatctactttgtcaccttgtgaaagagatccgtattctcgggcctatgtacctacacaacatgnttcctttcaagaggtacatgggcgttctgaagaagtatgttcgtaaccgtgctcgtccagaggcaagcatcgccaagggttatggaacaaagaggtcatcaaattttgcatagaatttatcgaagaccttcgcccaatcggggtacctgaatcacgccatgaagggagactacggggaaagggaactcccggaaggaaagcgataatgacggtagacaacaatttattccgtaaagcccatttcacttttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgagggaaccgtctgggtcgatcacgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgtcgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgcaaattataattgactggagaatttttaaaagtattaaatttaatatatttttaaaactatcattcatatattagagtttttcacaatttaatttactgtctttcatatgctacttatatatgactattcgaatttttaaaaggtttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatattggaatttttattaattataagtcatatatttgcttattacaatttatccacttaatttattacagacaaaaataatttttcgaagtaattgtcattaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttggtaataccaaccgggactaaagatcatctttagtcccggttgttctcaacaaccgggagtaaatatcttttctttactcccggttgttctcaacaaccgggactaaagatttagtcccagttgttctcaacaaccgggagtaaagatcttttctttactcccggttgttctcaacaaccgggactaaagatatctttagtcccggttgttctcaacaaccgggaataaagatccgggggtatatatattcccggtgggccctcgtcttcttcaccaacacttagacgttttcagccgatcgatctttctcggcctctttccttcgccgccactgcctagggcaaatccccgcaccgacgccgccgtatctcgccgtcgtctcgagctcgtcgtcctcgtcgccgcctccgcctcctccgctgccgccgcatctctggggtgagagccgccgccgccagatctcccttcatgcatctcgatctctccgatatcgatctctctccgtcgcgccgcccgccacgagacgccgcgccacgacgacgacgcgccacgacgacgacgcgccacgccgccgccttcgccgccgccgcatgccaacgccacgccgccgccgccacgccacgccgccgccgccgtcgccacgccggcgccgccttcgccgccgcgcgcgcaatgccgccgccgccacgccacgccgccgccgccttcgccgccgcgcgcgcaatgccgccgccgccacgccaccgcgccaaccgccgccccgatgccgccacaccgccgttaacgaacgagaacgagaacgatcgaacgaacgagagcgagaacgaacacgtcaacgtacgttgccgcgagaacgtgaacgagaacgagaacgatcgaacgaacgagagcgagaacgagaacgatcgatcgaagacaagcgagaacgagggaacgaacgtgaatgagaacaagcgaacgaacgtgaatgagaacgagcgaatgaacgtgaacgagctagggaacgtgaacgagcgaacgaacgaggacgaacgttaacgtgaaatgcaatatatatatatatatatatatatatatatatatatatatatatatatatatatatatgttacttcgcatttatcctaatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattggacttatcatataagattgtgtagtgttctaatattatttgagttttaatataagattactttatttgtaattagacttagtatgtaattattgactacggaattggtgcgacaagtagcaattgactattgtagtcttaattagacttagcatatacgcacgaaacacttagcatagatgactattttagtcttagcaagtaatattatttgagttttaatataagattactttatttgtaattagacttagtatgtaattattgactacggaattggtgcgacaagtagcaattgactattgtagacttaattagacttagcatatacgca

SEQ ID NO: 86366 - DNA, 889 bp, Oryza sativa
atgtgtaagggttctcaattcactcctcagatttcaggcatcagttctgtgcctccatatgaatacactttttgtgctagagagagcccagatgtagctgacattgaacgttgttacgcagaataaaagggacagagttccgaatcatatatcaggatgaaaaccaggcagaggtctcgttcgtcagaacatgggatccttctctagaaggcaaagctgttcccttgaacattgataagaggtgatccaatagcacaggcatacaatggagttgttctcagcaattcatttggaaaaggcaatcatgtttaacagagcaagtaattgatatattttgacagcgcaagtatgtttgtataggttcatcgtactccggggctgctcaggattctatacttacggaatctatgagcatcaggaagggtggcctggttttagcatggtagagaccagggtggccttcaagcttcggaaagacaagttgttctagttcctgaatttaagtttttttttcgattttgctatatctcactcgaaagttttttttcttatctctcactcgattttctcactcaaatttatagtgcattttcttgtaagttacaatgtaatttatgaaacttacgctgtaacttttacaatgtaattttgaatcttaagttttgaaatttatattggatttggtctttttcttgcagatatggtaattagtgtctattatggtgtttcttagacgcaatgtgtgtatgacaggtggtaccgggtattaatagtatagcaagcaactattgtatgaattggctattacattggttatagatgatttagagctggcagtgggttataccattaaactcgctctaaggggagtactagtgtgcatcaggca

SEQ ID NO: 86367 - DNA, 6253 bp, Oryza sativa
aatgatgcaacaaaaagattcttctgcccatctcctccaccaccattccacacaccaccaaatgtacatttcatgtgagtgcatgctggttcgtcaactttgagagctctcacagcaacagccctgcacttggaataacttgcaccagatgacaaacctgatgcttcgaatatatcgtcaccatatctgtattgtcctgtgtacaatttacaaggacaattagaatccggtaccatctttccaagaaaacgtaaattgatacaactgaacaaaaaaaaaaggagagaatttcagaaagctacaactattttgttaaaattatcagtatgttacaaatttaaccaagcatttcagataactccaactatagcatatatgattttatcaaaaagctgcaaattttatctgtttgacaagtttgggcccacctgtcatatacacatgaaatactcatgctgttgtaaattggacccagatgtgacacgcacagagtgaataaaattgcagtttctgatgaaattatttgttgttattgcagctttgtgaaatacctagttaacgttatagcataatgatagttttgaacaaacaattgcagtttgtgaaatttactcagaaaacaattatggggtaaatggtgcgtgtgtgtatacatattttctaaatttatacattgcgaccataatttgccaatagaatagtcattcttttaccaaggccttcagaatatcgaaaatgatcttaactaatattcgatgattgcagaatttctcaaggaaatccaaatgacattctgtatcttggtttctgtttcaataatgagcttttgctctttcatgttgacatagtttcaatgaagttcacaggaaatctatttaaatttccaagcaggcagatgaagataatatcatgttggctttgtggattaaagaagatgcgggcaaccataccatgatgtccttccaacatacagttgcggtaatcattgccttcacctgcttttaagatctctgctctagccgccagcaatccataacgcaaataactgtagaaagcaatgtttcttgttattccatgatcttttacttgtgatgttggttccaacatttgttcatcaaaatgtggtaaaaagaaaatgttccatttccatgtcagatttagagtaacaaaaagaagtgatagattggaatcgcagtgtaaataacagtgcagaaatcactttgcagtcatatgtacaatcttcactgatttcatagatggaatagattttgcgatgccagtgccaacaacagttcatcagaatattgtcaacaacattgttcatgtcccattgaaagtaacagcaagaagtaataaaatcaattgaaggacatatgtactgacatctgcattgcaaggaaacaatatccttaagttactagttcaacttctcaactttcttttagcccaggtgtgctttattctatttctgtaatgatcagcttctagttgcagcttcctaaataatgtcagggttcctctctttacagttctaaaacacctaaggattgagattaaaaaaaaattacaagatactgcaaggcaatcctactagaaataaagactagtcaaaaattagtttcgccaatatttcaatacttatgacagattttagacatcattagtacgatatcttggtacaaataataacgatgtaaaatatctgtaaaaaactggaatgcaacaaaccatttgacgtgtacctgtgaacataaagataatatgttgttcccttaagtagaagctccttcacatatgaatcttcaccttctgcaactggaggagcctttcctgcatccttctctgagatggcataagccatttggacagaaccaccacctagatcaaccactccaaccgtgtgtgagtaaggctttcccaaatttcccaacagataattgatggtaacctaaaaaacagcaaagaagcactcatgtaatcatgttgatttttttttttttttgtatggagtacaaaaagagcagcatatggagtacggacaactttgtacttccatataagaaggggcaagcaggcaagtggtggcaatgaacattgctaaatccaaaggaacaccaatcatagaacctttttatatttgctaaaatagactaaataagataatgatctggggcatagaaacaaattaactttccatacccactggaatgcaccttcctgagatccatctagaacggtaacccattctggttgggatctgaaagagctcttgtcttgaagaagatcccttacctaaagaattcaatgaccaagtaacaaaaattacaagagagtacaaagcataataaatcttacaatctcaagtgagattataataaaaaaaggcagtccaatcttgacaggaataagatatgctacagctagcttatcacaaggacaatttaccgcttgcaaaatttcttcagacttttcagtccctaatgctctcaggcctgcagtagcctgcataagggtgaacatcacttcacagaaaaaagatgttatggaaagtcaaaaaaatgtgtttttcagcttccattccatagagtgaaatagaatggcctccacccaccccaaccctgacaggagtttgctcacgtaattccacaggaattactttttcagcttcctctagaagagaaacaagtgacttagcagcttcttgtgggtccatggcataggcactgaggcctggttttttctggcaagaggcaagagaaaaggatgaaggttcagataaaattgtacattcccccagttctatccttcttcatttatatttagaagttaggagtctccgcaacaactgtatgcatgaaatttttcgagaagtagaacatcttaatcaaggaagtaaactagtggtgcatacttctctgaacaggatgtagctcttggcaattttacaatgtatctacctagaaatctataatcgacacatactttaaagcttcagataagctttacccggcatatatagcccaaggcccagtgcctgtcagcaatttatacaaatttcagagaacagttatctacagtatataagaatgttcatacactctcagattttaattcaacgtccatcttcaaataatataaaggggtaaactgatcaataacactagaaagatcgcatgttgtaaaatcacattgatatgtcaatgacatatcgaccttggtcccaattctcacctgaatgctgttttccaatctatacatgtttgcaaattgcattgttcctagaaaattttcccaaatattaatgcacttgcaaaaatattggagcatctggatggcatccacatatatgtgtatttgcttgccactagtttcagctagtttggaaatacaacccagttcagtactaagtagtcttaaatttgaagttaaaaaaattcacaaagattattttctacaccgtatcttttgtctcaatactcttacaaaagaccagctaattatgtgtcacacttacaacgttgcctggctgaatatgaagcaatgcatctgatcacaggcattctaaacttaagcagtgcgcctaattgcagcaagccaggcataataacaaagacaggttaaattgttaaatagctgtgaacatcaataggtggtttcatggttttaacggcttgctgtcaccaactagcaatgtcagcaccaaatgctacagttcagcatttcatagtatgttactcacatgtgcttgctttgcagaaacgaaatgatcccatttcaaattctaaccaggatcaattatccctataagcatgctaatataagatcataacaagacctatcccgatcggatccacctgatagcaccccatatttcacaactaaagataatcaaccaaaaatgaaacgcggccaattcacctgcttgaacagctcgatttcctttccaataggcagcagatccaggttcccatcgaagcagtacacgtgcacgcggctcccggagctcccggcatcaaatatcacagcgtacctggtggatccgtccccaagtccgctgacggcccgggggccccacctccgtccggcagcggcgacgagctcaccggcagagccctcgacggtagcggaggcgggcgcgcgaggcatgagaaggagcacgagcgagatgaggagcaccggcgcgagcaccacgacgaggaccccgcggaagcggaggacgcggtcggacacggcctccccctgctgctgctgctgccgcgccccggcggcggccgagaagcggcgcatcctcgcggcatccgcggcggaggggccggcggcggcggcgaggtcatcggccgggagtaggtcggccgccgagggcgagcggtagcggatgcggccgttggtcggggacggcttcaccgcctcctgctgcggcggctccagggcggcgggtcgggtgcggccgcggcgcgcggcctcggcctcgtgggggcgcgtggctggaggtgcggctgcgcgagatctcccccgtcgcggctcacggcgaccggcggtgcgctcggcgccggggcggcattgcgtgcggtgcgagcgatcggagcggcgaggtaggcggatcggtggtggttcgatcagggaggacggattcgtggtggagtcgcgcgcgccgctcggggagagcgagaccgggacggatcggacggtgcggttcggctcgggagtcgggacgaggtggtttgtctcgctcgctcgcgtcgcgtctccggggacgggaatgggaacgggaggtgcgccttgggccgcggccgccacttggctgcacgctgcagcctttggctctctccgcctccggtggtttttacgtacctttctgggttgaaactgcgtgtcacgccaataatcgtgctctcatcttcttcttctttttgtctttttgtcataattgtgtgcatatttatatgagcgtttacgtttgtactgtgttttgtaagtgaatagaagaagtaacttatgttttgaaaatatgtaaaaaaaagggggtaaaatgatctcatttggcgtccgataacacggctcaaccggttagatttttaatggtgcaaccaacccattctggttcacatactagatttgacgcacgtgcttctattttcgactaattgtttatttcagtggcaggcaacatacccggacagcgcggcgcacgttgtgattttgtcaatcttaagatatatcagcaaagcgtctgtgatgattttgtcaatctcaaaatacaccggttcagtctttcggatatgctcatagggatagggtgtgcgcgtgttcataaaggagattatgtgtgtgttacgggtacatgcttttttattatgcttctaaaaaataaaaattttaaatttgaatacacatctaccaggggaaaagcattactaggaaaaagaacccggtctattgaaggatatcgagcttaaactgaagggccgttagtttggcgcattattttgttgggcctttgttggaaattaagagagatgatgggtgggaggcgatcagagtaaatgggccagaacattactctaccggggaaaaagtgcaccgaaagtccctcaacttgtcatcggggtacagaaacatcctcaaaccacaaaaccagatacgcgggaaccgatcatccgaggtccttcggtggttttgactccggttttgtctacatggcagctgagtcagtgtgggacccacgtgtcagcgtgccacgtcatctctctctttcccttttctttttttctcttctttttttacttctctttgcggcaggggagtagcaagaacgggcggcggcgggcggcgaaggcggcgtgcgagcgcgcggcggccggtgagcatggtggtcgtcggcgttgccatggtggttgtcggcgtcctcctcgtctcctcctcctccgcgtccgggtccagccgcggcgcggtggccccgccgcatcgacggtgtgccccgtttctccctccctcgccagccgtcgggacgacccgcagcgcttgccgcgacctccacggccacctcctgcgcggccgcgagctccgcgtcggcctcgccgaccggccccagcaggaggcccctggaggacggggtggcggaaggggcggcactggaggagccggagccgatggagacgacgaggaggtcgtcgacgccggcagtgaggcggaactcctgcttgttgtggaggacttgggtgatggcggcggcggtggggttgcccatggtagc

SEQ ID NO: 86368 - DNA, 2563 bp, Oryza sativa
tatcactcttcagttccttatcgagcatgggcagtggctggttgttttgttgagcggccaaatttgtgcttccacttttgtttcctaatatatagagatcagccaaagtacctgaccaagtaggatcaacgcttttctcttgagtaaacacagtgctaaatgaagtcggatcttggggtttgtatagcggatccatgtgatttgaaggaatcaaagagactgcaccatcctaacgcggaggaggaaacttttcactcttgcttttcgcagttgcatgtgttattaatcttcttttaacgatatttacttggaagcattggaacggctgtattttaaacaatgtcatgcctagtgtcaatgttgttttggaagcagtggtaggggagagtgttttgtggtccgtggctagagctagggctctccatgaactcctgtgtctgtctatcctgttgactggttatttgttgcctgaaagtgtgttttgtgttttggtgacgcatcgcctgttgtgatgttttctttctcaagagggttccttcgtgaaattctcttttcaacatattttgagtattcttaatgaaatgaagcacatggcttttgcgttttcatgaaaaaagaagtccaaaaatcaatttgactttttagtgaatcctgtaatccaaaaccacttctaattttccttgtatggcatataacttacccctcccattgtttagtaccatcagaacgtctacatcttctcacaatacaagccaagccctagtaggcagtcaaccaccgaaaaatcttctagctagaagctctcacaaaaaccaatccccttttatgtagtgcggcacagctccatccgtcgtccaagtttgttgggtgcttgtcatagccaagcgccatggtacacatcaatccttgtatcgtggaggacatggcagaggccatgtacaccgctatcaatatggatgtccaagagacacacgaatggaaagtcaagcactacgcatttgccacgttgcatggcatcatcatatgggcgatgtcattcaccgctgatctatcctcctagccttctcttgttagggattacatgttgcgaagactaacattctcactggatgtcaaggtgctcctgtttcagtcaacgacacacatgcgtgcacgtgaccataaacactccaaaacacacacacacacacacacacaaactccgcgtggaccccatggcctcacctgatttccctacctccctaccatcactgctgcatctccaagcccaaatcccaaaaccatagcccatggtcgcatctcccactggctcctcctcctcggccactgccgtggcgacgatggcagcggcagccgagcccactgacgggccaacccttagcgtcgtctcgaagtggctccacgcgctgcggaagaagcacaacaagattatccaaatggaggagccgctcgctgacgggcggaagctgaacaaggagcagggggaggtgccctaatccaagcccgtcatcgtcgtgctcatcgacgagctcaagcggatgcgtgccccgctcgccaccgcactcgctgaggagctctcctcccgtcccgcccgttccccatccgtcgtcgtgtcctcctcctccagtgtcgatttgtctatcaaggatctcctcgcgctcatctactttggctccctcttcgacgtcaagccacagaccgagttcatcgccaccatgctcgtgcgtcccaaggagtgggactgctgcatcacctttgactatgtccgcccttgtcgcctcacgcgctgtcgctcactggtcccaccgccactcgcagctcgtcagtgcgggaagaagacaggagaaagaaggaaaaaagggggaaaaagaagagatggatggaaaacatgacggcggtggcacggttcgaattttgtaaaattttagtagcatggctacgaatagacgaattgtagtggcatttttttgaaccgacatatttgtaattgtatggatccaattaaccctagtatttattgtgtggtgagcaaaatcgataaaaatcaagtccaaaaggcattgtctgtaaatatcactcttcagttccttaccaagcacgagcaatgcctggttgttttgatgagtggaaaaatttgtgctcccacttttgtttcccacctatagagaggtcagccaaaggatccgttggctccgaccaagtaggaacatagcttttctcttgagtaaacacagtgctaaatgaagtcgaatcttgggattcatatagtgggtccatgtgatttgaaggagccaagagacgacaccatcctgatgtggaggacgaagaagcacaacaagatcctccagatggaggagtcgctcaccgacgggaggaagctgaacaaggagcaggaagaggtgccctgatccaagctcgtcgtcgtcatgctcatcaatgagctcaagcggatgtgtgccccgctcgccaccgcacttgctgaggagctctcctcccgtcccgctcgttccccatccaccgtcgcgtcctcctcgtcctctagtgtcgatttgtctatcgagga

SEQ ID NO: 86369 - DNA, 1127 bp, Oryza sativa
ttcataaaagagaaaagagaaggaagaagggagaaaaataaaaaaaatccatgtcatcgtccacgtggcatgccacgtaaataagaccacggtcaaacgcggctttggaccgggatgatacaataaaccaagtttagatatctcaatgtgcgctttgcaagttcgtggacctaagtaaaatctgctgacaagtttaaggaccgctggtgcattttactcttctaatatctttggttgtaagttaggctttcttcctgtcaaatatcttggtattccaatacattttagaaagctaggtaacaaagactggaaggttattgaataaagaattgagaaaaaacttagtagttggaaaggtaagtatatgtctgtgggtggtagattggtgttgattaattctgtactttcaagtttagctatgtttatgatttccttttttagataccgaaagggatacttcaaataattgattattataaatctcgctttttttacaaggatatgatcataagaaaaggtacagacttactagatgggatatcatttgccggcccaaagatcagggtggtttaggggttcataatttggaaatacaaaataaatgtcttttgagcaaatggttgtttaagttaattaatgaacaaggggtttggcaagacttattgaggaggaaatatcttcataataagtctattactcaagttgataagaagcaaggtaactctcatttttggtcaggtctcatgaaagttaaggatactttcttaaacatgggttccatgattgtgaatagtggggaacaaactagattttgggaagataaatggttaggtaacttagcctttaaagataagtatccctctttatatgccattgtccgaaggaaatgttcttcaattactagtgttatgagatctgttccacttaatgtttcttttaggagaactttagttggtcagaatcttattttttggtatgagttgtgtgcttctattatacatatccagctaaatcattcttccgattgttttagatggaactttaataagaatggaaggttctcggttaggttaatgtatcttgctttaattaataatggttatattgagagaaataaaatgattggg

SEQ ID NO: 86370 - DNA, 1071 bp, Oryza sativa
ctaaagatggtactgaaagggaatcttggacaataatgtctgctgaagcatcacggataattagttaagcaggccttccggtgatggtgctgctctaatctcaccaccagtcgtatctccacttgccaatacatggttctactatgtttgatacagggagggaaaaaaatggatttgctgcttggactaagattgaaaacccatttttttacaaggtagaaaatggcaccacggaatccccgaagtccaatatgatgttcaactcagttgacaatagttctgcccatggaagtactaacaatggcaatggaaataaagcacctcttgacgaagagaatgaagaccttcttgcagattttattgatgaagatagtcagttgcctagtaggttagcaaaaacaaaaattgtgaaaggcaattcttcccattggaaggatggggacatttcatcacagacaggatcatcgctttctttattaaggtatcaaatatgccataactttcagattgttcctgtaacataacttcctatgctaaggtgtgatttcttcactggaatcaggatgatggataaatatgccagattaatgcaaaagctggaaattgtcaatgttgagctttttaaggttagtttaagtcacccatcgtaagatattcgacatgtagaatatttcctattgttcatgctagacaaaattttcagggtatatgccaactgtttggcatcttttatcactacatatacgagacatttgggaaccaggacaggggtcaaagtggcaagtctttacctgatcatcaatcgtgtaagaattaggtttgctctgtgcagttttttatgattcttttctattgctgcacaaatgcaattatacttttgagtcttaaatatcctttgtgacgcttgtgatgtattcagttcggcttagagtggctttgtcaaaaataacacaagactctgaccagtggatcaaaccacagagtatttcatattcaccttcatcacccgtatcaatggatgtgatgcctactgcgcctcccagctcaatgttcaccttgtatggtttgaag

SEQ ID NO: 86371 - DNA, 1471 bp, Oryza sativa
cctaaaggcaaaactttcttcacttcagaaagacatatctttgaaagagcaatcgttgctttcagagctggagaatatattccaagagcacaaggagcatgaagaaaggatagatcgtgtacatttacttttaaacaagattgagaaagaaaagactgttgaattacatttcccccgctttcttgagagggaggttattagtcttactgcacagttatcttcaacagaagaggagcgagaaagttccacattggataccatccgtgaggtttccatccttcgagcagacaaggctaaacttgaggctaatcttgaagatgtcaatgcacagatgatacattacgagtctcaattggaagatctgcgggagtctaaaaccaagattaaagacctagttgactcacttaatgcatccaaacagaatgaggaaatgctcactacagatgttgacaatatgagaagatcgatagaagctgctagatccaatgaagataacttaaggaaaactttgtgtgaactagaattgaaatccaaatccagtgattatgagaaacagcagataattgaagaaatttctgtactgaaaatccaggtccacaaaatagcaggcctccaagatgaagttcttacattacaaagttctcttgatgaagctaagtttgagaaagggaagttggaagggctgattcaatcattgtctgaagaatgtgaagaactaaaggcacaaaaggggatgttaacagacaaggtctcatgtatgcaggacactttgaatgctgccaatgaaggaaaacaaattgaaatctctgcacaaacaaagcttgtgatgctaggagatgaaccaccagttaaggaaacatcagatgtacttgaagctgagctaaaaagtgaactaagtattatcaggggagctaacagtgaataccaacaaaaaatatattctcttcaagaggaaaatgaggatctcacaaggagaaatcagcttatggagaaggagcttgacctgaagacaagccaaaacaaagatgaaaataccaataaacaggtgagccatttaaatataatcaactgtggaaatctctatgcctgtaaagaaccagttttaaaacagggtaaagtacatcaaatgtgataaactcaatcagctgttttcttattgttttagggtaatgatgctaatgaaaatggagattctccagttaatgaggtcccagagcttcagtcaaaaaggatccaattactggaaactaggcttgctgaggcactggaggaaaataaattgtatagaggccaaaaaaaactgaagaggtacagtgattcatcatatctacacgccttgtccttctgacaatttttactagcaaaatgcgttgtccaccagatatcatttgctatcccttgcataccaaagtcctgtttaggccccaggttctgactcatcagagctatgggctgtcgtccttaataataa

SEQ ID NO: 86372 - DNA, 3294 bp, Oryza sativa
gccggtggcccccggtgggcccctcggcgcaccggcgggggaccatggaaggcagggaaggggtgaaagctcccagatccgggggccgggggaaggctagggctcgcgcgcgcgcgtcgtcgtcgtcgtcggtggcctcggcggccggtcggatcgcgcggggggaggagagagagaaagagaggagacgagaggtggttggtctcgtggcgtggcgtgggtctggctgggcttttttttccctcgcggtcgcggcgatgtgcgtaaagcggaggagaggagaggggagggggcgagagaggagcagaccagtctcgtgctgaagatgatgatgctgagtctttttttttctttttaccttacctttgttcctctccaagttacagcgcagtttgttacaacctccgtcctataatacttatcgtcgttttgaatttaaatttttgtttgtaacatttgatcatttattttattttaaagtattatagaaaaaagctaatgtttaccattagccaccacgagtgatgataacccgaagatgatgtttgaaactaatgacaaagatgaatattccctccgtttcaggttataaaacgttttgactttggtgtttgactaaatttgtagaaaaaaatattaacattttcaacccaagataaatttattatgaaaatatattcgattattgatttgatgaaattaatttagtattataaatattattatatttatccataaatttagtcaaacttgaaacattttgattttgactaaagtcaaaacgtcttataacctgagacggaaggagtattaagttagcccacataatgtgtaaaaccagtagtacatgattaattaagatttaattattacaaacttagtaaataaatattttttatattttaaagcaacttatatttatatatagaaagttaacttaccgtttagtagtttgatgaaaaacattatagcaaaaatcgagataaaatttaaatcttaataaaaacaattgaaggctcagattattgtttgtgataaaagagttttccactctcctctaaaacattttttcatggctttcgtgtgaggtgaacagtacaacaaattaagttacttatgtataattcgggatggtatattctgatattcacaatacctacacctcttattgttggaattgtggataaaacacatcattatatccttttagtacaacataggagtagatcttaataaaggttcggtccatagatgcactttcatcgtaaatatcctcttaccatttacatttaacccactaacaacagacataaaagattttaccatttttccatggtttatcagccatagcaaacgatcaaataaggtggtgtttagattcagagacttaactctagtccctgtatttatacgctattttagagtattaaatatagattacttacaaaactaattacataaatgaaagctaattcacgagacaaattttttaagcctaattaatctataattagagaatttttactgtagcatcacataggctaatcatggattaattaggcttaatagattcgtctcgcgaattagtcaaagattatggatgagttttattaatagtctacgtttaatatttataattaatatctaaacatccgatatgatatgtaaacatccgatataataggtacttaaaaaacttttagtcccatataaagacagtaagctggtaactattgcagtcgaaaagttaaacattctgtccagcctcttctttctctcctttttactgacatcatcctgcattacaatcgggcgataccagttccattaacgctgaacagatcattataaatgaacaaactcatccgcatacgcacgctggtccaatactaactatagagtagtactactacactttgcatgatgatatctatcccgtcgcacgtccacatctgtgaccatgatccaactttctacccgcgcgcgcggcgtcttccaagttggcagacaaaatcacaccacaccacacaataccagtgcgacactgagccctggccggctggccctgccctctcaagacaaaacttgacaaaacaacattatctgatcctctctatcgaaatattgctcttataccaactggaaatttacatgtacagtgatgatggtgagttacaggttttacatatgactaccaaaattctgctgccctcgcagctgccactgccgtggcagtggaggaagacaaataaagaatcgaatcagtggaactatgtgacataattttataaccactatatgaacaaggaaaaccgaatggatccagtccaggcagcttccagcttcaccaagctctccttcggagatgagagggagatcgaagaggtgagaaacaatgcgtattcacaacaatgctgcgttcgcgctttacctcttccagctgcaataatgtgttcgattgccgtatgacaaaacatggtctggtgggttgagtctacagctgatgttgatcagaagacttcctgattgtcattgtccaaggggtttctgcttgtaaccggacttttgtctttccagcaacttcaccttgttcttgagttttttgtccaatttcttaatgtatttctcctctctctcacggtcagcgataccaggccagaacacctgaccagtcagtggccacagccattgatcatccccagcatgcatgccatcatccgcttcctctgccagatcctcatccatgctcttcagtagggtgaaattgaagaacttcacccacatctcatttctatcatcaagagggtgctgctctctgatatctccggtgacaggatttaggtaggccatcttctttccgctgtgataagcccagacattcacaaggacttcgaggattcgacaatagcagtgccttttctgaggtaaagagggtggttatgttcagatcacacgcatatccaagtatacggatgattataaacaaaaatagggtcaccttaagctgtgatgctccaagcaagcatgaagctggatctgtaccattcacgtttaagctatgaagataatctacaaacatcctgcaagggttttttttttctctcagaataaaataaaaagcattaaagaaaagggaagtgtgccatggaaagatgataggtgcactgtaaaacaataccttgagaacatgatgaacttcaaaaatgacggagtaggcatcacccaactatgcagagtagaccaataatcaccatcattgggcattggtggcagggctgtgatgccatctgagag

SEQ ID NO: 86373 - DNA, 4019 bp, Oryza sativa
  unsure (1)..(4019): unsure at all n locations
acggccttgccgacgagctctcccccgaagaggtcatcgacctcgacgagattcggaggctgcagggactcagtgttgtgtccctggccgacgaggaggacgaggaggcgaacggcggcggtggcggggtggattacggcgacgacggggtgcccctcgacgacgacggcgaggtgttcgatgtggccgatgaggtcggcctcgagggggcgagggttcggtacccggccttccgcatgacgctggccgagctcctggacgagagcaagctcgtgcccgtggcggtgaccggcgaccaggatgtcgcgctcgccggggtgcagcgtgacgccagcctcgtcgcggcgggggacctctacgtgtgcgttggggaggaagggcttgctgggctcaccgaagctgacaagcgcggggcggtcgccgtcgtcgccgaccagaccgtcgacatcgagggcacccttgcttgccgcgcgctggtcatcgtcgatgacatcacggcagctctccgcatgctccccgcctgcctctacaggcggccttcgaaagacatggcggtgatcggtgtcgctggcacggatggggtcaccaccacggcgcacctcgtcagggcaatgtatgaagccatgggtgtgaggactggcatggtaggcgttctcggggcctatgcgtttggcaacaacaaactggacgcacaacctgatgcctctggtgaccccattgccgtgcagaggctgatggcgacgatgttgtacaatggcgctgaggcggctttgttggaggcaaccaccgatggtatgccgtcatctggtgtggacagcgagatagattatgacattgctgtgctgactaatgttaggcatgccggcgatgaggctggcatgacctacgaggagtacatgaacagcatggcctctctgttttctagaatggttgaccctgagcgccatcgtaaggtggtgaacattgatgatccaagtgctccattctttgctgcacagggagggcaagatgttcctgtggtgacatattcatttgagaacaagaaggctgatgtgcacactctgaagtatcagctttccctgtttgaaacggaggtcctggtacagacaccacatgggatcctcgagatttcgtcaggccttcttgggagggacaacatctataacatccttgcatctgtagcagttggtgttgctgtcggtgcaccactggaagacatagtgaagggcatcgaagaggtggatgcaattccaggccggtgtgagctaattgatgaggagcaagcatttggggtgatcgttgatcatgcaaggactccagagtctctttcgaggcttttggatggtgtaaaggaactgggcccacgtcgaattgtcacaggtattgtactttcgtccatagcttcattaagattgtgaatatgttggacatcttctctattttgttgtagtatancgcattgaagttcctgctatgatgtttgatgtagttattggatgttgtggtgagcgagaaagagggaagaggccagtgatgacaaaagttgcagctgagaaaagtgatgttgttatgtgacatccgacaacccagcaaatgaagatccatgtacggttctttctatttgattatgatatcatattgtgatgtaaatgcattgggggagctgaagttttacacaaattctgtgtcctatttcttagcagtggatatcctggatgatatgctggcgggagtagggtggaccatggaagaatacttgaagcatggcacaaatgattattacccaccactgccgaatggacataggatattcctacatgatattagaagagttgctgtacgagctgctgtcgcgatgggtgaacaaggagatgtagttgtaagttttctatgaagttcttattgtcaagtaaccttcttacaatcttactatatataaccctgtagattgatgaaacatgctacacttgagtcaccatgcatatactcctgtatagaaatgcttaatagaggctggacttaaaatttcaagaatgaagtagttcaagtacctaatcccattagatgaggaataaaaacttgcaaaataggctattgtgttgcaatctatctgtttttgggcaattctatctagtaataagctgctctagtttttgtatatttgcactctctttccattggaattgctagttaagagtgagttggtagcattgatcttctgagataacaggcttggtagttgaagtaattaattatatggttttagcattcaccatctgccccgctctccagttgggaagtaagggttggagaagggcaaatgctcattcttcaaaccaacatttaagatcaaagagacaggtggagcacttcttgttcatcatgctgacagttctgcttctccttcaggttatcactgggaaagggaatgatacttatcagattgaagtcgataaaaaggagttctttgatgatagggaagaatgccgagaagccttacaatatgttgatcaattgcatcgagctggaatagacacctcagaatttccatggaggtgtgtttccttttaaaccgctaattgttagggcttgttcactttctaatactttaggctttgcctttgttttaccaaaagaaatccagaaaattttccagacaatcaccaccttttcatctaatgcacactttgtgttttagtttagcataatttcttgtttttaagaaaaagtttggtataacttgctcagagttcttttatgaaaaagtttacttcaaaccagaccctctgttatactgattccgtcgctcgatttcttttgtttcatgtgaaaaccaccaaatcgcttattttgcttcgttgtgatttccacaggttacctgaaagccactgattctgatgtattcaatatagccgggcttcttctttgcttgctcaaggagcagcattttagattctccctttttgctatggtaggatgtacttcagaccagcgggtgctcaaggttgactacttgacccccagtactaactgctaacttctcagtgatactcagtaggtacaaaatatatgcaatgcagcttccccttaatttctgctgccattttctatgttctttagtctaagtttttcatgtcccatagtcacaatccagtaactcacacacaaatacgtacaatgaaatcctgattgtggaatatgtgccaaacatcattcaactaattctgattcatcagaatggaagattggcaggacataccgaggaaagcgaatacttgtatggataaactaaaggtgcaaaacgtcatgatcagaaccagaggccccattggcatttatcaatcaccatattatagtccagcaccaaaaggtcacctgggggatcaggcatttggatatgcaagatgccaaatcccttatcttattcttctcttacaacagccaaattcagagatcacataaattttaatatccacttgagcggtcagcacacaaagacattgaacttggctgtaactggatcctctacatgatttttaatataaacaggggcatctttttaatccaaagaaaaaggcagagagacatggtatgaatgattatgaaattgcccacgttttggtctgattctgaatttcctgataggattgcgacaagttcagaattccggaggaaagtcgcctccttcgtgtcccactttgtccatgtatatcactgttccccgtgttgctgctgctgcctggggcttcaattcctctctctctctcccctcccatggcgtcactgtcgccttctcctacgcgaattgagaggacagcttagctcgatggatccggcgacgcgggcggcggcggcggcggtggagaaggtgttcgtggcgctgccggctgagaaggggaagacgacgctgtcgtgggcgctcggacatttccgcggcagcggagccaagctcgtcgtcacgcatgtgcatgtgccgccgcagacgatccccgtcagtacgtgccctgcccccccccccc

SEQ ID NO: 86374 - DNA, 3073 bp, Oryza sativa
aggtggtctcgtcagtagaatgtcccataaatgataggtagcatatatcttacacaagtttagatgatcagaaatggtcaacataagtaaacttgaactggggggatccaactatttatggaatagaccagtactaatttcagcagcagacccaaacataccacaatctttctcagaaaaagtacataaaacataaaaaaacaattaagttcacaacttcagacaataaccttgaaacctatcaaacattcaaactcagatgagcaattttaggaaataatcccccttatagtatttaagcacagaaatccataagttatgtacttttttctgacagcgaaataatccataaaattcaaaaccactgacagttatatttagacaatcagtggaaccaagataagtgctagtacatacctatttctctgcgtattatttccaacctcctgtaattattttccaattagaaaatggataaaataaactatcaagaaattggtatattaactgatcaaatccaatacctcttccaacatttctttcaggacataatgagtctgagagagtacttcttgcaaaaagaaactctgcatcttttcagccatgccaccgatgtcacccatcagcgcataggcatcaataacctattgtccacgtgtaaacatataaagaatggaacttgtaaattagcaaagcaaatagataactaagacttccctaacaactaagccaatcaagggctcacgaggaaaaacaacaatggaaatactcacagttagatagctttcctcatggaaggtctgacaaacccctagtaaatgggtgtctaatttttggattgttcgtgccaaccatgcctgaggatgtattcatagtataaacaccatcaaaaggacaaacattatacagctatttgttcaatttgatggtggacaagtttcttttgctctttgaacataccaaaagaaagctttgagatgaagataggttcaatgcattctacacttgacatagaagcaagcaataaatgcaataaaataataacaattacctcaatcccacgccccatttcttgtacagaagaaaggcctgaatagttctccaagatttgcaaatattcaggcaataattgaaacgcctgcaaacatcagcaacatggcataagaaaactaccataaatataagaaggcataggtgattaacagcataagaaacaactactgtggtagttcagactgtggagcaaccaacatactacaacaggtcaggtgatttatggggttgaaaactactggagtaaaataaagcagtagctaatatcaccctagagtaaaagagatggattcatgaaacagatagagaaaacagcagtcatggataaaattcagctcacctgaaaatagttttctttctccacaaaactttcaagttccatctgcatgtcttgtgcattacgaagttctgtaagaattggaagaacatcctgcgatacagaaactaaatcttttatttataatcttcaattcgtgtagctaatggtagcgattacttaaatattatatgcacatgaatttatcaacacaattaataatccatccttgaaagacattgaaaaaagaagggttggaccagaaacatataaacacattaagaatattgcttcacagtagaatggtagttcagtgattgacatgtaaagtctggcgccaatcaccattcactaagattatccagtcgatgccgcaaacaataatgagacaagagaatttatttaccagcaaagcttgtttcttctttgattttacattgacaaccagatccctcgatacctcattctttgaagaggatacatgcctccgtccattctgtaatattgattaataaatcgtaaatgcaaaaatataaaaggaacagaacaatgtttgtaaataccatccagaagtttcatgagataataccatgcagatcacatttgcaacctttaaatcttgttctaactccatcactaactgcatccccttcactggccaaaacttattatcagtgatctgggatttccttaaaaggaaatcagtatagatgcatttttggtagcataacacagaacatgttattttaggaaaattgagaaaaatacttataacaggtatgtctgaaaactagaaataaaaggcatgtgattaaaatatatctaatatgacacagcaaagtaaggaaccaaaaactgaacctcttctatattctgatgggagacatacccatttcttcatgatgacccataacatgatgtgatagtcgttctgcaattttgtcgagctgcgctaatctcaaagtagactgcacagaaaaaaaggaagacgtcaattttgctacaaaagcacacactcatgtgcatggatgggcccttttgttggaacatatgttcattggcaagaacattgctcgaacacgacaagaagtactcggtttcttctacaaagggcatgcgtgttgtttgttgaaagaaatgcttccagctatcattaacaaagctgtatgcaagtaagcatgcaaactccactcactctttatcatacccaccagcactaatgtctcagacatgaaaaaacatgtgaaggtaaaccgctgcactaacctgcttatcgaaatagctggaatcaccctctgcagggatactttgcagaatgtactttattgggtcgaactcctgcagacaattcaaaacacatcaagcccaactggctgaaagccgcgggaaaccacagctgcggaaatacaacacatacctcctgaaagaacacctcctcgagctcatccacggcatgcccctgcgggttgctcccgtagatggagaccaagtcctccgaattcgaaggcaggctgatcttctcgtgcggtggcagcccagcgatcgcacgtgcggccgccgctgccgccgcagctctagctggaacctagaccggcgaattacaaaaatgagcaacctctatcggatccaacacagggtacaccgagtgagagattgacgaaggtggaggagggaggaagtgattagggacctcggggcggaggg

SEQ ID NO: 86375 - DNA, 1171 bp, Oryza sativa
cctctcccacctcccaagttaacagcatgctcccccgcctccaccctcagttcaaactcctccacctacaccccaatctgctctggtagaacaagtgcacatgccagatggtactacatccgaaccgaagtctaatcctttggaacctcgtcgtataattccaaagttgatatcgacatacgacccaaagaagattgacaaggataaggagaagttcatgttttcagctttcaggaattctgagaagagaaaagaatttgctcacgtcttgtcagactcccagaagtcagtactagcggcccaagatgaagtgcaatcctggttatctgccgatgtgcctgaaacttatgagtatggcaagccattcttgccaacttatcttatgaacaagctaccatgggaaatgagggtaatgcacgaatggtatatgaaggcatctaggaaaggtctcggtttcataagcgtcgccgtctcggaaggcgctttcatgagtggtcctaatgggatattttttatctctttcccagacctttacgccctctacaagctagataaaatggatgttaatctcgttgtggcgttctgtctgtaagtctgaactctttattacatgttacacgtatcattccaaacaaataaaccaaatctcatttcttctttattcattgtacagtatgcaattccacgaagctgatagaactggagcaaaggttggatacgtcgatccaacaagaatatgcaaaacacgacacaccgtagagctgagagaggactgcgagcaattggttggcaagacccctgaagaaaaggaagaatatgtgaagacattgcacaagaggaagaagctagaagtagcaacatacttggcaatagcaatgttggcgcacgccgacaaagatgtcttaatggtcccgtaccagttcacgtaagctttctcttctttttgtttaattaatttatcttcttcggaattttctgtctccaataagcctatcttatatgcagagaccactacatattattccttgtatatccgaaagaccaattgatcatatcattggaccccgcacactatgacaaggagacatttatggaattcctcactattttgaatttgtaagtgataaacatttcattactataaattgtttaggtcgatcaccagtcttct

SEQ ID NO: 86376 - DNA, 1298 bp, Oryza sativa
agaatgacttacattgtgaaacggagggagtacgaggcaatattattcttttgtaattaaaacacctgggcagctgtatttttgcagcatataactttttttttgtgtcttttatgttatgttgtcatttacaggatttatcaaagctaaacagaaatcccgcacaagtcatttatatcagtgggcatgctctggaatcatgcctgcagcctgaaaattgtgttgagatcaaaccttggaagcttgaaaatgatgacactcaactgcttgatcttattccctttcttgaatgtaagacttttaatcaatttctcttattatcctgtcatccagttattttttttttccatttttgtggttcttaggaatgcaagtgcattagccaactaacccctcatattatttcattcctgtggtttttgaagcatgcttgattgccccacttgcatccttggtatttctgtttttcattcttgtcaatctgtgcggcagatgttgctatggcaagaccttcggatatcagggctgttcttgcgtcctatcaaggccgtgatatacctgctgagtttattgagcgttcaaaggagcaccagaggtaagcagatgctttccataatcttcaaatagttgtagctgatgctaatcttctcaagtgaaagtaaatccatggattgcaccagaataagccacgccatcaaacaagtatgactcatcagatgcacaattgaaatgaaaaaagaccgttggatcgaagagagcaggagcagtcaaaaagcaaacattaccgttaaaactctggacccttccaacactcttgagaatgagaatagcaggaagagtacagaaagaactatatgtacccgtacccttttcaatttttgccgtatcctactccctccattccaaaatataagtcataaccacccttaacccaaaaaccaagaaaataattattatcatcttgtagtttggattatcctaataaatacaatgcatgcatccaatagaattagagaacatgagagtggaggatttaaaaaagtaataatttaatggagaaggggtcataattaattgcctacatgcatgcatttcttatactccctccattttttaatagataacgccgttgactttttctcacatgtttgaccattcgtcttattcaaaaaatttacgtaattataatttattttgttatgagttgttttatcactcatagtcctttaagtgtgatttatatcttatacatttgcataaaatttttgaataagacgaatggtcagggctgcaggaat

SEQ ID NO: 86377 - DNA, 4486 bp, Oryza sativa
aggggaggggaggggaggggaggggagtgaggagggacgcaggagaggagtgagggagaatgaggacttagaaaaaatcggccctaggtcagctctatttatattccaagtctactttcataggcggatcacataagaggtccgcctgcgaaaatggatttcgtaggcggacagcgagcttcatctcggtttgcatttttgtaggcggctatttggctctgagggtcatgtccgcctccaaaaatgaatacccaacgtcggcgaaaatgatttttatagtagtgtgggctagctggtctggatttgaagtctcaccccttttatttataatattaggtcattttctaacattcactttttttaatggatttgaggccacatttgaagttttcgagtccaccggccggctagccatgagggggagagagagagagagagagagagaatgagcgcgccatcggcagggagaggcagccctctaccctgatcttggacatcgaaactgttgagttgtgaccagcttctgccagagcgaagcggaggcccgtcgttatccttttaggatttcaccttcatatatacttcttgtaagccgtcgttcggtgttgtaaccttaccccgatagagtgaagatattttgctaactgatgctcatagttttttctctcctgctttggaaagattttccacgttaaatctcgggtcttctatgattgatctattattttttatcgtttatttgcctatcgctttctaacaggagccgccgcacactccctcgacacatcggtagccaatgctacggatgatgtgctcgcatagggcgcccctcgccgccgtaacatatgtcaatggcgtaaccaggagattttccttgggcagtactagttcacaaatgcacatcacatactacaattttctacaccgaaaatatgatatacaagtacaaaactagtgaaaatatgatattattataatgtcttaaaacatcataagtggcttacttaacaagctaaaatgacacattcactaatcaatatccctgctcctcttcatgttttaccaatcctgcaaactgcaatgacacatttacttaacaaactgctctgcgctgatcttggacgtcgaagccgccgcacgcgcactcgacgcatcggtagccggcactgctgatgatgcactcggacagggcgcccctcgccgccatgctatctaaattcgggggcgtaacctggagatttgttgggtaacatgtggtgcacactcacatgttatactgaagtgacctacaggtacaatattatcttccaaaacaaagtgagtgaaagaggtgttgaaatataataataatgtcttataacatcgataagtggcttacttaacaagctaaaatccctgctcctcttcatgctttaccaatcctacaaactacaatgacacattcactaaacaataatcacaacttacaaattgtatattcagttattcacttattcacagactcacaaatcagaaatctatttttgaagccattacctacagagacataactactgagctagtcagccaaaggaaggggagtagaggcagttgttcactacctgcaggggaaggcgccgttccgttccgccggaattgaagcaaaggctgcatggctgcgggcaagcggccgaggcgccgagcgctgcagcgggagcgggaggctgtggtcgcttggctggccaagagcaccagagcggagatggctgtggaatgtcctgcagaaggcgccacgaggacggtgggtggtgtatccacggcggcacggcgcacgggtggcggtggtgcgacttgacacacgggtgtcgcctcgtcggcgactcggcaaccgcgcgtggtacgggcatcgggcgaagttgaagggaggaagacagggagtagcgttgtaacggctcgtccacccaggattgctaatccgcgcaaacgcgccagattagtacatcgcgagcgtttcctagttcgtagcttctcacactcttttttttttcgtttttccgccttttcggtttctttcaattctatatttatttgtaaagaggtgtgtgaatgattaaaaaaaataaaaaagaaacgaagaaaacacgcctaagatcagagaaaaaagtgcgaatacgcaaaaaaagaaaaggaccggcggaaggggatagctgatcgctggcgcgtatgcgcgcattagccatcccctcgtcctccactctcaacgtttttcttttttttaagggagggggggggggggagggggaggccccacctaaattggattaaaagaagtaagagaattacagaggaactatacaaagacgaggccaaaataaaagggaaaaactaaaagctacaaaagagataaagaacagcaactagagaagagcaagagaagcattaaacagcgatagccagagcgggaggagtgctttaagcggatgtttaaagcgatgtgcccagagctgagcatcctgaatacaacttctattgagccgagaaatggaggggggctggttctgaaagacaactttgtttcgatgattccacaggcgtcatcaacagagaatgaagaaggtattactctgaagagccgaaatgctgtccatcagggtgttggagtgaagcaaattcatagatgttataagggtgctacttgaatcatatcccagaaagctgaggccaggggacagttgaggaaaaggtgatcagtgtcttccgggcagctcttgcagagttcacagctcaacgtttttcttgggtttgggttgctaattttagtttggtctattggatttggttatttgggcctaattttttgaggtgtaggggatttcttggtcaaaattggggtagtcccgagcccacaaggactaccccagctacgtccttatgatgcttcgttaggtcgattgaacctaagctaccggagtatttctttttaccctatctctccctctgttatcctctgcgcgtctccatgacaccggcgatgtatgagagacgatgaagtcgatcctcacacaaaaacactaatacagtagcacacaacaatgtgaaaatttctgaaatttcaaacaatattggaccctgttccggccctctcctgtcggtctacacagtagcgctgcacagtgtacacgcggtcctggctcgcctgtgcatatgcggtcgggaagaaggtattgatcgtacgtacgtgtgcgagacggcgattgccgctgacccctctttttttatgtttagaactcattgagtaacctcgagtcgtcgctgaatgtttctgtatgcatgtaagctagcacaaggagcaagtagcaatacagtgagtgcacctatatactatgggccgcttcaattcgatcagtgcgtagagggaattaaaactgcctacatatcaggctcgatctcaaaattgacttacttgtaaattacactattagcgccagctgtttcatacatagttcgcgacgtggaaaaattcaacacatcttaaaagttaaaaccaatttcgatcagaacgaaaaaccgtaagctactaatagtacattgttcagaaatcagagttgacatatgaaccctttttaagtgcacgaggaaccctgtgaatgaagcacatatatcaaagctagcacaaacgtcaaatcatcaatagcttatcatggcagcagcgtccggcaatcagctgaccgagagccggacgcacttcgcccatccacagcacccgcttctcaagacacagtacggcggcggcgagcggcagccgagcagccgccacgtctgccgcatctgcgggactcgcgtcgtcgccggcgccggctaccgctgcgaccactgcgacttcgacatccacgaggcctgcgccgacttcttcccggagaaaatgataactccacctcccaacttcttcgggcatccgtggtcgcacaacctcgcgctcagacaggtcacggcggcggatggatcgtggccgtgcaccctgtgccgggggcccttccagcacggccacctcgcctaccgctgcggcgcgcggaggtgcgggttcgccgcgcacccgctgtgcacgatgctgccgggagagatccgcagcccgctccaccggaagcacgcgctcacccacaccgagctcatgctcatcccgtccggcccgtgcacacccgccgagatggcccgggtctgctccgtctgccgccgagactgctccaccgtgcgcacgcggcactaccgctgcgccgcctagctgcatgttcgtgctccacatcggcggctgcgtttccggcgtcccgccgccgccggcgccggccggcgaggaccagggtagcagtggtcctgacggcgcgaggggttcgtgcggcggagctgctgctgctccagcccccgccgtcgcgaggtttctcgtcgtggtcggagcagcagctggcggcggatttcccggctgccaatggcatggtggcggtcattaacgccc

SEQ ID NO: 86378 - DNA, 913 bp, Oryza sativa
aaacgatttggcagaaaattccagcagcattcataacaccaacatgctccaatatataccagccattccaagcctaccaaaaaatatcatagatagtactctgaaactctggaagcaagtgtagtacttcagaaaaggaagatcaaggcgttaaaatgtaagcttgcaaggctgcaactaaatacagctaaaagcttgttacatacagtcagaaacccaaggcattttcaacataacaggtacttaagctactaaagtacatcttatctagtagattttaacaatacaatgatgcatcagtttatgttcccccagatagcttgccctgctgtcactttgttgctcggccttgcagtcagctcatatagaatccttgcaaatgtgtcggagtatttcccttccgacgtgagtatctcagcaaaagtattctcatggacaaggagatgcatcctgttttgaggctcagagactaggctctccactatcattgatgctttcctacaaacttcaggcacgggatgtggcgtcttcacgaccttaaggagtctatcgacagccctggttcaaataatacgaaatttaagagtttgaatttaagttctcatgtcagtgtgctatatctaatagaatgaaggagatattaccatcgctcgctagcaagcttcagctggaagtacatattcaattatgctacattgtacagagcactaatagcagctgcctgtgcatcgagtgttggcacactcaagaggtcaactagtatcttgtatatctgtatgaaatttagcaatgtaaagtacagaattttatcacccacaaccgaatagctttattcggcccatctccatagcatatcaacaaaattgaaacaatatgctagaagtcaaaaatgatttacctgtggaatggctgg

SEQ ID NO: 86379 - DNA, 5375 bp, Oryza sativa
gtggcatgcgaggttgggatgaagcattcctcttcttccgaccaggttgacagtcaccaaggattagtatagctacaaagagtcattgttagcctggtgtgatatggaggttaatttattggtaggattttgttgtgctaaaactttgaatagagatgtgttaatgcggaccaaaaaaacatgtaagagagcttcacactcaatatataatcttgttttgatcttaatttcttttggagtaaattgcatcgccgatacacgaatttgttaaatgggtgcaatcttgtacacgaacttgtaaaatactcgttttggtgcatgaacttgtctaatgcgtgcagaggaaggcaaaaaggaaacaacatggctaatcttattgatttaggggctcatcaggataactatgtaaacatatatctgagaaggttgctattagataaacacctcttcaataaaaatagaatgggatatagtgatggtagaaaatgataaaaaaaaaccgagcaatgatataagagttagaaatatatgaaattcatcacttccatgatgatggataaagtacatatcaaatttataaatattacatgtcttatacatagtcatatgcacgtcacatcctaatcaacatcagctttataaaattaacattgctttctaaaaaaaattatcaacgttgctttgtaaatttatcaacatcaatgataatataacatgtgacatttttgaaaaaaaaaattgggaactaaacaaaaggatgcatggaggattaaattaacatcccaaaaacgtcacatcgaatttttgggcacatgcatagagcattaaatatatataaaataaaaaactaattgcatagtttatatgaaattcgcgagacgaatcttttgagtctaattagtccatgattagccataagtgctacagtaacccacatgtgcttatgaaggattaattaggcttaataaattcgtcttgtggtttctaggcgagttatgaaactagttttttcattcgtgtctgaaaagctcttccaacatccagtcaaacgttcaatgtgacacctaattttttttttcgtgaactaaaccaggccggagtatgtatggaagacatcggaagcagtgctgtttttagtgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgcgaagcgcttcccaaaaaccttattgccgccttctcccggtgcaggatgtcaaaggcagaggttccggagacctgctctcccgatcgctggtgcacgccggcgagcgggatggagtagtctacgagcgacggcgcagtacagagtaggaggcaaaccctagattgattttgcgtatatactgcgtgaagacggcgggtcggtttatatagagaagggtcgcttgatcagggcgcccgcacgatctctattgcgcgtaaccgaaccggataagtcgcgcgtaacttatccggactccacgccatttgcacgcaccggatttttcggaacgtttccaaaacaaaaacgaatccgaatttgcagcaaaacaaaactgcaaaaagaggctgcatctgcgcaagggtgaggagccaatttttcggaccattcgacgcgtacgtcgtgcacgcgcgccgcctgccaggcgaggcgagcgagcgcgcgcgtgtttcccctcttctctccaccacacatgcttcaagtggctaggaggacatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacatttagcccatgaacttttgcatattacttctgttttcaaatattcacatgcatatttcaaaatcattatacattgatgttatttgtttacttatcgtgcttaattatgtgtgcgtgatgtgaatagtgcttggtaatgtaaaattgaagcatgtcagtcacaactcacaagaaaagaagcacgaagcgtaagtaaaatttgtgcatgggcatctacattgaaatccaactgcacactttggctggacctttcagcacctacaagaggaggacctagtaaaggttgtgtatttaaaatgtgacatttttttatagccaaataggtttttgacaagtgtaatattatatagtattgatggtacaatacatgacatatgtattatgtgttgaataagacctctttttcagttttgtactccctccttccctaaatgtttgacaccgttgacttttttaaacatgtttgaccatttgttttattcaaaaacttttgtgatatgtgtaaaactatatgtatacataaaagtatatttaacaataaatcaaatgatagaaaagaattaacaattacttaatttttttgaataagacaaacggtcaaacatttttaaaaaaatcaacggcgtcaaacattttgggatggaggtagtatatgcgtacgcatcatatactatttcgatctacctattctttttataaaaaaaatgttagatattcatcggaataattgtgctaagcacttgccagcttattccctgctcgcacattcggccgaaatgtttcaacagcagccatgctaaatttctgattaaccgcttccatactctgataaaaatggtaaacccgttaattgcaacactaggctatgcctgtacgacgtcaaaccggcaccaaaatcgtcactcagatgaactaagcgctgagattcagctacatggatacgtgaactagcaagaacagagcaaactacatctgagctgtacaaatcaatgccctgaaataagcaggtggcaatatatacagatcaaccataatatgcgactaggtaagcaatagtaataagaaatgattttataatttatttaattagtcagctcctagatcagcttgctagcacacaacttagtcaatgcctagctagcattggctcttttcagcaggtaagagaatttagtgcttcatcaatctcaaaatataactataatatagtactatgttaaaaattaagtattgggatgaaagaaccaaagtacacctcattaatccatggtgaggtgatggcgatcaaagatagtatgtgggaggtgtggattttgagggctaataggggtgatagggctcatggtggcatgagaggagtaatgtggtaaaagtcaccttatatgtacctatattcaagataaactttgaatttcaaggtagttatattttgggatggatggtttaagagactgagtattctttcctactaagaataatgtagatgtttcaacagctttgtctaggcttttcatctttggaccccccatattttggcttatctatggcacctcaattatagatttccatagtttgtcgtggatgagcaaagcttaggagatgattcttcatttaactaggtaagaccccgcgcgttgctgcgggagtttagtataataataataagtaaaaataatatgtaagatagctagacaacataagattatataagttaacgtggtttatgatatttaaatttacaaaatatatacaatgatgattcaaacgtaaaagtaaggtgatatgactttatgaaagaagaaagtattgagatggtttggaccgtagattaatcatcttaaggctaaaaataattgagatggtatggattaataagagaagaaaataagagagataatttagaccatagattaattgtttgagcactaaaaacaattgatgtgatatggcttaatgagagaagataaaaataatattaactaagtgaggacgaactatataggtacatagcatattataaaaaataataaagatatatattgaaatattatgtgaattaggtgggatgatgatttaacatgcttgcatttttaaagctctaaaatttaataaattataaaattatagataatatagcatgtttgtattatgtttaaatttaatgattgttagtgaaagatgatgtagtatctttcaatgttaagctttaggagttaatgagttataactttatagtaagataggatttgatggtaagatcgatacggggaaccttaccaactttgcctacctcctgtttatactacgcggtcacatcacatgtggtaacatgtggtaatggtatctgcacaaatcttaccaagtgaaaagacaatctgatcatgaaagctggaagagccacagcatgtggtacataatgggcatctgattgaaaagcaaacaaaattaatgaaatggatcacaaccgcacgatcaaggatatgtggaaggaaccagaagctgatcaatgaaaatgtttgcataaaacccatatattctcacatatctacaataaacaactttcatagtttgatttctcagtacatttcattattgtctcccccatcatcatttgtgattgaaccatgtaattatgcaattaagaagaaaactcgcacaagtctattttcaagacaaaattctacgctatatcttaaaacaagtttaaatttaatttatagctttatttatcccattaagttttagcatacataactattatatatatgacacgttataacgtttcacgtaaagagctaggtaatagtcacaattatttttgtaacttattccgaaatgtatgtaagacaaatatgtttcttaaaacatataacttattttcaaacttattatcagtagcacactttaggatggttaaagtcgcgtgaatgtgcaacttcataagctagtagtgttggatttaatatgtaagtagagggggccttggccccctcaaaatttacatctcacgtataccagaattcacttgactttataatttaatatatacgagttataaatttatcctgtaagttagtataaatataatatatatgcatgccaccggtaaaaatttattgtgctttcacccctatgcacacatccaaccaagcatcatgatgaatgtggtcaatgcattcttgatttcttgtctagggatggaactgctcttcttgtagttgaccagaattgttagtgctttctaggtggatttttgccgccgacaacaactcgtagaagttggggaccccctccaataagagaacat

SEQ ID NO: 86380 - DNA, 1129 bp, Oryza sativa
tgttacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagcttctacatttaattaacaagagaactattgtatttatctaacacctggattatctccacctttcatttgatccctatttatagattacgttgcgttgctaacgggccgcacctcctatttcctcaagggtgaggaaatgaagtccatgtacaccacctacaatccgcagaatgtggtggccaccgcccgtttcttgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaatacg

SEQ ID NO: 86381 - DNA, 3795 bp, Oryza sativa
ggggggggttgcagaggctaggcacgacggcggcgacggcggaggataacggaggggaagggggaggggacgccggggcggcggcgaggcggcggtgggatctgcccgagaaggcggccgacagcacgtaatgacgatggctttgatctagttttggcctttgattttttatttttttggggggcgaggttttcggggggctaatggtgtgttggtgtgtggtttcctggggttgtcggtggatctgagtggctccgtggtcgattccggtggagttctaggggaaattttctcgagtttttggtgggatttttttttttggattggtgggggggggggggggggtgactagggtttcgcatgcggggagtggaggcgttggcttttgaatggttcggaatggtttgcttagctcaatgtctgtgttccattgttattgccgcaaaatggtcactgttctaatcgcattcccggttgcgtcaatggcattgagggcgggttgatagttccgctgctgcaaggagttgagggcgcgttcgtgcggatctttaaataattcgagcgaattgggctctggcttgccatttcatcagttggtttttgcgaaaggatatcaaattggcatatgctgtagtcgcgctggatttttttttctttgaatgcttctgctggacgtggcgttgaacttgtcgagggggaattatattctcgcgtgacgtgttgcaaagcatttttaaaagtgttgccatttctaagctatttgtttggataaatttgtgattttgtcttagtggccaaggtgttaggactgcgccacttcaattttatattgcaagggatgttgtgggcttaatgattcaaacttaactaattcttttggctagtggtatttataatcagaaactatttctcaggattgtggaatcgattttgattcttcaaaatatagttttgcaaatttttacatgaatttaagtagaatttatgtgagtaatttggagttctggctatgatggcacttgcttaaattactacaagtatttacttgttgatataacgtgaacaaaaaataagtatggtgcactgattattctagaacaatgtagtacaattggagtttgaaatgattaagagacatcaccaaatgtactgataataccttcaagttgacactacagctcttggttaaaacttacaaataaatgcatatcattgcgatatttgttgttttagaaagcttcgacagccccccctcctttttttttgtgatggctctacatgcacacacctgtttcgttaacattttagcatatgtggaattcttctgcttgtctttagtcatagttgcttgcatgtcattgataattcatatgattgggtagttatcctttttttattttaagatagtgcaatataaaatactacattagctcactgtttgtctctttaataagtaataactctgttgtttttgctgatctattgtgaggggcttcaaggctccagctatgcagtcatgcatgtatttataccttttatttatttttgcagtccaagcggcaaaggggttgtagaaatgtccacggatgatgaatcagattgtgtggttatatgtcccccaaatgggaaagctggtcatacagaagttatgagtggcaggcatgatgaagattcttcaagagggcaagaaaccccttctactatagactcacatatgaatgggaatgtccaggatggagtgcctgcagatcaagatgtgctgaagctggttgatcagcagaagtcttctcttcccagttcaccaataaaccatggtatagctgaacaggaagagtcaaaccacactgttcctcagccatttgctcctgcaactgaaagggaggattctggagaaggagattgtactccagtgcctcatcccaccagcaacggtgaaaaactctctgataaaagtagcacctcgctggcaagtatggcgaagaaggtctgacatactctatttcacattgtatcatatatgttttatctgctttgttgttgcacaatcgcctgaatactatttaattttggaataaatgtcatgatgcatcattttgttggtattatctcagtaaatttctgtattcttttagctttaaccttcaggtatgggtcatctatcacttgaaatggtgcaacatatgctttgatttggcaattgggatgatatttggaagatcctacacagttatctaaataagccacaatttgttgcatcaacctgaaccccctatgtacacaagaaaatttttattagtttcttttctgtttacttgagtatgcctgtgactgcagttctgtttggctggcataaactgtagtaagctctcttgagatgaaataagccagttctattgacaatattttccatggttatggattgcagagtccatcagtgacacccaggaagcctctgcaagctgacagtacttcccatagtcacgaagatgattcatattcggttacttcgtatcctttcagatattgacttgatttctcatgtgtgccttattcttcgcagccacacctacactattcataatagctacaattgggatatagctacatgctttgaacattttgttccttgaattactaaaacacagaaaatttgtctaactttttctttaatgtcttcaactcttcataactggtggaaaactagaaatatatcatgttctctttatttctattgggctttcctgagcttcattcatccagaactgtaacttcagcaaggactggaaaaattaagaagacaacagttcctgtcgcacctacttttatatgtggtaatcgtcttgagaagaggggagaggtacgtatttaatttcatcatactgtagagaaatggctttgtaagttaaaggggacagcattgtaataattattctagtaccgttcagttttacacaaaattggaagaaaaacgcaaggccttggaagaggagaaactagaagctgaggcaagaaaaaaggtaggttttgtttcttttgtcatttgattcttttagagccattgtgatagtggcatacagagcaacacaattattcatgctcggtttttcctatataatgtaaatctgtaaagtagcctttctgatgtcatgtctgaattgtgttttgcttcagacattttttacctcctcatgaatcatgtcttatcttttgaaattttgttatttgaaattcaaaaatctacagttcaaatgtttaattcacaccattctatctagtttcacttttatgtaaatggaatctcaaagcgtttttcggactttgcaaaaaagatgaaataactggaattgctttcagtagaccatcccaatttggtagtctagtaaatgatccccaagaccccaactatcatggctttcaatcaccgttaacgttgaacttgagaaccctgccagatgacacaacaaaacatgctgaaaattctagtctcccattgtgatatggagctgtttagtagttcaattgtttctgcttttttaaatagaataaagtacatgggcggtccttaaacttgtatgggtgtgtcatctaggtccctaaagtctcaaaatgcagatccaggtcctagaacttattaaagtgtcaaataggtcccaaatcaccacagcccctctaggatcgtacgtaccgctgatgtggcatgccacacggatatgacatggcataatcttaactgagaaatgggactcacttaaaaaattttctttttttcttcttttcttttctttttctttttct

SEQ ID NO: 86382 - DNA, 10311 bp, Oryza sativa
ttgatgatggtgctcattggtaggcaaaggagactggcgaggaactctacgacatcattaccggcctcggcagagcagactttctgagccttggtatcaatcaagagtttgatcgataatgtcttcatagccatgatttttcccctttaccaaaattctttaaatttattggtagttgattgattgcctctacaatcaccagtgaaagaaaattacacaggcttttaattgattataggtccaaatgttcagttatgagtagcacaatggcacatagtggaaaattatacaggcaattgaattgtccagggaaatttaaggaaggcaaagcaaaagcatgttccagatatatgatcgaaagaaacatctagattggttgacagctgctcaaagtagcaaaagtgatctcctatgtatatacaaaaaatacaacttctcctgtagactaagttaaacaatctatgcatataacacaatttccaaataagtaatagcacagcagtatgttaatcttctccaaatggtaatatggaaaaatggattcagaccaagtaatctggttttctgaatatctcatttggcaaggcatgggaaaaaaacaaaacctagaaaacacaatcttataaatgttcttccagacaaaatcataggttgtagttttgtacaagcagttaagcgctacagacatgcaagtatatgcatgttatgtcaacttgtgaagtgtaagccttcaacagcagcctaatcttactttttttttctgcaattaaatttactattcctaattaaatcaatcactcctttgtattttaggatagaattccgggctattttaggatagaattgactcacaatggatccgtggtccctaaaagtattgaaaacataggttgatgggtatatatatttattctgaaccatatagaaaaagattttacgggtgtgtttactccatactaaaattggaagtttgtttgaaattagaacgatgtgacggaaaagttggaagtttgtgagtgtaggaaagttttgatgtgatggaaaagttagaagtttgaagaaaaagtttggaactaaacaagggccatttcgtttgactcactagatgtctggtctgctaccgatggggcatccgtatttgaataaactgtggaaaatcacacaccatgctccaacataatccaatactctccaatatagaaaacgcaagtcggtttcttctttataattatcatccttacaacctctctccccaaaacccccgtacccaaaccctcactcccaaaaaaccccaaacgctcacaacctgtggttcatggcgatcatgtcaaaaattcaaggagaaatgaaccgggagaaaaaaaaaggagagaaatcaacaacgacgatgatcccttaacaagacgaaatgggacgaaatcaggtggggcggattcatcgcgcgtgaggagaaccagaaataaaataaactacagacgagagagagcaatctgcaagttaagagttgaatgtatagcacgatgggtggaattgtggaaagggagtcgctcacgatggatcgcctccgccgccgccgccgctgccgcagccgccggcctgagaggaggagggaggcgagtggcgatgaagagtcgaagacgacgagcagaccacgacctgtaaagcgggacccccctttcggcccatttacagataccggcccatgttatcggaggagctgcacgttgacaggctgtgttcggccgtggctgttcccatcctctgctacacgatttcctcgcgcacgcttttcaaactactaaacggttcgttttttacaaaaagtttctatacgaaaattgcttaaaaagatcatattaatctatttttaagaaaaaaaattagctaatacttaattaatcatgcgctaaacattgctccgttttgcgtgctagagagtagcgttggtaaccctcactccccaacgcagccacggtcggtaaacgaagcgaaccgacgtgcacgatgtcagtcggaagttgaataaggttattaaaaaagttgattgaattaaatgaaaaaagattgtgatcgctttcgtcgagaggaaagattgttattgatcgggacaaaaatgtatgcgatagatattgttatattttaaaataaatttcatacaccgaaagttgttatattttgagacggaaatattaactcatgatgacgacgggggctaagcctctactattggcgtgagaaccatgagagggctaagcctccactatcggcatgagaatcatgagaggccctacgaggtcttactaaaattttttgttctatctagataggaagtgtttactttgttcagacctcctgttatttctttttaaatccgtcattgtgaaaatctcgctgcatctcaaccttcatccttggtggtgcttctaccctcgaatgcaatcaatcctttaaaaaaaatgaagtcatacctgttacatttacctctagaaggcaagcagaaacatatttatagcgagacgcaaattgacagtaagatttcactggctgggttgtaacatttctattaaaaaaaaactattccaagtgtatttaagactaatctaaaaatgagcaatacaaagtgatgctttccctttaagacaaatggaaacctactccatgctcacaatgaaggtctgtaacttgtacggaactttccaatttctcagatgcgatgcctggtaaaactgctcatgtatcatacatgtatcatactaactaagtagcagcctccctcttgcaactaacttttttcttcaggagaaatacatcagtcagcacggtcttagtcctcagggatgcaaggagtatctccagtgcctacattgtaacacagaaaatcatcaaccacaccaattaagaaaaacgactacgactgttctcttcactcaaagtgattctgatagatatgtacaaacctcttccttgccaatcttcacggtcctttcctgcagcgtgctcaagtccttgacaccgcattgtgcaagcaagctgatggttgacacgctggatgctggaacaattgagagatcatccttgacagtgtacctggctgtcccaaccacaaacccagtggctttgacatgtgccattgccttctccattgcgtagccgcacttagggcaaatgctgcctttcataaccgtaaaatatccacaagcaacacgaatgccgtggtaatggttcaatttcccttcacatgtgaagaagctggtatcggtgtctagctgtgcatctatcagctgctgcaaaggacagagcgctccaggggcaaccattggcttaaggtaaggctccttgctttcgtttgagattacatgatcggcgtccagcttctccacgctgtcaaacacatttgcaatgcttccaaccatatgttccttggtaagcaggttgatgatattgcttacagggagacaaaggaggctggagaggaactcgacgaagtcactgccagcttcggcaaagcagactttgtgagctttggtatcaatcacgagcttgatcgacaattcagcggcagccatgatcctttttattcgaagttctttaaatttcttgggagttgattgattgcttctgcaatcaccagcaaaagaaaattaaatgggttttcaattaactacagttatcgtccaaatgttcagagaaagcgttataatttaaagcagataaagcaaaaacatgttccagattgtattccattgaaagtttgaaacatctagattatattggttgatagctgctctaaagtaaggggaaaaaatgacctcctacatacaaattctcctgcggagtaaggtaacaattcatgcatatataacataatttccaaatttcatataagtattaataatagagcagtttgttaatattttccaaatagtgatatggaaaaatgggttcaacttgctttcgtctaaatgggatgccatgcaatccttttacacgttcgcgaaagaaaaatgaattcagtgcagtagtctgcttttctgaacatgtcatttggaaaagcaggaaaaacggataaaccacaatcttataaatgttcttacaggcaaactcataggttgcaggcttgcagcgttgcataagcaggtaaggacatacaaagattagtggaacatagtgttagacacaaactaaaaataccaaagatcaggcttatattactttttatttcttccattcaaattgggtagtcctttatattttgggctagaattcacagttggatcatgctaggaaactccattatactagaatattcaactacaaataatcatttcgtttgcattgctagatctccggtctgctatcaatacgggacatccgtagttgtttgaataaactgtggaaaatcacacgccatatcgtcttcgagaaacaaatcacacgcgatactcaaaaagttatgaaaatcaatgaggcatccatagttgtgtgaataaattgtggacaatcacgcaccatactccaatagtctccaatatggaaaatgtgaaaaaaaaatctgtatttactcatacaacctccctcccccaaaacccacatactcaaaaccctccgtccccaaaacctccaagcgcttgcaaggctgacgataaaaatatatatattaggagaaaaaccaaccgaaaataaggtggagaaacaaccaccacgaggatccctaaactagacgaaataatcaggtagggcagattcatcgcgcgtaaggaaaacaaaaatagagagcaatctgtaaggtgagaggagaatgtacagcacggaggacggtgaggaactcgctcacacaatggattgcccttgatgcccgccgcaggcctgcccgccgcagccgccggcctgcgacgacggcgaggaggaggagggaatcgacggcgaggacgatgagcacgagcagtaggtttgcttcctttatagcctgtagtaaatcggaccactcctctcggcccatttacataacggcccaccacgaatgcccacgttatcggagggaaaaagtctattttgactcttcctcattgaattgtctttctaaaccacacaaccggaaataacatctccggcatcttcaaagccaataacatctcccgcaccttaaaaaccaatgcaaataaacgcttttgatggtttgaaaaaaatatttctattgacgtactatcttcttcgataataaaaatcgctttgactttttcttcgacgtttaatcatttgttttatttgaaaaattagtataaatataaaaatagataattcaattaaagcacttttaataataaagtaagtcacaaacaaaataaataatagagtgaataacgaatgatcaaacattttcgttacaaacagaaacttaaagcgagtaatatgagatggaggaggggtttcattttgcgtgccggggaggagacccctcctcccgaacacagccatagtaccaactagaggatgccccgcgtgttgctgcgagacttggttaacatcaaattgttagatatgaggtacaatctcaaaaagaaacagaagaaacaaatagctttcttgaataaattctttttagcagctctatccaaaatttgtagataatttaggtagcacatgtcaactgaaggggcattcagtcataaagctcttttatacagattgacgggctagatacatatagatgtgtgtggagatgggccaatgtgttcatgtgggttacatttggcactgaagaggcgaagagactcacccggtgactaatgggttgagctctatgctacattctatccaacatctgagaagcgatctaatgcatttatccaacggttcactatttgatgatgatgtagaagcatgtggtttgagtttttggccttaactttatattatagaaagaagggatatggatggaggtaggacccatgcatcatcgacttttctcgtcccatcgtctgctttctagtctcctctcgtttctctctctctccccctcttccggcggttcgtgacttcgtgcgccggtccatgtcacggccgggaaacgaagcgacgtgcacggtgtcattcgcattgatgtgcctgcatcgtacagctccactataaaaaaagaccatttaaatttcgaggttgcttcaaatctcgctgcaatccaaaccttctccattctagtttggtgcttctgatctctcgtacgcaagagtgtgtgaccgtgagatggccggaaaaacatctaaagctgccactctaaccatgaagctgctcgtcgacaccaaggcgcagcgcgtgctgtacgcggagggcagcaaggacgtcgtcgacttcctcctctccctcctcgctgtcccgctcgccggggtcaccaagctgctcactgccggcgacatggtcggctccgtcggcaacctctacggcagcgtcgttgacaagctcggcgccgactacgcctgccgcggcgacgtcaaggccgcgctgctcgcgcccacggccgccctccggttgggctcgccggcggacgccgacaacggcggcggcgccctttaccggtgcagcggctgcgcctgctcgagaagctgctacaacttcgtgaccaaggtgaacggcacgccgtgtccggtgtgcaagaggaagatggcgaccgaggtgagtcttgttgagccggacgatgtctccggcgccggcgccaaggtcgtgacgtcgccggcggcgccgtctggcgaggcaagctctagcaaggctggttacgcgccgggcaaggtgacgtacacggtgatggatgacctcaccgtcgcgccgtcgtccaccgtctccgccgtcgccgccctcgtggcgcttggcgtgacggacatcaggggactgcaggagaagaccgtcgaggtcggctacgacgaggtgacttgattagatatccacacttgaaattattttctcatgtacagtttggcttaatttgttttaaaccttgagctttcgattaacaatattgaatgtgtttttatacgtatagggtttggctgtgctgaaggcttcgttgcagtcaaagacagtgctcactgatgtcttcctcggtgcgaggcggactgctcaccgacgtcatcctatgctggtttgaggccaagatgatcagattacagagcaaacaagtagccaacgttgtagtaccttgttgtccatgaaggcatgaagtcattttggccatatggtcacgctaattttgtggagcacctgtattcgtcttaaaaaaaatgtagtttaccccttttcctagtataatcatcatctaacaaagtactaatcaaaattattttttattggtttcaagccatgcaacagtgaattattttttgttggactgaatcaacggagcattgttttgttgtccttgttcttggtgtggatcattaaattaggatggagccatagtgggagggatttcagcatgaagtttctgtttaaagtaggaattttggtgcatggattaacaaatgtgttaaaatttgtgacatgcacatactatttcgaggggatatcccctcatgtcgtgtatgttatctaatgtcacaccctgaaaatcattaatatataaattgttgtttaattggaattattagaatttatttttaaaagcctagaagagaagatctaattttttttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggtttttaaaagtctcttttggctttgggccgaaagtcggcccaaaaccgttctctctctcctcggcccagtccggcccagtccgcagccgcgccctcgctgtcgctgacaggtgggtcccgcctgtcaggtcgtcgtcttcgtcgcgccgcagccgtccgaaaccctagcgccgcgccgccgtcgtttccttccaaatccggccgcttctttccttctccggccgaattgatagaggggaaatgatcctcgggatctcctccgccttttctcctttggaaacatcggctaaatcggtttggaaatcgttggattcgagatcgaatcggtttcgtctctctcctccgaaccctaaaccttccttcacgttgccgccgtcgacccgaagaccgccgccgcttcaacctcgccgccggtgccgtccgttcctcttccgccgtcgctttggtcgccggtgagttcgccgtgccgtccgctacccgttggtgccctccgtttgtgccctagcgccgccgttcgccggtgagcttgcgccgtccgagctgtcgagccgccgagccgccgccgccggtggtgacgtcattgccgacgtcatcgtccccgtctcccgtgagccggtcgtggaccgatcgatctcggccgtccgttttggatggatcgatctcggccgtccgttcgcgtgaaccgccgccgtgcgcccggtcaaccgcaaaccctagccgctgacgcaataaatctatttttccttttcaaaaataattcattattgcgtcataattcaattaaaatcaatataagtgttttaatccgattaaatcttcaaaaattcataactaattcatcttagctcggatttagttggttcaagtctctaaatttttctaaaattgagatctacatgataaaaatatccacatgtactgttcatgcttgtttatgtgctgttttggtgattttgcttctttctgtttagattccgtcgtttccggagagtccgttttcgcaggagaagagtttgaagagttccaaggccagcaaggcaagtcacacagatcctaaacacaaccctttgagcatgttgaatctgtttaaagctattgatttatttcaacttatgcattgttttcgaatgtcattgggtggtgagcctttcccatttaattatggccgaagatgactttattttcctatgggttataatttgactagcatggaccttatatattggattggttcagctagatgttatttatagttgcttagccatgcttagaaacattagcacacttttgggataacttatgactcactattatttaatgatggcataatgatagttcacgatggtcaatcgtgattaggttaattaattacttaccaactaaaacttgataatggtgggttgtgagcacatggttttgagagtcgtgctcatgacaattaaggaccggttcacgagtttcggttgtgaaacattaaccatgccaaccacaagccagcgtgggcaacggctttatcttttgtatagcatggttcattgcggagcaccagactgagaagtggcggagataagcccacgggggtcgctggggagtccatgtcttgtttataagggggtgattatgatccaggaaaggtgtgccgtaatggattgtgttgtgcaaggggtattgtcacaactcctttccgaggtactgtggtggtattgaggcacatggtgacatgatgtggggttgtgtcttgtgggtatagtggtacacctctgatcagagtaaaactattcgaatagccgtgcccgcggttatgggcgggtctaacaatgtctttcgtgattagtctcacccttctcatcataataaaaggtgctctaactggtaataatttgattagcttctggtttggaatggtatattcctggtttggagatagaactgtgcagccgggatggttgttcagaatggttgagcctatacaacagggtatgttatatagcgttggattaatattgacggagctcgtggctcctcaccgggagaccgcgcaggcccccctttgccagttcggccgggggcttagggtgagatctcaagctctcgctgtgtgtggaaagatcgcgtgccaggaagaaacacgagacacggcgatgtatacaggttcgggccgctgggaagcgtaataccctactcctgtgtttttgtggattggtgtatgaatgagctaccaagtgtcagccaacttctcccccgttctaagctctaaatctggaaaagaatcaaccaacccccttctctatgggcaaggtcctccttttatacttcaaggggataccacatgcaccctcctccttccaaactggacttttcttctctttatggacggagattggtattgttgctgttcgaatgacacttcgatgggacagcccccacctaccttcacttccgggggaagacgggcacaacgtgggatcgtggctgcc

SEQ ID NO: 86383 - DNA, 3881 bp, Oryza sativa
aatttagatttatcttgtgagaattatctcatggttagtttctaaatagcatacgggattattgtctactataatcaactaaaatatagtgattgctttggtgagttataaacactaaagtagatagtaattgcttagatatagtgttcagacagttgttatccagtaattgctgcgtatcccacagtatgtttgaggtgggtgtagaggtggtgacagccctcgagatcacttaagtcctctctgtccgggtacgtagtagagcgacatctaggaacaacgggttgccagtgcctgaagtattgcatctaggaacagcgggttgctagtgcctgaagtattgcgttaggattaaaattaagttttccctggttggtgtccttggatgaactggaggaagatctgaccacacacgttcccttggattcgatacccttagaatactccgtatggagaagtgctacatcggtatatccgtgcgcttgcggaaacacttcgcgtgcacgcgcggcgggcgcggacggcagcggggcccgtgcggctcaacggcgggcgcacgcgacgacgacgacgagacggcaccaccggctccgcttgcacgcgctacgggtgcggatggcggcggggcccgtggctcagcagcgggcacgcgcgacgacgacgacgatgaggcggcgccgccggctcctcggcacgcatggcggggccccacgcggctctcggtggcgggcttgatgatgacgaggcggcgccgccgactccgcgtgcacgcgctagatctcaagcatctcctactctctttcttctccatggctgctacgacagcaaagtggtgtggttgtgatgttgaactactggttccagtctcttgatgatttctctcaagcttgagttgaatccccagccaaaccactggtggtggctgctattgctaatgttctggtagttgaagctgttgcgctactaatttctccatgccgatatagccagtgcttgagttcttgctctctcctttctttgatgtcactctctctctctctctgcgcgcgccgccggctccgcgtgcacgcgcggcagcggctgattttcctacggatggtttctatggctgtaactactaactagtactactgcagttgctgcttgtttcggtttctacgaccaaaatacggcggcgggcgccacgacgacgacgacgatgaggtggcgccgccggctccgcatgcacgtgcgccggccggctgttgctggtcgcggcggcgcccgcggcgatttttgcttttttttatttttgtttttttccgtgcggacggtataatttgactgcacggggtaatcgattatcccgtgcagtcaacttaacccgaccgtacgggaaaatgattatcccatgtggttgggccacccgcacgcgaaaatattgatttttccagacgtattgctgcatacgggcaagtcctccgcacggaaaaattattttgaccgcacggaaaaatgcttttcatagtagtgtgcgatcccctccaacagtgctgttgtcgccacgctctttgtgttgctgccaccgccgccgaccgccgcaggtggcctccatgccgtgggggtcgaggtgcgtcgccgccttgggagccttccccatccctctttcttccttgagctcggctcgccgctcgctgggcctgtgtcgtcgtcgttgttcgcttctgcccgactaccgcgtgctcaatcgccgcggtggaccactgcccctcctccgatggcaacgacacgtcagaattgaaaggggtagtggtgctgacaagtgagccccacatatttttatttttaccttttacgtgtaggatccacttttaccttccattcatttgacgactgagactaagtcaacctaccacatcagaataaatcacctccctaacaatcaatgagttcatttgcaccggtttttaaacttgaggaacacgattcgaccaagggcaagagttgaggtacgtgaaatagacttattccatcccatttcatcgcattctgaaacctgtgcccagcccagcccattgaagttcggcatagtcagcctgcaccgaatttttgtagagctcccttgctggctggagctggagaagtggagactggttgcggacctcaccctaaaccctagccatggcggcggccaaccttctctctcgcgcgctcctccctgctctaaaccctaacccaagcagccacagcaaccgcgtcagcccttcggccgtatctctccgctgccgccacggcctgacggcctccgttcgcgcctctctctccacggcagcgccgtccccgccgccgcggccggcggcggcggcggccgacggtcgggcgccgaagcgctgtttccggcgcggcgccgatgggcacctgtactgcgagggggtgagggtggaggacgcgatgggggcggcggagcggacccccttctacctctacagcaagcctcaggtggtgcggaacttcaccgcctaccgcgacgccctcgaggggctccgctccatcgttgggtacgccgtcaaggccaacaacaatctccgcgtgctgcagctcctgcgggagctcggctgcggcgccgtcctcgtcagcgggaacgagctccgccttgccctccgggcaggattcgatcccactaggtgcatcttcttctcttttcgtttttcgtttctatctcccgctatatttgattttttgatggattggaattggaatgcaaatgaacaatgatttgctggtggacaaaaggcctttttgactattctccatggacactagccatttttttatcttcatgttaattataaaatatccatctagtgactttctggggaaggtccgatttcagtgtcaaaagacatataaatgcaatagttggaccggaagaaagtagtatgaaaatggttcattaatatgctatatttatattttttttgccatattacgatgataggcaactttgttaattctaccaattttgttcacagagcttgactcgtgaatatgattttgataacactatgtttgcacaagcattagaatttataaccaaaatggtccgaacttaagaccatgtgttgggtcaaggagcacagccaaatttacatggcagaatgtagtgtaagaaattacgatcttcatatttcacagagcatgcgaggtgacaatccatgatgaaatctaagcgtatctatgaatgtttccaagttatagattgcacagttttctaaagtctttatctgtaacaaataagtacttcagttcatgtcaattgataccaaacaaaattgtagtaactaactagtttaagtatttatttaagttcaggtgtatatttaatggaaatggaaagacattggaagatcttgttttagctgcagagagcggagtgtttgtaaacatagacagtgaatttgatttggagaatattgtcactgctgcgagagttgctgggaagaaagtccctgttttgctcaggataaacccagatgtggatccacaggtaaagtttttcctcccacctcaggatacagtgggggatttagttatattggtatgctattgtgttattgtcatataatactagaaatcagattatatagttttgggtacccttgtgttttccattttttcttgaaaaaagttgtgtactacataggtgattattgatcttagttgtgcgcggtatcaaacatgtactactccctccgtcctaaaatatagcaacctagtacttgattagacactagggcatttcttttgcattaattaattgaatggataatgtaggcaaattttgctacgggacatcgtgacttgaggttttagctgtaggataccgtgcaaagtgacttttg

SEQ ID NO: 86384 - DNA, 1349 bp, Oryza sativa
ttccccctcgtccggcagctccctccccctcccaatcctatataaaccttccccgtgcctcccttcaccgtttccgccactcgccgccctctctccccgtcggaatcgagctcgcgccgtcgctctctctctccgccgtcaccgccgagctccggtccgccgccgtcgtcgccccggaccacctcccgcctcggcgtcgccaccttcggcttcaccgcatccccggcgacctcgtccactcctccgttttgctcgccgaccgccggagcaccgtcgaccccgtccacccgagccgcgccgccgccttcctccgctccggtcgccgtttccgtcgtcgccgtcgacccggggtgagccgtggaccgccgcttcttttcccccttcccttcccctctctcggccgccgctccgccgtgcctatggccgccgccggcgaccataggggcgcgggcgcgccgcctcccgccgctgcgccggcgtggccgccttcgggcgcaccgtgcggctgccgcgtggggcccggctgtcagccgcccgcgtcctcgggtgcggctgacgcgtgggacccacggcgccggccggtgtaagcccgggtgcgcccggtccaccgtggaccgtggggctgccgcgtgggccccacccccgtggacccggtccgcgcgcccctcccctcggctgacgcaataaatccattttaaattaaaatttaaatgaagaaattcacaaatatccatttaaagagcatataaacttcaaatggccataacttggccatttgaactcggaattggaccgttcaagtctctaatttttccttaagaagccaagaacccatttttgtgctttgtttctgcttgttatatggagtttagtagagtaaaagccatttcttttccgttggtcgtgtagacgctgcagcttcggaagatccgctcttcgtggaggttgaagccggcgtttgggaaagcgagcaaggcaagtcacatcattaaaagcctaaaatgcgtaaataaattttagtggaattttcagagcacaaataataattaagaagaaataaacaaagttaaaaaggttttataaaaagaaaaaacctaaaaagtctttttccccctcctccccctcttgggccggctcggcccatctctctccctctctctcctctcccccgcggcccattcggcctcctccccgcgcgcgtgccgctgacgggcgggcccgcccgccacccccacccggcatccccttcctcccgccgctcccgccgcctcgcccgtgccctagcgccgccgccgccacgaatcccaccgcctcccgccgtccacgcgcgcaataaagcgggggggggg

SEQ ID NO: 86385 - DNA, 3267 bp, Oryza sativa
aacttcatcaacagatggaagccctgaacctaagcatagttggtcgtggattcttggctacgctggaagccaagcccaccttgctcgatcaaatctgcgaggctcaaaagaatgatccagatatgcatgggatcctcaagaatatgaaacaaggtaaagccgctggtttcacagaagatgaacatggaaccctatggaacggaaatggtgtatgcgttccggacgacaaggaacttaaacagctgatacttcaggaagctcacgaaagtccttattccatccaccctggcagtacgaagatgtacttagacttaaaagggaaatactggtgggttagtatgaagcgggaaattgcagagttcgtggccctttgtgatgtgtgccagcgtgtcaaggcagagcatcaacggccggccggacttctccaacctctacaagtaccagaatggaaatgggatgaaattgggatggatttcatcatcggacttccaaaaacccaaggcggttatgactctatatgggtagtcgtggaccgactaaccaaggtagctcggttcattcccgtgaagaccacctatggagggaacaaactagctgaactctacttcgctaggatcgtaagtctccatggcgttcctaaaaaaagtatatctgatcggggacgccagttcacctctcatttctggaagaaagctccagaagagttgggtacccgattaaatttcagcaccgcgtatcacccgcagacagatggacagaccgagcgtctaaataagatcctagaagatatgctccgtgcttgtgttctagatttcgggaagacctgggataagagtctcccctatgccgagttctcctacaataacagctaccaagccagcatacaaatggcaccctatgaagcgttgtatggacgcaaatgctggacaccgctattgtgggaccaagttggggaaagccaagtgttcgggactgataacttgagagaagctgaagcgaaagtcagaaccattcgggagaatctaaagttggcccagtctcggtagaagagttatgcagacaaccgacgccgtgacctggaattcgcagtggatgactttgtctatcttcgggtcacgccgttgcgaggcgtacgtcggtttcagacgaaagggaagctcgcacctcggttcgtgggtcctttccgtatcattgctcgacgcggagaagtcgcttaccagttggagctgcccgcatcattgggcaacgtgcatgatgtgttccatgtgtcgcaactcaagaaatgtcttcgagtgccatccgagcaggccgactcagagcaaattgaagttcgcgaagacttgacctacgtggagagaccagtgaaaatcttggacaccatggagcgcaggaccaagaaccgggtaatccgtttttgcaaggtccaatggagcaaccacgccaaggaagaagctacttgggaacgtgaagacgagctaaagtcagcccatcccgatctcttcgccagttcttccgaatctcggggtcgagattccgtttaacgggggtaggtttgtcacgtcccaaaacgtgtaaataaatttcctaaaagtcaattaaggcttagaggatttttgtatatttcctaaaagcctaaaatgtgtaaataaattttagtggaattctcagagcacaaataataattattaagaaataaacaaagttaaaatgattttataaaaagaaaaaccctaatgggccgaattcggcccatctccctccccctctctctcctctccccgcggcccactcggcctctccctgcgcgcgcgccgctgacgggcaggcccgcccgccaccctcgctgacgggtggggcccacccgtcatcccctttctcccaccgctcccgccgcctcccccgcaccctagcgccgccgccgccgcgaatcccgccgcctcccgccgtccccgcgtgcaataaagtggggggaatcactccccgtgatcccctctcccattccacccaattttgcatccctctctcccttggattcgtttggaaaccctcccctaatcccgccggcgccattgatggagcccgagagcgccacgccggtttccttcccctccggccactctctccctcttccaaccctatttaaaccctccccgcacctccttcgtccgtttctgcctctcgccgcccttcctcctcgccggatttgagctcgcgacgtcactctctctctccgccgtcgccgccgagcttcggtccgccgccgtcgtcgccccggaccgcctcccacctcggcgccgcctccttcgggttcaccgcatcctcgccaacctcgtccacctctccgtttcggtcgccaaccaccggagcgccgccgacgccatcgacccgagccgcgccgccgcctccctccactccggccgcctcctccgtcgccgccgtcgacctagggtgagccgtggaccgtcgcctcctttcccccttccctcccctctctcggccgccgctccgccgtgccggtggtcgccggcggcgaccatcggggcgcgggcgcgccgcctcccgccgaccgcgccagcgtggccgccctcgtgcgcgccgagtggctgccgcgtggggcccggccgtcagccgcccgcgcccttgggtgcggctgacacgtgggacccacggcgccggctggtgcgagcccaggtgcgcccggtccactgtgggccgtgaggctgccgcgtgggccccactcccgtggacccggtccgcgcgtcccctcccccttggctgacgcaataaacccctttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttctttttcgttggtcgtgtagatgctgcagcttcggaagatccgctcttcgtggaggttgaagccgacgtttgggaaagcgagcaaggcaagtcacatcatccttgagcatattgaatcctagtttataaaattattttgatttaaattattgcattatcgctttacttaaattcacgcgttatcactgttttatctagccatgcctatttacctttgttatgaccttattattgttattgttattattaccttgttcaccctagattaaaccaaacc

SEQ ID NO: 86386 - DNA, 3258 bp, Oryza sativa
aagaatttgaggaaattggaagacatacccatagtctgcgagtatccagaagtgttccccgaagaccttactaccatgccacccaagagagagattgaattccgaattgacttggcaccgggaaccgctccaatttacaaaagaccgtacagaatggcggccaacgaactagcagaggtcaagaagcaggttgatgagcagctgcagaaagggtacattcgaccaagtacttcaccttggggtgctccggtcatttttgtggagaaaaaggataagacgaagaggatgtgcgttgattatcgcgcacttaacgaggtcacaatcaagaacaaatatcccttgccgcgaatcgatgatttgtttgatcaactgaaaggagctaaagtgttttctaagatagacctgcgatcaggctaccaccagttgaggattcgggaagaggatattccaaagacggccttcaccacccggtacgggctatatgagtgcacggttatgtctttcggacttaccaacgcacctgcattcttcatgaatctgatgaacaaagtgttcatggaatttctggacaagtttgttgtggtattcatcgacgacatacttatctattcaaagtccgaagaagaacatgagcaacatctccgtctggtactcgagaagttgaaggagcaccagctatatgccaagttcagcaagtgtgacttctggttgacggaagtcaaatttttgggccatgtcattacagctcagggtgtggcagttgacccatcgaacgtagagtcagttaccaaatggaccccaccgaagaccgtgtcgtagattcgaagttttcttggacttgcaggttattaccgccgattcatcgaaaacttctccaggatcgcccgacccatgactcaattgcttaagaaagatgagaagtttaaatggacagctgagtgcggtaagagttttgaggagctcaaaaagaagttagtatccgcaccagttttgattctgcccgaccagatgaaagacttccaagtctattgcgatgcatcccgccacggacttggatgtgtcctaatgcaggagggcagagtggttgcgtatgcctcgcggcagttgcgtccacacgaagggaattatccaactcatgacctggaattggcagcagtggttcatgctttgaagatctggaggcactatctgattggcaaccgctgcgaagtatatacggaccataagagtctgaaatacatcttcacccaaccggacctaaatctccgacaacgaagatggttggaactaatcaaagactatgacatgagcattcactaccacccgggtgaagccaacgtggtggcagatgcattaagcaggaaaagttactgcactgccctatgcatcgagggcatgtgtgaggaattgcggcaggagtttgagcatctcaacgtaggaattgttgaacacaggttcgtagccgctttggaggcacggcctacgctcgtggatcaagttagagccgctcaagtgaatgatgccgaaatagcagagctaaaaaagaacatgagagtcggaaaggctcggaatttccttgaggatgaacacggcacaatctggttgggagaaagattgtgtgtacctgacgacaaggaactgaaggatctgatactcaccgaggctcatcagacccagtactccattcatccaggcagcaccaaaatgtatcaagacctcaaagaaaagttttggttggtcagcatgaggagagaaatagctgaattcgtcgcactctacgatgtttgccaacgagtgaaggcagggcaccaaagaccagcaggtctactccaacctcttcaaatcccggaatggaaatgggaggagattggaatggactttataacaggactgccccggacatcgtcgggtcatgattccatctgggtagtcgtggatcgacttactaaggttgctcacttcataccagtacataccacgtatacgggcaaaaggttggtggagctttacctttcgagaatcatgtgtctacatggagtacccaaaaagattgtatctgatcgagggagtcagttcacctcaaaattctggcagaagctgcaggaagaattggggacccatttaaattttagcacggcctatcacccgcaaactgatggtcagaccgagcgagtcaatcaaatcctggaagatatgttgagagcttgcgctctcgattttggtggagcttgggacaaaaacttgccatatgcggaattctcgtacaacaacagctaccaggccagtctacagatggcaccgtttgaagctttatacggccggaagtgccgcacacctctcttctgggatcagacaggcgagcgtcaactgttcgggacagaggtattaacggaagcggaagagaaagtcagaatcatcagggaaaggttgaggattgcccagtctcgacagaagagctacgcggataaccgccgaagggagctcacttttgaggcaggagattacgtgtatcttcgtgtcactccgctccggggagtacaccgttttcagacgaaaggcaagttggcaccatgcttcgtgggaccctacaaaatcttggaacgaaggggagaagttgcttatcagttagaacttccatccaatatgatcggcatccatgacgtgttccacgtgtcccaattaaagaagtgcttaagggtacttgaagaacaggctgattcggaacacattgatatccaggaggatctaacatatgtggagaagccggttcgtatacttgataccagcgaaagaagaaccagaaacaaggtcaccaggttttgccgagttcagtggagtcaccattcagaagaggaagcaacctgggaaagggaagatgagttgaaagccgcccatccgcacctcttcgccagctcctccgaatctcggggccgagattccgtataaggggggtaggtttgtcacaccccgaagttctcctcctaagccaaaaatttaatttataagcgaccctaagaaaataccagtgcaaagcaagagtaaacccttttaaatcaatgcgaataataatcggaattggcatgtggaatttttcttgagttctacatgtcgaaattcgctaacaggatttttagtggaatttttcagagccctagaaataattttaaccagttaaaattgagcaagcaatattttaattccaggaaatccttttctcctttttctttttctttttccctccctttttcgaatggggcg

SEQ ID NO: 86387 - DNA, 7282 bp, Oryza sativa
cggtattgggccggccaacaaggggcagcggggcgctagggcgcggcccattaggcccgacagcaaaaagggcacaggggggcgtcgggggggagttagggttagaacccttaactgccccctcgcgggatttctgccgccgccgccgccgccgtcgcctttccgttgccgatgccgccgtcggagccgctgtcgcctgtccaccgtgcccttcccctgccgtcgctgcgccgtccgtcgtcgccatttccctgtgcagcttcgacgcgggacgcgccgccgccgcatcaagatgcgtcgccgccgccgcctccatttccaccgccgccacacgccgccatctcctgcatccaccatctgccgcccatcgccatcgccatccaccatccaccgccgcctcggccgcccctccgtccgccggcggttggccggccggattaggccgacggctcccgatcctcatcggagtcggaaaccggccgagccccgacgccattccccggcaccccgttagggagtgtacggctaggagagccatggggaacggcgatgaaggtgtggcggaggccgggacggcgagcggcggcttcgctggcatgacgacgagacgaggacggattgaagaatggcggctcccccgtgcgcgcagccatggtaccggtccaaccggaccccggtggcgcgggagtgggggaacggcgtcggcgtcggcttggggtcggtagggctggtgaagcagcggttgatggtggcggcagcgactccatctccggggaaagatcgcatggctcgccgggcagagtcaccactgccgtccatccgtggtgggcgcagtactgcaccccttgcacacagatacggcgaggcactgcggctaccggagatggaggcggaggaggagcaaccggagtagcggccaccacgatgcgtcggcgagggtggtggcgtcggccaccagccctagcccgacgttcatggtgttggtggcggccgtggtggcggcggcgactcctctccgatcgatggagaagatggggaaggcgacgagcgcgctgattgcgagaaaggccgagaacggcatccataatccaatgaaaggtaggcatcgtaccttctcagttgattcttctgttcgcttttctgttagatcaaaagcgatgtttcttcctttcacttcgcgatctccttcgcgagagcgaaagtgctgataacatgttaaatgtggatagaaatgattgagcgagagagattgagcgagagagagaattgaacacaagtagagcgaatcgatggatttctcattgatcaacagttaatttatacaatgtgaagcggtgtcaaccgcaagggacgcggtgtttgggaacatcgcgtcggttgtcgagagggacgccaaagggagagagaggagcgatctcctcttctctgctagttagtttaggaaccgttgttcctatttccttgggtggatgagatcacccgtagtttcttaacaaaaaaaccgtaagttttggtcaacaccgtacaaaacccctaaaaaaccgtctaatactaatacggatcgattttgacaaaccgagatgtaacggtttcacgatgatgagttccgtgaaccctggccataaacctgtactcctatgttgcagccactgacacaagacaccacaacagctgcaaaagtcaacagttgaaaggcgtggtagactagtagtaggtggtgcagcatgacgggcggagaacctcaaaaaagttacactaacaaaagaaaataagaaacctcaaactttatttaagaatacaatatttcattagggaatctaaagtaatgaaagaaataacctttcttccaacctgattgagccacatcatcaattaagtatatgcgtgactatatagcttgttaaaaaataattaactactacgaggttgaaatgttgctttaaaatactactccctccgtcccaaaataagtgtagttttgcactattcatgttcaacgtttgaccgtccgtcttatttgaaaattttttatgattaatatttttattgctattagatgataaaatatgaatagtactttatgtgtgactaaatgtttttaattttttcacaatttttcaaataagacggacggtcaaacgttgaacgtgaatagtgcaaaactgcacttattttgggatggaggtagtatgaaaataaatccatctacgagtttgagaagtatgttgatgataatactccgtatattatcagccccatcttttggcttatgcttatgtttataagccaaaatttaaattttcaacttaaaatttagagctgattttagattttttttattatagtttatttttcagcctttagttttacttttagaacactaaaaacacatgtataaaaattttatttacaaattatttttcgttaaatatatcgtttcgcttattccgtcggagtccaacatgtttgagtgaaaagggagcaaggggaaaaagtatatcggccgcatccttgaacacatcaacacgtatgatatattttttattttatatgacataatgtaaaagtacttttatacttcggtaccatatgagctttagtaaaaaccatttgccttgtttagatcttaaaaattttggctaaaaacgtcacatcaaatgtttgacacatgtatgtagtattaaatgtgggaaaaaaactaattgcacggtttgcatgtaaatcgcaagatgaatcctttaagcctaattacgtcatgatttgataatgtgatgctacagtaaacatttgctactgatgaattaattaggcttaataaatttatctcgtagtttacagacggaatctgtaatttgttttatcattagtctatatttaatattttaaatatgcgtccgtatacttacaaactttacatccaaataactaaacacccattatggtttgagggaagaccggaagagggtatttcacatggttcgaagacctttgagattagctttaaactatggttgcttgtaacgatgtcggaggttcagaaataaactttgcctctttcacatatgcagtaggaaatatactactacttcgatctatgtggaaaatactgtgagaaattaagaggccttctcattcaatatgcttgtcgaatatccctctcagtctccaaccgtataacactgttacaaaataaaacaaataaacgcgtacatgcatttttatcattacactggccatggacaaattttgcagtggcttcgactaagttcgtttaggcaattggggaacgactcctcgttcatcataagcacactcttttaagtatatattaaactgtgtgttttatataaaagttttctgcgtagaaatttctaaaagatcaaacaaacaatatcaagggctattcagattgataccattttcaaccataccattttttttacaaaattgttaaaaaaatatctatgtttagtttgttgctaaatttcataaatacataagaaatcatgtgccaaaattttagcattgccaaaatttgataaggcatattttggctataatatgaacatatccttaattttataataattaatattcaactaatcctgtactaatgacttatctcgctccgttatgccgtaggaaattccaacccaacaacctatccattttgagccaaataaacaaaaatacaattttatcgtcatatatattcgccatcgacgaattttttttgagcggcttcgtcgtcattgacttggacttattttgagtcctcctagactaatatggcaagagtgctgacttcacaatgtaattgccgcgcaagaatgcaatattaatgcaaccggctgctatatgctattccctccgtcctattttaagtgcaactatgattttttatacacaactttgaccatccgtcttatttaaaaaaaataaaaaaattaaaaacataagtgacgtataaagaaccattcatgttttattatctcataacaataaaaatattaattataaaaaaaatttaaataagacatatgatctaagtttggcacgaaaacttatggctgcagataaaatgagatgaagggagaagggagtagctagctcatgaaggcactgacggccatccttgactttacttgtcagcatactccataaaacttccaaatgcacacctactccaaccgtgcaagttatacatgactttgaagactcgacgacaatcatgcatgttggtactacacatcatcaccacggtacaccgattgcttatacatctcaagttggcatttggcaatgctcaatcttgttatatatatgccctttatcttcaaggaagaaaacctcaacttcaaattgtatatatatatatatatatatatatatatatatatatatatatatatatatatgttgtttgtacgcaaaaaatgatatattaggtgtttgctttgttgttttgctaggaactttgtcttaaatggggcacatgtgtcaaaccgttgtcccatgctatctatataggctgcctcgcctttctagatgatctcatactataccagtatatacaatatctagagtaagactaaagaggagataagtagatttatactcaatctatgatgttgagctatatatggatgatagtgccttgataagtagtagtgggagtatttgtggtccattgtgtaaagtgtaaagtcttgtactcttgtgtgctataacaaaatgggatttcatttcacgcttataatgatatactccctccattcacaaaagttatacgtattactttaatttatcacacaaatgctatgtttgggagcttaaaattctaagaagtaacttgttggtatgagaatatggaaaagttgggtttctgaacttctggcttctacttcattttttggattatacaactacaacttctcaggttctgattccgagagaagcaacagcagctagaagctctccaaacaggctcaaactaagggaactcaaatccttcgtgtgtttaatggtgtccacacccacaccctctgacctctgtaaattgcctacctctgttagggggtgtttagatttagaggtgtaaagttttagcgtgtcacatcgggtattatatagggtgtcacatgggggtgttcgggcactaataaaaaaaaactaattacaaaatccgtttgtaaatcgtgagacaaatttattaagtctaattaatctgtcattagaaaatgtttactgtagcaccacattatcaaatcatgaagcaattaggcttaaaagattattctcgcaaattagtcacaatctgtgcaattagttattttttagcctatatttaatattccatgcaggtgttcaaacgttcgatgtgacagggtgaaaaattttagggtgagatcttaacagggccttaattgcatacgcacgaactgtctttgctattcatgcagtccatcaatcttgctcaaaaggagacccttggttgccaaatcaatttaactagttgaaaccccgcacgttgcaacgtgatattttgttaagattggtggttgcatttggtaaattgaagtgatataaaaattcctcactattgaattgggccatgattaaattagatgggtctcccgtagtggaaaatatacatgggcctcacatggtggatgtgtgtatgggttgggttgtgtttagaggcgatcaaacgactcggaattgacgatgatgtgaaacattgaggtttgagctttaggatcttaattgcagttagtgggtaactttatagtaagaagagatcaacgcagataataattttttttagaaaggttacagcctcatatgaggattttattaaactaggaaggtagcccgcgcagttgcgcgggcatcttatttaaactatcataatttttgttattaggattttgaatattatgacttttgtctctcggtgaaagaatttgaaggttctttccaacacatgattgaaaaaaatatataagtcagaaacatgttagaaatgcatgtgtgaaacaacgaataaatgaattttggacagtaaacgaattttttacagagtacagcaataatatgaatgttaaaatttgttaacccacatagatgaaatcatcatctttcattgcataaataaattgcagttaaccaaacaacctttgcatcagcagcttgattttctcgatcccatgcgaaggaaaaaaacatgcgcatgcatcttatttctattttattaattttattgccattgagatataccgcaactttttggatatcagctaatcgttagatgcaccgtgcatggatacctcgtaagcaatatgatttgggaattagtagatagtggtagtgtggatatacctcataagttataattgatagtatacatattaagcgttttagtagctttctaaataacttatcggattggctactcccttgtccaatatatctgtaaagttcatcccactaagtgcagctaatgctaattctctcttctctcatgaagccacatcatcttaattgtttttagcccttggatgattcatcaagggtgcaaattgcatttcttctccccaaaagccacaccatacaactcaaccatttataacttttcaataattgatcaaagtacaaaatatacaagcacatgaaagaaaatcatatagtaaataagatttttttttctacagctcatatctactattttatcacacaaatctcccgcagcaatgtgcggggtacccatctagtttatagtgagaacgtttcccggactactaaacgtgtaatattttatctttttctcataatttctatgattttatctaatttattatagtatcatgtatgaatttaagagtgttcataagatgtttaatggactttaacttttctatgtttatttttgcatggtatcgataggatttgaatttttcatcagacttactataatgtattcgtgcaaatcaaaagatgcaatcaataggaatcccaatcgcatactttttttcctataatctaaaggagctttgaattttaattttaaatcccaactatacttttgagctgagtacaaactttttaacggtgtattgccttttggatttcacaaaaaaaaaatgaaagagaggaacatcggaccggcgtgggtacatacttatgtgcaccttgaagtggggacttttagagataaatttaattggtagttttttaagatagatgtaatggataaaacaatagtctaccaaaataaatgaaa

SEQ ID NO: 86388 - DNA, 30797 bp, Oryza sativa
ggaagtcaaatttctgggtcacgttattacagctcaaggcgtggcagttgatccatcgaatgtggagtcagttaccaaatggaccccacctaagaccgtgtcacagattcagagttttcttggacttgcgggttattaccgccgattcattgaaaacttctccaggatcgcccgacccatcactcagttgctttagaaagatgagaagtttaaatggacagctgagtgtgacaagagttttgaggagctcaagaagaaattagtatccgccgtagttctgattctgcccgactagacaaaagacttccgagtctattgcaacgcatctcgccacgggcttggatgtgttctaatgcaagagggcagagtggtcgcttatgcctcgcggcagttgcgtccacatgaagggaattatccaactcatgacctggaattggcagcagtggtacatgctttgaagatctggaggcactatctgattggcaaccgctgtgaagtatatacggaccacaagagtctgaaatacatcttcacccaaccggatctaaatctccgacaacgaagatggctggaactaatcaaagattatgacatgagcattcactaccatccgggtaaagccaatgtggtggcagatgctttaagcaggaaaagctactgcaatgccctatgcaccgaggacatgtgtgaagaattgcagcaggagcttgaacgtctcaacgtgggaatcgttgaacacaggttcgtagccactctagaagcacggcctacgctcgtggatcaagtcagagcagctcaagtgacggatcttgagatagctgaactgaaaaagaatatgagggtcggaaaagcccgggacttccttgaggatgaacatggcacagtctggatgggagaaagattgcacatgcctgatgacaaagagctgaaggatctgatactcaccgaggctcatcagactcaatactccattcatccgggtagtaccaagatgtatcaagatctcaaataaaaattttggtgggccagcatgaggagggaaatagctgaattcgtcacgctctgcgatgtttgtcagcgagttaaaacagaacatcagaggcccgcaggactattacaacctcttcagatcccggaatggaaatgggaagaaattggaatggatttcataacaggtctgcccaggacatgatctggccacgattcgatataggtagttgtggatcggcttaccaaagtcgctcatttcatcccagtgcacactacttatacgggcaaaaggttggcagagctctacctcttgcgaatcatgtgtctacatggagtacccaaaaagatagtatctgatcgagggagccaattcacttcaaagttctggcagaaattgcaagaggaattgggaacccggttgaatttcagcacagcctaccatccgcagaccgatggtcagaccgagcgagtcaatcaaatattggaggacatgttaagggcttgtgcacttgattttggtggagcttgggacaaaagcttgccgtatgcggagttctcttacaacaacagctaccaggctagtcttcaaatggcaccgttcgaagcgttgtacggccggaagtgccgcacacctctcttctgatatcaaacaggcgaacgtcaactgttcggaacataagtgctaacggaagcggaagagaaagtcaggaccgtcagagagaggctaagaattgcccagtctcgacagaagagctacgcggacaaccgccgaagggagctcacttttgaagccggggattacgtgtaccttcgtgttactccgctccggggagtacaccgttttcaaaccaaaggcaagttggcaccacgcttcgtgggaccatacaaaatcttggaacgaagaggagaagttgcttatcagctagaacttccattcaatatgatcggtatccatgacgtgttccacgtgtcccaattaaagaagtgcttgagggtacccgaagaacaagccgattcagagcacatcgatatccaggaagatctgacctacgtggagaagccagttcgcatccttgagaccagcgaaaggaggactagaaacaaggtcaccaggttttgccgggtttagtggagccaccattcagaggaggaagcaacctgggaaagagaagatgagttgaaggccgcccatccgcacctcttcgccagctcctccgaatctcggggccgagattccgtttaagggggtaggtttgtcacaccctgaagttctcctcccaagcctaaattgaatttataaatggtcccaagaaaatatcggtgtaaaagcaagagtaaaccctaataaaccaaggcaaataataatcggaattggcatgtggaatttttctcgagttctacatgtcgaaatttgctaacaagatttttagtggaattttgagagccctagaaataattttaaccaattaaaattgagcacatgcaattttaaatcccaggataaatcctttagtccttttctttttcttttccctcctttttcctcttcttgggccgtcggcctagtccgcccgccgctgcgcgcgctcttttcctccttgtgggccggcccaagccgcccctctctctctccgggacgccgacaggtgggtcccacctgtcgaggtcgtccccttcctccggccgcccgccccaggtcggcaaccgccgccgaaaccgccgcacccacctcctccgctcctgccgcgcccacgccgcgccgtccccgcgtcctccccacgtcgccgccgtctcccccgcgtctcccggcccgcgcgcgcgctcgcaaggggcgggattcgcattttgaatccccccattatctctctctccaccccacgtcgcaggtcaaaaaggaggctttcccggccgtttccacccatcccgcacctataaatcgctgccccgagcctcctctttccctttccgctctcgccgctccctcccgtgcttcctaccgagctcgcgccgctcgccgccagcgccaccgcttgccaccgcactacggccacgtgctgcccccgctagagccgccgccgcgctaagccgccgtcaccactagcttcgccgccgcaagatctttcccagccgccgccttgcgttgccgaaatcccaccaagaccacatttccctcgcgtcgccggtgagtcccctctccctccgactccggccgacatggatggccaccgtggggttttttcctttgcgctaattcctgtcctcccctcccctaggtgtcgccgtcactcgtccgcacctcggcatcgccggacttcgccgcctccctcgttttctgccgccggtcgccgccgtcccctccggtgaggaatccctcccccttcctttccttccccttcccgcgtgcgccattgcttttggccgcgccgctgctccggctgtgcgccgccgccttcgcgccgtccgccgccgccggtcgccgccggtggtcatgcacgccgccgcctctagccatggccggccggccggctttgaagccgagccaagcccggcggctgctccctgcgccgtccgatcggcccgaggccgatccggaccgtcggtcccgtggaccggcggtggaccacccgcgtggccccagtccacggtggaccggccgctttgtgccgctgacccgtggggcccacgtgccggcgccccctccctctccccttgcgccgctgacatgcgggccccgcatgtcggcgccacccgctccctttgatgacgtcagccctgggcatttattgcgcaataattcaattaaggatttttctgtttatagtaaaaacacagtgaatcttctaaaattcataactaattcatccgagctccgtttaaacccattcaagtcttagtaaatcaagaaaaatatgtagaatccattaaaattggttttgttctctgtttcagtagtattatagcgtgtttgtattgtttgctatgtatgtcacttagattccggctcttccgacgctccggtgtacttcgagatagtcgtcgaggttcctccagcagtagagcaaggcaagtcatgccggtcacttgaacatgttgatcctatattgcaaatgttctaatgttttccttcaaatactgcattgttttacaataatactatgtgatgtttacctactgttacagccatgctattttggtaccatgctcctttgttagcttgggttataacatgactagatattggactagggattgcttagccatgctttgttcaactagcacacaaaggggaaaatcctattaatgtatagactgtaggttctaatggtaatgttggattagtgccaccgcttcggtgttggttaattaaaataaatcacatggtgggctgtgggtgcatgattttgttggtcgcgcccatggcagttaaggaccggttcacaggatgccctggaagaacttatcgtacttaccacaagctagtgtgggcaactgctgggcttgtagtgtagctttcctctagctgacgcatctaggcaagggtggccgtgatggagtttggatgggtcctgcgacggcctatgcggcttccggattcatctaggcacgagaggggactgcccgctgccttgcgaggagtgggggtgatacctgaggtgtggtgtgcttggttagagggggttatgcgaagggtcctgtcacggcctctttccggtatgtcgtggtggcatgccggcgcacgaaaacgtgtcgtggggctgtgtcttgtgggtacagttgtacacctctaatcagagtaaaactattcgaatagccgtgcccacggttatgggcggtcaaccagattcaccgtgattagtctcaccctagtttagtctgatgaaattggatagtataggtggatggttgggcctgttgcaacatggtatagcgttggacagtggatgattaatattgattaattgttacaactgctttactgctttcaacttctgtttataaatgctcgttttatgcaaatgaaccattatagctatcccttgataattccctgcatcatacccctattccggtatgacttgctgagtacagtgggtagtactcagtcttgctctattttccccaaaccccagagtttgagtatgcgtcagatggtggtttctccgaggagtaggcttcgtccgtgccatcgaggatgcctgtggagtggtgttcccgctgcagttcaagtcaaggcttagctccagttatcttttgtttttccgctgtatttatgtaagacttttataatgtttgtaagacgtggatctgtatgtcaactttgtcgtttgtgtaccccggccggtcctggacggggattttaatgcacattctgcttggaattctattcgggaatttctgggcgtgacaagttggtatcagagccgaccttgaccgtaggacaagccaaatggaaaacctaagagccctctgaatccttttcattgcatatgttctttgcaattggatttgttccgtgagaaattgggatctgttcttgtggttcaagggaaaaatcttggtcgctcgtttaagtgagatttgtcgaaacaagtaagtctagggttttagtaaaattatttgagatatattcgacagttagtcgggatttgatgggtggtatgcattaggtcctagctcaggaatatgggttgcaaggtgtttatgcttttattgttattattagtatgtacctaattttctcactattttatcgctatgtaagtctgtcttatttattcgctctcatgcaaatgatctatgcataaaattccgctcttattcgcttctcttatttgagtcctttactgctttatttaaaattggatttgagcatgcattgatcctacccctttgtcttctctagatggccgagcacccacccaaccaccgcggagaaggcatggatgattttgtggcagaattggctcgcatgacactggtggtgggctaccccaacgtgccagagtactcgactgttccaccgctcagtggcgagcttcctcaccgtgttcgcctggaggtccatggctatgtgggtacctgcctcgctaacattgtggttgaggcatccggaggcacagcagatcacgcctgtcaggaggcagcatatctgctgatggccaggcttcgtgatcagcacaactacatcttctgcaacacggtgtaccgcttccaccctcgtcgagcaagtggcgatgatatcagcaccttccgcccgatagctggtgagaacgacaccaccttcggccacatgtgcaccgtgatgaggggaatggacaggatgcactcggatctgcacaaggcgtctaaggccttgaatggtgggaagctcgtgaggatcatagctctgaaggatgagatagcacgcctgaagaaggagaatgctcagttgaagggtctccccgcgccaagaggagtcctgatccgcaccacgcccggcaagtcgacgacggcacccgtgtgcattcaacttgcgcccaggaacccacctccgcctgcagctcccgcagctcctccagttctgccccacagttgccgcagctcctgcagctccagagccagtcccagctcatgttccagtgtcagctcccgtgtccgctctctccttcgctccagcatcagccgtcaggggcccagccagtggcaacggcggttggttgcctgccactcccagtggcagccgcgaccacagcagcagcagttccagtggctcagagccgggcagcggcgagacgtatctgccagactccaggagccgctcagagggacctggtgacaagcaggaggacgccttcgactccaccgaccgcaggagccgttccgagcattaggctcgctttccattagtttatcgactgtttagtatttgcctgttagtttgtgtgtttaggtctgctcgcttgtgggtcagtcgacggtcgatatcatgtgcctatgatatggctgtcttaataaggattttgcttgctgttttaagtgttttaattcagatcagaacaattgcagtttaaattcctatataataaagcttagttcctgagcatctgtttttcttcttttctacccccccgtctgctcttcctccagatggtctacaccaggaatggtagccgcacaacaggcgagggcagcaacggcaaagaacgcactgacggtgtgcatcccaacagcgattccagcaatggtccgccaccactccccgagaatccgactctggcccaagtaatggctcatcagactcagatgatggcagccatgatgcagcagcagcaccagcagatgcaccagaggatgcagcagcaagacgagcaacagcagcagcagtttggtccccctccccctcagtccaagttgccggagtttctacgcgtcaggccacccaccttctcttgcaccaccaaccccatggaggcgaatgactggctccatgccatagagaagaaactaaatctcctgcagtgcaatgatcaggagaaggtcgcctttgccacacaccagctccagggttccgcgtcagcttggtgggacaatcacatggccacccgcccgccaggcactgaagtcacttgggcggagttctgtcgcagcttcagaaaggcgcaggtgccagacgcggtcgtggcacagaagaagagggaattccgggcactccaccagggcaacaggacagtgactgagtatctccatgagttcaatcgcctagcgcgatatgcaccagaggatgtccgcactgacgcagagaagcaggagaagttcctaggaggcctggatgacgagctgaccaaccagttaatctctggagactacgccgactttgagaggctggttgacaaggcaatccgtcaggaggatcagcgcaacaaaatggacaggaagagaaaggcggcgcagttccggtccaaccaagggagccaccagcaaccgcgcttcactcccggacagcaaggtggacctaccaccatgatcgtcctccagcaccgccctttcaactcaagcagcttccaccagggcgccagtggcagccagaaccaccagggaggtcagcccaacctcagtgcagctccgcgcccaccaatggcaccagcacagtcagttccatccgctcaagccaagatggaggctgggacaaagccagggtcctgcttcaactatggcgagcttggccacttcgctgacaaatgcccgaagccaaggcgtgccgggctaaggtttgtccaggctcgtgtcaaccacgcgtccgcagaggaggcgcaagcagcaccagaggtcgtactgggtacgtttcctgttaactcaatccctgcaatagtactttttgattctggtgcaacgcattctttcatttcaaagaaatttgtggggatgcatgggttaagaaaagaagagcttagtactgtcgtgtcccaaaacgactctaaaatacatcctcaaaattgtgcatagaataagtaaaatccatgtgaaagcctccaacaattaaaatgtgcaaagttaaaagtcgaataaggcttggaggatttttgtatatttcctaaaagcctaaaatgcgtaaataaattttagtggaattttcagagcacaaataataattaagaagaaataaacaaagttaaaaaggttttataaaaagaaaaaccctaaaaagtttcttttccctccccctctccctcttgggccggctcggcccacctccctccctctctctcctctcccccgcggcccaatcggccccctccccgcgcgcgcgtgccgctgacgggcgggcccgcccgccaccctcgctgacgggtggggcccacccgtcatccccttcctcccgccgctcccgccgcctcgcccgtgccctagcgccgccgccgccacgaatcccaccgcctcccgccgtccacgcgcgcaataaagtgggggggggggaaatatttcccgtgattccctccctctttccccccatttttccctccctctctccctcggattcgtttggaaacctctccctaacctcgccggcgccatcaatggcgaccggatcttccgcgcccgtttccccctcgtccggcagctccctccccctcccaatcctatataaaccttccccgtgcctcccttcaccgtttccgccactcgccgccctctctccccgtcggaatcgagctcgcgccgtcgctctctctctccgccgtcaccgccgagctccggtccgccgccgtcgtcgccccggaccacctcccgcctcggcgtcgccaccttcggcttcaccgcatccccggcgacctcgtccactcctccgttttgctcgccgaccgccggagcaccgtcgaccccgtccacccgagccgcgccgccgccttcctccgctccggtcgccgtttccgtcgtcgccgtcgacccggggtgagccgtggaccgccgcttcttttcccccttcccttcccctctctcggccgccgctccgccgtgcctatggccgccgccggcgaccataggggcgcgggcgcgccgcctcccgccgctgcgccggcgtggccgccttcgggcgcaccgtgcggctgccgcgtggggcccggctgtcagccgcccgcgtcctcgggtgcggctgacgcgtgggacccacggcgccggccggtgtgagcccgggtgcgcccggtccaccgtggaccgtggggctgccgcgtgggccccacccccgtggacccggtccgcgcgcccctcccctcggctgacgcaataaatccattttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttccgttgatcgtgtagacgctgcagctttggaagatccgctcttcgtggaagttgaagccggcgtttgggaaagcgagcaaggcaagtcacatcatccttgaacatattgaatcccagtttataaaattatgttgctttaaaattattgcattatcgctttatttaaattcccgcgttatcactgttttatctagccatgcctatttacctttgttatgaccttattattgttattgttattatttccttgttcaccctagaataaacaaaaccccagctagtggacactctactcatggtaccactagtatgattttaggtagatgcttcgctatttaattaggtaacattaggcggttttacaactctagactttgggatattcatatcacctggacactttggaattgttggagtattgtggaattggattcacaccgccccctctattcaaaatccccaaaaatggttttaggctgggctcggggtgcatggttttgatagtagcacctcggccaaataaggaccggtcttcgggcctctgttgcaaagcactaccgtactttcacatgtctagtgggtaaggcttagtttgtggctcagtctggttataaacaaaagtacacggatggagatggacgaagtcgggggtcgatggacatctccagggcaaatgaaggctacacgagctgcggcccggtagtcgagatgtcatggcacagggtcggtgtcctgctgctaggggctcagtcctgcctacctgtcccgggggttccggccgtaggtgggattgggtcggtactcttgtctatggctaggatgggttggaaactatgtcacgtcttccgtctgtataccgtggtggtatgtggcacgtggttgcatgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccggttcggtctgaatcatcgtaggccttgggttaaggcaggttcgtgtgggttcacggccttgataaataatattgtatagttctagaatcgtgtttacaaaatagctttgagcaactaagtatctttaaatgctgtttactgcaaccctaaccctttatattataactcccttgtactcccttgcatttattatgcacttgtgggtgtgtcttgttgagtacggtggttgtactcagtcttgctcaatttttttcccaaacccagaagaggagtctctggaagatgaaggttttggtgtctagctcgtgcctgccgtcaaacgcctgtggtcgtcgccctagtcttccgctgtttctcgtttgtctttgtgtgtgctgggccttcgctgcccatgtaataaattaactatttacgcttccgcttgttgaactctgatctgtatcaacttttggtgtaccttgcctcctgggacaaggaataatgcactcacgtaaggaacgcccgttgggttatttccggtcgtgacatacaatctacttgaatcgttcttttactatgttttctattttaccctagtttagtccatctttgtcggtttgcgctgtaaacagtctgccgccgctgcgagagtgcgacacctctttgtaggtttctcctgaaaaccttccgttttacccacgagacgggtagttatcctcatatcgatctaaatcggcctagaggctgattttgatctctaaatcggctccactagccggtttagcttttctttatacaaaacccatcttgatttggctctttggctagatcgaggtggttggcgactccatatcaccgcaaggcgtttaggtgttgcgatcgtgcttgtcgacttgtcacaaaaaggtgccaacatgatttttggcgactccgctggggacgagatccgttcatcgtcaactcgacttcgacttcgccatgacgaagccatcatccagaacggaggtggagccatctaatgtgatgccggtcacattggatgacttcgaaggagaggatcgtaaagctgtggaggagtacatcaacgagctcacacgggaggcgttgatgagattaactactaggactcatcaagttgtgatcatcaagcccgggccacgtcctatgctcgctcccgacgtggtaagtaatgacgaggtatcgcaatctatcaacgaacaaattgcatctacaaaagattcatctatggctaattttaaagatagattagatttaatgtttaaggagaaggttgatgggtttttaaggagtaggctaggtgcttttatggatgattacacattaaaggataaagcctataccactgttgatcaatctcctatagatccgatgggtagtaaaaccgacgcgacggtattcacggtcggtccgaccgggcctgacggccggtcagaccataacatagccgtcggtccgaccggccagacggccggtcagaccggctctcaggccggtccgaccgcgcaacaggacgctggtcagaccgggccctgggccggtcagaccggtgcaattgtcccgattcagggtatagatccaacgactaacgctagttatttgtaccactttagaacatttgatcctcctgtatctactgctactattaatcctcaagttcccccacatattcctaatgcttataatgatgtttctaggggatatcctcccgatactaggcaaggccaatataatcatattgcgccacaaacccagcctattaggctaccaaacccaccaccaaatccacaagggcctaataacatagagaatgtgattagtgatattatgagaaatagattcgggattgaaactaggaatcgtgctagagcttacaaaaagccatatcctgattattatgataatgtgccgtttcctagaaattatagagttcccgaatttgccaaatttagtggtgaggatggtaagaccacatgggagcatgtaggtcaatttttagcgcaatgtggtgaggctaatagtgatacttttaaattgcgcttgttttctttatctttatccggtaatgcttttacatggtttacttctttaccggcaaattctattcatacttgggctcaattagaagaacaatttcatgatcatttttgcactggtaaaactgagcataggttgtctgatataacatcggttaggcaaaaatacaatgaatctgtcgttgattatattgaaaggtttagagaaattaaaagccgatgttttagtttgaaaataactgacaaagatttggccaacatttcatatgatggattgcttgattctattaaagagaaattgaatggccagatatttcttgatattgatcatgtgttgcatgaagctctgactcaggaaagccgagtggatgacaatagcttaaatgctagtttagatgatagtgcaataacatgtatagccgaacctagcgataattcggattgtgttaataatttgtgcaatgatgccgtgacaagtatagccgaatcaaatgttggtccggactgtcttactagtttggatgataacgcaataatcaatatagccgaaccaagtgttggtttggattgtgtcactagtttagacaatgatggaatagccgaaccaagtaatggttcggattgtgttgctagcttagagaataatgccatcgaagatatagccgaactaaatgacggttcggattgtattacaagctcaagtgaaatagcattgtcacctaagaccgaattacaaatcggtcatgtagatgttggaaaagatagtgacaatgtcttgcaggatagtagtgagatagaatccaaagtaactatgcatacatatcaaagatcgtatcctgaacacgtagattcggtcccatacccgcaaggatttaaggtgcccaacttcacaaaattcacaggtgaggatgctagaacaacaatggagcatatcggccaatttattgatcaatgtggtaaggccggtaatgatgatttgcttaagttaaagttgtttcctctttctttgtcaaactttgcatctacatggtatagtttacttgctcctaattcaatttctacatggtcacaaatggagcatgagtttcatggttatttcaaagatgcaagcttaatggagcaaagaccgattgatacttcaccggtcacttgtgaaactatttcggttacatctatgcctaagaccggaattgttagtgattctctccctgttagtcctattgatgtagacaaaaagaaagggaaaagtgttattattggggatcttcggcccaagaataggataaaaaatgcgaatgccgaatatcataaagttgcaaaggatgggtcatctaattcccaaaagaccaaaaagccgaagctcacttttgagatgcttatggctaaatacaagaaaggattagccggttaacgatttgataaccaaactagtgattcgaaaagaccaagatcatctcgtaggaagagatttagtcaaacattaaagcaatcggagccatcaaccataccaactccatataaacctccggttgtgatgccatggtatccatatccaatgtcaccgtttggttatccttttatgtattacgtgccgtggatgcatcaaccacttatgccgcattatcaggagtggaaggaatcacctaggacagtgccaaatcgttcatctaactcaagacaagactgttttccacaagagaatcggtccggtggatcaaaggtgaaaaaaatgaaaaaggtgaagaaggtgtgggtgaggaaagaagccaaagctccggaggtcgttgctgccaaagaggagtctcaagaggttcatgtacctactggagatgcggtggaaaccacgcaggcaaaggagattgaagctgatgccgtgactgccaacattgggggtctaaccgagacagctggccggtctaaccgccagtctatggccggtctaaccgaccttaccggccggtctgaccgacggcttgtggccggtctgaccgggctcagaggccggtctgaccggggggcattggagaagagtgggaaaattgagagcaacataggagcttccacttcgacaaaaaatatcaagaatcattgtttagctcctggaaaacaaccacagccgaagtggataccttctggcttatctcgctctcaaaagaggaggctacagcgtcttcgggccataggtcaaaaagaaaaggaggccaaagatgtggagaacaaaacatgtaacaatttagagcttcgaacgacacctaagcaagtgtggagatctaaagaagtaaaagttaagagaccggtgatttcccatagtagtagtgataaatccaatttgatgagagaagaatcatcggtcattagagataagtctccttcacatgatgctatggatgttagtacggtattcatcttgccttcgaaatcgtgcaatcaagaaagccgattttgcttggggggcaagacattaatatgctcgtgaaggaaccaagagaagatgaacggcgatggatacgacatcatatctttgagccgccgtttgttggatgctaaggcaagatatgggtttattgtgtttaccattatattatatgcctatgccatgttattagaatattgcttgctatctagaacatgtgtgtttttgcttatcaaattgatattatacatacatgttgcaaatgccagttctaggaagtagaattggtaggatggcatataatttgtttgaggtatgatttggctcatgactctttgatatttatttaaagccaaatcatatgtgtttttatggatcaccatataagatatagatttcatatttattgcaccatgaaagttttgcctactagtaattcggctaatatcaatggtcactgtgatggtttgctctagagtggttttctttaggaacattggcattgttaatattttgcatacatgctcaagccgattacttacatttttagtttattggaatctatgcatgtgacacatatgactttggtgattcattattgatcatacttcaattggctaagtgttgtgatgccatgatgattattgtttcaacagccaattgaattagtattcatctagacatattagttgaatgttatgatttttcatatgtatagagagaaggaattttggtccaataatttgatacactaagcatctggctattatgtgaagaaaaattatatactaaaggccgatgcttgatttcaaaagtttggatgaagttggcaaagtcatagatcaggggtggtctgaccggcattgcacggccggtctgactggtggtacccgcggtctaaccggctctgcatggccggtctgaccgggcagacagggtggtctgaccggcattgcgtgtccggtctgaccgatcccagacaggaggctggggggcacgttacaattgattaaaaggccgaattaattattcggacatttgtgcccatgagttagaaatagcttggagaattcctttgattagatatttaaaagatcctacacttaaggttgatcgaaagattcggtggcaagtgttcaaatattgtatcgccgaaacatagatggtgtcttgttaaagtgcttagatgaagatcaatctaaagtggctatgggagaggtacatgaaggaattcgtggaattcatcaatcggccgtaagataaattggttgcttaggagagtggagtttcttggccgaaaataattgatgattgtttcaaatgctatagagggagtgaagcttgttaacggatcgacaatgttcaaattagcgcctatcactatattgaatattatcatcaaaccatggccgttccaaggttgggctttggatttcattggtcaaatttatccttcgtcatcaaaagggcattggttcgtgctagttgcaatgggttacttcactaagtgagccgaagccgtgccgctcgagaatattactacggaggtaattggctttattttgaagcatatcgttcatagattcggtattcctcaaacattaaaggagcttcttttatgtccaaggaagtgagaagttttgccgaatcttatgatattaagttgttgagttcttctctttactacgctcaggctaatggataagccgagtcgagtaataaaacattgttaaaattgccgttttgccagttgaggtaaatcttggctctcttcggtatttcaagcaagacgacttgtcggttgacgattacaagaccttgatgggaagcaattttgaagacgtcatcgacaagcgtttaaagactttgaaggagatgaagacacttcaagacggtgttttcaaagagcaattaatgggaaatagcttgaagaaatacttcccgagcatttggtaagatgcttaggaagtcctatggccggtaattggattatcgccctgagataacatgttctatgcttttaggttcacgtatgttcaccaaaaaggcaggggggcatgtgtttacacccaaatttggcacctatggacgaaatagggaaaaattgccaaagtttggaaagtgtcgggtttccttcactagggccggtcagaccataggtatgtgggcggtctgaccggctagtagggccggtctgaccgcagttatgtaggcggtcagaccgtgagggtctgagtccgactctgttttcgtcgggtctcgggtttccttgctcaggaaggcatgtttcgtgtttccattggtttctatcccgaattggacgtgaaggagggcctgtagagggcaagaccaacccctatataagggacaaggccggttcattgtaaaacccccgaatacaatctacttgaatcgttttttaactatgttttctattttaccctagtttagtccatctttgtcggtttgcgctgtaaaccatccgccgccgcagcgagagtgcgacacctctttgtaggtttgtcctgtaaaacttccgttttgcccacgagacgggtagttatcctcatatcgatctaaatcggcctagaggctgattttgatctctaaatcggctccgctagccggtttagcttttctttctacaaaacccatcttgatttggtcctttggctagatcgaggtggttggcgactccatgtcaccgcaaggcgtttaggtgttgcgattgtgcttgtcgacttgtcacaaaatgttgccaacacaaatcactagtctcaccaaagcaaggggtctccttgaatcagattgaggtggaaatcccagtggtcaccgaggggaagagttcgaggaaattggaagatatccccatagtctgcgagtacccagaagtgtttactgaagacctcactaccatgccacccaagagagagattgaattccggattgatttggcaccgggaaccgctccaatttacaagagaccgtacaggatggcagtcaacgagctagcagaggtcaagaagcaggttgatgagcagctgcagaaagggtacattcgaccaagtatttcaccttggggtgctccggtcatttttgtggagaagaaggacaagacgaagagaatgtgtgtcgattaccgcgcactcaatgaggtcacaatcaagaacaaatatcctttgccgcggatcgatgatttgtttgatcagctgaaaagagctaagtgttttctaagatagacctgcgatcaggctatcaccagttgagaattcgggaagaggatattccgaagaaagccttcaccactcggtatgggttgtatgagtgcacgcttatgtctttcggacttaccaacgcacccgcattcttcatgaatctgatgaacaaagtgttcatggaatttctggacaagtttgttgtggtattcatcgacgacatacttatctattcaaagtccgaagaagaacatgagcaacatctctgtcgggtactcgagaagttgaaggagcaccagttatatgccaagttcagcaagtgtgacttctggttgtcggaagtcaaatttctgggtcacgttattacagctcaaggcgtggcagttgatccatcgaatgtggagtcagttaccaaatggaccccacctaagaccgtgtcacagattcagagttttcttggacttgcgggttattaccgccgattcattgaaaacttctccaggatcgcccgacccatcactcagttgctttagaaagatgagaagtttaaatggacagctgagtgtgacaagagttttgaggagctcaagaagaaattagtatccgccgtagttctgattctgcccgactagacaaaagacttccgagtctattgcaacgcatctcgccacgggcttggatgtgttctaatgcaagagggcagagtggtcgcttatgcctcgcggcagttgcgtccacatgaagggaattatccaactcatgacctggaattggcagcagtggtacatgctttgaagatctggaggcactatctgattggcaaccgctgtgaagtatatacggaccacaagagtctgaaatacatcttcacccaaccggatctaaatctccgacaacgaagatggctggaactaatcaaagattatgacatgagcattcactaccatccgggtaaagccaatgtggtggcagatgctttaagcaggaaaagctactgcaatgccctatgcaccgaggacatgtgtgaagaattgcagcaggagcttgaacgtctcaacgtgggaatcgttgaacacaggttcgtagccactctagaagcacggcctacgctcgtggatcaagtcagagcagctcaagtgacggatcttgagatagctgaactgaaaaagaatatgagggtcggaaaagcccgggacttccttgaggatgaacatggcacagtctggatgggagaaagattgcacatgcctgatgacaaagagctgaaggatctgatactcaccgaggctcatcagactcaatactccattcatccgggtagtaccaagatgtatcaagatctcaaataaaaattttggtgggccagcatgaggagggaaatagctgaattcgtcacgctctgcgatgtttgtcagcgagttaaaacagaacatcagaggcccgcaggactattacaacctcttcagatcccggaatggaaatgggaagaaattggaatggatttcataacaggtctgcccaggacatgatctggccacgattcgatataggtagttgtggatcggcttaccaaagtcgctcatttcatcccagtgcacactacttatacgggcaaaaggttggcagagctctacctcttgcgaatcatgtgtctacatggagtacccaaaaagatagtatctgatcgagggagccaattcacttcaaagttctggcagaaattgcaagaggaattgggaacccggttgaatttcagcacagcctaccatccgcagaccgatggtcagaccgagcgagtcaatcaaatattggaggacatgttaagggcttgtgcacttgattttggtggagcttgggacaaaagcttgccgtatgcggagttctcttacaacaacagctaccaggctagtcttcaaatggcaccgttcgaagcgttgtacggccggaagtgccgcacacctctcttctgatatcaaacaggcgaacgtcaactgttcggaacataagtgctaacggaagcggaagagaaagtcaggaccgtcagagagaggctaagaattgcccagtctcgacagaagagctacgcggacaaccgccgaagggagctcacttttgaagccggggattacgtgtaccttcgtgttactccgctccggggagtacaccgttttcaaaccaaaggcaagttggcaccacgcttcgtgggaccatacaaaatcttggaacgaagaggagaagttgcttatcagctagaacttccattcaatatgatcggtatccatgacgtgttccacgtgtcccaattaaagaagtgcttgagggtacccgaagaacaagccgattcagagcacatcgatatccaggaagatctgacctacgtggagaagccagttcgcatccttgagaccagcgaaaggaggactagaaacaaggtcaccaggttttgccgggtttagtggagccaccattcagaggaggaagcaacctgggaaagagaagatgagttgaaggccgcccatccgcacctcttcgccagctcctccgaatctcggggccgagattccgtttaagggggtaggtttgtcacaccctgaagttctcctcccaagcctaaattgaatttataaatggtcccaagaaaatatcggtgtaaaagcaagagtaaaccctaataaaccaatgcaaataataatcggaattggcatgtggaatttttcttgagttctacatgtcgaaatttgctaacaagatttttagtggaattttgagagccctagaaataattttaaccaattaaaattgagcacatgcaattttaaatcccaggataaatcctttcttccttttctttttcttttccctcctttttcctcttcttgggccgtcggcctagtccgcccgccgctgcgcgcgctcttttcctccttgtgggccggcccaagccgcccctctctctctccgggacgccgacaggtgggtcccacctgtcgaggtcgtccccttcctccggccgcccgccccaggtcggcaaccgccgccgaaaccgccgcacccacctcctccgctcctgccgcgcccacgccgcgccgtccccgcgtcctccccacgtcgccgccgtctcccccgcgtctcccggcccgcgcgcgcgctcgcaaggggcgggattcgcattttgaatccccccattatctctctctccaccccacgtcgcaggtcaaaaaggaggctttcccggccgtttccacccatcccgcacctataaatcgctgccccgagcctcctctttccctttccgctctcgccgctccctcccgtgcttcctaccgagctcgcgccgctcgccgccagcgccaccgcttgccaccgcactacggccacgtgctgcccccgctagagccgccgccgcgctaagccgccgtcaccactagcttcgccgccgcaagatctttcccagccgccgccttgcgttgccgaaatcccaccaagaccacatttccctcgcgtcgccggtgagtcccctctcccctccgactccggccgacatggatggccaccgtggggttttttcctctgcgctaattcctgtcctcccctcccctaggtgtcgccgtcactcgtccgcacctcggcatcgccggacttcgccgcctccctcgttttctgccgccggtcgccgccgtcccctccggtgaggaatccctcccccttcctttccttccccttcccgcgtgcgccattgcttttggccgcgccgctgctccggctgtgcgccgccgccttcgcgccgtccgccgccgccggtcgccgccggtggtcatgcacgccgccgcctctagccatggccggccggccggctttgaagccgagccaagcccggcggctgctccctgcgccgtccgatcggcccgaggccgatccggaccgtcggtcccgtggaccggcggtggaccacccgcgtggccccagtccacggtggaccggccgctttgtgccgctgacccgtggggcccacgtgccggcgccccctccctctccccttgcgccgctgacatgcgggccccgcatgtcggcgccacccgctccctttgatgacgtcagccctgggcatttattgcgcaataattcaattaaggatttttctgtttatagtaaaaacacagtgaatcttctaaaattcataactaattcatccgagctccgtttaaacccattcaagtcttagtaaatcaagaaaaatatgtagaatccattaaaattggttttgttctctgtttcagtagtattatagcgtgtttgtattgtttgctatgtatgtcacttagattccggctcttccgacgctccggtgtacttcgagatagtcgtcgaggttcctccagcagtagagcaaggcaagtcatgccggtcacttgaacatgttgatcctatattgcaaatgttctaatgttttccttcaaatactgcattgttttacaataatactatgtgatgtttacctactgttacagccatgctattttggtaccatgctcctttgttagcttgggttataacatgactagatattggactagggattgcttagccatgctttgttcaactagcacacaaaggggaaaatcctattaatgtatagactgtagattctaatggtaatgttggattagtgccaccgcttcggtattggttaattaaaataaatcacatggtgggctgtgggtgcatggttttgttggtcgcacccatagcagttaaggaccggttcgcgggatgccctgtaagaacttatcatacttaccacaagccagtgtgggcaacggctgggcttgtagtgtagctttcctctacctgacgcatccaggcaagggtgggcgtgatggagtttggatgggtcctgcgatggcctatgcggcttccggattcatctaggcacgagaggggactgcccacggccttgcgaggagtgggggtgaaacctgaggtgtggtgtgcttggttagagggggttatgcgaagggtcctgtcacggcctctttctagtatgtcgtggtggcatgccggcgcacgaaaacgtgtcgtggggttgtgtcttgtgggtacagttgtacacctctgatcagagtaaaactattcaaatggccgtgcccgtggttatgggcgatcaaccagattcaccgtgattagtctcaccctagtttagtctaatgaaattggatagtataggtggatggttgggcctgttgcaatgtggtatagcgttggacagtggatgattaatattgattaattgttacaactgctttactgctttcaacttctgtttataaatgctcgttttatgcaaatgaaccattatagctatcccttgataattccctgcatcatacccctattccggtatgacttgctgagtacagttggtaatactcagtcttgctctattttccccaaaccccagagtttgagtatgcgtcagatggtggtttctccgaggagtaggcttcgtccgtgccatcgaggatgcctgtggagtggtgttcccgctgtagttcaagtcaaggcttagctccagttatcttttgtttttccgctgcatttatgtaaaacttttataatgtttgtaagacgtggatctgtatgtcaactttgtcgtttgtgtaccccggccggtcctggacggggattttaatgcacattctgcttggaattctattcgaaaatttctgggcgtgacaccgtatctagcgtgccagacccaggcttgatccttcccctttgcgagaagggaaaccggttgcgccagctcgacgtggagaacgtagaggcgcccaactccttggcgcaccctacacagcagctgtcgctgtggatcatgcaaagtgagaacaccatcctcgatcaccgtcttgcaatgcgcctcatcaagctagccaaggctgaccatgttgctccgaagcttggggatgtagtagacgctagtgagcgcgcagtggtcaccattcttgcaagcgaacagcaccatgcctcgtccttcaatccagactctcgacgcatcaccaaacttgacagtgccgcgcacggtggtgtgaagctcggagaacacatcacggtagcccgtcatgtgatttgaagcgcccgtgtcaaggatccagtctagatcaacgggctttccttcatcctgaagagaaacgtgagcacgttcctccttcagtgtcacctccccgtcagtaatgacaggatcggtagcaggggcaagctcgcacacttgcgccatcagcagtgtcggctccccttcgtccgcggcttgagcaggctcggtgatgagaaggtttgcctgagccagtttctcgcggtctcgcttcgccttgcaacagtccttggcccagtgaccaagtttgccacagtaccggcatttgtccttggacacattgcggtttgccgcttgggacgaacctgacttgccgtcggagccgttgccgtcgcgctcgcgcctgctgcggtgtggttgccgtgagctggacgccctccccccggctgagttctgcccagcttccttgtttgagtgagcaggggcctccttttcgctgaagagcacctgacccgcgtcctcgccatcagagtcggggtgatcgtcgacggtgagaagccggccagtcagatcctcaatagaaagcaaggtcagtgtttgatgaaaacaaaacaacgaacacacagaaaatagggaaaccctgtattgcctttttattaatcatgattcattaacatgaatgtttacaaatacatgagggctcctgtaggagttcgccttttgccttcgtgaggaatgcttaatggagaggtatcttgacaggagattccgtgcagtccgctgattcccggcgctagcaatgaggcggccggttaattacatctataggagcgagcctatggaacacctccgattaagctgcgctttgtgatcgtcaacatcaaaatttggttgctcgccgaaggttgaggttggttcagatttaacggtgaatatagtgaatgtggaactgatggctttgttttgccaaaacccagtcacaatacactatcatcatgttagtatacggagggaatttggtgaagcgggtgacctttgcctcatcggtgcccactcatgtgccccggccttcatcaaacatggattttgtgattgcttttgcctcgtcggtgcccagcaacggtatatccagttcccgtccattttagacgtgttaatagtatagtgacctggccttgtcgacactcggccatggtttcatctaacctcgtcggtcatagacaaatggaatgagttaatgactgcagccttgtcagctttagccaatatgttatccggactcgtcggtctcggacatagcacaaatattgataaattggccatttcatctcgtcgacactcggccatgatgtcgacgtgtgttgtaaatctgcatgccttgccctcctggcgagcattgtttttgttgtcttcaagaattttgagagttgctcccatccatctggtagaatttagagagagaaggaattgctcccgcacatgacatgcacaaggcaaatctataattgttccggtatgaatataaatatgtataaatcatggttggtccgatgccgattagactcaaactcatcccaagtttatacaagtaaatatgcacatccgatattttatcatgagcgagaacatcaatatgcataaattatggttggtccgatgccaataaggctcaaactcatcccaagtttataaatatgcgcatccgattttttatcatgaacgagaatataaatatgtgtaaatcatggttggtctgatgccaataaggctcaaactcatcctaagtttatacaaataaatatccaactccaatatttgataacttagacggtccaaccccacgaggatcggactcgtctgcacaccactgatgatattttcttgacgaaaaacaagatcgatctgcttgttattcaggacggacgactcgccggcagagatgccatcagcgccggcggctctctaaggcatattgctgctgagccgcgcagcggtccgccgtctatgtgtgcttctcggtgacgacgtgtaaattgtgtatatgttggatatgggtttgtgaaactataagcagatcagagcacacagcatagttgcctacctacgtcttctcctctgccagccgcctctgcgccggggattttctcccacctcctgcgtcgtgagggacagcgccttatataagagtagaggcgacggagtcctcgcctaatcccttccgagatttcagcaagccagcgaaatcaagcgttaattctctggataagccagcgcgtctgttaatccaacgacctgcgcgtgataaaaagaattttgtgctccagataaaaagaacgtgtgtgtgctggagataatcacgaggattaacttggctaattgacggtggatcccacacctcatagggtgtgtttggataatgggaaatgaggggtgggattgggattaggaaatgaatgaagggttaggattaaatggatgagggagaataaatggttaggatttaaagatgagtgggaaatcatttcctttagacatttgccaaacactgccataaggataattaccaaccggtgaggagcagcaaacaaattaaggatatacgaggttaacactggttgatctccttcaaatgtttatatctccctaatcatatatcaaatatgaattctgttggaaccattattttccaatcaaaacatacaacaaaacgagtccaattttgaatatgtttgaacattgtatgatatttgaattttctggtcccacatgtcgtagagacatgtttcacgtgtatttcgtaaaattgggctgcaaattaatgcccaatgatatattattttttctatgaattttggtataaaaattcatcaaacagtgagatcaatcaaggtttcaatcgatagagccatttggcgatacctccggggaacgacgcgaagcaattttcaaacaaccttctcttcagacagatcatctccaaggactggagacgaaggctgaaatcctccaggtgttcgccattcttgaatcgcatggactcaaaagtttggcgcagcttctgtgctcgggactccttaacacgatctgcgcctactcgcatggatttgagcgcatcccaggcgtctttggcgctgtccttctcggcaagcggccggaccatctcagccggcaccgctcgcaagatggctgaaagcgcctggcaatcttcctgatacgggacatcgccggtgtcgacagcatcccacagaccttgagcctggagattgactcgcatcaacaccgcccaatcggagtaatttgagcgtctgagtattggatagtagacggagccatcttccttaacaatccgctgcacgacgagctgtcgcccgctcacgcgcggcggagacggcgagagccggcggcctgttcgccggtgagtgcgagacgaaccgctggcgggagcggacatggctctgataccaaatgatagcaaagcccaagattgtgaatcctcactctctctctcacgcgaattctctgaattggaaagacgatgaacacgaacagagtttttggtgtcgcgaaccaaccagcgacgttttctgatgctcatatatatagcaaatatgtacagactcaaactgacaccactacgccatcatccacgacgatgcgaccacgacactgaaatccggatgactcgcacacgacgcacgacccggaagactcggcttacaggaaaaagaaacagagaaacagacgccgaaacagagtctgacgaaactgaagaaacgacaacactagacacgttacagtaaccgataatacgacacatgattatagctgaagctaacagaaattccctaatcctttcctctccatcatcaatttcacttgttgaatgccgaaaattgaatctcttttgatgagttggatcttgtctcccggctgttcatcttttctttcttccttctcgatcggtcatcttcttcctctggccagcaggaggccgaagtcccatcagcaggaggccgaagccccatatctcatttcctcgcatgcagttcgaaccagcccgcctgcgcgcttcagctagccccggccgtgccatcacatcaccagccaaatccccggcgaaacccctccatcaattttctccaccaaagccaaaaaatgagtaaccatcatcagtcagtcacctcaatttccatcgtctcagctaaaaaaatgaataaacatcttccggctggccgctcaactccctgtcctcctctataagtagatccagcaccccctccttttccctttgcagaccaccgttcctgccacaccgtgccgtcgccgccgccggtcaacaccaaggccaaggccacctcccatgcatcttcctcacctccggcgacacgcctgcatccctccaccggccgttcgctgcgaacttgcactgccgcctctctctccatcgtcgtccaccggaccatgtcttgctgctattgctgctcactataatccggcctaggttcctgcctcgggacatcgagtagacgcggttgtgttgcagtccgatcgagtgagcaccaatgttgccgctgtcatcgcaagcacgagctgctccatgggaagatcgagccggcatgatggtcgtctcatttccagcactgctaccatcgttgggagatctctcaattaccagcgaatggcgcagcactgttatgccatccacctctgtcgtcttccccacttcctgcgccgtcttccatcaagccatccaccatcgccatcaacttgttgtcaaccacccggcattgctgccacctctctatcgtggtaagcacctgcgccgctttcacgttcttcctccctaatcatcatctagtgtgagaaaaccattttggttatattcgcagatcacaaacaatatcatcgttgcccagtttccaacatagctgccacctcaatgtcctcatcagtggttaatccccggtcctctcccatgtgttgtcgttgtcgccttcgtgcagaggtgctgctgccatcgtggaatggtgccaccctctcgccctcatgatagctgcctaaactaggattcagaactggagacacacaagatatatcgacggggatttccaacgaattccgccgccgccaatcgccactaccaagttctaaatcgataaaaaggtttacaggagttgtgtgtttagttttatcactcccactcactccccacacacgcttacagtctggcacttgggccgaataaccactcaggcttacaatgcccattctggtccacttaaacgaacattcccccttttaagtctactacctctcccttcgatcttctcctccttggcaatgtcagcatcagcacccaacgcagccttgacaatgttccccccttgaaaactggattgcccccaagccagtgctcttgggaaacgagtacgaagatcttccaagtcttcccaagttgcattggcgatcacatcatcagaccaatgtataagcacctgaggaataacagacatacctgacttgcgcaccctagtatccagaatagccacaggaacttgtttagtagaagactgaacaggaagatgaacagaagcatcccctttaaaaccttgagctgctttgagctgcgagacatgaaaaacagggtgaatagagctgctcgccggaaggactaaacggtatgctacaacaccaatcttctcttgaatttcataaggaccaaagaacttgaaactcagcttgtgattagccctggctgctactgaagtttggacatatggctgtaacttcaaatagacccaatctcccactgcaaaagctctaaaacttcttttcttgtcagcttggctcttcataaactgttgtgctctgttcaaatgttgctgcaagagttgtatcattaaccctcattcattcaacaactgctggacatttggaagttcacaagagttaacagtaatgcccaattggttaggaatatgcccatacaatact

SEQ ID NO: 86389 - DNA, 1719 bp, Oryza sativa
gcattctaaataacatataccttgcttccttcagttttttagccagagacggtctcatgcctgggcgagcttatatttcggcaaatgccagtgactaaagcaccataggtgatgagatcaggtgcaacattggttttcatcatcaaaacaacaagatctaaacctaatcttacatctcctttcctaaaaaactgatttataagcattgtatagatgactgtttgtggtgcgatgccctcctccagcatcctttccaaataaccaagagcctttctgattttgtttccctttaccaggccatttataagtgaaccataagcatggggaccaggttgcaaacctctctttagcatttcatcgaaaatacggcacacattccttgtttgcctcgtcaaggaatatccattaataagtgatgtgtaaataatctcatctggtgctaatccttctcgaatcatttggcggagtgtagcctccgcttctttaaggcgcctcattctacacaagcacactataatagaatcatatactgcaatagaaggctctatcccatccttggccatttcaccaaacagatgaagtgcactttctatttcaccaatcttacagtatgctgttaccatgattgaatttgtggacatatcaggtctgacacccctgctctgcataatagtaatgagtgccctagcatcatccatacgattttgctcacacaggcattttatcacgatattgtatgttaagacagagggctcacagccataagccaccagcttccccagtagatagtaggacacatctagcctcccctccgagcacatggcaattatcatcaaattgagaacgatattaacagggagcacattgcttgtcactatttcatcgagaagatggtcagcctccttctgtaaactcatgttcgagcacccaccggcaagcgaagaaagctccagcagcttggcgccacaatccaacttggcaacagccttcaatgctttccgcacaaataaaaccacccagcctttggggaagaacctcgctatcgaaataaacataacatggtcagggaaaaggccactctccagcatcttatcaaacagattctcggcctcacccaacttcccatccttgcagagcgatgccatcagaatagtgtagcacctcaagtcaggtgcaacacccgtccttatcatcaccttgtagatatccatggcagcaccaacccacttgctcttacaataccacctgatcatcacattgtaggttgctgcgtcaggctgaatgcccctgtcaatcatctcatggtacatctggaggccatgatcgacacgcccatgctcaaacaatccccatatcatcgtcgtgtaagcgtacgcatccaactgaacatgctcatcccccttcatcctacggaacacatccagcgcaggctccagccgcccctcccggcaaaacacccggatgagcgccgtgctgagctccctatcgagatacatccctttgatgagcatcagctggcacatgtcgctggcatcgagggagcgcctggccttgcagtatgcgaaggcaagcgacctgtagacgcggacggggggtgtgagcccggagcgaagcattgcgtcgaacaggaagcgggccttgtcgacggccccctcggagcacaggcccgggatgaggagggcgaagtccgagacgggcaacggcgaggggttgcccatc

SEQ ID NO: 86390 - DNA, 5062 bp, Oryza sativa
tgcaaatgggcggcgagggggcatggaattttgcaggcggcccccttgccgccctccgctagggcgattttatactgtgctctatatttttgtataaatatcaatagttatcaaatctttttatattgaaaactatacaagattaaaatctccaagactggtaaaatacaattttattattttttagggcatatttggattgttaccgtacaaatattttgttaccgtacaaatattttattaatttttagggcatatttggattgttagtgccaaatttttcttcacgaccaaatatttggtaaggtaaaattgcatttgatcatatttggtttgctgccaaaatgtaaaattatagtgaagaatgttctacataatctcaaatctagattacgtattaccaatgaataggcttccattttcgtgtgttgtgtgctagtgggaaagaaaatatgaagaggttgccttcagattgtcaattatatagcgtcgttttcactgcaatatatgtgaactcaatgagatacattattcattagatgtgacaagacgatcacgcgtgggcgtgattcactttatgtaaacaggcagcgccgaaagttgatagtgataactcgagctgccgcttttcatgtgtgctgttgtggactgtgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccgtgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtctgcaccgtgcaagtcgtcatcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggcgagggatcgacgctccgtgagaggaagagctggcgaacgcgcccgaagaggtggcgaacgcccctgcggagctcgtggaagcgccggtcgtgcctgcgaacgcgctcgaaggcagacgaggtcctgcgatgaggaaacgtgcagttaaaacatggtgacataatcgtgcaaaagctgaaacaaaaatgaactaatatctgggctgaactgtaccgtgcgaaaccggtgctgtaggtcgcactgatccaaagctaggggcgctcgaaggcaaacgaggtcctgcgaggatggatcatcaagttacgacggggtgatgttttcgtacaaaaacagaaacaaaacttaagaaacctctgggctgagcagtaccgtgcgaaataggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataacaaattcagtagttgtcctatattatgcaagataaatgaaataattgtaagaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaatgttagtacaaaacactcattcggtcgcaaataagcacgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtccacgggaccaactgctgctcccgccagcggtagcccgagcaggtacgacacgtcctgcagtgtcggagccatctccccacagggaaggtggaacgtgtgcgtctcaggtctccagcggtctataagagcggcaaggagtgaccggtctgcatcccaccgcttcgctgggtcacggtcgtccgccgccgcctcaacaagcctacaaagtggtagaaggcctgccgcacgcaacctgtatagagcaaaattcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaataattcgcaatactactagtacaacaatagtcggaggtactcattacaacaacattgaattgaaattacacgatagaagtatttagtccgaacactcattacatcacaacagcattttatttcctaaatcgaaagcattgttacaccatggaatcgcctgctgcgcgacgacgccttggtcttgcgcgcctgcttgttgttccttcaccaggtggtcgcctaccatcacttgcctgtccagatggactagcatttgcgccgcttggaacttctgcattcttcgggcatttcttgtaagtatggccgagcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactcgatgtctccgtgcctttttgattttatcttccatgtactttgtcactacgttgccaaacactatgttgttatcggccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaactagtggtctgcgagattgctcatggg

SEQ ID NO: 86391 - DNA, 10693 bp, Oryza sativa
  unsure (1)..(10693): unsure at all n locations
actccaacaaccacgagttcaatctcggcgtgttgcaaaggaacaagacgcagacaaaaacccagatcgtttggtaggatttgtaggtttggatcctcacgaaccctcggtcctgcacggtcgggatgatcgagaatcaaactctccacgtgacatgaacatgatcaacgggagggcggcggtgaaccatctgctcgagcaaacgcggatcacacccgcactcctgcccaacatctgaacatcgttaactcgatcctaagagaaagccctttcgatacggtcttgcatcccaacggtgatcaatgggttcagcgactttgggagacaatggccaacctgaacagtgcttttgcgacagttgccaaaccaccagccccagacttgccgcatcaaggagatgatgtacatgacggagccgacaccgaagtcagtcaagaccatagcaatcacccaagtcgagatctaggtcgaaatccccgcaatgcttcacctcgtgtccctcgtcatcaaaccccaccgccacaaggtaatcacgatttacgcgatcacttagttgggcgtcagcgggaacaacgagttgacaacaatgctcaccaacgccatcctccgccgcgatgaaacaacgttgcgaatcaaggaggccaccctaacaagaaccaagaccgataggattgtcgaagtcatcatgatgatgaccgtcgagaacggcgagatcgggacgacaatggtcgaggtcaacgacgagataacgatgatcgacgatggcaggagtcgaattctccagcctcccgtcgatatcatcaacaaggacgccgatccaggtgcaacgctccatatccgagcggcccttcgtcatcatcatcttcatcgtcctcatcatcagctagaccacctagaagacagcatggacaccgaccgcgtatcgtaccgggaggaggatgcagagcattcacacccacagtacgagaagtacggtggcctgagaaattccgaccaggagcaatagagaagtatgatggaagcatagacctcaaggagttccttcatgtctattctacagttctctatgctgctggggcagacgacaacgcactggcaaattacttaccaactgcgttaaaaggatcagcccgatcatggctggttcatcttcctcctcgctcgatttcttcatgggaagacttgtggcagcagttcgtcgctaacttccagggaacgtacaaacgccatgcaatcgaggacgacctacttgccttaactcagaaccccggtgaatccttgagggactatatttggcgcttcaacgaatgccgaaatacgatcctcgaaatcatcgatgcttctgtgatacgtgcgttcaaatcaggcgtccgaggttgctacactacctaggagctggcgacatgatgaatcacctctgcacgcaagttattcgagatcgttgataggtgcgctcacacagatgatgccttaagacgaaaagataaagggaagacaggcgaggagaagaaaacaatgaacaaagaagcgccagagtctagcaaaaagagaagccgtaagagcgggaagcgcaaggcaacaaaagaggttctagaacatatacctaattaagatggacttcatcagctaattaaaagaaatataataaagtatacggcacctttgtctaatcctgatcttaattgttacttatcaatttaattagtagacctgcttcctcataacataaacaagatacagatcattcaagtcggcagctccacgtgcatagagccaacctgaattaattaacttattcttcttcttgaccacaatatcagcagcatcaaaatatgtttgctgacaccatggaaaaacaccagcagctagcccttttgatccctcgctcttgccatttttcatgactgaagtacaggaaccaacctaatattcattaaactgtcggttgtaatatttgtgtccctgcatgcgaatcagctataggtgaaatatttagggtagacatggtctcatcacacaaattgtacaaaataattgatgacacacagaattccaagccttcctattccaaaaggaaggaagaggttcccattgaagaaaacgtaccgactagcagggtacgaatttgtaacgtcccgcctcttctaggccgggcccttcctgaccggtcacccatccctaaattactccaagccaagcatgcttaactttagagttctttagaaatcggctttcgaaaaagaagttgcaacttgttatatgagtattctaataattctattaagccttagatcggaatgttacataattgccccttgataatacaacaaacatgtgactagaacaatgcctaagcctaacctataagtaaaggatactttaatttccagtacagctagagcaaaatatggacaccgttagcaaagcagcccccatccacaaaagattttcttaaagaaattatttccggactattaacacattcaaaactatgcaaaattagaatattcacatacctctctcagagagagagatagttaagaccagggttcacgattccgacgaaaaccgatcgaattccacgaaatttcgaggtttcgacgaggctgcagaagccggatttcgatgagtttcatccaaatttaaatttgaattgataaaaaagaaaaaaattaaataaaatcttataaatagtatgatattcatcaaacctattgggatataattttttttaataaattgatgtattccatatatttactaaaatttatagtaggaaagaaaagaataaagaattaaaaaaggaaaaaaaaattagtttacctctttttctagttaccaattgaaattttgatgatttcgctcagaatttcgccaaagccgaccggttttcgcgagcttaggtaaactcagggaatttgtattcaaaatttggtttatgaaatttgttcgaaatctaccggcattccaccgaatttcgcgaaaaccattgttccgccagagcccgaaacataaggccatctcggaatcgtaaaccctggttaagataaacgggataaatgggaacttaccgcgcagtggtggatggcatctgggtcaccaccggagtcgacagcgatgcgttccagctccaggactggcgccagtgtccacatcattatcccgtccaccttagcctcccgcgctgtagccttccacaagaacctttggttgcggcggccattgggagtgggaggaccgtgtgttgggactgaaccaaaacacctagaatgtgcaaagtacaattcactaaccggcaaacatatttcacacaatcaacccatcatcttgccatgaactttgaggatagtttcaactagcaaatcaacaatgcaataacaataaacacatacacacaagatatggtgatttacgtggaaaaacctcctcgatgtgaggagtaaaaaactacgggaccaacggtccactccaagcttccactataatcaacaatgggtacaattggagtcttctctagaacatctagaggcacatctcaatagcaactacaacatcaagttacacacttggcatcatcaacatcaaccatcaaagctaacaagaggtatatcaacaaacaagcagagaaatggcagattttgtcctcttcggttctcagctgagatctctcaaaccacagatgcaaattgatgaaacatggcagaaatgatggtctatgagtcccttccaagctatccaaaaaacagcttaatcggacaccgtttgacccctcaaactgacactttactaattgttgcacaatctgtaatttcagtaactcgagttgataaaccactactcaaatccggtgctctactcaaacatttctcatccaaactggccagattaaagtgctcaaagtgaggaacaaactcaccaagtttggtgccaatccaaccacgtttgagcctctaatcgctgacttgataaagatcgggtaagagccccgagctgaacaagctggacttcttcctctccctctcttgtgtttgttggttatttcttcgatcaaaggctactgctctctctccctccaatggaggctagggtttttcttcctaccacaaggataaggcaatatcaaccattgatcaaggcatgaatcaatggctcacaattattaggcatttttactgcaatgggctgagaacaaaaggtacatgtggagtgaatttagcccaacaccgtggagaggaatcagagggaggagcacaggcggttacgttgcccggagcggtgagcacggaccacggagaggttggagtggcgcggtgcggtggcccgtgaagagtatcctctgccttcacaccgtgaaggcaccagcatgcagtcaagtaatatcaaccgtccaagccaatccaacggctcatcaaggactgtgtaccatttaactcacgctcaactacatttttacttcaatggttatatgggttttgtttctttgacaaaattttgttggtgcagtaatcaagggccgtgctatcacaaaaaacgccgaggtacaaaataccattgctttcaataagcaaaaggcaaaagtacggcgtcaaagctatttttcgcacaaatttttatatgagacccaaatctggttgaatacttaggccattcccaacctaaaacactatacataatttccataaactccacatcatcaagaaactagtactaaacactactcttccaatgcaaacaccactgttccatacttaaatttaatactacttatctcacatgatatcttagatgttgtgtagaaaccatgtctcatgtaaaacatggtttccttctcttttctcatttattcacttgtcatatcattttttcattctaggtggcagcttatttaatgctatggacaccatcctagtcattgggttggaaatgaccttaggctgcgttcgggaggaggggttgtgataccctcctccccggcacgcaaaatggaacatgtattattacatgattaattaagtattagctaatttttttaaaaaaaatggattaatttgattattttaagcaactttcgtatagaaactttttgcaaaaaatgcaccgtttagcagtttgaaaagcgtacgtgcggaaaacaaggatgaggggctaggaacttgaaggaaagaacagagcttaggagaacccatcacatgacatcgcatcctagcggctagcggcttcccaccgacgagttagtgattatggttatatcgattatgagaggcttggcagattgctaattttattgatgctaacgcgatttgaaacaattgcgaacgatccaaattccaaaacaatggcacaaagcattactggctaatggctatagcagtatatacagatacattataccctgacatatccaggaccaaccattcaccgtactgatcaaaatctgatgcacagaatcatcagaaccaatggcccacaaaacaattaattatcctccacaagactaagggtaaaagggatggaaggactcctgtcctgtgatgagattatattctgcagtttattttccaagcagacggcgtgcccgagtgtttgctcccttgatcctgaagttcagttcgtcgtagtccttctctgaatctcccaaagcctttgtttgtctgaatccaatcaacagacaaaaagacatatcacatgatgatttttattggttggactgttaaagcaacaatactcatcagatttaaatataattatgcaaagtgttccagattagatattaggaagtaatttgccgcttgaatttgaaggtactttggccaaactttttactcctttttagttcgttcagcatgaagaagtgaaaatttttaaagaatggactaaacataaactggcagttagtacaaactataaaagtacgctggaattagagcacaaaaaagggattccacataacaatacgccaatctcagaaaaaacaagtgtgtattagtttttatgaactaaagtgaaaaatgtggcattcacctgtcaatctcagtgcccatgtcaaccgccatgcctttcagctcggtcaatatgttacttagatcagataggccatcatcctgctttgccttctccatctgagcaacacaacaagataatcagaatacacacacttagcaaatcaatcaccatatatgtcttagcgcattacctccactttctggagggctgaagttggctcggaatggaattggcgtgcattcgattgaggtgggtgatccgatagtcccagtttgtgcctttgttccaaatggctgcccttccgaatgaaggaatcatctgcatacaagtaattccatccttccagttagttacacagagaacataactgataagtgataccacatagtacaagctttccctgtcagcaactgttgttgcagtctactatttcaagactagagttggagattacctctagttagcataggccccctgatttctccattcttttttggcttccactttttggaaaatatacccccaagatcacccagcagcttctcgctctgaaaaggtgcgaagaattccctttagccattattaccacataatacagtaaatttggagttggcaattaatttctgaagtgtgacacgaagtttgtttcagttttcgtggacttattaaggatggaattctgaaggaaacaggccaattttggtggggacttgttacgccactatgtgatcaaacagaattaatcaggcttctgagtaatcacatagtattagttattagtttgtgttagttaccctggagagatcctggtcgatgtcgagggtcatcatgtgcgtgcgcgtgatctgctggccctgctggtgtatggtgacgaggctcttggacgcggtatccctcatctcctcggcgatgcggacgcagccctgcacccgctgagtggtctcctccgccttgtacgccgcgtagccctccagctcctgcaccgactgggcctccacgccgccggtgtcgcggaagtcgttcctgtaccggctcctcgccgccgccgacgaggcggagaagccatccccgccgccgaagagggagccccgctggtcggccggaggaggcacggaggaggccctcgccggtctctgctccctcccgccatcgtcggagtcggagtcgaaggggttgctgctccgcgacggcttcttggatgcgaagaacgatctcctcccgctcatctcgaaaactccttgggtcagattccgcagcaagcaagtttctgcgcacaaatgaaactgaattgggcaaagatcatcccccgtgccaacttgccaagaatacacacaccaaatcccgattccttataaattccagtaaccaagatcgaccttaactatcaagaaggtccagaaataactgcgcgtacctctgcggacagatcggaagaattagtagtaggcaagaagaacaaggaagagcagcacatagcaagaggatatataacagtagaaagcaagggcggatggtaaaagcgaggacttggtcgcgcgaaggcagaaccgcaatcgcgtgcgttgcctctggaccgctgaccctgtcctcctgctcctcctactcccttcctggcttcttcggcggtagagtgcggggcggggagccagggacacgcgcttctagttggaaacaggaaaaaccgtcgagattaagaaagaatataaattggcgacagcgatggggatggtggctttacgcgcagggactgctacatctctatgtgaaggcagcgaaatcttaactactccatccgttttatacgtaagactttctaacactacttaatatatccgtgctaaacgctacggtgtaattcatttaaaattttatgttagtaattttttttgttagcataaagacgtgaatataaactcaaataacaatatgaatatgatatgatatagatatcaaattaatggtttcaccatgtaaaacaagataacaattgttggtcatcttgttaacgtctacttttaagatatacatggaacaactactaaaatttgccgatggcaaaagtaaatatttagtgagacataagtgttaacacatagtcatgttatcaatccggtgcaaattgacgtatctagaacatgatggtatggagaagataatcacataatattccacctaaatagtgatgacgtgctttacaaaacaagaggaagttggtgagtaacattcggattaacaatttactatcttctaaaatatattttcgaattaattttgatcatgcgaacctacctttgctcaccagttaagaacatctttatacacgatattcttggtgctcttccctgtggggtcaacttctttctttggcttttccaaaatccttgttgttagccttgacacaccccttgacaatgcatcatatagctgaccatgtgaaaacacgggctctggaagatagatcccaacatttgggatggtttgtccttgtgatttgttaatggtcattgcgaaactaagacgtattggaaattacttccttttgaatttgaaaggaagagatatatcatcggagggagataaagggatccgtgggatgaacacccttttgctggcatgttgtccaccaacaatctcagcatcaattgcattatcttggaaagctcttaccataagtctagttccgttgcacaacccattattaggatcgaggttgcgaagaagaatcacaggacaattgatttttactatcagctcgtgtggtgggagaccatttggagtgatagagttaaggtaatccagaggatagctattgtgagggtcatcatcaacagagtcaaagctatgataaaccttggcctgcactggaaatctgtcaatcatattcgcattcagcttatccacataatcatttttagtggatagaatggcacgtgtgctcatataagatgcagagcttgcattcttttcatcatcaagcgagggaaacacatgattaatcaattaatgtactgaatcctcactatccccataagcaatcacaatttcatcaggcaagcgaacgtaatcatctctgatagtgttttcagttccatttccaattctaaggagatattccgaaaaccatggattggattgagccctcatgttacgcgacaatcgtatcttcctaatattttcccataaatacgatctctgcaatgttgcatcagttatctaggcccttgtcccacgtgtaaccacgggaagaacctgtctgaagtcaccgccaaaaacaacaaccttgcctccaaatggcaataaataacccataatgtcttgaagatacctatcaagtgtctcaacagctgacgcttcgtcattgcagcttcatcccaaataattaaggacgccatgtgaagcaattccgcggtgccactttgcttcgtgaagttgcacatgctgttgtgagcaatcttaatagggattttgaatcttgagtgtgaagtacgtcctccgggcaaaatcgacgctgctataccagacgtcgcagttgcaatagctattaatccctcggatcgcactctagcaagaagcgccttgtacataaacgttttgccagtgccacctgggccgtcgataaanaatatctggctcttcttattagttacattatcaattatctcatcaaatcctgcacgctgctcgtcattaagggatgtgtatatgtctagatggtcttggtccactagcacgttaagttcctctataatctctgtcattacgtcgttggtacgttcacctgattagtgaaaacaaaaatatgcgtcatgaaactattgatgggtggtgcgaatgtaaattaataaaaaatatgtgccagtataacaaaaaatacctatatcactgatctcgagaagaccatactccgtgatatcgttccccatggaatgaagcaaatcacgtatatctcgtagcaccatctgctctactgctgcagggttagtgttccctcggctataatcttcagacattgcagccttgtgattgtcccataatgcacggatatcggtgactcacaaaataccagtatggttgcaaataactgacgcagagcagatggcatttggaaagtggatgcctcatttaaacaatcatcatgtgacttgtccgtctccacaagccctctcttctcgcatgcctctctaaatgtagagtacgttgtacctgacattgtcctcaaatcttcaaacgaggtagcacctcgcacatggttgagaagaactctcaagttgtatctctccccttctccagggtgagcgtacacaacccgtccaacttgacctctctgcgttttccttttctgccacacattctgtccaattatccagcgatagtgttcggggaactccttgtatagcaatttccttgcttctgggtctacttgattcattttaaaatactccgtaagagttgtcctagaagaagatggtcgattgacaacatcctcaagattaccatcctcattatacgtgacatactgcatgttaggaagatgaagttggagctgcaaaacagctggatagataccgaacagtgggaaaccaagcatcctatatatagcctctagtggtgtcacatatctggcatttatgtactgttgtatctcatttatttccccagatggatcagccgagaaagatgcacaatcgtg

SEQ ID NO: 86392 - DNA, 2190 bp, Oryza sativa
acgcccgattgagatagattaatctctatcggccgtaaactaaggcccgtcaccgatgactaattttccatctttcatttgaagtttttgtatttgtgagtgcaaaatatatagctgctatgtaataattcattttattagctataatacatattcggatactaaatgatttcaaatggaaatatggtcaacaacaaagttgtagagcctttcaagatctacaaattttattttggtcatttttctatataacttttttcccaacagcttgaaattgaatttgaatatatgacaaatataaacagcaattgtaaatactaaatgatttcaaatggtaatatggtcaacaacaaagttgatcctctcatcaagatctacaacttttcttttggtcatttgtaataaaacaaaattagccatattaatgactacacatatcaagtctttgcaataaaacaataaaacaaaatactccattcattacaatagataagtacaaatgcatcagtcacaaggttatgccttccgtatgatctgaacgagcatatgccacaggctcttggggatcatcgtcacagtcaatgtgaggtcttacatgaagattatggttgtattcttcttcatcgacgacgttgtcaactcctacaattcggcgctttccatccctcacgatgtgcatcttcttgtttgaagggtcttttatgtagaatatctgctcgacctgtttcgcaagtacaaatggttcatcggcgtatcccacctttgatagatctactaaagtgaaaccttccttgtcggctttgacaccagtgcgtagattcacccaacggcagcggaacaaaggaaccgtgaacttgacgtagtttagctcccagatctcctcaatgcggccgtagtatgtgtttgacccaacttgatcctggaatgcatctatacggacgccgctgttttgcactgtgcttttgtcatcttgtttgacggtgtaaaatgtgtatccatttatatcatatccttgccatgtgtctacggtctaagacggtcccatccccaacaactgtactgtctcatttgggacatccgtggacattgtcacacgattcttgaaccattcgttgaaccgagaattatgttctctgttaatcaatgcatcagatcgccccaagttctcatctcggattttcgctaagtgctcctcaaagtatgggccaacttctgttatatgttggagcacaacgtaatgagcctgcgcgtacgacgtttgatctggcctaattcttttccttccgattgtgccaacacctgacaaccttccctcgtgacgagacgcaggaactccgataggatcggcatcggacatgtaattgacacagaactcaatagcctcctcggtcgtgtaaccttcaatgatgctcccctcgggtttagctctgttacgaacgtacgacttcagaactcccatgtacctttcaaacggacacatttcccttagaaaagccgggccacatagttttgtttgcttcaccatatgaacagggagatgaaccattatatcaaagaaagacagtgggaaaaacatctccaggtgacagagggtattcacaatatcggtctgcaacccatctagatcttctggatctataaccttctgtccaattgcattgaagaaggagcacagacgttggatcgtgtgacgcactttcggtggtagaatgcctctgatagcaactggcaagatttgtgtgattagcacgtggcaatcgtgagacttcattccaacaagttttagatcgtccaatttaacatacttacttatcctcgctgaatagcccgatggaactttaatatccttcaagcatgataacattgcgatcttctcatcctttgacaatgtgtggcaggctggaggaaggtacactctacctgtctctgcatctcgtatgggctggagttcactgcaaatattcatgtcctgtagatcaaggcgcacgttcaacccgtcctttgtcttcccgggaatattcaacatcaggccaaccaaactctcacacacattcttttctacatgcatgagatcaatgcaatgacgaacatcaagatctttccaataaggtagccgccaaaatatggattttttcttccacatacccttctcctttgtcttgctacgtttacttttcttcccaaactcat

SEQ ID NO: 86393 - DNA, 6941 bp, Oryza sativa
caagggcacggtggtggcgagggaatgaacgagagggagatggggtggctcagtttactagatggcaatgtcggtttagggaggaagaaccgacattggcagtcaaggagagcgagctggcggtcatcgacgcgtgcagccaaggcggcgacaggtgatgatgccggcagtgtcgggcaaaagtggaaaaggaggggaaaaaagtgagctcttctctttgccgagttggggagggagagggatgggagcgggagctcggcctcacggttttagcaggacacgcgtggagcggctcgggcacgcgctgcagagctcgcggcaggcagcggggccgagcggcagcgtagcgcaggcgctgacggtggcggcgaccgggcggtcggtcacgagtgtgtgcgcgcgcgcgggaacgagcggcacagccgaaaatcgaatggcggcagcgggaaattggcgatggcggcagcgctggcgtgggagagagagatcgaacgagagagagagacagcgagagagaggaagaggacgagagagcgagagaacgtccaagagagggaagggagagagagacagcgctctctctctcggtggtcacgtgcagcgcacgtggagatggagggagctgaggagagatgggccagcggcaggtttcggcccaaatcatcacgagagagataaaatagactttttctggaacttcctattaaggaatttgaggggcatttgagttgggatttgaccaaggtggggctttaaagcgggaattttggtatttttgggatagatttatatttggcggcacgaaggattatttcagaggatttcaaaaagggaagatcattattcaaaaatggaacaagggagatagcggtagaatgccatagatagatagatagatagaaagataggttgataggtagagggacggatagacagatggataggtcgagactcagagagagatgggatggaagagaaggaagaggaggaccggtaaaaggatgaaggaatccaacctatgagggaggttaaatagactttcacagagagatttaattaggaggttttagggttggagtctggattcgaatttcgaggttgatactcggtctcgggagaataggaaggagtcaaggaagggaacaatattcggagacgagtcaaagggtgatggataatttagagaaagagagtgtaacttgggagtttgagtttgactactcaacgagatatgtgggtaaggattttggagagaagtctgaatagaagggttcggacttcgagattattttggaacggaaatcatttcggggagaactcaaggcgaaagggattgaatcttggggtttagagttcaagggtggaagcgatctcgatttgcatattcagacttgggtccgaagttcgagaaataaaacaagggtagattgacgaaccgataaagagagaaagatagatgaatcaaaacctgagaggttgaattcgaatttgagaatcggtttgaaggaaccaaggagagagtttatgacgcgaaggtgaatccctggacggagttagggttcgggcattcgacaaagttcacggatggggttccaggagggaattccgaatagaaggaatcgagcttcgggactatattgggatggaaattttgaggagacgaactttgataacagggtatcgagacaagggagggatttaaattgagatctttggcacaacttagactcaacactcaaagaacgaaaattttcgcaattaggattttgccgaattagtttttaacgtcacgcaaaaagcggagcgttacatccgccgtcgccgcctccaccgccggcggacggatctggaggaagggagggagaggattggagcgtcgcctccatcggctcctcttccattcggatctaggagggagggaaggggcggggccggcaccgtcttcggtggacgcctccgccgtatctgggaggaagagagggagggagcgtcgtcaccgtcagctcctcttcccttctcactgagccgtcgccactcctcttggccgctcctccgtcgctcctcgccgagtcggacagctgtcacctcctccttgcatgcgccgatggccgtcggctcctcctcttctgacaccgacgccgccgccgccacctccttgcgcgcgctgagccgcctacggccgctagctcctcctcacggtagagaccactcatccaaatttcaaaaatcgtaggagagggagagggagagggagaggtagagatagaggtagagagggggagaggataaggatgggtgggtaggtgggtggttgttgggaaaggaaacatataagattttttttagtgagtggtcctattttcccaggcgggcctcttatgtggtccgtctgcaaaaatttggaccactttagaggtcatcctctgaaaataaaagtatttttacagacggatctcttaagggatacgcctataaaaaaatgattttcgtaggcggacgacggtctcacccccggttgccattttcgtaggcagttgtttggttctgaggaccaacccgcctggaaaaaaaaagatcacgtctgcgaaaatattttttctattagtgtagactatcaattcagaattttattttattttgtaaaatttaaaatccaaaactactactctatccttcccataatatagcaacatagtaccagataggacacttaatagtacaacgaatctggacatgcttcaagttcaaacatggtcctccatgagggtgtgcaagtggtcagccgaaccgggcccctgattttccttactctaatgtatttaaaatcatttcgctctctttttttaaaaaaaagatcactcttacttttaaattttttttgttagaatagttttttttagctttgataagtgtttgatggtaatcatgaccaccttagagaactatgactcatgacaccgatatgaacatatgtttcagacaataaagattctatttttttcgcttaataaaaaaataaatgactacatcaagggaaaaaactagctaaatactcatgctttgcattccttttccattccctcaatcactttgggaatggacagtttgcacgtgttactgtttagtgaccctatgtaccaacttcatagtcgcacatgtcaattggtgggtggtgacagattcaccattcatcaccaccactaaaatcttttaaaaggagtatagattatttttctgacttaggtagagctcaccgctaattcattctcttatttcttggcattttctaaacataagacatcaatttgtgtttcacaatggagtctcagattgttaagtacggcctaatgacaaatggaggccctttgcagatgtatacgttttcaaggatagttttatagatatttttattaagacgaataatcaataatttcatatattaaaaagctaacgtagtataaatttcacgtgcctagtactaaggatactcatagtggtaaattcaaaaggaatgaaacaattataaataatttatgggtaaaacttctatatctgtgttttagtgatttagaagttgatgtaaaaaaaataaactatattccaataagaaaacctcaaaatctattacaaatttaagtttttggtcgtacctcatgagccaacaaacaatgaatctgctgtgagcaatggcgcgctccactactctgcctgcacgaggctgacaataactttcaaacggcaaatctacaattgtcgtctagcgctagcagccaagtacaggcaaattcaacgtactagacatctggaattttccaaatacaggcgaattcatcatacacctctggaatttcgggtttattcatacgtttctgcggctgcatctgtgattatgtgaatcagttctgagtaaagggtgtgtttattttacgctaaaattaaaagtttggttaaaattggaacgatgtaacgaaaaagttggaagtttgtgtgtagaaaagtttggatgtgatagaaaaattaaatgtttgaagaaaaagtttgcaactaaactcggccaaaagcatctccagcgacggcttgagcaatgaacagtagtgtttcgtatatcaaggccaagatacgatcatcaacatggatattttcttggtgtctcgtcctgctcgtacgatcgaatggtcgcacacgtttcacatgggataacttttgtaagctcaatgctggggcctgtggggtggtgatctgtctgctgtcttctgtgcaagaagggaagggaactgttctttcttttgtagtcggagcaatggcctagctatttgaatctcctacttcaacttgtttaccttttcagtgacatgcgaaaacgagataaaccgttagcacattaataattaaatattaattattacaaactttaaaaatacatttatttgggttgttaaaggattttttttatatatataaagtttttttttggagaagacaccattaacaatttgaaaagatactcatggaaaataagaaagctgtaatttgaagttgaagaaaataatggaacctaaatcggtatgccaggaacttcaaatacttccttcattttgaaataaccgacaagttattgtctcatgtttgaccaccaattactcttaaatggttgaactgtgataaattttgtgcttgtatttttaagatgccatacatttaataatacgatatcctttttaacatttggaaaaaaatctacataaaaagtgagtgctgaaagtttagaaataaatagtgtccgatgccaattatttaaaaacagaggaaatattaaactactatgctaagggcgtccctcctacttccataatggaagatgaattggagcttagctatgaaaattatctgacagcaaaaatgaatgaattaggttccttattgtagaattagctcagttaagattaagttctagatttggtacaaatgaccatatttatgactaattactttttcaatagtagaggtgtacatatctacatcgagacgtttctgatggctttgtgaatctcaggatatatatatataatgatccagtctatacaaatcgatctagtctatacaaggatcttgtaagttctagtgtgtgtctatgtatttgtaaaggcgagtgtatgtacatgtatgtgagcgtctgtgtttgtaccatgtttttagaagtattaaaaaagttgttagatttacatcaaagattttgtaagaaatgttgaaagttcccgcaaaaatccacataacataagctaccaaagattgcactacgataatactacatccgtttaaaaaaaactcaacataggtaagatgtgacctatcctagggcacatcctatcttatattgagttttttttaaatggagggagtataggccgagtttagttccaaaatttttcttcaaacttccaacttccaacttttccatcacatcattctaatttcaactaaacttacaattttggcgtgaactaaacacacccatagtttaatttaaatgatgtgtcgaagatagcagtagtacacaccaaattaatgggagtagcagcctcatcggctgcccacatttcctaaacggcttattagggaataaaaattaatttatacataaaacgtttgtaaatatactcttagtgacttaaaaaacaatataaaaaactatgttaaaaaatcttaaacttagcttcaaaattaagtttaaaaaaataaattttggctttgactttggcttattaggtcaatcgatggaaccctagaacataagctgctaagaattgtagtcctatgccagctcaaagcaaaacaacccaaaatcatgaataaatgtgatgaggatatcattgactcggatataactatgcttctattacatatcaacaagctaaatgtgcatttgttcaatattaggtttactcattatatatttgaacaaatattactacaccagttttgtatattcacatttgcagaactacttgtgtgtgcaaaagaaaggagagcaaactcacgaagtgtatggatgatcaaataagttgactagggatcagagtttatcacctacgtcatttctcaagctaaaatgtttgacatttctcaagtctactcatacatcaacacaatacttttggtttatataaggcaaaagattaaagtctccacatgttggattcggatttgggtatcctagcaatatcaacttcaaatggaactagtagataatctaaaagaaatctctaggcttatgagtacttgttgtaaagcttatgggtctactttcatatggttttggtcccacattaaatttactcattagttgttaggaatcgacaaaacaaaccacgtacctcatacaatccaagtttgatttgggtcctagacgttgtaattatatcgttggctaagcccaagagggcatacgccctagggcttatgtttttcaattcatatgcagggattagtcttctaggcgaggtcaatcggacaacgtatggttgataaccagagtagaagtggtattacgattgcagggttcggatcatattgatcggaagccagaagccagaagccagatcgtgagtgtcaaattttcaccaaatcaatctaatcaatacctatcgaaagtttgctcatcagtacgtcattctcgatcggccggcggaaaggaaaaaaaagtaagaccaacttgctggaagcatacaaaacgaaccaccgtacggcaccgagttatcgccgccaggtcagttggtttagtgtttgtccttccgtgctagactgctactccctccgttttataatgtaaaactttctagcattatctatatacatatagattttaatgaatttaaacatatacatatgtttagattcattaatatttaaatgaatgtggataatattagaaatttttacat

SEQ ID NO: 86394 - DNA, 9331 bp, Oryza sativa
ctaggcgaggtcaatcggacaacgtatggttgataaccagagtagaagtggtattacgattgcagggttcggatcatattgatcggaagccagaagccagaagccagatcgtgagtgtcaaattttcaccaaatcaatctaatcaatacctatcgaaagtttgctcatcagtacgtcattctcgatcggccggcggaaaggaaaaaaaagtaagaccaacttgctggaagcatacaaaacgaaccaccgtacggcaccgagttatcgccgccaggtcagttggtttagtgtttgtccttccgtgctagactgctactccctccgttttataatgtaaaactttctagcattatctatatacatatagattttaatgaatttaaacatatacatatgtttagattcattaatatttaaatgaatgtggataatattagaaatttttacattgtaaaagggagaaagtagtagtcaaacactccaaacctaaattgcccaatcacaagatatctaccactgtaggctgtagcatggcatgcggttcacgattccatccacatacttctgcccattcggaacccactaggctatctatcgatctgtataaaacgagagacgcatcgacgacgtaaaatctaaaaggagcacatctcactcaggctggccggccgaaatcgatcggcagcaaaggccaaccaaactaagccaagagcgagctagctaagctggttttctgcttgtgccatgggagaagatggcggcgtgaactcttcttccaactctccggcggccgccgttggtctcgtgctggtggtggcgatctgcacgtacctggccgtcgtcgccacccgcaagcagaagcggcggcggcggcggcggccgccggtggtcggcacggcattccaccagctgtaccacgtccggcgggtgcacgactaccacacggcgctgtcccgcgagcacatgaccttccggctgctggtgccggccggccgcgagcagatatacacgtgcgaccccgccgtcgtggagcacatcctccggaccaacttcgccaactacggcaaggtacgcagcgccactctttattactgcatgctcttgtgattctgtaaactgctttactactcctatacggctatactttagtccccgttctctctccctttgtccaattggagagatatttcccgtgaacctaaaatgagaaaagttattagcacataattaattaagtattaactattataaggttgaaaaatagatttacttgattttttaaacaatttctatgtaaaaactttttgtcaaaaagtatcatttaacagtttaaaaaatatgctaacggaaaacgtgaaaactgaagtttggagttgagaaaaaagaactaggcccagtcttttcttcaacttactcgtttttattagcacgttttccaaacggttaaatattgtgtattttgcaaaaggtttccatatagaagttattttaaaaattaaataaatttattttctaagttttaataattaatacttaattaaatatatactaatgagtgcacagaaaatctctctccaaacggatagaaccaacagtcttattactgctactagcataaccctatgtagtcaaaaaggatatttctctagtcaatttgacgcgtacggccccatctaatatgggccacacgtgcgccgcgaacatgttccagcccaacttgtacgtatcgtcacaatcctattcatcctatttattgtggaccatacgttagtcattgagttctcaataaaaaaagaaacgttagttattgtctttgatctaacacaactatcatgggcccaaatggattatcctaaaaatctactcgggtggaagaaagaggttgtgggcttgtggccacacaggccgcgacgttgacaacagcagcatagtgtggcggaggagagaaccgggacttccgggtacttgcacacgagtacttccgggtgtttgcacaccatgcacgaagagataaaaagagaggtgaagagccgaaggagaatgatgggagtagaggagaggaggaaaacgctataagttatggtacccggcaacccgatcaaataagtgggtaatctattggtcaatccatttaatttatttataaatagatttacgggttgatccattcatacctttttaattgtaggcagctcgatatctagctaggtaacagcgacgatatacatacccggttagtcagttacgagcgtgacactcgaaaggaaataggcaaaatttgttacaggatcctcaaaaactgtgtaatttgctggtatatatcataaaaacgtgccacggcttaaagacacttaaaaaaactcgtaatttgtccacggacacttttggcttaattgaagagagattcttcgaaaagacaagaatgcccctagggtcaaaaagcttttgagctgagattggagcaaagatgaaatataatatacactagtgatatacttagggtgatgacaaacttaaagttgcataattataaatgtttactgtaacatcatgtttgtagcatttggtactagaggcattcatgttgatcccaaaccagtcagctttgcaagcagccatttgaggctgctagctaggccggtgcggttcatgtttgtggatttgttgctgccctgacacgtatggtttctgtgaaaaatactaaggggtcgtttaaccacgggaacatgagcgacctgttcggggatggcatcttcgccgtcgacggcgacaagtggaagcagcagaggaagatcgccagctacgacttcaccaccagggccctccgcgacttcagcggcgacgtcttcaagaggaacgccgccaagctcgccggcgtcgtctccagccacgccgcgtcaaaccaatccatggacttccaggtaatcaaccgatcgtaactatcgatggcgccagtggtgtgttgtgtttgtatcgccattgaggacgtttgttcggttgtttcttcagggtttcttgatgagagcaacgatggactccatcttcaccatcgcgttcggccaagacctcaacacgctggacggctccggcgaggggcgccgcttcgccgcggcgttcgacgacgccagcgagttcaccatgctccgctacctcaacccgttctggaagctgtcgaggctcctcaacgtcggcgccgaggcgatgctcaaggagaggatcaaggtcgtcgacgggttcgtgtacaagctcatccgtgacaggtccgacgagctctccaacaccaaggcacacgacactgtaagcactacctgatatgtccaattgtccatccattttgtgagtgatcaaacacttgaaattaaggtgaactttttgtgtgcaataggattcgaggcaggatatcctgacaagattcatccaggcaacgactagcgattctgggacggttgattacaagtacctgagagacatcatattgaacattgtcatagccggcaaggacaccacagccgggtcgcttgcttggttcctgtacatgatgtgcaaacacccggaagtacaggagaagatctgccacgaagccatggaggccaccaacgccggcgaggccgcttccatcgacgagttctcgcagagcctgaccgacgaggcactgaacaagatgcactatctgcacgctgcactgacggagacgctcaggctataccctgcagttccactggtaattaattacgatcacaaagttaatcaaacgaaattaattctcttgcccaatgccaaatgaatcgaagtatagtaacaaacgtagtgtcactttgtttctgacgatgtttcaggataacaagcagtgcttctcagacgatgtattgcccaacggattcaacgtcagcaagggggacatcgtgttctacatcccctacgcgatgggccggatggagagcttgtggggcaaagacgctgaatccttccggcctgaacgttggctcgatgagaacggcgtctttcagcaggagagcccgttcaaatttacagctttccaggtgaaatttactgaactccaagaatctttctgagttccggttacccacttctgaaagttttctgaactttgtgatgagacaattctgaattctgatcacctgctccttctgtaggccggcccaagaatctgcctcgggaaggatttcgcgtacaggcagatgaagatcttcgcggccgtgctgctccgtttcttcgtgctcaagctgcgggacgagaaggagatcatcagctaccggaccatgattacactctccgtcgatcagggtctccatctgacggctatggcgagatgagggcacacactacagtctgggcacgcacagcagctggctcctgtactcatgcaagtgatagctccttgtgcataccaaaacgaacgagatctgcaaaccttaattatgtctgatcgtgaataacccgcattgcaccctagaataataagtgcatctgaactgcagtcagggtcagagtaacttattggagtgaactggtgttgtagggaacttcaattgtacaacttggagggcgcaatacaaatgaatggattaaatagtagaaagttgattttaaaagggctttcaacaaatgctgatgatttttttacaaaattgtaatgtttttatgagcttggaaaaggtaagtttggaaaaataaaaaaagataactcaaaactcatggcatcagcttgcattgagctcggcttagttcggctcgaactcataatcaactactttggttgcgttcggcactgcttgttaccatcctctactctctcgtttttcatacacatgttttccaaactgcttaacggcgtattttttgcaaaaaaaaaatctatagaaaagttgttttcaaaaattatactaacccattttttaagtttttttagctaatatttaatttttcgtgcaataattcatcgctccgtttttcgtgcagaaaatgagggctgccaaccctcactcaagaactctgccttagtttggctcggagtaataataataagtcaagctgatgtgggatttcaagtcgtgagcataacaagccagctcatgagctacttgtttagttatcttcgaatacttagttctttcagttacaataaatcaaagttttgtcatcggcaaaaactcaaatatatttataataaatctataacccaagttgacaagaaataaggtgattctcatttttagtctggtcttatgaatgtcaaaagtactttcttaaatatgggtttttggattgtcaataatgggaaacaaattagattttggaaagataaatgaattggtaacttggcttttaaagataaatatccatctttgtatgcaattgttcggaggaaaacatcttctattgccaccgttatgggatcgatctgttccgcttaatgtttctttcaggagagctttagatggtcataatcttgtttgttggcatgagttgtgtgcctctatagtacatattcaattgaatgattcgtatgatagttttagatggaatttcaatcagaatggcttgttctcggtgagatctatgtaccaagctttaattaataatggctatatcgagagaaacaattgtatttggaagcttaaattgccacttaagattaaaattttcatgtggtacttgcttaaaggggttgtgttaaataaggataatttggcaaggcgtaactggaatggcagcttaaagtgttctttttgtttaaagaatgagtctattcaacatctctttatggattgtcattttgcgaagttcctatggagagcagttcagttctcttttggttttattcttccagttagcatatctcatatttttaatgggtgacttttgggagttgataagaaaatgagtaaactgatacttgttggagcttctgccatttgttgggcaatatggctgagtaggaacgatatggtttttgacaaatcaccatcattttcctatatgtaggttattttcagggcaactcattggctccggttttaggcacaactacaaaggtgtgatgaagatgaagagtttctgaaagttgtatgccgaaagttggagaccacggttgtcgaggagtgatcctctctagcgggagatcgtgagaacccccccccccctcatgagttcagccgggggaagaagctcgcctctagaaatcgcatatccgtccccaaggctcctagctagctcgcacacaaccaaattatacaggttcgggccgctatgaagcgtaataccctactcctgtgtatgggatttagactgagagttacaagggttcctaagctcgggagaacactcttacttccctcctccacaagctcagattttctgagagtcgtcccctttctcggtgggcaaggtccaccttttatacctcaaggggataccacatgcaccacctctacctactcttctttcgggtggggacccaccctatcttgactggaactcgaccagtgccttcgcctggaagctaaaccacagcttgtccttgagcggggcccagcgccgtccctcgcctgacacgggggacagccctgttattccctcattaataggtgaagacttgtggtggccgccgtccgaatgaccccctgatgggacgggtcatacctacctccactccgccggaagcagatgcgacgtgggaacacggttgtccgtccagtcatacgtgaccggcgtcaggccggtcacagaccggtcattcttgaccatcgtgcatcagtttagcacgccacacgtctgccccactgcattaaatacgacagggggcagttggggcgctgcgcgcattaaagtaagtttagcctgggccccctcctcgcttgcttcccccgccaaacagcggctaggcgagggcctaggggcaaagcagtgcaagggcccgaggggcataacgtggcaccccgaggccccgaccccccggccgctcctgcggttcacggaatgcggggacaggaccaggctgtagggacacgtggcaggatgggaaggtagattcccctcacttcgcataccctcgggcccatatctccgacaacggttatgcaactttttgctaattatggtttgagattttcaaatagacttcaataattgtgatctccttacgttaggctggtttctttgtttttcttttcggtgtgttctattcatttagatttatactatattattgaaagctactatgtaataattggttgtagttcttttgagtaaaggccggaatattatattccattatgtaaaaaaaactcaaattctaagtgttgccattaatgaggacatgtttcagtaaataccatcctataaacgattttatccaacaaatgacatcgccatcaactttctagtagcaaacatctgttatgatgttgtgcaaaggccattttaccccccacgtataacacgtactccctccgtcccaaaatgtagctatttctagcacagtgtcttgtcccaaaataaatctatttcttcacctacctcctcctctcaaccaatcacaaccattcttcttcacctactttctcttctcaaccaatcacacacttcctccaatcattctcacctactttcttaatacccgtgccaacctcaaaaatggcttcattttgggacggaggaagtagttaccttattactacaaggcccagatctgctgctacattgcctcgtccggcatccctgccatcgtctcgaagcctagaagcattgtgccactgctacctcgaagagccagcccaacaccactcagacagccacactgtccccacctaggctgtgtttagatccaaagtttggatccaaacttcagtcctttttcatcacatcaacatgtcatacacacataacttttcagtcacatcattttcaatttcaaccaaaatccaaactttgcgctaaactaaacacaaccctagattcatcctgctactgcttggaagttggaaatgccacgccaccatcttcctcgcctggatcaactgcactgctgccggatgcaaggacctcgcgacccttgccatcctagggtctctgccatgtcaccattactgtgaacaatgcaccgacgccgagcccacctccactgtttcactcatcgcctctgccgacaccttcctctgcattgccgtccatccctattaatgggatccggatctggtttttatcaatcctgccccgctgtccgccattggttaattatttttgtgttccattttacctagatatgccaatgccaaaaacacctatgcaccttgggacatgggtcgtggcccaagtagcaatggactgccttttgtataactagaaatttcgacataggaaaaagtacaccgaaggtccctcaacttgtcatcgagttacaaaatcatcccccaatcccaaaaccagatatccggcatccattaaccaatcaaaaccgattacaataggtcctttggtggttttggacccagttttgtcctacgtggcggcagagtcagcgtgggacctttatgtgggccccacgtgtcagatgccacgtcaatctcttttccttcctcctctctctttctctctctcactcttctcttctcgttcgacgccgtgaggagggcatggcggccggcggcggagaagcacacgctcttggcgatgccactgccgccgaggaggaggaggtgaggcggcagcccggcggcggcggcggtcacatcgtccttgccgaactgggtgctcttgtcatcggagtggtggcgcttgcgaggggatgcgccggcggtggtggtgaaggaggcgaagcgatgtactccagcaggcgaagcggcggcgtcgacgggcgagcgcggtggcggagtggcggcgtcggtgggcgagcacggctgcggagaggcggcgtcagcgggcgagagcggcggcggcggcgggcgagcgccgctgcggatggggatgcatcagccttgtcgtcgtcgacggctccaggcgaatgcggcggccgcttggattgtggcggcacgggcgccacgccgccggcgacgctgttcgaggtcacgctggggaagggcggcggcggcggcggcgccggtgacctggactactacgacgtgagcctcgtcgacgggtacagcctgcccatcgtcgccgtcccgcaggccggcggcggctgcgccaccaccggctgcacggccgacctcaaccgctgtacgtaacgtgtcacacatccatgcgtcatgcatgcatgtcgtacatggcgaacgtgtttgtgctgcatgagcatatgtgcagcgtgtccgaa

SEQ ID NO: 86395 - DNA, 3421 bp, Oryza sativa
cactcactcctcaaccaaacacccataaaagtagattcgttccatcccatcccatcccatcccatcccctcaccaaacactacctctagcttctggtgtttggccatcacgcgtcaatgattaagtatatcatctgtgtcttaataattagcttccgcagatctgtttggccatgtcgacaagctggcacgattcgccgatagtaggtttaccctgagcaggagattgactgacgaagctacaaaggcatctgtttcccttggacagctcaaggcctttgcgtgtcgctccgcagcacgcggcaatgacagcaggatctcaactaggatttgttggattgaaagcatataaacagcgatcgctaattgtgtttaatagggccgtgccgattagatcgtcacagctgggacttgcttccgactctgcttgcagtgtgatcatcaacaccagcaaaatcaaacccctaggtgcccgggatttgagcaccatatgcctctctttctcctgttttgcgagcaaaatcgatctcaaaatgtctatctaactctagggcgtgcgaatgtgattgtgcatcacctagcctttttatagactttttaatgtcgatatttaatttgattgatgtgcatatatgctagacaatgaacctgactgctgcctgcaaggatggcaaaaagcgcatattaatggcgtacgtacaaatgtacaaataaggcaaattaattataattaatacaaattgattatatttaatgccaaaaagatacactatccccatttctcagggttgctgtctttagagcaaggctaataatacaaccgacctgctagttagggcatcaccaatgtatatgacaaaagtggtctatatagatgggacccatataaataaactttaactatagcaatccttacaatgtatatggatacaatgtaatattaggagaagagagagaagtagagatatataatattatttatgtcatatgggtagtccatatgcatatggataccttttgctatttcctttatatggactagttgcacaatgttactagatggctgaatggaatagtttattccctatggactacttttgtagtatattgtggatgccctaaggtttttttagccttctcttatcctactcatataatagttagctctttacaattaatatagagcccacttttttctctcacagagtttcttggttcttgtgtccaagccgactgtaagtttacagctcgcttctcctctctctcctctattctctcatccatctcagcatttagccggcttatagtctactattatacttgctcttagcgagcacgcggttccaatgaacactttactttctctcttttatgttttggattccatctcttctttctatttgccatttacgacccgagaattctcaagtagacaagataagtcacaggatatgtcgatcctcccggtttatttctcgttcacaatgaacctagactgctaccaaaatggcagcaagtgctatgatcgttgctatcctacttaatggcgcacatatgtgtgaaaactgcaaataatatgaattaattggatttaatgcaaaatagatatgcctatccccatccatgtttcgcatattcaccataaccctcggctcgtaggacggagcagactacaagcgacaacgtactacagaggaggcggcaaaaaccctagattttgtttttgcctatgtgttgcgaggagatggcgactcgatttatataaagataacaagacacgtaatcaggatacctgcatgatctccataacatataaccgaaccggataagtcgcaagtaacatatccggactccacgccgctagctgcctagctccatgcaccggattattcagagtgttttcaaaagactatgtttccaaaaacaaacactaaatttcgcagcaaaacaaaacagtaaaaaaaagatacatccacgcaaggatgagaaactaattatggcggaccattcacgctcacgtcgcgtacacgcgccacctggcctagccaggcgagcgagcatgtgtgtgtttctcttgtcctctccaccacacatgcctcaacctaagtggctaggagagcactctccctttgaaggaggtcaccatctcatataataggtaaggttatactaaatatcctcatgcatatatccccatgaggtgggattttgtgatttttcaaagaattaatctccaaatagaccttagcctatatatgaattctaacacttccgttgtagggtagataccagtctcaaattgctgttctccataggatggcccatggctagcccccatagaaggatgtcgcacagagacgccgacgtcacctatgatgccaccgaccaacttaatctcactacaggtagtgacggcggcggcaacgtcccagcagctagacctgtcgccactagcctcggccctgctagctgtaacgccccgattttcgttcgggattaaaaatcatttaataatgcattttttagaaattaaataaaagttaaagcaatttaatcaagtgaaataatgggagaattaaaattttcctttaaaaatcattggccaagaatattttgtaatattctttgttacctaaaatactctccggatttttccgcgaattttcggagctcaagaagtaattttaatagcactaagttcattgaatcaattaaataaaaagaaaacaaattaaaatcatccttcctctctttgggcccctttcggcccaatccctcctttccccttctcggcccgcttgcccctctccccttcccctccttccccctctcgggccgtcggcccagctcgctcccccttcgcaagtctattttgcctccctctcccgtctctctctccctctcttcccgacaagtgggacccgtggaccccacctgtgatcttcctcttcctccttcggccagccgccatggccaccgaaaccgccccactctgccgccgcgcccatgctcccgcctcctccgggccacgtcggccacgcccgcgcatgcgccgcacctcccgcacccactctccctcccgctcgcccgcacctgtgcccgagacggccgggattcgaaattcgaatcccgcctctctctccacctccacctccccacgttggccggcgaaatcgggccactcccggccgttcccgacctccccgcccctataaaatccatccccgcatcctcctcccctcttttcctttttccgccggcctctcccgagctctccatcgctcccgcaccgtgcacgcggccgcctctaactgctgctcccactactccggccgcctctaaccgctgctaggttcgtcgcagcaccgcaccgctaccgccgttgggttcgtgtggtcgaggtccacctcgtccacccctcc

SEQ ID NO: 86396 - DNA, 800 bp, Oryza sativa
cagtagtggtagctgtataaaccagatgtagaggcgagggcactagtcagcagcagacgagacgaccggcgatgaagatggtaaggccaatcaacactggcagaatcatgcagccatggaagtgaagaaaccagtcggcagccatggcaaacgtaggcagcttgtgttgaagatactgatgcctattagtagtgactgcgatgtagccagccgtgaagaagatagcatcagtcggcgttataacaggccagccgtgcaggcggtgacaccagtcagcggcggatgcggcggccggtcggtgaagacgtagacgcccaacaacggcagcataataggccagccgtgcaggcggaaacaccagtcggcggcggtcgaggcggccggtcggtgaagacgtagacgcccaacaacggcagcataataggccagccgtgcaggcggaaacaccagtcggcggcggtcgaggcggccggtcggtgaagacgtagacgcccaacaacggcggcataaaggccagccgttcaggcggaaacaccagtcggcggcggtcgaggcggccggtcggtgaagacgtagatgcccaacaacggcggcataaaggccagccgttcaggcggaaacaccagtcggcggcggcgaaggcaagccggtcggtgaagacgtagacgcccaacaacggcggcataaaagccagccgtgcaggcggaaacaccagtcggcggcggcgaaagcaagccggtcggtgaagacgtagacgcccaacaacggcggcataataggccaaccgtgcaggcggaaac

SEQ ID NO: 86397 - DNA, 1763 bp, Oryza sativa
gccctattggcacaggtgggtgcgatgtttttcaccgaaattaaaaagttgaaaaagcaccaaaacatgatttttggacatatttgagtgttttgggtgctttcgtggcaaaaagtcacttcgtgattcgtttggcacttttgtcaattaatgccagtattggcgtatatttgcacaggtgggtgcgatgtttttgacaaaaatgaaaaagttcaaaaatcaccaaaacatgatttttgaacatattggagtgtgttgggtgcattcgcggcaaaaaatcacttcgtgattcgcgcggcgaactgttgtcaattgatgccaatattggcatatattggcaaacgtgggtgcgatgttttacaccgcaatgaaaaagctcaaaaagcaccaaaacatgatttttggacatattggagtgtgttgggtgcatttgtggcaaaaaatcacttcgtgattcgcgcggcgaacttttgtaaattaatgccaatattggcacaggtgggtgcgaggtttttcaccagaatgaaaaagttcaaaaagcaccaaaacatgatttttggacatatttgagtgttttgggtgctttcgtggcaaaaaatcacttcgtgattcgtgcggcgaacttttgtcaaccaatgccactattggcatataatggcacagatgggtgcgatgtttttgacaagaatgaaaaagttcaaaaatcaccaaaacatgatttttgaacatattggagtgtgttgggtactttcgcggctaaaaatcacttcgtgattcgcgcggcgaacttttgtcaattgatgccaatattggcatatattggcacacgtggatgcgatgttttacaccgcaatgaaaaagttcaaaaagcaccaaaacatgatttttggacatattggagtgtgttgggtgcattcgtggcaaaaaatcacttcgtgtttcgcgcggcgaactattgtaaattaatgccaatattggcacaggtgggtgcgatgtttttcaccggaatgaaaaagctcaaaaagcaccaaaacatgatttttggacatatttgagtgttttgggtgctttcgtggcaaaaaatcttttcgtgattcgtgcggcgaacttttgtcaactaatgccactattggcatataattgcacagatgtgtgcgatgtttttgaccggaatgaaaaagttcaaaaagcaccaaaacatgatttttggacatagtgtagtgtgttgggtgcattcgtggcaaaaaatcacttcgtgattcgcgcggcgaagttttgtcaattaatgtcaatattggcacaggtgggtgcgatgtttttcaccggaatgaaaaagttcaaaaagcaccaaaacatgatttttggacatatctgagtgttttgggtgctttcgtggcaaaaaatcacttcgtgattcgcgcggcgaacttttgtcaattaatgctagtattggcatatattggcacatgtcggtgcgatgtttcagactggaatgaaaatgttcaaaaagcaccaaaacatgatttttggacatatttgagtgttttgggtgcattcgtggcaaaaaatcacttcgtgattcgtgcggcgaactgttgtcaattgatgccaatattggcatatattggcaaacgtgggtgcgatgttttacaccgcaatgaaaaagctcaaaaagcaccaaaacatgatttttggacatattggagtgtgttgggtgcatttgtggcaaaaaatcacttcctgattcgcgcggcgaacttttg

SEQ ID NO: 86398 - DNA, 1865 bp, Oryza sativa
gctttttaagtttttctttccggtgaaaaacatcgcacccacgtgtgccaacataggccaatattgacattaattgtcaaaacttcgccgcgtgagtcaaggagtaattttttgacacagacgcacccaattctcttcagtatgtccaaaaacatgttttggtgctttctgaactttttcattccggtgaaatatatcgcagccgcgtgtgctaatataggccaatattggcagtaagtgataaaagttcactgcgcgagtcacggagtgatttttcgacacggacgcacccaagacactccaatatgtccaaaaatcagttctttttgaactttttcattccggtgaaaaacaactcacccacgtgtgtcaatataagccaatgttggcattaattgacaaaagttcgtcgcgcgagtcacggagtgatttttcgacacggactctcccaccatactccaatatgtccaaaactcgtgttttggtggcttttgaagtttttcattccggtgcaaaacatcgcacccacgcgtcccaatataggccaatattggcattaattgacaaaagttcgccgcgcgagtcacggagtgatttttcgacacggactcacccaacatactccaatatgtccaaaaatcatgttttggtgctttttgaagttcttcattccggtgaaaaacatcgcacccacgtgtggcaatatatgccaatactggcattaattgacaaaagttcgccgcgcgagtcacggagtgatttttcaacacggactcacccaacatactccaatatgtccaaaaatcatgttttgcagctttttgaagtttttctttccggtgaaaaacatcgcacccacgtgtgccaacataggccaatattgacattaattgtcaaaacttcgccgcgtgagtcacggagtaattttttgacacggacgcacccaattctctacagtatgtccaaaaatatgttttggtgctttctgaaccttttcattccggtgaaatatatcgcagccgcgtgtgctaatataggccaatattggcattaagtgataaaagttcactgcgcgagtcacggagtgatttttcgacacggacgcacccaagacactccaatatgtccaaaaatcagtactttttgaactttttcattccggtgaaaaacaactcacccacgtgtgccaatataagccaatgttggcattaattgacaaaagttcgtcgcgcgaaacacggagttatttttcgacacgaacgcacccaatacactccaatatgcaaaaatcatgttttggtcctttttgaagtttttcattccggtaaaaaacatcgcacccacgtgtgccagtataggccaatattggcattaattgacaaaagtttgccacgcgagtcacagagtgatttttcgacacagacgcacccaattctctacagtatgtccaaaaacatgtttgtgtgctttctgaactttttcattccggtgaaaaacatcgcagccacgtgtgttaatatatgccaatattggcattatttgacaaaaagttcgtcgcgcgagtcacggagtgatttttcgacacgaactcacccaacatactccaataagtccaaaaatcatgttttggtgctttttgaagtttttcattccggtgaaaaacatcgcacccacatgtaccaatacgggccaatattggcattaattgacaaaacttcgcgcgcgagtcacagagtgatttttcgacacagactcaccaaacagactccaatatgtcaaaaaatcaagttttggtgctttttgaagtttttcattctggtgaaaaacattacacccacgtgtgccaactatatatctatattggc

SEQ ID NO: 86399 - DNA, 1927 bp, Oryza sativa
caccaaaacatgatttttggacatattggagtttactgggtgcgtttgtggtaaaaaatcacttcgtgattcgcgcggcgaacttttgtcaattaatgccaatattggcacaggtgggtgcgatgtttttcaccggaatgaaaaagttcaaaaaccaccaaaacatgatttttggacatatttgagtgttttgggtgcattcgtgggaaaaaattacttcgtgattcgcgcgacgaactttcatcaatttctgccaatattggcacacgtgggtgcgatgttttagaccggaatgaaaaagttcaaaaagaaccaaaacatgatttttggacatattggagtgtattaggtgcgttcgtgacaaaaaatcagttcgttattcgcacggcgaaattttgtcaattactgccaatattggcacaggtgggtgcgatatttttcaccggaattaaaaagttctaaaagtactaaaacatgatttttggacatattggagtgtgttgggtgcattcgtggcaaaaaatcacatcgtgattcgcgcggcgaacttttatcaattactgccaatattggcacatgtgggtgcgatgttttagacaagaatgaaaaagctcaaaatgcaccaaaacatgatttttggacatattggagtgtattgggtgcgttcgtggccaaaaataacttcgtgattcacgcggcgaacttttgtcaattaatgctaatattggcatatattggaacaggtttgtgcgatgttttagaccggaatgaaaatgttcaaaaagcaccaaaacatgaattttggacatatttgagtgttttgggtgttttcgtggcaaaaaatcacttcgtgattcgtgcggcgaacttttgtcaactaatgccactattggcatataattgcacaggtgggtgcgatgtttttgacaagaatgaaaaagttcaaaaagcaccaaaacatgatttttggacatatttcagtgttttggttgctttcgtggcaaaaaatcacttcgtgattcgtgcggcgaacttttgtcaactaatgccactattggcatataattgcacagatgggtgcgatgtttttgacaagaatgaaaaagttcaaaaatcaccaaaacatgatttttgaacatattggagtgcgttgggtgctttcgcagctaaaaatcacttcgtgattcgcgcggcgaacttttgtcaattgatgccaacattggcatatattggcacacgtgggtgcgatgttttacaccgcaatgaatgccaatattggcacacgtgggtgcaatgttttagaccggaattaaaaagttcaaaaagcaccaaaacatgatttttggatatattggagtgtgttgggtgcattcgtggcaaaacatcacttcgtgattcacgcggcgaacttttatcaattactgccaatattggctcacgtgggtccgatgttttagaccgcaatgaaaaagttcaaaaagcaccaaaacatgatttttgaacatattggagtgtgtttggtgcattcgcggctaaaaatcatttcgtgattcgcgcggcgaacttttgtcaattaatgccaatattggcatatattggcacacgtgggtgcgattttctacaccgcaatgaaaaagttcaaaaagcaccaaaacatgatttttggacatattggagtttactgggtgcgtttgtggtaaaaaatcacttcgtgattcgcgcggcgaacttttgtcaattaatgccaatattggcacaggtgggtgcgatgtttttcaccggaatgaaaaagttcaaaaaccaccaaaacatgatttttggacatatttgagtgttttgggtgcattcgtgggaaaaaattacttcgtgattcgcgcgacgaactttcatcaatttctggcaatattggcacacgtgggtgcgatgt

SEQ ID NO: 86400 - DNA, 1746 bp, Oryza sativa
  unsure (1)..(1746): unsure at all n locations
attcgagctcggtacccctatctggatcccaaatgattttgtgagcatcacggtggtgtcactgtttctgctaattgtaagctgtagcttctctgacctaacatagtcatgtaatctcagagtatcgcagcaggagaaagagcggaggagaaggtgggcccaacgaagaacatcctcaaaaccagataaaaaggagcctctggaggtagaagataaagacatcaaacagaaggcagagaatgaagaagatgaggagagcgaggagacccatactatgcctggcatgctccctaccaatgttatcgaaatgcttgcagcacgtgagaagtatgtgtacttcccttgcaccgtattcagtttttttttgttttttttttttcaattttgcggacttaattggttactgtcgtccttttctccttcaggcaaaccttctcatctgactccgaggaagagataacaaatcagaaggttcagaaaaggaagaagcggttgaaatcttccgggtacttttttcatgtcttgcagtctcatatgaattatgtggaaatgttacttatgctagttcttttgccaatgtttgtcaggcctgaaacaattctgttgaaagacgttcgctcgacacagcatgtgaagaatgcccttgctttcctggagcaaaggaaaaaccaggtgccaagatccaatgcagttttaaagaacgcgaacaaagctttgcgcctcctttcatcgaagggcaattttttgagttgaatatggtaattgcgagagcaaaggattttctcaatttgctgttaggtatgtgcttcggaagacatttatgtttcagagggatggtcttttttgtgcttttatttgagatgaattggctttcacatcccaggcgcacaacgggcatatcgatgagcatgaaactgtacaatacgaatgtttgcaaatgtaatatgtatggtgcgtcagtatttgacaattctttgggcatgagtaatttcttatatggaatattattgttcattacttctttgctaaagaaaatgggaattgttcagttaaacccgttgacatgaattatttggaaacttagcaaccaatcaaatgaggatggcatggacatccggaggtttgcatccacatgatgttaattttacttctgacttcaattatttttcaactcgtgtaatattaatttgtactccatctgtccctaaatatttgatgccgttgacttttttaaagatgtttaactgttagttttattaaaaagtttaggtaattattaattcttttcctatcatttgatttattgttaaatatacttttatatatacatatagttttacatatttcacaaaagtttttgaataagacgaatagtcaaatatatttaaaaaagtcaacggcatcaaatatttagggacagatggagtaatattattggtgagcggggtccccttgtttttggccccaggatttccaaaccaccttcagggtgtacttaacttggttggccgtgaaccaaatttgcttaaaataaaattcttttctaaaaacccctaattaagctaccaaaatcttcagctcattttccatttgtttatacagcatcaggatatattatgccggccgcggctagatgatgtctacaccgtagggtgcatgtgccggccgcaccacccacaggttttatctgatgccgtgaaggtcantgtgaggcangcgccattgcaccgactcgaacacacgaac

SEQ ID NO: 86401 - DNA, 7856 bp, Oryza sativa
tgaatggatgactcaaggatgggtgttttatactgacttaaaggtgttaaatctgggaagctattaacttattttaagccttgattgggtgattggtattatccctttccgggtgaatggggtaaacaaccttctttgccagctttctggaaaaaaggatccattcctttacagggtttttggtcaaaaactaccagggtcttcaacctttttttaacaagttttggaatttaaaggataaccaggcatttttcaacctaatcaattgtgcccactatcaaaatcttcaaaccaagaaccaatgccagtggaaattcaacaagtgctagcagaatttgcacaagtgtttgaagaaccttctggattaccaccgttcaaggtttttgatcatacaattccactcatgccaggagctactccagtcaatgtgcccccctaccggtatacacctgctcaaaaggatgagaatgaaatgccagtcaaggaaatgttaaccaagggtatcattcagccgagttccagtccattttcatccccaatgttgttagtcaagaaaaaggatggtaccctgcgtttttgtgttgattacacatttgaatgccatcacggttaaaaataaataccctcttccgattattaatgagttgcttgacaaattgtcaggggctcattggtttactaagctggatttaagagctgatgaacataagacggcatttaaaacccatcatggtcattttgaattcagggttatgccgtttggtcttactagtgctctagcaacttttcaaggctgtatgaacaatgtcctatctcctttgttgcgcaagttttttctggtgtttgtggatgatatcttgatttacagtaagactcttggtgatcatgttaaacatcttcaggctgtcttgcaaattcttactaaacatcaacttaaggtgaaaaagagcaaatgttcctttgctcaacagagattagcctacttgggtcatattgttagccctaatggagtatcaactgatgaagagaaggttcaggttgtcaaggactgaccaattccaacatcagtaaagttgttaaaggggtttcctgagtctgactggatattaccgcaagtttgtcagacattatggcttgttaagtaaacctttgaccaatttactacgaaaagggcagctctatgtgtggactgcagaaactgaacaagcttttcaggctcttaaacaagctttaatcactgctcctgtcttagctatgcctgatttcaatgaaccttttgtggttgaaactgatgcttctaacaagggaattagggctgtttcgatgcaaaagaatcacccaattgccttcttaagtagagctttgggtactcgacatcaaggattatctacctatgaaaaggagagtttagcaatcatgctggcagtggaacattggcatccttatttgcaacatgctgagtttttcattcgtacagatcataggagtttatcttttctggatgatcaacggcttaccaccccatggcagcataaggctttaacaaaattgcttggtttgcgttataaaatcatctacatccacctcattctgttcttgaacttgtagctgtttcttcagttgttccagattggattcaggaagtcattgctggttatgattttgaccctgatgctttaagtaaagttcagactctttgcatcagtgcagctgcggttccaaactttactcttaaaggagtgctatatttcaagaacaggatgtggataggtaacaatactttacttcaacaaaagattttggctaacttgcatactgcaccagttgggggtcattcaggcattcatgtcacttatcaaagggtgaaacaactatttgcttggcctcacttgcgcactacagttatgcagtttgttactgcttgttctgtttgtcaacaagccaaatcagaacatgtcaagtatctaggaatgttgcaaccactgcctgtacctgaacatgcttggcaagttgtttctttggattttattgagggcttaccaaagtcagctaccttcaattgtatcctggtggtagtcgacaagttttccaagtatagccattttgttcctctttctcaccctttcacagctatggacgtggccgaagcttatatgcagtttattcataaattgcatggattacctcagtcactcatttctgaccgtgataggatcttcacaagcaccctgtggactactctattcaaattggctagtacacaactccggttgagttcttcttactatcctcaaactgatggacagacggagcgagtgaatcaatgtcttgagactttccttcgctgctttgtgcatgcttgtccttctcagtggagtcgatggctggctctagcagagtattggtataatacttccttccattcagccttgggaactactccatttgaagtattatatggacataagccacgatattttggtttgtcagcaaatgcagcttgtcagttgtcacgcccagaatttctatccaaaattccaaacgcttacatgtgtgtaaaccctcgtccaggaatcacccgaggcacacaataacaaattgataatagagtgcaattattactctaattaataagcgaatataaagtcattacagaggtagatagttcctctcaaacaataaagttctaagcagcggaaaataaaataaacagcgtaggcgactccattccacaagcagcttgaccagggctacgcctaatcctccacaccttcagcatcactatagaactcctcctctgatgaatgattgcaaggtgagtatatgacatactcaacaaaccacgcagcaaatatgcaagtgcaggggataagaaaggaaggcacaatatagtctcatttgcataaatggcatttaataaatactttagaatttaataaaacagtaaagtatttaattaaacaatattaatccaatgctatacaacatacccgttgcataggcccaccattctaaacaaccattcccggctgcacagttctatctccaaaccaggaatataccattccaaaccaggagttaaacaagttattaccaattacagcatcatttattagggtgagaggtatgagactaatcacgaaagacattgttcgacccgcccataaccgcgggcatggctattcgaatagtttactctggccagaggtgtaccactgtacccacaagacacaacctcaacatcacgtcaaccatgcgtcgcgatacttaacaagtacccgaatagagattgtgacaataccctctgcataacataattcaaagcagtgcaccattcctggatcataatcaccccccttataaacaaggcatagactccccagcgacccccgtgggcttatctctgccacttcacagtctggtgctctacaatgaaccacagtatacaaaaggtaaagccgttgcccacgctggcttgtggttggcagggttaatgtttcacaaccgaaaatcgtgaaccgttccttaattgttatgagcacgaccatcaaaaccatgtgctcacaacccaccattaccatattttagttggcatcttaattaatcaacctatcatgattaaccatcatgagctatcattatccatcattaagtaatagtgaatcattagttatccattcatatgagctagtgtctctaagcatggctaagcatcctaattactttagctaaaaccatataatgttctagcaaatcaaattattaaacaggtgacaaagaataggtaatcaataatcaaaaggctatagcaaaggcaataggttattcccacccaatgacattcaagaataaatgcaatagttgaatagaaacaatagctttaaacgggatcaacatgctcaaagggttgtttgggatctgtgtgacttgccttgctggccttggaactcttcaaaatcttctcctacaaaatcggtctctccgggaacgtcggaatctaagcataaaagagcaaaatcactaaaacagtacataaacaatcataaacagcacatgtggacatttttaacatgtagatctcaattttagaaaaatttaaagacttgaaccaactaaatctgagctaagatgaattagttatgaatttttaaagattaaaccggattaaatcatttatatagattttaattgaattatgagcaataaagaatcatttttgaaaaggaaaaaggatttattgtgtcagcgggctcgggttcacggtggacttggtgcacgggaacggtctacggaataaacggctgagatcgattcgatccaccgcggtctacggatgacgcggcgctgacgtcgacgatgacgtcatcaccggcggcggctcagcacctcgcgctcgccggcgaacgacggtgcagcgccgcaaacggagggcatctacacatagacggcgacgcggcgaactcaccgagggctcggacgacgacggacggcaacggatggcaacggcggcgaggtcgaagcggtggaggcgttcgggtcgacgatgacggcaatgccccggcggtcttcggtggaaacagaggacgggacgaggacggcgacgacttggcgatcccgacggcggccttcccgagtgacgacgatgaccggagcggcggcagcatatggctggactcgcggcggcgacggcggcgcacgggctctagtggctagggtgctacgagcggcgagaagataaggcgagggtggcggcggacggaggaggtctcggaggtccttatataggggctagggggcggcggtggaggcccacggtggccggcggcggcgatggaaggtttagggttatgaggaaagagatgatccgaatcgggctgaaatccaccgatttccaaacaatattagccgaagattccaaaagagaaaaggaagaagagatcccgaggatcatttcccctctatcaattcggccggattgggaaagaggcgatggaatttggaagggggcggcagcggcttgcgcgcgctagggcgcggctacggcgagaggaggaagacggccctgataggtgggccccacctgtcagcgggagagaggagagagggcgggcggctcggcttggcgggctgacttgggccgggcgcgagtaggctgaaggagagggagagagacttgggccgactttcggcccgaagccaaaagggagattttaaaacctttttctttttaaattattcatgaaatgcaatttcatttattaaaaatacttccttggctcaaataaatcccagaaaaatctaggaactatagaatcaagtgaagtatttaataaaattttatctagcccacttttatattggaatttattatttaaaattagatcttttcttcaaggcttttaaaatcatttctaataattccatttaaacaacaatttataaatttaagatttttagggtgtgacatgagtcgactgagttaattgactggttacatgaaagggagcagattcagagtttgattcgggatcatttgttgcgtgctcaagctcgtatgaatttcaggctgattaacatcgctctgagagaacattttctgtcggcgactgggtttatctcaaattacagccgtttgtgtagcagtcagttgtcactcgcgctaatcgcaggttggcttttcgtttttatggtccttttcaggttctctctctagttggtgaagtggcttacaagttggctttaccagctaccagtcttatatacccggtggtccatgtctcacagcttaagaaagcattggtgccaagtaaggtggtgtattctcaattgcccagaattcagtccactgctggtacatcagttgttccatcgcaagtgttggatcgttgcttcatttggaaaggatccaagatggtggagcacttgctggttcggtggtctggagacgatccgcatgtggtcacttgggaaaatgatcaagaacttcgtcgtcgttttcctgactctgaagcttggggacaagcttcgaccgcaggaggaggggatgtcacggcggcagcatctgtagcagggagttcaaagcagaagccagtggcccagcctgtgaatcggcctagaagggagaagcagcccaactcccgtttccctgcaagtgtgtggacccagtagtaattggctaggcaactgtcagtgagtgagagagactgtgtagttcgatgctatataagccggcacgattgagaggaaggggatcaaatcatgtaatcaaacaaactcaaattcaattccatctctgtcctgttcaattctgttatgatcttctccttcttcttcttcctcaagccatctctctcaatctctttccttctctactcgaccgaatctctcctacgaattcgagaccgtgacagaaactcggcgaagcccttacctggcgcgccaactgtcgaaacaatatttcagcaatataaagagggtagcgcacgagacctaaaagtggagggatgcaaagacaaaggatttagaaaggttcaggccctctcaatgagaattaataccctactcctatttggggatttgaatccgccgagtgtattatagatctgacgatctgattgtatgtcatctgccccctagagagcatcctgcccaccttatataggatgggggcaggattacaagatagaaaccttaaccaatacggtatcagtttcctaaatttactttaccatattatccaaccaggactaaaggccattccataatatataaggaaacgtattacccaagtcatgatttattacatattccatagatataagttatcccctgtaactagtcggataaccatgttatgtgggtatgggatacctataatctgagcaatctgtagcccaaaagccacgaaagtaaatagcaggaatccatggcttgatgatgggacatgacaacacgatgccgacaatctcttgcaccacgcaggaaccggcaaataactaaggcatggattagtttctaacttttttttagaacttttaactttttcatcacataaaaactttttgacacacataaacttccaacattttcgtcacatcgtttcaatttcaattaaacttctaattttagcgtaaaataaacacactctaaagaagaattggataaaccctactacgagacgatatatactccacctccagttaccggtaaccgaagccattggagcggcagaaagagcactttctttttctctgggagagctctcgccgactctgctcaaagtactgaatctaactaaaagaatggctcgtgcctcctgcataaaaataaatggctcgtgttgaagttgtttgagacatccaagaatcggcagtatacgtcatcacaaaagtacgatcgacaaggaagttgcaccaaaagttgctaacctaagttgaaactgtcaattttttttctaataaattccacccggtcgtcatacgtgagagaagtatgtaacccgcttctactaactagaagcattgattcgtcaacaaatttccaaagaaaatcaacatactgaccatccgttttattttaaaaatttataaaataattaagaaaaaaaataagtcacacataaattactattcacgttttattatctaataatcataaaaatactaacaatcaaaaaattcaaataagacaaacggtcaaatgctctacaatgaaacccacaactgcgaaagggcctgtagcctagtggttacaagagcatcaatagcacctgaggtgttgggttcgactctttatgggacgaatttttcagaatttatcggcgttgtgctttcagtggtagacggtgataggcgacg

SEQ ID NO: 86402 - DNA, 3198 bp, Oryza sativa
gtttacttgactacttacctttttactttgattttgtaactttattcaaattaatccaaaaacttgtgctattaattggataaatgtcttaactccctcctttcacttgtctttagatgccgcgctacaagcctgagtacttgtttggtgttgagggatttgtccaggagttacgtacgatgtcctttgtcattggatttgggactgcccctttttatgctcagattcctcatgatcttcatgaagagaagtgccgagtcaaagtcaccttgaacagtaatagtgaagatatcccctcagtgatgttcgaagctggaggaagaaactacatccatgcatgtcaggaggtggcaaggatcgccataggagagcttcagtgatcagttggccgacactgagtatcgctaccatcctcgccaaccccagggaagtgaccgtggcagttaccttgagactgaaggaattgagaatgatgctaccacaaggcatttggttgagatgctgtgggctatggatgaaagtcgtgcggagactgtgttagcagctcaagatcgtgaagaccggaatcgtggtaagatttgcaagctagaagacaaggtggatcgtttggagaaggaactagctgcattaaagggagaagcaccgccacagaaggccaggattcgtctcaccgcaaggaagagagctctatttgtccctcgctaccaattggcgccaaaggtccgtgtggtggagaaagaagttgccccagccctagcggatcctccggtcattatcataagtgatgatgaaggagaagaatcaaagcgcacccattccaagattgagtgggtagcaactcaagatgatgaagacgagccgaacgagccttcaatcgacctccgatgctcggaagaactagagtgacttgttaagtcgttgtcttagatcgttgtgttagtttgcttgctttaagtttggttgtgtgtgtctcgcatgtgatttacatcagtggtgggatgtaagtgcatgcgtttgtttgctttcgagtgttagggagttggtgagtttagtggtgtgagagtcttcagttctgtaataatgaaactcagttaagatcaataaaagttaaagtaattctctgtcctaagtagtttcccccggtttctcttcttgtgccctgtccatgccagatggtgatcactcgcagcaatgggaatggccctaacaaccccaataacaacaatgaagggaacccaacacttgctcaagttcttgctcaacagactcagttaatgaacatgatgatgcagcaacttcagaaccagcagaaccagggaaataaccatgcacctccccagaacaagttagcagaatttcttcgtgtgaggctgcctattttctctagtaccactaatcctgttgaagctggtgattggctgcatgccatagagaagaagttggatttgcttcaatgcactgatcaggaaaaggtctcatttgcatcacatcagttgcatggccctgcctctgaatggtgggatcacttccgccttaataggactactgctgaacctatcacttggcttgaattcaccgctgctttccggaatacgcatataccatcgggagtggtgtctctcaagaagaaggaattcaggtcgctcacccagggatctcgctctgtcacggagtatctgcatgagttcaattgtctggctcgttatgctccagaagatgtgcgcaatgatgaagagtgccaggagaagttcttggaaggacttaatgatgagctttcttatccactcatgggctggagattatcctgatttccagaagttagtggataaggctattgtcaggaggacaaatacaatcgcatggaacagaagaaacgccggattgctcaattcaagacacaaccgggaaataatcaaaggccgcgtcttactttaggaccccagtccatgccacatggaggttcttcgtctgttgttcgtccgcggcgtcagttcttcaacaacaatgctggcaacaacatccgcaatctagctccacgccctgttgcagtttcgacacagcaacagcctgccaagagggagcaaggcagcaagcccgtagtgtgcttcaactgtggagacccaggacattatgctgacaagtgtccgaagccccgacgcgtgaaggttgtccctgcccagagcaactctaccgcaccagcatcaaaggcccgtatcaatcatgttgctgctgcagaagctcaagacgctccagatgtgattttgggtacgttccttgttaactcagttcctgcaacagtgcttttcgattctggtgctacacattcatttttatctatgagttttgcgggaaatcatgggatggaagtagaagatcttagacgtcctttgatggttagtaccccaagtaatcaagcactctctttgcaacgtagcccctctgtcagaatagaaattaaaggagtaccatttctggccaatcttatcttgttagaacccaaagaccttgatgtcatcctagggatggactggttagccagacataaaggtgtgatagactgtgctaacagaaaagtaactctcaccagcaatgatggtcgagttgtaactgttcatgcattgtcttctgagtctttaaggtcaagactgaaccagataactttggaagagattcctatagtccgggagtatcccgatgtgttcccagatgatttacctggtatgccgcctaaaagggatatagagttcagaatagatttggtacctggaacaactccgatccataagagaccttatagaatggcagccaacgagttggcagaagtcaaaaggcaagtagatgatttgcttcagaaaggatacatcagaccgagttcatcaccatggggagctccggttatttttgtgggaaagaaagatcatacccagaggatgtgtgtggactatcgtgcactaaacgatgtgactatcaagaataggtatccactacccagaattgatgatttgtttgatcagcttaaaggtgccactgttttctccaagatagatcttcgatcagggtatcaccagttaagaatcaaagaggaagatatacctaagacagcttttaccgctaggtatggattgttcgaatgtactgttatgtcttttggacttaccaatgcccctgcttttttcatgaactttatgaataaggtgt

SEQ ID NO: 86403 - DNA, 10722 bp, Oryza sativa
  unsure (1)..(10722): unsure at all n locations
gagagagagatagccggggagggagggggagatgggccaagagagattcggcccatcgaacccgggggaggcaaaatagacttttgcggaggaatttgatttggaaggatttggattcggaattgaactcgacaatagatcggggatttgagatcttgagatggcacggacactagacaataagcaaagaaacaaatttcgcaattagggtttttaagagataattttcccacttggcgccacgacggaatcatgtcgtcgtctcccgctgttgtcttggcgccggtctccgtcatcatcgtcgttatggcgacgtcctcgaccagtattgtctggcacccgtcgttcgcgatcgttgtgatcgtggtggttgtcctggtctcggtcctcatttgagcggtctcctcgattttcgttatcatggtgccataaagagatatgacatcgagaacgattcacatcgagaacgataaaggggtagctcactgaggcgattccctccgttccgggttttcaccattggcatcgccagttggtggctgctccgggtgcgctgtggtagcggcctcttcgaacgcattgctgaggttggtcactgattcccgtagtcgttctgtccaacgcgcgaggtcatcgttcagaacgggatcgtatgggggtttccctcagtatagcgtggatggctctgatgtgctgggctggagtagtcaattgattctccgcttctgcgttggtgcgtgctgacgtgccaacgtcatcgatagccaatacctcccgcggcgcgctcgttgtcgatgacccatagtcttcgagaagctataagactgatggttcgtgaggatcgatatcgattaccccaacaaatcgatctgaagttggcgtcgctccttattccttgtcgttatccctgatggggacgtgtgactgttggaccttaggagatggagctttcatgtcgctgagaaagaccttgcagcttgagaggtcgtgattatttgtcttgtgaataggacaatagacatcacgagttggagagatacgctgaattccacgctctttgcaggcgcgaatttcatcgcggacgttgaggaaaacctagcaggcttgcaaagttttgtggataggacaccaggaccttgccgcttcggaagtcatcttcgtcggctcgtggttcatgtcggaatgacaaggtttggccgcatcagaatccttctcgagcttggatgtcatcgatgctccgttctccgtctcagcgggaggatttttcgacatggattcgccttggtttgtagcaactgcgttctcgtttccggtcattgagggaccggttgagatcggcgtcgtggtgtaaaccgggaagacgatttcgccgactttagtccacaccagcatcgttgaagcagggattacttggctgaggttggtgttgacgctgttgtcgacgaggctggatgacatagtagtagaaccttgaataccaagtgcccctacctggcgcgccactgttgacgggtggtacccgtagaccggatatagagggtattggggtacgttggtataaggatctacgtaatacgacatcaagcaaacaaaagacgaggattatactggttcagtccccttgataggtaatagccctaatccagttgatatgggattatatggtggaaaatacaggttacaaaggaaacaatggaacttgacggatccgacgagatcgtggtcgagttggttcgactagatcccggcgagttggctccttgcaggctccgacttcgtagactgtgagggttgtgttggctctgagattcgatgccccatgtcctctccgaggggtcccttttatatcgcagatcagggggtttccaagtagaactcggagatatcagaccttatacgacatattgacgacccagtcttgtccgagtaggactcttcccatccgtagactccgtgaaggatttccttagagtacgcaggaaatatccgtatgcgcatgggaataccataccgatatgtgacgtatatcgaagggtaaagggtatgcctaacccataaccctgacaccacgttagatgaagaccgggtcaatttagccacgtaagctaaaaccaccgtccaaaccgccatgggacctatattgcactggttttgatagttgagagacccattatatctagttttcttgttgaaggatgaaaatcggattcgttaacaagttaagggaccttgggtgaacttattccaaacgaaaatgcttctgaaacctgatgggctgttgttagttgatacatgttgaagcgtgttatctttgtggatgtctttttcccaaagcctagaaacacataacaaatttatagatgcaaaacatcaatagttgatcaattttgtaactgaagttgcacaaactgaaagagcatccatagaattgcaaaaaaaaaaaggaaaaagaaaaagaaaagaaatatgagctgaggccacccatgtgtacgtatgtgttccctgaatatttgatccatattctttcactacatgaacaaaagaatgttgaatctctgtgtgttccaaggtaattgtgacaaaagaaattgttaaaaaggtagattcctcgggatgtttccccagaaccatctgaaacggaattaatcctttcaaagagagtgagggtacatagaagtaggggcaattccttacatacccctaaaagtttgctccatcccttgcatgcccttgaattttgtcacatcccttgtatacccctgagatttcgtcttgatcccgtttatacccataccgttagttcaccgttatcttttttccaaaatggccatgttgccctttttatagtcatgtgatcacttcaaaaggctaaataaagcttaatgtgaactttttaaattttgtatagatagttgagcctaaatttcaaaaccaatatttattttttgaaatatttttaatagattttcaagcaagctttaacaaaattaatgaaactcatatagaagtttcaccgaacatttagaaattaaaactatatttaacttgaatttaaatataaataagaatgttttatgaaatttgatctaaatttttaaaattttaaatttaacttttcaaactttgaggtcaaataaacacattctttttgttgtttactaataaaatatttttcaactcgaaaattatgttggtgaaaaagctagcgcataggtactctaagtaggggtaatatagtcattttgaaaataacttaatagttaactgatggtcaactaacggtatgggcttggaggggatcaaaatgaaaactcgggtgcatataagagatacgtcaaaactcaagggcacagaagggatggagcgaaatttcaggggcatacaaggaattttctctaagaagtatgctgagtctataagaattaccttgaaggccaagcatgaaaaaaacacacccaataggtaatttgggccggtttgctgaatttaaatgtgtggatttgtagtcttctagacatcatatcaaagtcaccttagcaaaggattattcttaattacatgaccaaggtttggcataattggtttcaaacatcacgccaaaacaagtcggacaatatcaaccataggggctatacaattactatctgtatagaatagtgttccaagatcgttctcggacggaagagaaaaacaagttgcctagaaagttgttataggagattaatcggaggaaccggccttgtattgaatttatagttttatgttggcctgttgggtacctggcgaccttggttatgtatagtttatcttttctatatgtaatctcttaaagtactacctccgtttcaaattagtattcgctttgactattttcttgtaactttggccattcgtattattcgaaaaattaatacaaatagaaaaaaatgataaatcatacttaaagtaaatagttgataataaagcatgtcacaaacaaaataaataataattttataattttttgaataagacgaacgatcaacaattgtaaataaaaactcaaagcgataagtattttgggaaggaggtaagtattttgggaaggaggtagtatttattttcgttcttctcaatatacagtataaccaaatgaactcctgccgttcggattaattaaaaataagaaaaagaaaaagagaattaaggttttaactgccgacaaggaatatcgatcttttggtcagcgcgaactactgtagtaacaggatgaccatcaaccactaccttcatgtatcttgttactacaagcaatggaggctttcttctgaagcatgcatgctgactcagacgagaaaaaggtacagcatgcaaagttatgcaagtaactatactcgacatgggaaataacaaaataattgttgagcgaggtttctcacaagttgatcaagttaatttttttctcgctaagtgagcacataactaggtagattttttttttaattttggggggggttttggggggggnaaattcaccccactaaattttgaatcgaagactgaatttaaaggaaaaatatcctattatagtgaatcgtacgtattgatattgcttgtatagaaaaagttagtgggtttcgtaactaagtgagcagcagctcgtagaccacctgaaaaaatatttattatttgagccgtgctcgtatcgatggctaataatgttttcagtgataaacaacgtaccaatcgaagtgaagtgtccgtggtgattcatcaatctcaagatatacctacttagtctttcgaaaattctcatagggtagagtgcgtgtgattatagggtgagtgtgcacgtgttatgagcgcctgtgtttatacggtgtcttttaaagaaaagttaatttctttgtcagaactagttgtgctgcttacatttctctgtgacttcattgccaattgcacagacatctcacttgtactgcttatacattactctaggacttcacctgtcaatttcacacacagctcgcttggcatctccataaatgtattttagatttctgttggatatataattcaatgcaaatgaatattatctcgtaaggaacgttactaaatactcctatataatctagtcataaatatatgacaacatctggtactgaaacctccaagattttgactatcaatgaattttactccttcaggtcccaaaattaagtattttgattttttttcttgagtcaaaactatcctaaatttgagtgagttaatagagaggggtattaatatttactattacatcaaacaagtaaactaggaaaatatgttgcgtaacatatgtaatgatgcccatttgatatcgtcgtaaatattattttttctatgaaattgatcaagtttaagtttttttaagaagggtattttttttacccggcctctacatctaatcagatatatgcggtccttttaaattaggaacttagccctcaactaatccaatctgaaattcgctcccacgaagattttgaattcaagatcttggggtgctaattaagtttaagatagcttgacttaaggataaaataaaaaaatgcttatgttttgggatgaatgaagtagactactttgaacatataaatggtgtatgtggacctgtgtattgaaaagtacgttcataagctcataaacttattacatttataaacttattatagtaaaagttatgatcaaaatcaaataccatatataaaaatatcaaacagtgcatatttttaaagagagggaatatgaaataagtagtaaaaatcagattgacttttctttacgatgaaaatcagtttgacttctgtttgcttgggcaagtagattgcttgccgtattcttatattttgacatataattttctctttccacagtcaatgatttgtgatgaacgaaataacacattatgtagacatcccctttttccattttaacatgcgacaatcacatggagaaatgtgttgaaatttgaagcccgtacactgtacaccaaagaagaaaatttttttgagggaaactacggcaggtgtgaacaccaacctgaactttattcatatggtaaaaatctttacaaagagggagctttattcatatggtaaaaatctttacaaaaagggaggtacagagggacagggagaagaaactaaaaattaggatttagcgcccaagagtagagttgttgtttgcctacggcgtcgttacatcggtttgaccacaactcgatatagctggcgcagcgacgaaggactagcgtgttggtttcatcgatggagttgaagatcttgttgttgcagcgtttccatatgttccaaactgcggcgagtaagatgatgcaccagacctgtggggtcagagcattgccgggggtgggaggccccataggtcttcgagttgtgctaggaggtaacttgctgttcatcaaatccataggagtgccaaatggctgccactccggagcagcgaaggaagagatgttccacatcttcgtcgatggggcagaagtggcagcgcgcggaagttgctagtctgcgtcgcatccgcctgtcgtggtgatgatacgtcgtgtaggatcaaaacacaagaactaagccaaccagagggggggtgaatggttggtatacccaaaaaccaaaacttttagcggaaataaaaggtaccctcaaattcgacggattgcggtctgaccgaagtagttgcaccggtctgaccgcgtgatgaacgtcggtctgaccgatgtagatcgatcggtcgaactgccgagatgcctgcctctgcctgtcaccactgccggtctgaccgccgccttgccaccggtctgaccgccggtgagtcgtcggttagaccgccgaaacccagtgaaacacaaatcgaagaactcttaaaatagatgacgactttattgattatctctgtgtttgcaaagtgcaccaacagcactccttacaaaaatttcgactaaactcgaaaccctaactcaaaactcaactcaattgctctcaaaagcaatacagggaagcctcacgctccccctttatttatacccaaggtaggcagcctaaagccacggaacaaactcatactagaagtcctaaacaccttaggaaaccctctagtacaagacacaaactttacataaccaatcatatcaaatttggactccttccaaattcgactccgcatcccatacacacacaatacctccatcgtatgccatatggaatctacatcacccacgtgcatcaactctagcctaagtatcccgcatgatctctgaccaccacggacgtcgtcttatccccaagctgactcccggtccatcaccgcaaatactctcccgaggcatcgagtcacctacacatgaaatctatacctaaataaaaaatacataaggcttccggaaattattttggtacatttttttttgttatcgccgtttcgcttgatcgcggtgcccctaccccacccctcccgatctctttttattttcctttttatttccaaaaaataaataaacaatctaacttcctaatctctatctctactattataaaaattaaagatatttttgccggtattttggtaagtcatctatgtatgagtcggttttttaagttcgttcgcttttgaaaatgcatatctgtatttgagtcagtttttaagatcgttcacttttggtaatacagaaggaatcatataagaaatctgtagctcatgaattttgaaaaatatatatatccaagtgaactcccacagtgaatttcatcttaactaaaccatataacaataataagattaaaataaacttcacccgttgcaacgcacgggtatttttctagtaaacaaagaaaccatattccgagaccaagctatctctaacttgactcattagtagcaaacaacagtattacatacgtatagtatccatctagaagccataatcataaaacaatcacggatatccaaacaaacaacccggaaccgaaaccgacacagcgtcggccggtcagaccgcgggctgcaccggtctgactgcgcaatgcacgccggtctgaccagcagcacatgcccggtctgaccggtccatataaaataacagcagtatcctatagattcacctgtgaaatccaatcatctccaaaaccacttcgtaaataaattccaaataataaaaccaataatctccgatgccaattgttcatcacataataataatcaaaaacatctttgattttacaatgtcccccttgatgaacccattggcaaacacataaaaaatattttggtgtttggaaaaataaaaacaaaagtggtaaaaagcacacttcgtacaaatgtacacatcgtgctcgaaaatccaaaagaaaacttctctcacttttgaaaagaaagaaattcccaatcgaaccaaaaacaacatgctcttcaactcatttgcttctccaaaaattttcacttttcaccttgcttctcccaaaactcatctcttcttccccttttgacaatgatttcatcaagaataggaattatgttcattaatgttcaagagcttagcatacatatagcatatcaagtcatgtgttgtaataaaaagaagatgaacccatctataatacagcaagcgtgtattaaagtataaccatgaaccaaagattttacaattaaacttgaatcaacaatcaaaattcatgatttcatacgatttataatgcaacatcttaacaagcacataggttgaagaataaacactaaacacatatacatattgcattactctttctcaaataacctttagcacaaaataaccaagagaattttttaaccttttcttttcttgagcctttttgctcatatttttctcttttattccaggtacgtccctgtcgtcaagactgtttccagggattcggcacacattattttgctcacatcgaatacgtccttgtcgttaagactgtttccaaggattcggtattcattttttttttcatatttttattctcttttcacaatgagcaattaaagctatttgaggaataacaattcaataaagcatatatataaagcatttagaaatcaaaccatatgctagcatcaacattgcatatttgcataattcaagtagaatttaagtgtcatgcatcatctcccttaaaagcaaaatctaaatctcatgaaaagactagaataaagctatgctagagacaaataaaccttcaaagtattgctagcatgcaaaagaaaatgccatatgcataaacaaagctctcttttatcaatttttctcattgtcatactattgcttgataaaaccatgaggtacaaactccctctcaaaacatgccaaaaggatgaattattcccaattcaccacaaaaagaaaaacaaatcgattagaatccaaaggtttagtgaaaatatcagcaagttgcaactttgtatcaaaaaaactgcaattcaacatctcccttctcaacatgatccatcaaaaagtaaaaacgaatatcaatatgctttgtgcgtgagtgttgaacatgattcttagcaatgttagtagcactaatattatcacaaaagagtggtactttctcaaaagtaagaccataatctttcaaagtagataaaagacaaagaatctgtgaacaacaactagcagcagcaacatattcaaattcagtagttgattaagcaacactagattgtttcctagaagaccacgctaaaacctttcccattgtaaaacctttcgcaagcaaaaagttcttaagcctatcataccatgccgtaggagcttgtttcaaaccatacaaagttttagacaatttaaaaacatggttgggaaaattaggattttcaaaacctagtggtttgacataaacttcctcctgtataaaaccatttagaaaagcacttttcacatccatttgatacaatttaaaaccttttgaagcaacaaaagccaacaaaagtctaattgcctcaattctagcaacaggagcaaaagtttcatcaaaatccaaaccctccacctagctaaaaccttgagcaacaagtctagctttatttctcacaatcaaaccatcctcattttatttatttttgaaaacccacttggttccaataatattatgtccagaaggtggttcaactaaagtccaaactttgtttctctcaagattttcaagttcttcatgcatggcattaatccacgattcatcagttaatgcatgtgacacatcttttggttcaaaagaagcaacaaatgcagaatttgcacaaacatcatgagtcgttaccttagaccttgtagtccgctcacctatattaccaataatttgttccagcggatgttgtcgttgaatgtgcaaaggagcagcgacttctgaagttgatccacgttctgtatcagtactggtcgaagttgtaatctctggaggtccatctcgagcagcatcaacagtacccgaacccgacgagcctggtcagtttgaccgcacctcctgtgccggtctgaccggaggtgtgccggcggtctgaccagcctggcgtccggtttgaccagccgagccgaccttgtcatcgttgtcgtcttcgctctagttttcaaaaatagggccatcctccccctaaacctgtgacattatacctgcaatatcgggtctagtacctggactagcttcatcaaaagaaactgggctgcag

SEQ ID NO: 86404 - DNA, 3171 bp, Oryza sativa
tgttccgactaccaacaggacaacaggcaagcaaaagtacacaacacaacggtggattttcagcatttcaaaaataatttctgaacatagccattttgagaggaaaaaacagagacacaaacttaattggaactaaagactagataatgggaactaatgaagaaacttattcgcaattctcagctggaatatcaaagttctccacgtgatgcagaggcaaacaagatcagatagatgaactctcatgatgaggatgcaatcaggtgcttagatcttgtcaagcgcctgaacaacgtcattcttcaaatcctcaaaatcctccactccaatgctgaacctgatcaagttgtccttgattccatagatttctctctgctcctttgaatccctgtaatgattcataactcagcaacatgttctttttgattgattgattatctgaatgtgacaaaatatgaacagtccataccagtaagacatgatggcaggctgatcaataatgctctcacagcccccaaatgatggggcatgatagggtatcttaacagaatcaataaatctcctagtagcatcaaagtctccagcaacctgcacagacaaggtattttagaaatttaaatgggtggtgttatatccacaggtgagatgagaattaaagagaagaaagtacctcaaaactaatgacaccaccaaagccggtcatctgactcttggcaatgtgatgttctgggtgacttggcagaccaggatagtagacacgtgcaatctaaggataggaaataagagactcagaaaaaacaacacaacaaaaagaactactcgtagcttcatagcttgtacaacaaatgaaaagtgcagagtttgcaaacctttggatgttcctctaaaaattgggccatccgcattgcagtattattctgacattgtacacggagatgcagtgtcttcatgcctcgaagaatcaagtaggcagcattctggtatcataatggcatgaaaagttaagagacaagagaccagaatattcatcaacagtataacatacagaaatagaatgcaaagacattcacaacttcaattcaaatcgctttcagacattcacagctgcagatcatctattatagtgtgttatctatttctgtacaattgacgattttaattacagaattacctaacaagggctatcactacctctagtcaatgcaaacgagagagatattttaccagcccaaactcaccggatttagaacaccaccaactacatggtgatagatgcggactttggaaactagctcatctctgccactgatgcagcctccaataacctaaaaaacaaaatattcttgtcaaggcaatctatatgtgtaatgagtacaggaagtttggtccaaacacttacatcattgtgcccagcaatgtactttgttgctgaatggataactaagtcagcacctagagttagtgccttctgattgattggggatgcaaaggtactatcaatacaaagcaatgctcccttgctatggcacatttttgagacaagatcaatgtcgatgcatctcagaaatggattagtaggagtctcggtgaagaatagggatacctgagtagaggtcacggataaatttttggttaataaataggcatatgatagcattagaggaaaaggaaatagtacaaagatcacactcacattattattatccagtgcattttggagagcatccatgtcagcaggtctaataacggtcatctggacacaaaattgtgtcataagataagcaacaaattgtaaacatttatgtataaacaaatggaacaaagatcataggcatattccaaacaccgtattctgcagaacataaatatttaatatgcacttccaagatactggaaatttgaaagcaactatgaaatcattatacatttttggcttctacaaattgatggaaagccaatctcaaatagtaactgcagaatcaagtgtgtgcacacgcacgcacgcaaaaagtaccggtataattataaatgcctctatctggctctcacaggaatctgtacagattactaaagtagcaatgattgagtggtggtggacaaaagaatgcgagttatgttggattagtttattatacaacataaaattgaacttagaaagatgacaggtaattgctgtgccaattaacacaggaaatagtagcctccatgtccaaatataatattttaagtagatcataaaatttaaaatttgtaagccttctgctactatagaacaatgacaagtcacatcaactacaagaaaaactccattgaaagttacatatgcattactgcaaacaagaataataagatcagattaccgtaattcccctcttaggtagttcagtctccatgtaaattctcgtcttgcggtaacaatcagtggtggtcacaacgtgcccacctgctggaacaagcgcgctgagcatagccacacttgcatacatcccggatgccacaaagacagtggactcggctttctccagtgcactgaaacatcgaagtagagcaatcaaaatcccatccactaaaaccaacacagcatcaagcattcccacttccaattagcagaaccattcatttcaagaagaaaatattacaccagcaacaaaggggaaacatcacctcatcttcttctccaatgcctcagtggtcgggttaccatacctcccatactcgaagctagcatgcctcccctcctgagagaagaggaaatttttaacatttgcaaaaagggcatctaccaaatcgatttgtaggagtaattgcaaccccccaactatttacgaaagatcgccaatcatttctaaccttgaagtcaatgagctcctgcgagttgttgaaccagtaggccgaggtgttcactactggcgtggtgatcgcgtctgtggcgatccttctgcccagcctctcgccttcgataggtatatcaaaagcacgaaatggatcagaaaaaaaccgaagcagcggggggaaggcgatagatctgagaggggattgatcgtgattacccgcgtggacggcgaggctggcgtctgaaccgagcagggcctgctcggccaatgcggcggcggacggctggccgagcttggcgttggggatggcgccaacctcggccgtggcctccgccgc

SEQ ID NO: 86405 - DNA, 9503 bp, Oryza sativa
cattccgcaagttgctacttaggttgattactaatagatgacctctcatcacgtgaaggtggcgtggggaatggccatcccaacggacatttcagggacttaccactgcaggccgattccagcaggatactcgagggttaaagttgagctggtggaagccgtgtacagacctcgagttggactacccaggaggagacggtgagacgcatctacgagacacaagccacaccattatactatggcgcaagcggtacatcatcctccctgggcgacaagcggcgtctcgtgcaccatctcttctggctccgccgtctcctcctgcaccatctcctccggctcctccgccacctcctcctgcaccatctcctccggctcctccgcctcctcctgcaacaggctcctccgcctcctcctgcaccatctcctccggctcctccgccacctcctcctgcaccatctcctccgcctcctccgcctcctccaccgtgtccgcctacacctcccaagacaaggtctcgccaagctccacctcctgccagcacaagggcaacgaagaaggccaaagttgacaccaccaaaaacaaggagccaccgtacggttgcagtcaagaggagcttgacgcttatgtggcaggagaagtgaagaggcaactcaagtctcggagtcttgaaaagaagatacatattgacccgagcatgaagaatttcttcaagggaatgtccaccacaaacaaggaggccttaaagctatcagactatgaccgaacacttaggaaagcctattacaagaagtccaaaccagttcctcagcttggagaacaaccacaccaagtggtagagccgttggtgaccggcgaagactttggcataacggatttcatttcggacaccggtctaaccatcgctcagtaggttggaggcgcaccaatcccgaaggcggaagtggcatacaagtttgaactcagtaaaccgcttgtcaggcctgagcagctgcagtccctaccgacacaaatgtacaaattccatgcacggtacatggaaatgagcgccaatggtagagagatgttcggagcgaggatcagaaaccccgacttcttgcaaggagaagatgttctatggatccatttcaaggatgtcttcgatctgtaccatcgggacgccctcgacgtctctcttcttagcgcatggattttgtaagtatctttgagttcgatttgtttcattcaataattagctcctggcatatatgtaagcaataataatttcctttcattgttgtagaatggagattcaaagggcccgacagcgggggttttatgatactgggttcatcgtccctcggaaaatcaacaccgaaatgctcgacaagtacgagaaagacacagaggacaatctcgtccatctcctaacgcagcagcatttcaagacgttcatactattgccgtacaacacagagtgagtttttgttgtcgtttgaacaaatttcattcccatacatataacatgtatattctgatatttatctcatctcacgcatattctagattccactggtcctgttctttttcgacttggacgcatgcagagtcactgtgtacgactcaatgaataaaaaggagaaggtttttgacaaggtcttccaactgatagacaggtaatataatgccatctattccaaagtcgcgggactctgttgctattatgttgatctcgggtaatatttaattaatcatagcttgcaactgcacatgtagggcttgggatcggttccgtcaattggtccgcgggacttggaaagaaaaacttggacgaaggtttcattttctagtgagtacatgcatgatccaaaattatattgaattgaatctctagttacagttaatataaagagtatattaaatctctcatcgtttctcatgtagtgtgcaaagcaggacaagggaactaacttatgcggctactacgtatgcgagtatgcccactgcctatcaaaccaaatatacaccacacgagagctcgatgtacgtatacataaaccattcaaaatttcattgcgtatcgatttgttaagttgtttattaatttcatatattgatatgtcattatttttcgaatgatagcgtattcacatgagggaaaaactcccacacaaggattttatcatggctgttcaagaacaactgatggggttcatcaacgaagaagtccttaatcccgatgatgaattctactatgacggatcgataattcgtaacgtctgtccttcctcttctaacgtaacgcaagcgtcgaagtcgtagctatagctagcgagcaaatgaattgtactatacatgcatgtatatatatatatttatatatgtacgtatatttactttagtgtcaatatatattttggtaacatatatgtacacaaaatgttaagtgctttaaattataaatatgtgtgtaatatatgtatttatacatatatacataggcatatatatatatatatatgtatatatatacatgcataatatatatattacaatgcatatatatgtattgtaatatatatatatatatatatatatatatatatatatatatatatatatatatatatatatatataatcaaccatgtagcaaacagggccatgcaaataaaaaaaatggtacatagatctttagtccaccaaccgggactaaagatggatcagccggccacgtggctgaccgatctttagtcccggttatttcacccgggactaaagatcgctatctttagtcccggattcgtagtcccggttggacaagcgggactaaaggggggttacgaaccaggagtacaaacgatttctccactagtggtatctgcatattgatcagtgatttgagagagagatgagaagagtaataccattataatgtgagatcagtagtagttgagttgcacacagctcttgcgctaagatcccggtcttgaaataccttgggtactctcgttaacctttagttagtgttgttcacttgctaagatcccggccggccggacatcgcttaaatatacaatgcagaacgatttccagtgtccaattaattaatacgtgttatgttctccattacaatataatgttctgcttttttggacggattcgtcctcagccctttccaacaataatatctagttttataaaatgcatgcactctaacatataatcgttataacagaaaggtaatatacgtatcatacatacatatatacaagttttacatactcatggtcggcgcacagatgtcaaaaaaaatataaaaaagttctactgctactctcagtcaagaattgattgtattttacccgtaataagaaagaaaaaatgacaattctatgagtacaaattcattagaattttctattccccgctgctctttatgtgatgaattactacatctgtctacacatataaaggattccggggttcagatttaatccacaaatatatataagaaattctataatactagttccccccaactaatcacccctcatttaatttccacccaatataccccaaccatatatccttccatcccacatccttaatcctaatctctcaaaaattcctaggtccatatatgtatgtatatatatgtatatgtatgtatgtatgtatatatgtgtatatatgtatatatatgtatatatgtatatatatatacgtatatacatatacatgtatatatgtatatgtatatacatatacatgtatatatgtatatgtatatgtatataggaaaattatatactactactgggagtagctactccctccctgtccgccaccaattcaattcgtttgcctagataacgataatgactattaacgggtttattgaatcgaatacttttacccgtattttttttccctcagggtcaacaagattgtttctgttctgtagcagattcgaaaattgaatcaagaatcctgagtttgttgtagatagaattttgttcggagacagctaaccagagatatttcagggtggttttttcgctctttagtttgcttatccaaagcgagaaatcaggatgattatcccatcgagcagaacattatcgatctaaaatcgttctctgcgttttgagagttcttaacccatctcaactcagattagtagcctcgccggcggctgcgttgcagataacgttgaaagctctagcatggagaactccagttccaaggtttgttgccatattcatctgttattttgcagtgaatgcggcgccggccatggcgacgatgaacagcaccaacccgacattggtacggtatagcagtgtcaagctgcaggctgccggagtggagcgccccaatcttaccggagaggagcgccccaatgtgccgcgtgcacgccgagcgccccaacgccggcgccgtcaaagctcgcggtagccatggatggattttttttcctaatctttgagtctttttttgatcgtatctcttaatagtttgttttgtttatgtttttgcatttgcagcacctttgcagtcctgcagcaggtgcgaatgtttcaggtggtggtggctctagttctgttttcactagagcccttcatgctgctcaagcaagaaagatgcatcagcggaagcagctacctggttctgcagtatcaaattccaaaaaaacaagtggcatcaagggtaaaaaggtagtacaagaaaaaatttacaccaggtgcactcctgctattctctcagatctgttctcaagttttggtgatcagcaaaaagagctagtgaaacagatggggtttgatgggttgctttccatgaggctgactaaactgaacaagcaattcggagcatggattctgtgcaagctagacccatcatcaggtaatctgtttacgggatctagacatgaaatttgtttgacatgtgaggatgtcagcctacttttgggaatcccttgtggacggaaggagattttgcctgcaataaaaaacgaggtaaaagatgttaaggcttatatgtatgaaatcttcgagaaagattcctttgatggacttaccattgtaacaattcagaggatattggagaaaaaatttaacaggacgatgactgttcacgaacaaattgtattcaagactgcttttataatcttcgttgtaaccaaattcttggctcctcaatctgttaacaatcacatatctataaggtatatgaaggctttggttgatgtagaaaatattcacaagtacaactgggcggaatttgttttgcatgacatcaaagatgcagcagcagcattgcaacacaaaatacgccatcggaaaagcattggttacatcaatggctgcattatactacctcaggtgaaattatcctattattcgttcgaattatttgccttttactttctaatatactcgcaacatctttcacatgctataatttatactgctcagcttttttatttggacaatctggatttcgggacggacactcccgagcaggaaaacattccacggattggcatgtacaatgactccatgatagcggaattcattgagaaggatgtaattctcaagaaccggaatcctttccccgcgtatggaaagatgaaggtaaaatcaactctcctgccggtagtatattcttgttgaaatttctcttctgcagaaacttcagactattgacatttttattgggtttcagctgcgaaacaaacatgatgaaaaatacaatattggccatcatacgggtgcaatagaggtgcaatctcatgtagtttgtcaatctattcaatatgaaaaaaatccatttttctataagaattgttgatatatctgtacacaggctatccatgtggatcatacctacgatgccaggtctgacatcgagcccccaagctttaatctaggaataacacaagatatcgaagaagtaaacatggtggcatgtaccccaggtcatgacatatccaatgtggctgaagactctgacaaagaacaagaactcaactttttagcacgtaccccagatcagccaatctcaaagtcagtagatgcctctgacaaatccggagaaggtaatgcagtgcacaaaactccctcttcgcatagaggtaatgatacccacaagcctgtatcagtttttcattttcattcataaccaaccacatgcacataatatgactcactcttactgttttgactcataataggttaccaacaaacaaaacttagtagtttctctccgtactctatgttgaaagagacgagtggggcgtgaggagtacgcatgtacaaagctcccacctaaatccaagaggagaattattggcggtccttctgatatcctattcgatcggccaaagaggtcgattaaaccaagccatttggtgaaatcaccatttctgagcaagcaacactctttcgtcaggcatgaccagaaggcacttgatgatttatgcacatatgcaatttcaatcgctgatgcagaagctcttaagtaagccacctatctgaaacacttgatgatttatacacatatacaacttcaatagcttatgcagaagctctaatgtaagccacctacctgaaatgttcctttctttcaccactaattgtaaagatatcacatttaacaggaaaatctgggttcacatctcccaacctgtccctatgtcattaagcctacatgacatacaataggctattcggctggacactcaaatgcaagaagaaacattcaatgttgcagttcaagtattagtagcggatgcgatacagagatttggaggaactgattttgtaggctggagacatttcttaaatcaagattttgcagtaagtgcttccaattactctagatcgactatttcaatttttaaatatggtgtgttttaacataatatggcgctgtagatgtttgcaacagctggtgatgaccagtggaacccagaggaccatctcccctcattcaaagatgactccctgataccatatgtcgtacctagttgccacctggtttgataattaacagcatcttgaaaaattcagtacatcaagtgcaaatgttcaggccactaacttttgcaatgtcaatattaatttgcagatatttattccactacttcaaccactgcactattctctatacgcatttgatatggagaaaaaaaatatgcattcttgacccactgagagacgcctcgaaaagataagaggatacagcagaaagacacttaaaaacaaaatttcacatttcatctgctctgaaggagtgcatgaagcttgcatttccagattggggcgaggatataccaaactgggtttctaagttcccttcggtcatcccagctttaaacaacaagttccagttcatgctcccaatttgatccaaattaatttttccattctactcatttatggtcattacaataataacaattttggtaggctggattgtgcctttcacgtgctctactacatgcgaaactgggatggaactcgccttgtgaaccccccaaaatccgtgagttttctgtacacactaggttcaacttaagtttcattgaagtagcttcctttataataaataattttctatattaacaacaggatcaacgagatcttcgaaaggaatttctgtccaacttattgtcattcagaaacaacgaagctattctgccggacttcgtcgttcactgcctgaagttatctaacaagatctgagcagttatgcaagcatgccaaaataaacattacattcagttacatcattattatctaaaatttgttagttcccaataatatttgtcttgttcttattcaacatttttcaaggcttcatgttctctgctattctcttcccaaatagatgaatttgtcatttaccttccaactatcataaatttagattttcccaacatcaaatccatgatgttcacctatggcaaattaaatactagaaactaattacatcttctgttgccgtacattacgtgatcagctctcctccgaacttagagagcagatcatgccatgatccaaatcagtgcatgcccagcgaaaaagagacatgttctgctgggcgaacatgtctataacagtcatgttttgctcggcgaaaaaaagacatgctcccagagcagaacagtatgccaattgatttatgctaccacgaggatacatcccaccaaacaatagcagaaactactagccatgtactgctgccgagaatacatcccaccaaaacaacagcagaaactactagccatgttctgctaccgtgctaaaccccaactaaaaatacaccacaagcactcttcatgttctgctcccgatgcagagcatgatgaaaaacgtttttggctcccacgaagattcatccgacactacctccagcagaaacaattagctatgttctgctccaatacgatgcttccaaagactacaactacaccacaaactctgaggcacaacagaaaatagaaaaaaaaatacaaaactagtgttcgcaaatttcctacaatgtttgccaaatgtaaatattcaaaatatactacatgttctgctgacaaaatttaataataataaaagttccattttatgctaaacgaaatgctgacaccaaccctgcagaacattgaacagaataattacactcacttcttcctctcataactagatttctgaccacatgtaatcttatagtggccatgaccaccacattgcttgcagtacctaatctgcttcgttgactctttttttcctttggcgtgattcttcgactcgtccttggaggtactctcactagccttcttctttgctttgctagatgtctctcccttcgacatcagtctggtactcctcggtcgtccacgacttcttctaacctcaggagggagtatgtcttcttcgttgacatcagtcatgtccacatcaactgaatcctcaccagcagaaacatcctgtccaatgccgtcctcatcggctacacaaaagtcatcaggcattccatgctccgagtcagaactgtctacactatcatccaattgcacaccagtaggtttcttcccaattgttctatctccgcaatgaatttccttgttgtttacaacttgcgaagtacacatgacctgaagttctccaatcagctttgtcaacacttccaatgtcttctcatatgtttctgaactagtaccaccaagtctaaccatatcaagtgcagacttgtgcaggagggtgttccgataagttctcgatgatgccgcctccttatccttcaagtatgactcctccaagtgctttgggattgaatctctagcatcttttgtccacctcttcaggatatacttcttcggtatttccgtgaaaccatactataccataacctgcaaaaacactatgcattaacacacaaaaacacaacagcgttatgagaactgcttaatattcaaacttactctgataatatgggagcatataattcccagggctgcaggaat

SEQ ID NO: 86406 - DNA, 1468 bp, Oryza sativa
gtttgaagcatacatggagatcgtgaacaggaggatgcacaacctaaccaatgagactctcatcaatgccggtaaatattgatcataacataatccacatggcatattatgtaactcttacttaacctgtgccatgttttgtagctgccgcattgaaccctaggacgcactacgcgtattctccaagtgctactgtcttccaagacctccgacaggcattcgagtggatgacggatatcgatacggctgccgccgctttgctggaggttgagatgtaccgacgtaagacgggtgaatttgggagggcactagcaagaaggatggccatagatgggaaaacttcacctggtatgtttctaatcatggaactatgatatatctaattgatcttgatgtattcagaattatgaaatgacatgttacttggcttttgcagcacaatggtggtctatgttcgcctcagacacgccgaatttgaagaagcttgcgttgcgtttggttggtcaatgttgctcctccagtggatgtgaaaggaattggagcacattcgcattcgtacatacgaaggtccgtaatagacttacccacaagaagctcaacaagctagtgtacgtgaattacaaccttcgccttcgaattcagcaagcaaatgcccaaattagggtggaggacgatgatccccttcaaagattagcggacctctcattctatgaaactaacaatcatatcagtgcctggatggacaatgctcgctctaatgcttgccccgaactagatgaagattcagctgagagtgacgctcccctgcctagtcaacttgtgtctgacctagtcaacttggatgacctgcgaaggaccacgggagcttctagtattgctgagtgggctgatacgaatgtaggtgacactcatattgggaaaaggaagactcgaaagccgccaaaagcacgtccatctaaaaaggtaaagggcaagggtccacgatcgactagtgttgatagcgatgaagagacccaaggaagcccagagtaccaagagtccaatgatagtagctcaagaactgaaacagatgacggcgacgacgatggttaaggaggccaaggcactactaatgtgcctcctaggggtcacacccaacaatcagatcaccacagccccgttcaattcactggtgtgatataattcagttgcaatttcaaccttcatcttccaattcagtactggataattttcttgcaattttttgatttgcaggtgagggcgacttcactcatgctactcaggaccaggatcatggtgctccaagctctcaacgaactaccattgcaccgggagtccgacaacagcaacaattcagtgacatacaacaggatagctctagctcattcagtgcctctagctttgaaagtggctatccaacgtatgtgtacaaccgtccccaagcttgagtattctatagtgtcaccta

SEQ ID NO: 86407 - DNA, 2406 bp, Oryza sativa
agcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtacgctttcgtgccgtgaaggatgaattcaacaatagcaaccaatggaagtatccaaactcctcgcattacccagttgtacacctctgccaaattggttgtcattatgccataccgagatccatcggtgtcgaacaataaagaccacttctccttaggctcattctcaatccactgagtgaaatttctgatggacgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaatttcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaatcagtaccagctttcagtgttctcactctctacaaatgcaaaagccataggtacaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccaatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcataatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccgtcaattacctcgttctccttatactcccagggtacatgatcaccctctgatataacaagtccagagaagtcctcatttgcccaatcagtagccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttatttgacattgtgcctgatgaaaacaataactgcgttaacctcgcatttctgtactacgccctaagttacattctctacaatattgttctccaaaattctaaaagtaggttacattctccagatcaaactaaact

SEQ ID NO: 86408 - DNA, 1344 bp, Oryza sativa
ataaacactttacaccaagtgcctgcagaaactcagctgcactctcactcatcagtttaccatctttattccttcttaccctacagcatttcttgatccgatggagccctgaccgactgttcctgccacagtaatcccagatcatctctgaataagtaaaaaaatttcttactcttgtcagcagcatgcagcaagccacttcacttcagttggactcccagcctttgagatgccatgccatggcatggaatggaatatcatgtgttgctgatcaaacaaagtaccttgcaattgcactagaggagtaaaggtggcaacttttccttttttcttgtgagggcaacttttccctctgaactttttgatcaagacttcacctttagctcacccaagtcaaaagagagagcaatatgcaatgccctacacacacacacacacacacacacacacacacatctcctctctccataattgattgtgtgttttgctgttcaaagtccaagtctaaaagtgctctctgctcttaacaaccttggagtgctccagtgacagcagtgtgtgtgtgtgcgtgtggtcctgatcgatctctgaacttttaaaacacacaaatgcagcaaacggttttcagaaggagaaaaagctgcagaaactcgctggattcatgtgtgtttgattgatttcagcaatgcattgggagatcttttgcgcaatttttcttcggtttctggagacgtagggtccggtttggaaccatgtgtgaaaatgaaggatcaattaaacggcttgcaataattttgctcttgctggatagtagctgagtagggttgagcttgttcttgcatgcttttcttgtgtagccttttgtgtgtaggaggcggcttcattgtcaaactaggctaaggtagtgatgcttgagggcatgttcagtttgctttgttccattctagtatggttgtatgaacttttctaggcttcctttggaatgtgtggctttcttggtattcaattccagcatgtgtaatgagaaaacgggataataggaaaaatatgtgattttaatgagaacgcaagtgtaaaacaaatatttaaaagaaagaaaaatacaggaagggccatttgaatagaccgaaaaaaatatacgaattagagcagagataaaactcctgcaaaaaaaaagaaaaagagcagagataaaacaaaatgtaggttttcatgaggttggtcctcatgtcaaatcgaaattgtattgtcttgtgccatttcacatgaatttcataggattgttgaagtcccaatctttttgtctcaaagaaccaaataggaaatttttcaataggagtcata

SEQ ID NO: 86409 - DNA, 1079 bp, Oryza sativa
agaatagaagagaagtacatcatgaaaatgagcccatttaagggtctcttctctcggttacacaatagtttgtttcgccatccaaattcacgggatctccgatcacaatggacaggtttccactattgtgcaactctaagtgggtctcaagcccatttccctcgatgcattgtctatcacattacgtggtagccccttggtaaactgatctgccagatttttagctgtctggacatagtccagtgctatcactctggagtttttctgctttctgacagatttcagtcttctctttacatgcctagatgacttcatgttgtctttcgaactgttcaccttaataatcactatttgattatcacagttcattaggatagctggcactggtttttcaaccaccggcaaatccatcaggagttcacgaagccactcggcctcaactgtggcagtatctagtgctgtgagttctgcttccattgttgacctcgttaagatggtctgcttgcaagacttccaggaaacagcgccacctccaagtgtgaacacatatctacttgtggcctttatctcatcagcatcagatatccagtttgagtcactatacccttccagtacttttgggtaaccagtatagtgaatttcatagctcattgtaccctttagatagcgcatgaccctttccagagcttgccaatgatcatctcccggatttgaaacaaaccggctcagcttgctcacagcaaatgagatgtcaggcctcgttgcactagccaagtacatcaatgaaccaatgatttgggagtatctcaattgatcccttgctattcttcggtttttccttaatagcacactggagtcataaggagttggagctggcttgcagtcactataaccaaagcgactcaaaaccttgtccacatagtgagattgcacaagtgtaatcccaccctcatctcctctcagtagcttaatgttaagaacaacatcagccactcccaaatccttcatttcaaagcttttggacaaaaagtccttaacctcctcaatcacattgaggctggttccaaaaatcaatatgt

SEQ ID NO: 86410 - DNA, 3226 bp, Oryza sativa
gctatgaattacagtataagtctcattttttacatagtgtacatgtgaacagtgcatacatatacatatttagctcatcagtcagcacactcttccaaaaactacagtaggatttgacagcctcagcgtttgccttatagcttatacgccgtcgtcaagatgtgaattttaaaatttggttttgatgatttttttaatatagttcccttttcagtattaaattttaactcatggaaaatatatatgtaaaaatttctactcataaattattttttagttaccaataagtcgttactgcttgtaaacaaaagattgacctcagatgagaggaggagctggaccagcaatgacgttgtctagcatctttaatggtggaaaaaaaagctcaagctcgtgagctcagctcgggcttggcgtgagcttggttggcttggctcggctcgtaagccaaacgagccaagcctaagtctcctttttagcttaaatgagccgagcccaaactggctcacgagctgcttgttttggcttgcgagcctataccgtcgtgtgtttatattgattattttactttttatggagttattatttgtcaacttgaaatttatcattaagattttgaagaattaaatatataaacttatttaaattttacatgttgatgatttattcctgcttttttttaataattacaaaatatatatgaatatgtatatcaaccggaaggcttgcaagctggctcgagccaggaaacgagccgagctgagctctagttttagcttgtttctctaactaagacgagtcaaaccaagcctaatttattgcgagccactgcaagccgagcctcgtttccacccctaagcatcgtcacttgctgccatgtgtgccgtatgccatgtcctttctctttttcttttttccatcgcaccattcgtaaactggaccctccaattcctcgatgtgtgctcatggcccaggactctttggaatccaagcaggaaattaattaagcccaatagttacatcaccgagcagaaacccagcccaagtaactgggccgaatccagcccaaacgtcacgctctgggattctggcccagattacagcccaggcttgtagcttacctggagctcatattttctctcaaaaaaggaaaaaagaaactagagttcatatggttggaattctatgatatgctaccgcttgccaaattattgctcggtcgaattttaataattattttatttccttttatacaaagatgttatagtatatgttctcgcaaaaaaaaatatatgttagagtacatgattaattagggccgaaaatgatctaattgttataataaaatatagttaattagtttttatcttatacttaggccgtgtttagttccacagccaatttttttaagtgtacggacacacattttaagtattaaacatagactaataacaaaacaaactacagattctgcctgtaaactgcgagacagacatactgcgcccatgtatgacaataatcaacttaaaaacagacaaacaatgtttcttaaaacattttcatttccattatcgaaagaaaccactaatggccctacatcgaaccaactgaggagatcgttttcaaaaaaaaaaaaggaaatgacattattggttatgtttaagcattcaacaattgatgcgcaagattcattaattggttcggactaaattttttactataaggagggaaactatgcagtggaaactaaaaatttattactgtaggataagaaaattgatgtttgatgtttgtccacgtcataataaataaaacttttacaatatcattatatgtgtggaacttttgatagtagtcattactcatcaaagcggttcattagaaatccaacgcttgaacatggcgagacttctctctggttcaaactctggtactgtgtggctaccaccctgcgattaaattgaataacatatgatgatatttgaaatatctataatgcattatatacaatttattgatcgatttggaaatacaaattttggagcggctttcaaattaaattagtaagacaagatatctccaaaccccctggagcaccacaagtgctatatgcgacatgaccattaatttggaatacattttgagatgccatcgatcagatgttgcaaaccttaaggaatagcagtatatatgaaccaaatcaaaaggtaattaaatagatatattagatggattgttacgtacctttacagtagcgaaagtcatgttgttcatatacgttatggtgaacctgcaatagttatatatatttccaaatattaagtgcaggatcatacattaactgaaggcactggccaaactcaatataattaaggcatgaacaaactatatagtgctatatccatgtaatataatgaatcttaattaccctgctgactggccatcgacgtgccaagccctccagtcatctacaacagagaagttgagtgatctcacccaggcttgtgtgcccaaaaatggtatcattgcatcatggtcaccactgtttacataaacattatatgaaaatacgaaaggttaatcaattagaaaactgaacattcaaccacactataaattaacagtagaatcaccctaaccatatgaaaggtacacaggtaaactagagcaggcatatttatctgattttggcaaagaaccaccttgacgaattttttttttggcacgcggggtataattttctttttctttttagaagggggtcagggtagagagggatgcaggggagtgccaaaaggataagataattaggcagagcttattttttaaaaaacatattgaaagtacaaccaatcttttttttgaatttatagttcgtttcaaaaggatgatttgctttctaagatattattaatttgtttccattttctgatcaactatcctttgtgtttggcacattaatttgtacctttttggccatatattgtaacaaaactttcataaatagtttttgattgatcggtaataattaatgcaacaacacactttcatatatatgtatacaaaattaaaatgtgtattaaaaagtacgcaatactacctgtataccaaggcacggtaaccttttgttgtaacattgtgatgaaactttatgttgcttttgatgtccatcgagtaaggcagatctccattgtggcaccttaaccactcatcgacacttccctaa

SEQ ID NO: 86411 - DNA, 5112 bp, Oryza sativa
ttcgcccgttctaactatgcacttcgtcttttgccctttctgcattgtctaccagggtgttcgccaaaaattgtgcattcggcccccttctgggagttggcaaagaaaaaacgagaaatttgtggcgttgaagggtttgccgaaggtatgatgcccatttcagcctgtttatcgcgaaatggtaatatacggccatagctataaggtttctaaggttgccggctggctgcgagcgcaccccgggcgaaccttagaagactacgatcatgttcatacaagacgtttggaggatgtggttcgtttttggcgaaaccatcagaagactgatcggcaggaggcaatctcccagcgtcgttacagtctagtctgtgtttcgcccccttctcctcttagggtcgtgtatgatattagtagtgatgacgaacctagttcgtctgatcatcccttagagagagagagagtgattgtggaggcgaggatgtaatttatttctaagctaggtgtaaagccattgctctttctttttacttgtaccatgttgatgtgtttgtattcttcgatgtgcttttctttaaaatcagtaaaggtgcgttttatttccttttcgctatttttgcattgtcacttcgcgtgctttcgttgggtcggaacatgtcagcccctttgcgtatattagcgaaataggttctgagtttttagctttcggcttcgttctcgatccgttttgttctacgttgtaggaagcacttgtgctttccttttgatcgagtgtaacggtgttcggttagttgttccccgaaacaagctgttgtgatttcaacgttcggcgagcgatgcttcggccgattcgtttcgcccccctggcctttttcgctgatcaggcgtttgccttgggggttttccacaaattatcaatcacacaaataaatgaaaaagaagcggaggacacagagattttatactggtttgggcctccgtggtggataaaagccctacatctagttattttttgtcttttttcattttcctcttttttttcttttttttcttttgccgaaaggcttacaaagtgccgaagggcttacataacgatatatacatttttacaagttggcgatttgggtgccacccgctctagacatagaaacgcttgagagaggcagcgttacaggaatggtcgaactcttcgccttccagtgtcgccagccaaaaggatcctgttctggacttgtgcttgatgaggtacggtccttcccacttcgattcaagcttgccagcagctatcgggttcgccttcttccttaggacaagatgaccaggcaacaactccgttggtcgaacttttttgttataagttgccgaagtgcctatggcatacttgcgcgtgtgttcgagtgcttcaactctcaccccctccaggagttcgagtggcacctcgcgcccctcttcgccccagagaacaacacccttggtgagttagcccccagctctgtcggggtcattgcctcttcgccataaaggagcatgaacggactgaacttggttggtcttgtgggggtcatccaaagggcccagagaacagataacatttcctctggccatttgcccttcgctgccccctcaagccttttctttagtgcttctaggatcttaccatttgtttgtttggccgccccatttgactgtgggtgcgtgaccgacgcgaacctgatttccaggttaagcccttcgcacatttctttgaatttgtcagagtcgaactgcttaccgttgtcagtgatgaactcttttggcacaccgaaatggcaaacaatgtttttccatacaaacttctgtactgctgccgaagtgatcgctccgaggggttcggcctcaatccatcgggagaagtattcgacggccacaattgcgaacttgtacccatttcgcgccaccgggaatggcccaatgatgtccaatccccatatggcgaagggccagattggtgcgataggctgcaactcatactggggcgcggtttgacttcggccatggcgctggcagctttcgcacttcttgactttcttaacacaaactttcaacacggtgggctagtacactccttgtcgaaacactttggaggcaactgttcttgcggcctggtgcgtgccgcagagcccctgttgtatcttcttcgccatttcctcgccttcggcaaaagagatgcagcgaagcaagggttgaagtaccccagagcgatatggctggcccgagaccatcttgtaccttgcggctctgagttgcaggtgctttgcttctgcttcatcttctggaagccagctagtctcaaggtattttacgaacggtgttcgccagtcgtatagatcttcgcccagttttgcctggtcgattgccatgacctccatgctctccatgggcacacttggttcgtattggacttccaaaaagatacctggtgagtgtgggcctccacaagcagcagatttcgccaaggcgtctgcttcctcgttatagcctctaggtaaatgttcaaccgttatgccggtgaagcacttttccatagaccgaacggcctccaaatacctcttcattccttcttctattgccccaaaggatttgtcgacatggcctgccaccagcttgtagtcggtccggattagcaagcgccgaattcctaatgcttttgcctttcttaggcccagaagaatggcttcgtattctgccgcgttgttggttgtgtcgaactgcagccttgcggcataccgaatcggcacaccacttggcgaagtgagtactaacgcaatgcaggtgtccattcggccacgaagtcagctagcacttgagacttgactgcagtgcgggcaacaagatgcaagtcgaaaggggatagctctgctgtccacttgctaagccagccagtaacttccttgcctcggagtattttgcccaaagggtactgcgatgacactatgactttgtgggcctgtaagtaatgtttaagtttgcgcgaagccatcaccaaggcgtaagcgagctttcccatttcaatgtatcttgtcttcgctccttgcaatgcttcggagacgaaatagactggtttctgtcctgactctgtttcttggacgagggcagcactgactgccactggcaaagctgctgggtatagtagcagttcacttcctggtgctaggttgatcagagctggcgggctttgcagatattgcttcagctcgtcgaacactgcttggcattcgggtgtccaattgaattttcccgcgccccggagggtcttgaagaagggcaaacctctttcggctgccattgagaggaatcgactgagtgccgcaattcggcctgcgagcttttgtatctcatgtacgctcgtcaggggcttcatttgttgaatggcatcgattttctcagaactcgcctcgatgcctctttcagaaacaaggaaacccaacaacttgcctgcgcgaacaccaaaaacacacttctcaggtttcagtttcatacccgccgcgcaagttgtcgaaggtctcctgtggtcgaaagccttgcggctttttacgacgatatcgtcgacataagcttccatgtttcgccccagctgcttatcaaggaccttgtacaccagcctagcgaagtttgcttcggcattcctcaggccgaaaggcatcctgaggtgacaaaatgtgccaaatagtgtaatgaaagctgtattggggatatcggccgggctcatgtggatctggtgatagccggaatatgcatccaggaaactcatgagtttgcaaccagctgtcgaatccacgagctggtcgattcgcgacaaggggaaatcgtccttcgggcatgccttgttcaggtctgtgaaatcgacacacatgcgccatttgccgtttgatttctgcaccagcactcgattcgccagccactcaggatagtcgatctcttggatgaccccagtcttgagaaatttttggactttggctttagctgtttcttggcgatcagcggacatcttgcgcagcttctgtttcgttggcttggcatccggcttgactgccaggtgtggacccccgtttttataacaggaatcaatcgtgtaaacagtaccatttccctggatcaagtagtttggtacacacgaattcatagctgaaatatcaagtgcacatacacgagtgtctgatacgaattattacatcacaggcccgcaggcatagtcttaaatcatcggaccgagaggtccggaatacatccaaaagcagaaatagataaggcagcggaattcaggcagcggcatgccattgccacaggcaacgaccgtactaagacctactggacgctatcgtcttcatctccctcctgataataggcatagggatcctccgaggcttcatctcctacttctgataaattttatattcgcaaggatgagtaccaaccgtactcagcaagccaccacagcaacaatgcatatgaaagggggagttcaaaggatgcccatagttcttttgcgcaaagcaagttttgtaattcttttcacaagcctaagacctagcattgacttgatcaaatttagtacaagagtttgtatttaacaacgacggttctgtccaccatccattgtgatcccaaggatagcttcccgccattgattcgtcatggttttctgaggacgtccaccttcccgcctctcaggaagtggctccaacagcataaaattcatcatgcaataacccctcccacacaagttaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacctgctccatgaacttaaatcctcatgcactctaggcgtccatgtttctagcagtgagaggagttctggcgctcccgggaaagagaagtctcacacacatattaaatttatggttcaagttaagttctctctcacacacactcatggt

SEQ ID NO: 86412 - DNA, 2687 bp, Oryza sativa
ttaattagggttaattcttattccatcgcaatgaaatataattgatccccatatggtcgcgataatattttatttattactatccacacctaatctttatttttaatttatatttattttaccaatttgtttttaaggtttatttctaattaattattctttactcacgattaataatcctcgagatcaactccagataaaatagacgaataagatcggcatgatgcaattagtttaaaaagttgttgaaaatccgtatttttagagtttttgttttgtcggtcgaattttcagggtgttacaccaggtgatgcatgatgagatctgtcgaaacacctcccacctgatcagggccacaggcgaagatatcactgtttttcttgagtactctaggatgttcgcagcctcttcttcgcccatgtcgccccccagcgatacgagctttgtggggtcgacgtcatcaatctgcatcttgattatcttgtcgtgaggggcaggctttggcgcgtgcttcacccggtcatgttgttcggcctcaacattatgcactgctctattgattacggccagatcgccttttgaagcggccgaaggctgaagccccttcaccacgatcactcccaccgggccgggtatcttgagattgagataattgtggtgggagatagcttcgaacttgttcaaggtcgcacggccgaagatggcattgtagttgtatgggatgtcgacaacgtcgaacaatactcccttatcgactcccccggcctctggcgaatgccgagtagatgctgctacgtcttccgctcctcataggtgcctcgaaagttaagtacaaagacatcgcgcaattgctcccatgagtaaatgctattggcaggcaaattaaaataccaagaacgagcgatgtcgtctagagcaagatgtattaccttggccttggtattttcatcaccatgagccgcttcgatcgcggacttgtaaatagagaggaattcctttgggtcagtttcgactaagtagcgtgggacgggggggaacttgaattggggtgggattggacgggtcttgattccccactcagcggtagcccctttttgccccctgccgtgttcacggcaccttgctgtgggtacggcgtggcgaaaggagaaatcacggcttgcgcatgaggttgggccatgacattcggctgcccggctccgattggtgatgcttgctgacctgccatggatgagttgaacgttggctgggaccatgccatggcgacttggtttggtgcttggtttgctccgaagcctagcgttggtgcttgcggccgaacggttggtgcttgagcagtattgatgaagtcaaactgcggtccttgactccaaggcgaagcccccagacctggctgattcaacggcaaccaactaggcgcaccttgacttgtattcccctccaggtgggccgaaggggctgtacctgaaatgctgtggggttggctgagttgctgaaggaaagcttggagctgcacctgcagagccggttgagggtgtacttgggcaacgaccggctgagcttgcagttgcgcgtgaggggctggatgcaccgctgcgatcgagggctgcccggcgaagtatactggcgcttgcgtgacttgtggcggaatgtcgcgcccagaagttcttttccgtagcaaaactcaattaataaatggttggaagaaattatttgtttaaaggcaagagagaaaccctaaattaataaatgcaaataataatcggaatcggcatgtggaatttttcttgggttctacatgtcaaaatacgctaacaggatttttagtggaattttcagagcattggaaataattttaaccaattaaaaatgagcttgtgcaatatataaatcactggaaaatcctttcttctttttctttttcctccttttttctctcttcttgggccgtcggcccagtccgttcgcctcccgcgcgctcgccctcctctcagctgggccggcccactccctccctcctctctccgggtcaccgacaggtggggcccacctgtcggccccttcttcctcctccagccgacggcaccgccgccgccgaaaccgccaccgacgccgccggtttccccgtttcccgcgcccactccgccggtaccgcacgcccacgtcgccgcccaccttccccgtacctcccgccagctcgcgcgcccgcaaacggcgggggatttgaaatttcccccactctctctctcctcctccacttcccccacgtcgccggccaaatcggccacctttccggcctcgtccgcccctcccgagcccatataaacaatccctccactcccctccactttttcctctttccaccgctccctcccgtgccctctatcgcttccgcgccgctatacccgccgccgccgccttttccactcctccggccgccgctcgccgccgctggagccgctgccaagccaatccgccgccgttgttagcttcgccgccgccaaagctaccccggccgccgcatccccatccaatcccgccgtcggggcccgcttctccccgcgcgccggtgagtaccaccatagccgccgccgtcggccatggctctcgctcgtcgtggacaccttctctccatctaacctctctcacttcctctcttagggtgtcccggagcccgtccgcccgtc

SEQ ID NO: 86413 - DNA, 813 bp, Oryza sativa
gccggtcggtgaagacgtagacgcccaacaacggcggcataaaggccagccgtgcaggcggaaacaccagtcggcagcggcggtcgaggcggccggtcggtgaagacgtagacgcccaacaacggcggcataaaggccagccgtgccggcgaaaacaccagtcggcggcggcgaaggcaagccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaagcaccagtcggcggcggacgaggcggccggtcggtgaagacgtagacgcccaacaacggcagcataaaggccagccgtgcaggcggaaacaccagtcggcagcggcgaaggcaagccggtcggtgaagacgtagacgcccaacaacggcggcataaaggccagccgtgcaggcggaaacaccagtcggcagcggcggtcgaggcggccggtcggtgaagacgtagacgcccaacaacggcggcataaaggccagccgtgcaggcgaaaacaccagtcggcggcggcgaaggcaagccggtcggtgaagacgtagacgcccaacaacggcggcataaaggccagccgtgcaggcggaaacaccagtcggcagcggcgaaggcaagccggtcggggctgcaggaatcgcccaacaacggcggcataaaggccagccgtgcatgcggaaacaccaatctgtagcggcgaaagcaagccgttcgg

SEQ ID NO: 86414 - DNA, 1830 bp, Oryza sativa
gccagggtggctggcgccgccctttgcctccctgcaaattgaagatccatattgcacaaatgtaccaattcacagtttgcaattcaaattacaattcacagtttcatacagactaaaacaagttccaattgcacaaatcacaactccaaaagtccatcacatagtgcatcacatattccacacatcaaacaatgccaaaagtccatcacatattccacacatcaaacaatgccaaaaatccatcacatagtcctcacatagtccatcacattttatatcacatagtgcatcacatatgtcatactaccaacaaatagattaacttcatacaaatcacttcttccgttggcgccaaatagcttgcgagcccggagtgtacctacatttaaaaatccaatgtttaaaacatttaaaaaacaaaatgagggaaatcaaataacatttgagaatggtaagctcattttacctctttttcgctgcccgagtggatcgcaagttgtattgggtgggttgcgtcctctgaggcgcgtcgggaagctgcgacatgtctatctcctcagcgtttggtgcgacatagtcctcatcctcctcctcgtcatcatcgtcgtcgctaggtggagccaacgccttcccctttcccctcccttgcggaatgcgtgacgacgacgagccaccaacttcttcatgctcttctatcctgatggagtgtcgagcggtacttggacgcgcggattgaggtagtggtggtggtagtctccgcggttggtacacgtcgtccaatgcaaccgacctgcaacctaatcttgctgcaagttttcggcacctttgacgaactttctgcatttcacttaaaaaagaagtttgttaggcataactcaagtaatgcaaagtgctaaataaattttacctctaaaacattgcggagtgtgttctccgtgtccttaccacccctcggagcttggagggtatgccccatttcattcacactcctgaggagctctctcgattgaaagcgtgagaagatatatattagggtctgggatgcaaatggaaataactttgacaaatgcaagaaaacttacgactatgtctctaagtggggcgtgctccatttgatatccaactctagtccggacatcatagggattccgcccctcatcggagtcgcggtcatcctctatgtcggcttccgtccaagtaaggcggaggaacagtctatatgtcctatgcagccaacgaaggtactctgagaaaacatgattttggtgtattgtctcgatgtacctgtcgttccttccggctgtcctccattcatcaatgtatctgttatactctagcccccagtctttcaccttctttgttctcaccctgtcgtacatagacaagtggaaggtgatgaaagaatagtgagcatcgacaagggttaaatggtacaaagttgaacattgacaatgaaagcaaacaaagataagaaatatttactggtgtaattcaactccagttgagatgtcctcaaccggccagtcttgtttcttcccgaactgtcgcatgacacggtgcggaaggtggtactcaactgcccagaaacaaatcaatgggcactggtacatgaagtagtcagagtctcgattgcacattgagttcagggtcaggcttgaagcctcatttgtgtggtatggtaaccactcaatctgcaaaagttgaagagatgtcgttggttagtatctcaattaaagaagtaaatgtcaaactagaagtgatattggaagtacttacatgttgaggctgtaagcagtccatttcattgacataaggcttgtatgccacatc

SEQ ID NO: 86415 - DNA, 7009 bp, Oryza sativa
tcatttctcttggcaaagatgtgctaggaccccagttcttctttatatccaggactttaaggtgatacagcctgcatatagcttctggtagctccagcctggggcccttgtagaagcagcccagttctagatagcgaagattgacaaatgctgagatgttgcctatcaatgaatccaagtcaaagaagaccatctccagtttcaacacacggattgaccttacctcattgagttcttgccgaaacgtgtctgcaaaatccaagtcatgtggcccaaacagcatcaatgtgcttaagctcctttgttgcaactcacggaaggaattagagaactcttggaggaaagaatcattaggatacacagtgccattcaattttgttttgtactcccactctgttattacactgacatgacgaacacatggcggtgcattcctaggctcattgccctctatggtaaagctttcgtcagatgaaaccttctgtgccagatcatgaattagatcatgcatgatgagtaaggttgagtgctcaaactgtttttcgaaaaatccccaatcaagtagatcatcaaagtattcatttccaatgtcctcaggtcgtgtgtgaatatcagcggaacatagcaaatcttgcgctatccacatatcgatcagacgctctttctcatacctatgatactttgggaacacagcacagtacgagaaacaactttgaaggtgagctggaagatatttgtagctgatcatcaaggccggcatgatatcattctcatcatttttgtacttccattcaccggtatgcagaattctcctccagtaatcaacgtcaaagctccttctcaatactttgcttacagtctttgctgctaaaggattgccctttaacttgtcaactatctgctgcccaattttttccagtcttggttctcctttatagttctcatgtccaaatacacattccttgaacaaacaccaaaagtcatcttttttcaaaccatccaggttgatgtgatctgctgcttctatcattgttgccacagatggtttacgagttgtgacaagaacactgttccccataacatcgtttttaagcaatggatttaacagctcatcccatttttcctttgtgctatcctcccacatgtcatccataacaagtagcactcgttttgacttcaataagtagtcaagtttgtcttggagttgaagctccttcgatttcttgatttcatcatgctcatccccgcaaaaggagtccaacatttcctgcataatcttattttgatcaaagtgaacagatacataaacccataacagaacgtcaaaatgctttgacactgttgagttgttgaagactagcttagccagagtagttttcccaatacctccatcaccgatgatggcaaggatagagagtttcttcctagcacattcctcacttgttaacttgcttattatcaagtcacgctgttggtccctcccatgaactttgggttcactttggcatggtgatgtctcccgatgatctgttcttgttctctggtatttgtgcgcgtaaaggtaatccagactttcaagctcaagagcttcactcacctgtttggctatcctgtagcatttttcagtgtatttacttatctcattcgagatgcacttgttaagagtctccagatagggtactggactactgctactagcaatgtacgtagtaacctgaagagcagatgcagatgaatctgtgttgctaagagaactttctgtggtgtctttgtcatcttttgctgcatcattgttaaagaactcaacatccctttgaggcatggagagaagcaaatttccatttgcattgtcatgcaatagctgaaaaaaaggggcaaaagtggatttaaacaactatcaaaagttgctatgcatcataatttagtataactctgtacccacaagaaacgataattctgtaaagcatgtcactaaaagaagttgtatttatattttggtttgacacgtcacagttgaagagtccactacaaagtagtgtcaagtatttcacatataatagaaatttgtctgcattgaatacatacattattatatcataatgtatgaaacagagcatttgcacaagacagcactttgcaaatccagtcgttgaagtaaacggatagcgagagaacaaaatatggataaataccaattcctattactggtaaaaagatacagattactggcttgaactgttgtaattctgtatcttatttgttttaataatagttttaactgcaagggcctcccctgcagtatcattctcaacaaaattataagttccccaattagttaatcagtgttttagctgtgtgtatctccaggcacacaggccaggatattagttctagtatctaaaaagtaaatcagtgttttacactgtcattaaaatttgtttcaaatttacttgagtaaattgtgcctcaagtatggcaggtggcttacggtttagtgcaagagcttgaggactaaccaatacttcctccgtttcaaaatgtaagtcattctagcatttcccacgttcatattaatattaatgaatctagattatatctatctagattcattaatatcaatatgaacgtgggaaatgctagagtgacttacattgtgaaacggagggagtacatcacaaaagcaatttgcaaatgggtatttagtacaagaatctaaacactgagcaatctagtgaaccaatttggtgagttagtgcattcttaggacagttttgctaattttgtgtgaacatgtgttttccaaccagccattttctcatttggttccaggcctgtgagctcaaatctttttgccttgttccattttgattgcaagcaggtgtgctgttggctggaagattgattgtggtttacttcatacatatgcatgttgaaaaatctgactattttttgatacaaaatatcgaggtaaatataggaagggcctttttaaggatgaggaggctttatcgaagattatgtgccattatgattgctgttatctactgcaaaatgaagatgacaaatcagatatcatcatggcatgtagcaaaattgagatggtcgtcatcaaaactctacacatggttggagatttagtagtaggatttgtgtttgattttcatattctcatatagtcagtagttatgtttagcaactcatgttgcaaagctgtaataaactagggtcagatgcatcttttgatgcagatgctggattaatttcaattatcgcaaaaagaggcatgtacttatgatcattcatcatggattcatggcataggtttgtaatccaccgtaaccggcataacatttttcactagtcacatcaaaaccaaagtatggatactgcattctgattgggtgagaaatgaaagaaagcatatcgagcccacgaacatgccacagcctgcttcgtgcacgaaggtaccatgggcatgtttggtttgtattgcgaaagtaaatcttatcaaacttcactaaagccaatttttggcattcccgcaaaaattttggtaaggcgatgtttgacttgagcaattatcaaatttgttgctattttaacagttgaaagctctgaaattgccaaaatttagtgggattgtgatggttgaaatatgcagtaatttgccttcgatttgtagtacaagtacataggaggattggggaacaaaacaaccaggacctcaggtgaataaaaaaaaatccagaaaacaaaacctgcgctgaccttatcgtggtcgtcgcgctccacctcctcgcggatgcggtagtactcgagctcgccgaggaggtcacgggcgcgggcagcatcatgcgaggcctccctgaggcgccgctggagctccttgttccggatctccttcccctgcgtctccgcgagcaccgagtcgaggcgtcggtgggcttcgacgaggcgccccacctcgcctccgaagccgacggtggaagcccactgctgcagcgcagcagtacgatcgtcgttgactcctccggtgattggaagtggaacaaccgccgccttgtccatctgccagctacaactacagctagggatcaacagagaatgggtgtggcactgtggcgccgtcgaggcctcgagggcgaggtggcagtgcgtgccgacgccccggggcaaagctctgctggttgcaaacttacaatcctctcctccttttccctacgcacgtttttaaaccgtgtattttcttaaaaaaaatctgtagaaaaattactttaaacaattaaactaacctacttattaagtttctttaactaatatataattaatcctacactaattcatcgctatattttccgtatagaagctgaggaatactcaccgaagaacacagagcgcggctagtgactgaggagacgacagcgatgtacagaaaacacaaggccatagagagatactacgacaggagtactgtaggtctgtgaggcattgacaggtcaaacacacagccgagaggtagtcacgttaaattatgcgccaacttgcacatagctacatacgcgcgtgttgtcacgtttcttttcatgctagctacagctagtagtggctgctagctgttgctagcatagttgataagtgaaggtgaagactcgccaatccacccagcactaactaccatatcttcttggggaactctaatactgttggcaagcgcacaaatttcagtttgatcttcgtccatgtggaaatcgatatgtgggatccacgcagagaaactattagtctcgcccgcgtctacctctctcgtgcacaaccgaacctagaatattttattgggtcttgtgaaaaagatccaaatatcctctacatctcttgtgtttccactttaatttcttccatgcaagtcattttctcttctagctttccccctatcttgctttcgttgatttattctcattgtttaactttcttatttcaacttttcataccccatatacctttgtggtgggtctttggaaacctttcacaaatcccgtacaagcgaggtaatgatggcaaaacatgatggctcaacttgctaagttgtgagctagctataatttatactataccaatctctcgaggtgatatgagttcttattgtcccatgacgcgggaggcccatcggtccttacaaattgaagtaactagacaaaatagatgaaaacggggtattagaaagttataagataaattgatttgcagggaagtgtatgagattgaggtgtaggggggaaatagacaaaacactagtgagttgtagggggtatttagatatttccttttttttctttttgaatgtcaatttttcaatgacacactattcgactcccaaaatgtgttcggttttagtatgacattggagctccccttaaacggaggaacagacagaaataaaaaagaaaattccttatgtgcattttaatttagtagtattccttcaatacaaacttaagctttatagagcaattttaccatacaatattagatttattttaccatccaacatttggtatctacaggtaccatgttttgtacacagaattttggtacctcagatactaagtagcttgagataccaaatttataccggaaagtacctcaagtacaaaaatttcattatatatgtccttcatttttcatttttaatctcctcagggcatggcaaaactcaagggtgaaaaggacatgacatttcttatatttgatggaaccagctttcagttaatgagaaaggtaaatcaaatcggtaaaggctagttaatttggtcaagtagctagcattttttttttacaacaggcaacttccattacccagcttggaaaccaagcccaacagcacaaaaacataatcttaataaaacataaaagttgtctagctaccagctcgaaacttagagacaaaagggaaagtagctagcatcgatcttgatcaataggccagatatgatgtaacctataattcaaaattagcattattatatatacggaacgttttattttcactcatactcctgcgcagttcagttaactcactgctgcaccgatatatgtccatttcctctagcgaagacggcatgccttcctccggtagtgaggttatacgtggacaatgtaggatcttcaatgttttcaacaattgaaagtgacgaatctctgaggacaatataggatcttttatgccccattctttcttagtataaatttcatagacatgtaaggtaaaacaaatgaaatgttttatgccatcagtatgtcctttacggaaaatataaatacgatactccagaatacttcgaggtgaaacatatttatgattatgtgcactcgcggaacatttttgtgagggcataagaaatatcaacactgctcccgcattggctacctacgtgtagttgttctagaccattggtcctactacactgctcccgctgtcatcaatcgttacgcctccaccagtcagcctaacccattggcaccgaaacagagggaccttcaggggtccatagtctagttcccatatgttgtcgatgacaccgtaatacatgctagttgtactatcatatcttatggcattgatacgaacatcattgttttggttcgtgctctttttgtctttggctcttgtgtaaaatgtgtttccattgatttcatatccttggaatgtcgagaccgagcaagatggtcccctagccaagaaggctagttgtcggtcaatcatctcgttacccatgaggtgttgtcgcagccaagcggggaaagtatcaatatgatagcatgtaatccaggcatcggacttgccaatgttttctgagcgaacaatcgcctggtgctcctcgatgtaaggagcaaccaacgaagattgttgcaaaaccgtgaaatgtactttacggaataaatcgttgtctgtagtcataattgctctccttccaagagtgccctttccctatagtctcccctcatggcttga

SEQ ID NO: 86416 - DNA, 1988 bp, Oryza sativa
cgccgtcgtcgctccggacctcctccccattcggcgtcacctccatcggcttcgccgcgtcgtcgtcgacctcgtccgctccttcgtttcgcccgccgaccgccggagcaccgtcgccctcgtcatcccgaaccgcgccgccgctttcctccactccggccgccgttctcgtcgtcgtcgttgtcccggggtgagccgaagaccgccgttcgctttcccccttctctccgctctctcgggcgccgctccgctgcgccggtggtcgccggcggtgaccatcggggcgcgggcgcgccgctcccgtcggccgcgccggcgaggccgccctcgggcgcgccctcgcggctgccaagtgggcccggccgtcagccgcccgcgcccgcgggtgcggctgacgcgtgggacccacggcgccgaccgccgccagccgcgtgctcccggtccaccgtggaccgagaggctgacgcgtgggccccactcccgtggacccggtccgcgcgccctctccctcggctgacgcaataaatgggtttttaattaaaatttaaatgaagaaattcgtaaatatccatttaaagagcatataaacttcaaatggccataacttggccatttgaactcggaattggaccgttcaagtctctaatttttccttaagaagtcaagaacccatttttgtgctttgttcctgcctgttgtatggagtttattagagtaaaagccttttcttttccgttggtcgtgtagacgctgcagcttcggaagatccgctcttcgtggaagttgaagccggcgtttgggaaagcgagcaaggcaagtcacatcatccttgagcatattgaatcccagtttataaaattattttgatttaaattattgcattatcgctttgtttaaattcccgcgttatcactgttttatttagccatgcctatttacctttgttatgacattattattgctattgttattattaccttgttcaccctagaataaacaaaaccccaactagtgggtactctattcatggttccactagtataaatttaggtggatgctttgctgaataattaggcaacattaggtggtttcataactttagactttgggaattctcatatcatttggacactatggaattgttggattatggtggaattggacatacacctctctttctctttcaaaacccctaaaacctgttttcggtggggtttgggtgcatgccagttatgggaagtagcaccccggccactataaggattaagctcgggcctctgttgcaaagcactaccgtactaaccacatgtctaatgggtaaggcttaactcggtgctcagtctagtcctgaacaaaaggacacggatagagatggatgaagtcgttgcgacgatggatatctctgaggcaaatgaaggctacgcgagctgcggctcggtagtcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcccttttttggggcttgggacgagctggaacccaggtcgggttgccagttccgtccgattcatcgtaggccttgggttaaggcaggttcgtgagggtcacggccttgttttattatctgtgtagctc

SEQ ID NO: 86417 - DNA, 4524 bp, Oryza sativa
gagaatgttttttggttcaactgggaatttctttcttttaaaaagggggagaagttttcttttggatttttgagcacgatgtgtacatttgtacaaagtgtgctttttaccacttttgtttttatttttccaaacaccgaaacattttttatgaggtttgccaatgtgttcatcgaggagattgtaagatcaaagtatgttttgattcttattctgtgatgaacaattggcatctgtgattattggttttgatatttggagattattgtcgaagtggttttggagataatcaattttcaggtgatgatcggattcactgttattttatgtgaccggtccgaccgggcagaggttgccggtcagaccggcgctatgtgtgcggtcagaccggctggcccgcggtctgaccggccgacactgtgtcggtttcggtttcgggttgtttatttggatatccaagtttatttcgtgattatgacttctaagtggatactatacgtatgtaatactattgtttgctgctaatgagtcaagttggagataacttagtctcggaatatggtttctttgtttgttccatgtgtaggtgacttgatgtctcgggagagtatttgcggtgatggaccgggagtcggcttggggataagatgacgtctgtggtggtcagagatcttgcgggatacttaggctagagttgatgcacgtggttgatggagattccatatggcatacgatggaggtattgtgtgcgtatgggatgcggagtcgaatttggaaggagtccaaatttggtacgattggttatgtaaagtttatttcttgtactagagggtttcctaaggtgtttaggactcttagtatgagtttggttcgtggttttaggctgcctaccttatgtataaatagagggggagcgtgaggcttcccgaaatcgctttttagagcgtggagttgatagtttagttagggttttgagtttagtcgagatttttgtaaggagtgttgttgttgcactttgtaaacacagagagaagtaataaagttgtcatctactttgaaagttcttcgatttgtgtttcaccgggtttcggcggtctaaccggcaactcaccggtggttagaccggcagcaaggtggcggtcagaccggcggcactagggcagtcagaccggcggcgtaagcaggcagcagcaggcagtctccacggttcgaccgatcgatctacattggtcagaccgacgttcatcaggcggtcagaccagcgcatccacttcggtcagaccgcgatccgtcgaatttgagggtaacttttatttccgctaaaagttttggtttttgggtatatcaaccattcatccccctctggttggcttagtttttgtgattcgatcctacaatttggagtgcatctgcatgggaacatgtgaagttagctttccctgacaacaatctttgcagcagaataattgcaaccacgcggaatgctaatgtcgcaaaatcatgctgctctggttttcaacactatatttacaatattcaacctctagatgagcaagattcctataagctatttctcaaaaggctttctcacacggagtccgattttccttctcacctgggggaattatctcatgcaatcacaaagaagtgtcatggtttgccattagctatcatttgtgttgctagtctgctagctaataaaccagagacaaaagaccaatgggagcatgttcacaattctatcagttcggcatttagttcacagataatgaaggatatactgctgcttagctattatgaccttccatatcatctgaagacttgcttgctgtatcttagtatatttccagaggattactggattagtaaagtagatctgttattgagatggatagctgaaggattcattcctgaagtgaaggatcaggcattgtatcaagttgcagagaattactttaatgagcttataaacagaagcatgattcagccagtcaacatcgactatgatggtagcgcaaatgcatgtcgaatgcatgatgtaatgcttgagctgatcgtatccctgtctgaagatgagaacttcaatacattagtagatgggaaggtgtataaatgttcttctagcaatattcgcagactctccctccaatccagctgtgtggaaaatgatgtgatgcaggatttaatgaacaagtgctcacatattcgctctcttagcttctttcgggaaaataaagaaacacctcatctcccaaagttccgttatctgagagtattgatatttgaggattgtgatagcttaggaaaccaacatattaaatatctcagattcttttgccaattaaagtttttgagaatcaattctgaaggtatcactgagcttccggataaaattggcgacctgaaaaatttacaaacactgaacatacatggaagtaaaattggaaaacttccagcagccataggccatttacaaaatttgttgtatctacatgttaattctgatgttgaattacctgatgaggttggagatctacaagctttgcaggtgctgtcagatgctttctcttataactctattaaattcgtggaagagcttaggcggcttactaagctaaggtcgcttcacattggactacattccagtttaaaactttgttatcatgacatgagaacgtatgaggaagctttgaaatcctctctaactgtgttaggtaaacacagtcttcgatcactagtaatttcacgtgctgattgcctgggtgattacctgatggatctattatgtgacactgtccctgtctccaagtacttgtaatgtatggcccctggaatggcatgctttctgagaggatagcatctcttgataatctgtcttttcttgccatttgtgccagaagcattaaacagaaagatctttgggtgcttgggggcttgccctcactgctgaagcttgagctacatttactctatggccctgatgaaaggctgattatcagcagtcaactattccagtgcttgaagaagttcaaattgaaatatgaattgggtggtggactaagcatggtgtgtgaaaaggaagcaatgccaaagctccaaatgctacaccttcggtttaaagcaatggaaacgaagtccaatacgggtttcgagttgaggctcgagcacctttcaagcctgcggcacctcagtgtcacagttgattgtgatgatgccactagaaggagagttgaggctgccgaagccaccattcggaacacagtgagaatccaccctcgatgccccactctagaaatcaaaaggaagtgggaaagcgatatggtaaaggatgaggatgaggatgagatggagagacgggagtgcactatagaagaggaggaggttcagcatcaggatccataacagtttgtcttgcaagcattcagaagttctgcaaggtattggtttgtcctctatgaacatcgtctttctttgactgaatgtctggtgatgtctactactcttcccgtttcatattataagtcattttaacatttttttagtcaaacttctttaggtttgatcaaatttataaaaaaaattagcaacatctataacatcaaatttgtttcaaaaccatctgtgatggtctacttttacatatactccatctatcccgcatatattattaatcttgcaccagtcagtctactgatggtgactttcacttaaccaccttctcttcatagttttaatcctaggtatcttaaaagtttgtagcaacttgatacttggatggggaaacaagaaaaatcttggttaattatgttgttgtgttaagcattgtatatgaataatagtctctcctgactttgcagaactgtctactactctatccctaaaaaaaggtaaactctagctttgaatctagacacgctggtgtccaggttcgtagctaggattgtactttttttttttgggacagatggggtagactctagagtatttcatgactgatggaattgacagactgactcctaaaaggtaagaatttaaaaaactgttagtctgaaactgagtgttgatctagcatgacttacaacaaaatggaaaaagaaaattccctgcctgatggaacaaaaataatctatgttaaaaaaactaaaaaaaatcaagtgaaccccttctagaaaagtagttaatgacatgtataatgtttattcttggaaaacaaatcttgtttttcttccgaaattggagctttaatagtggtgaaactgctgattgtggttaagtgggatcaggtattcttggcacctaagtacagctggagtatgttgaaattatattatatatcatgatcaaggatgcagactaccctgtagtttgtttagcaaggatataccctgcttttattaattgaaatccataataagagagttttacttggggggagaaggtagggagacccaactatatatcagaatttgaacagaaacgaggtacagaacacatataggcatgaatcattagaagaacagagca

SEQ ID NO: 86418 - DNA, 12390 bp, Oryza sativa
agaaagagaaaaaagaagggagaggggagaaaaaaattaaaaaaatccatgtcattgtccacatggcgtgccacgtaggtaagaccacagtcaaacacggttttggaccggaatgatacaataaaccaagtttagggatcttgatgtgcactttgcaagttcgtggacctaagtgaaacctcatgacaagtttaaataccgctggtgtattttactcttttttttaattatgcaaagtccgtcggatgccttgctacagaattccttgctttaaacattttttgatttgtggatgagaccacatatagatcttcttaattgcaaggaaataagaaatacctacggtactgcagatgcaacgatcatatatcgatcttccttggtggcttggtctaaatgaacttttagatttgtgtattctcaacccttcaaatttacagggtccaatgatattagattagaaataacttaaaaacatagaaactaatgttgattattttttgaaaaaaaaacaatgcgatcgtgaagcttgctctatatgtgcagatatcttcagatatcttaatgaggaagcatcgccatatacctgtgtcaatggtaatgcagatatagtactgggtgcagataccctaatgagtaccaagtgcttgatcgatgcatgataatctctgtccaaggctccaaaggcattccggtttacgctggcagtgatctcggcaaagacagcaataataaggattctttgatttcctcgtaaaagaagcacatatggaattggtagctttactaaagtttacaaccgaattcgattctgtagcatgaaaataggagatcagagcgcatctaggattttgttagattttggaggctggtatgcggaaggggaaggaggtggataggaccggtgtttataaattattagagtgtcacgtggtggtttaggagtgtgtgtaggaggccatgtgacagcttaggagtgtttatagggtgtttcatggacttctagtgtataatagatagattgaaagatatggtagagttctaggatttaattgtataagaatttcgggacctactgaattgcataggatttaatagttataggattgtacaatatttcttgttttcccagtgcagccgcaccgctagccccctcaggggcggccctgtcatttatcaactcaaataggaaatatgcaataaaggtttgggagcctcttactagatcgtgccatcccacatcgagcgctctcctcttcttgcgccctccaggatttgctttccgactgagccacgccatcccacagctgaaagcacatgtccacacgacgcatactaactccgacgcgctcccacatgaacaagcgttagagcctaccgtacaagcacacacgatccccatacacacagacatcaagtgccacgaagaaacacataggagaatgggtgcggcgctagctaggattaactcaacaggaccacataataaatgtttagctagcttgcactttgtctgaattcctgaagaacactgcaaaattaagggcgatcgtaggtcagttgctatgatcaaaatgcaacaaacaagcatacatgtaaagcccagcagattgatggtcttatacgagaggatgaaccaatacctgggttccagcgcttctgatttccaactgtgatcagtggctactgaatatggtgctcttcaactccacatccatctgtactgtcttttagctgctcctcttcatcttcctttaccattcgatcttgcaagtatctccgcaatacgagagtgggacggcgggtgtggatgctgatcacgttcctgatggtagcttccactgctttcacgtccgttatagtggcattggtacagcaaagatagaaggtgagatgctggaggctggaaaggtgcacatagctttgctcgagcccaaggtttgatgctgcttcccgtgcatacaaactaaaacaaagcctctggagttttgggcatagctccaggttcaaacaacaaccaatgcaggcgactgttgtcgaaaataaactcctttagacatggaaatccactacagcctacagtgagtccatcccccaggcctcgggacaagaatacttcaagatagagaagcttgggtatgcccaaggaggacgaccactttctgatcaatgcttgtaatattccagagacgaagagaggcaagattacaaagggagaccatccgatccgaaaatttagatattccattgccatcaataaaaagctctttgagatctggagcactactgcaacatgaatccatcaatgtatctgaaaactcaggagaacaagtaacatgtaatgatcgaaggctatttttacccaactcattgagagtgaagtaaaaggcttccttgtacctctggaaccttgctacatcacctccaaaatcataaattccaggacaaagtatgcgcagctgccttaatctggttagccaacagagagctcttgtaaacattttatgctgtaccgaatgctattaagatatagcacctccaaagcttgcaaaactccaatttcatctggcaatctcattgggtaattaaaatttaggcgctgtagtttttgcagtctacaaacacttgacggaatgtttatttcgtcgacatctcctgcatgaatagttagtgtttctagttgctgcagccgtccaatatccttgggcagctcggtaacatttacaccaaaaaccttcagatacttcaactgcaaaaggtatgttaggctgttaatatgctagctatccaggttcctacaccgatacagatccaatacccgcagagcatggcatttcttaaattgtggtatttgtttcggtttaggattctcaaagaagagcagcgaacgaacttgtgaacagttgttcgtaatcttcttgactattctattatctgtgccattggatgggaaccaggtcctccgaatcttcttgaaagaactccaatgctgttgttcatccactattgcgacgaaattttgtccagtcgataggcttatgataagatcaagcacaatatcatgaactcggcaatacttggcgctgccatcatactggatactaactggttggatcaagcttctatttataagctcattaaagtagttctctcctacttgctcctgtgtttgattcttcacttcaacgatgaatccttcagctatccatctccatataaggtcttgtctatcaatttaataatcctctggatacatttttttttagataatggaatataatcccggcctttactcaaagagctacagccaatccactggatacatgcttagatacaacggatattttttcgggggataaggaagatcataataactgagcattaatattttcctcactcgagcctctgagtttagtgaagcaccaatagtatcatgcacttgcacccactggtcctctgaatcggatttggttgctagcaagctagctatggagattatagctaatggtaaaccacgacatttcgatatgatggcatgagagatgtcttccaggtgaggcgggcagcaattctcagaattaaaagctctccggtaaaataatctctgtgattcttgctctgctagtggctgcatgctgtgaagatagccttcagatgtggtacggctacacgctttagctacggcagcgtttcttgttgttgttatgattatactgcccaaattattctctgggaaagcacaactgaccaccttccacgcacctatgtcccaaatatcatcaacaacaatgaggtacgtgagtacaattaaatttatgatccggtcatcatactttcgcatcaatgtggatgaatgatcatacataaaagctagttaccactcatgtagctagaatattacaattaagagtgcaaagtgttttattgggtttgttctagttctagatacaaccatatctgtctgtacgtttcggatttgctatatatcttgcgacagaaaattgaagttggaaacttccaaatttgagcatcttttccatccttaaaggcctgtttggttggggagagtttttaggatggattgggaatttagagggatgaggctattaagtgttttattttgttgggagacatgacaattttggtgggatggggatggagaattgagaaagaaactcctttcttttcaatacctgggtagggacaggtaattgggagggaattcctcctttactttttctaagcaaatctcagccatccatttttattaatgacctaatctccaactaaactctctttaaatttccatcaccgctaccaaacaagatattaggattaaaaatcaaattctcatcttaatctcatcatcaattttctcgtgtaaactcccaatccccttccctcgagttaccaaacaagccgtaagaagataacatgaggtacgaggtaccatgaggtatcaatcttatctaaccgttggtttaacaggggtaggatcgtctaatgaaaatgaggtgcccgtgctaatgaccgcccactcggccaatagggagttcgtctgtgccgcccacttcttcggcgcatcgaagcttccccggcgccgccgcatcgagcctgttttcccgccacggcgccatcgcatcgaccccggcgcggctgccgccgcaacaaggccgccgtggccaccgtggcatcgaggccaccgcgggcgccgccacatccagcccgccgccccgccgtgggcgctgccgcatccagcctcatcgagacagccgcggccctcgtctcatcgagggcgctgtgcctgccgccgtcccgagccggcggcgtccgctgtcgcatcgagccggccgcgcctcccgtcgcatacaggccgccgcctgcagccgcatccagtcgcacagtgccgcatccgcagccccatataccgctgacagtactaattttgaggaccagccgcaggtaatttgatttgtgctgcatctgataatgtgtggtagattaggaagctctagtttttatgattgacagcaatgcttgaagtaatcaaggtggtcctttttttgggcaggttcattgcgccgtgtaaaatggaagcagttggtagcagtattgaggaggaagagtatgctctactattatgggcatgaaatttcctagtgagtatcatggttttcaattctacaatcagtatgctagagagagaggatttaggaaggaggtatatatggacagttctaacagaactagggagccacgggcattatctcgctgtggttgcaaagctcaatttgagataaaacatgatgaggaaaaaggaaattggtatgtcgttaggtttgaatcgaatcataaccatccgttgtgtaaagctgatcaagtgccatttttgcgctcacatcgtagaataactcctgcagcacaggctaagatggtggaattgagagatgttggtttgcatcagcatcaagtgatggatataatggagagagaccatggtggttatgaggctactggttttacttccagggacatgtacaatttttttgtgaagctgaagaagaaacatattaaaggtggagatgctgaccatgctattaatattgagtattgctgttcctgtaatgagatggttttataacctcgttggtttgatttggttcctgtaaggagatgcttagataacctctttggaaaccttgtttttcctgtaagagtgccttgatgaccttgatgattcctataagaggagtaccttgatgaccttgatgattttgttctttcatttactgtgatgatgtggtgtgagcagaaattattacagtgcgcacgcaagtagctctgtttgtttgcaaacacatatcagcaagtaccttgatgaccttgatgattcctgtaagagtaataccttgatgactttgatgattttgttctttcatttactgtgatgatgtggtgtgagtaggaattattacagtgcgcacgcaagtagctctgttaaattgcaaacacagatcatcaagtacctctgtattagttatgcaactgaacatgcctgtcatcactaactttgcttttcggtatgtaaaaggatctgtttgagcatgtaaaagttatgcagtccataatgactgtctgaagtgagcataacattccattgttgtgatcatctttgcaaaattctcaggtccatcacaaaatgcacacaaacaggtggcgcatagtaatagacacacatacaggggcatcagttttgcaatccagtgcactagaattgactgatagatattttacatcggattaacatagcatacattacacatggtgcactataatggactgataagtcttaactgataacctaggcaaagtgcatagcatccattacatatggtgcagctagaacaaacagcataatactacatatggcaggaaacaacttaatactagatttcgcctaataccacattaggggggagggggcacatagatgttgttcatccttcacagttgttgaggagctcaaggctaagagtaagctcagcatcgttctcactgaacatgaagacacaaacatcacatagctcgaataatttgtctccaaccaacttattccatccagttgtgaaggttgcttgcttatctttcgatttcattagtctcatcgggtaggaaacagttgatccgaccacagtcacaagcaaatcttcaattggaaggtgttcgtttatgtactgctcgctaaatggtatggagaaggcctgaaaaataaatacatgacagttacactcaggacaagtacggctgaagaaatgcaaaagcggtggaattaaaaggtcaaacacaccatttttccctttttcagattagtcttatgtatctcatacacatacagtgaaatcttaggcaaattgcttgctgcaatgcaggcaagttggtactgcatcttgtgtgttaaaacaatgtatctggatcaaaatgtattgaaatttttctttcaaaatatgtctttcaagctattctgtatgatttctgtttccctaatttcaatccaactgtaagatttttgtttccctaatttcaatccatcatcacccatccaaaatatactgcccaaacattgaataaaaaccacaaattgcaacgaataacacaaaccttttcgatcggtctccatcctctctctgcatgttctgccacaccaagtcgggattttggactatttgccatcctcctgaatggcgtattcccaaatgccatcttcccaaataactttgatgatttgccatccgggtccactgatttgtttctattttaccactattcacctcaaactcagcaaattgagtagaaaatgacctcactacccctcccatttctcctttcccttcttccttcttgctctcaggcattagtgatgtggcggagcagtcttcggcgtcttctgcggcggtggcatcgctcatgctgctgctaccctacaagaggttcaacagcccatacatcacacaaaatcgagcctgacaccacccgtcctgtgccgatgatcgatctcgccagtggagtggcacccgcgcacatggatagacacccagagaaacttctggaacacagctgccattagtgccaaccggatgcgcatccctgtccaccacgagtcgagccaaagaaataatgtcggctatgaagcgactcgacaaacttgatggctggtggtgcattaactgaacaggtcagtaattgaagccggtgagcatgatctccccaaggtagcacatgaataggacgtctacgggacagctttcctacgctgacgtcggcgtcgttgtccttctgatggccgtggcagctccattcatcggtgaacctttctgacacgcatgtcatgttgtactcggaggtaatgagcgggatgttggcgaggttgaatgccttggaatgagggaattggcaatgcacaggatgccacgagaaggccagtcagctgaacacgccggtgttgcgtatggaaggaagaagaaagaaggaagtggatagatatgaggggcaatcaactcattttctactcaatttgctgagttggtggtgaaaagtggcaaattagaaacaaaacagtagaccgaatggtaaatcgtcaaagtcatttgggaagatggcatttgggaatacgccattcaagaggatggcaaatagtccaaaatccccaccaagtccgaatcgctgccgcaaacatcgccgacctcacgacgaatggccgctacaaccatcgccgagttctccggcgaatggcatcctgccaatgccccgccgtcgcatcgaggctgcctcgcaccaaggccgccgtgcccgtcgtcacagcaaggccgccgcgcccgtcgtcgcatcaaggccgccgcgcccgccgtcgccccaaggccgcctcgcccgctgtcgccccaaggccgccttgcttgccgtcgccgatgaaactccgatagccggccttccgccgttcaactcgaccaatccgccttgccgttcaacaccgctgtacggttccctcgccgatttagggttaagctttccccctcacacgataacagatgacgcacgcgaaattacaaagttaccctcccacccacggtaccgcgtcaaacagaaggagcggtaccatgaggtaccgacgaatcctgtccattagatgaagccagatcaacggtcatgatttggtactgcatagcctcaaggacagtaaaaaagctctccaaatttaatttgtgctgtcagataggcgttaagattcacgattcacgtgtgggggaggaaatgaaaatgtatccgcgcatgggatgaggatcgactcatcaaccgaagctagtggttgtgctagatcgtgattttatttgtaatatattagacctatttctgtatttgaagagaaaaaaaactatgtttgaaatctctattcgctgttatgttccacaaaaattagaaaacataaaaatttgtgtaacttttatctttcaggaatcctcgaagatgactgatgaggttctgctcatcttcagatacatctccattgctcccaagtcctttaagcatatcaaccaagaccttccttatattaggggtacgtgaaatagacacaaaagttatacacttaaaatccccttgtattgtcttgtacaattcattagctagagttgtctttccaagaccacccaaccaacaatcgaaaccactttgcgttgttctgatgaccaatctttgtgcatgatccacttaacgatcttctcccttggaccatcaatccctacgagcctctccacctcctcatacaatgccagcagacggggatcaatttccaccatacttggctcggagatgaaatcatcgatctgataccgcttgcgacgttggtcctcctccataacccgattcttcagttcttggatacactctgtgatctggtgttttccccatagcttctttatcttgcttcctatcttgcgaacaaagttggcattggcatcgccacaactcaacttgtggatgaagaggtcgatgcaatcctcaatatcataagctagctcgagcatgttgttcctccactccatggtcggcccatcaagcttgtcctccttgttcgatagatgctcaagcaagacactgatgctgctgagctcattcctcaaaaagatgatatccttcttcacacttttgagcagcttgtactctccctcgatcaaggaggaaagcttggttagaaggggattcagcaccccaactgaagcactcacgattgctcctgccatctctagctccgttcctctcccacacacacagtagcagctatctcaattgctgttatgctaatgagagactaatccaaccatttgactttaaggtgtagtcttcacctgtgcacagtggttgtcgcaccatttgattcctttcaagtttaataggctattgattatttcctcatgatccacaccctgacaagtgacagggttcttaattaactgactacagagctcgagtctcgcacatgaccacgtgatctaacatgcttcacatgcctctgcctcatcttttgttgaaaaaaacacaacccagtcaaaaaaacaaatggcaaacctgggtgaattttagtatgatattaattccgtcatggcagtactatttgtgaaacatgagaggattctttgtggtaaatctgcagctgtatgcccaatcaataaggaaacatttctttctgtcatcaactcggcgggcctagagctctcgccgacaaagttataggctagattagcgttgtgacctctactcgtgagaatcaaatagaatgtatagggttattggactgaatcaatttaaaaatcccattatttttctttctgtcagcacccttacacctgccatacgctatatacataaatacatatgaaatcaatataaatacatgtgaaatcaatatgttgatttaatctatataatgaacatttgtcaaaggtaagtctttcggaaaatatggtgaacagaatgttggcacttggagccggtcagaccgagcagtgggcgccgatcagaccggaggtgtccgagcggtctaaccgggtagcatgacggtctgaccagcagactccaggagggaatcggtttcgggttgttttcgtggaatttctagattgcttcatgtttatgactactagattgtttttattcatatgtgatactatgtgtgctgatatgagtcaagtcggtgcggacttgtatacggatatggagttttttagttgttcgtgcgcaggtgttgcttgaggccatgggagtatagctagtgatggatcgggactagacttgggagaagttgaggtccagatggtcaaggatatacgtgggatgcttaggctagaaaacaatgcacgtgtaggtgaaggttttcatatgacatacacgtggtgttgtatgcgtatggaaagagaagccaaatttagattggagttcaagtttgaaaagattagggtttacagttgtatggggatgttgtttccctagtttggtgggtttcttatgttatgagtcctattttgtaacaccctgaaattaaaataaaaatatcatgattgaaattgggccgaatcaaattgggcaagtcctaccagtgcagcccacctcccctaactagtaccctagggaggggcgactcccaccttcccactcgacgccgccacacctttctcttggcacccatggaactcatgtattcttttctcccctgttaaccctactccatggatctcctagaaccatagccctaatcaagaatctgattggaaaaatggatcgtcgaggaagaggagaggagcaggaggagtggtgggttggttttcccatcatattctcacaagttctccaagcacaccctaggtgaggcattcctctcctgtagcagaggttgtaggttattttagggttttagttcatcgttttgggagggttagaggatgggttctaggtgctgtgttttggatcgttagttcggggcgctgtcagattttctgtctctctgtatttcaccaattagaggatcaaaacgatttttgctgcgaaagcttataacaaggaagttgtagaggttttccttatctttccatattggtaaagtacattttgattaggagagtagaactccagatatggttgctttagtgtggacaatctgaaatcttgggcagattctgaagcttgttttgatgtgcgctttaggccatataaatgacagaataaaaatatggtttctacacgaaagttgtaggtattattctgtagtttcctaaaatgtattcgttttcagtgttaaacttaataattactgaagtaacaatgttgtttatagatgggagaggtgatttctgttttgcttgaggttgggatagcgtcgtaggagcgtgccacttaatttattatagttatatttgaatgtgttttataaggttttgttttaatttattatagttatatttgaatgtgtctgctgaggttatgtttgtgattatgtggtagtccttcagatcgtgtatgtcagggttatggataccacatacctaatagtagttgactaaatctcggcaggatccaccacataccatgttttatacggaaactgacctcgagggagttccggataaggaaagacaactagagttctacatgaaaatgacaaggactactcggattgtatccatattgatttccctagttctacttggacaaggagacacctatgggtataaatacaagaccccctaggaagagagagggggaccacctcaatcaacaccgccacaatctacggaacaatagatcaagacagaagatcaacatagaagcctacatacgccaaga

SEQ ID NO: 86419 - DNA, 5158 bp, Oryza sativa
cccgggccgcatttgaatttttcttatacgtattttagtggtttgccaatttctttttcaatttttaattaattctattattccttttaaaaaatgatttttatttcgggatgaatttatcaggacgtgacagttagaaagtattaagtatactgcccctgttgagtgtactttttgatcacccgtatagcgaacggccttggagttattaccaccgatcagatcgagtatatatccactgtccgtccctatgaggatgaaacatacttagtacaagggcatatacttaagcatggagccgatggctcattgatatactttttccccggttgtacaaatgaaatcccattacccaatgcggggtatcatttgtacaactgtcaggaactaaccattcccctacagaccatagaagaatcttgtgcaggtacatcttacaggaagacacgcaacagaccaaggcaagagcatgaggagtcatcctcatcgatacctgtgcagatgtacgaggcggactgggagccaacgggagatgcacccggttggacccaggcaccacggcacagcaccggtggttcttcctggcacagtgccaatgagaatcgctggcaagcaccgcacgacgtacactgggggaacgcgcacacccgttcctctggatcaagtgggatgcctcctgcttccaactggtggcgctcgagttcctctcgggacttgggttcctcacgatgaggctggacaccctttatatgcaggcgggtgagaatggcagcaaaatgctgatgctcagttcgtcaacatcaataacctgatgcaacaatagcaggctgatcttcaagcatactttcgcttccaagggttcaatccctacagggacctaagtgaagggctcaattcctttccaattgcatatttggatttccacattgcatcctataaactaaaaatgacataaaaaaatttgcaaaatagaaaataccaaaaatataggttagagtttattatgctaggtaagacaactagttctcttgttgagatgatgaatagtttctctgttttatatctcttatatatgggttcacggttaagtacgctctcaaagattgaataaatagtagccacatattatccgggaacctgaggtaagtgggctgcacttgccgaactaagtctaggttgtcgcgagatgatatagtgataagagttgctatgatcctgttctaagtttgacttaaattccggatgttttattttccaaaatgataaacttaaaagttcctcatttgataaaaattcctaccagagccaaaaattttcatatttgataaaccatatatattttgggcgcttgtacttccattgaactttgtcaaaatcttgagacttgtgtagatacttttcatactctatgatcaagatcatacacccacatatatgcacatgcaaacttctgcactagaagttagcattcattcattccatctatatccatcatgctatcacccaaaatcaagctctccaattatatgctttctccttccaatataatatcctttccaaaaagagataaaaagagggaaaggcatggttaggaaaataaagtcttgctcctcaaaatattgagcatgataaaaaaaatgagtagccatgccccttccaaaaaaagaaatgaatgatcttgggagaagaaagaaagcacaaaggagaagtatttcctttttttttccacattctatttccaccatatagcacacacactttatgcacgatcttgatcttgagtatgtctagtcatctgctctagtctaagttttgacttagtaataaatgcaagtatgctatgtttgatacctaccaagctccacatactaaaccttagagtaggaatcaactaggctacttggtgaggaattcatttatatacactctgagtgatcgagagggtcatttgaggaacttggatttcttttgaaagatcatttgaaaacttccggaataaaaggttgaataaataatgggtgactagtgcttgattgctgttctatcttccaaccgcacaagacaaggtaaagcaatgtctcgcgggaatcagttgtaagggtaagacacgtgtcaaaattatttgatttgagagagtatatctaccttgcacttgtacatttgagaatatacagcatagtagcaactcctgatcaacaatcaagttttgtttccttttgtcctttactcgagacgagcaaaggttcaagcttggggggttttgttgacggtcgttatcgatcagttacgtccgtcaatattactagaataaaagaactagttatgcttgcaatgcatatagtgtaataataaaataaaaactactagtacttggttcactaaccctctgcagagaatgggccataaatggagaaaaatcggcatcaaaaccgtacctctggtgtcttagctttatgaggtgcccagtttcaaaggtacaggaacaggtgtcttctctttaacctgccatacctcctttgtttttggtgcggtcaatggcttcttcgaaactgggaacgcaggttgaccgacctgtgttcctggcttcttgggtgccagcctaaggtatcaacggatcctcatttcttcttgatctttaggaaattcatcatgaaattgctgaaactgtcacgcccggaaaatctatctaaaattccgaacgcttacatgtgtgttaaaccctcgtccaggaatcaactgaggcacacaataacaaattgataatagagtacaaataaataactatttaatattcgcaaataataaattattacagaggtagatagttcctctcaaagaataacattctacgcagcggaaaataaaactataacaaactacggaacagctatggcgactccactccacaggcatcctaaccagaacaagcctaatcctccagatcatcaccttcactgagatactcctcttctgatgaatgaatattgcaagaatgagcatatgacatactcaacaagtcacacagcaaatatgcaagtgcacaggataacaaaggatggcataatatagctcatttgcagaaacagcatttaacgaatatttaagagaatagtaaaacagttgtaataattaatcaatattaaataaacaccatacaacacacccatgttgcataggcccaaccacatttgaacaaccaaccccagttgaacaaattaaacctccaaaccaggaattatccattccaaaccaggagtcaaattaattaccacattattaccattaatgagtagtgtgagactaatcacgaaaaacattgctcaactcacccataaccgcgggtacggctattcgaatagtttaaactctgatcagaggtgtaccactgtacccacaagacacaaccccacatcatgtcaccatgtgcctcaataccaccacggtacctcggaaaggagttgtgacaataccccttgcacaacataacccattacagcgcacctttcctggatcataatcaccccccttataaacaaggcatggactccccagcgacccccgtggacttctcgccacttctcagtctgacgcactataatgaatcacgctatacaaaagataaagccgttgcccacgctggcttgtggttggcacgataaatgtttcacaacagtagctcgcgaaccggtccttaattgtcatgagcacaaccatcaaaaccatatgctcacaacccaccttaaccaggttttaattatcaattaattaacatcacacgattaaccatcgtgagctaccatttaatgtaaccataattaaaacattaatataacatagtttataattaatccctttaattagctatgtttctaggcatggctaagcaaacttacatatagcatttagctgaaccaatccaatatataaggttcatgctaatcaaattataacccataggaaaataaagtcatcttcggccattatttaattgggaaaggttcaccacccgatgacattcgaaaacaatgcatagttgaaataaaataatagctttaaacgggttcaacatgctcaaagggttgtttgggatctgtgtgacttgccttgggcttccgcaaacgcttcggaaccttcctcaaaggaaacgctctcctccggaacgtcggaaactaaagcaattaaacaaaaatcaacaaaacagtacaaaaacaagcataaacagtacatgtggatatttttaacatgtaaatcttgattttagaaaaatttaacaacttgaaccacctaaaacggatctacggttatttagttatgattttccgaagatttaatctattagaaaatcgggaaaaagaaaaaccgatgacgtcatgctgacatcacccaaggcggccgaaccacgatggcgacctcgccggagatagagcggccggctgcggaattggagggcaagaacacgtagaggacgacgagacgaacccaacggtactcaccacaacgacaaacgacgtcggacgacttccggcgacgacggggaacgagcggcggctcgggttgaccgacggcggcgagctacggcggccggcgacgaaggggaaagggcggccgagctactccttgctcctatgcacctaatggcggcgagaaaaggcggcggcgatgacgcaagcggcggcgcggcgcggctgagctccggccggcggcggcggcgtcttgtcacgcgcggcggcggcgctacggagcactagagaccacgagagagggggcaaacgaaagagggcgacgaggtggtcctatttatagccttggattgaagagatcggactcctcccgcaagaaatcggtccgagaaatcaaaaactcggttttggagataaactcgaaaacgagtttgattcagataaaatacccaacgatttgctccgattcttgaggggaaagatagaagagaacgagaggatcaaaacccctcaaaaatccggaagaaatggggccggattgggtgcggatttgaggcggcaaggcggcggctcgggcggctcgggctcggcctgtgccggccggaggttagggacacacccgacaggtgggtcccacctgtcggcggctgaggggaggaggggcgggcggcgtcagctgggccggcttgggccggttc

SEQ ID NO: 86420 - DNA, 774 bp, Oryza sativa
ttttaaactgaactgaacacagccttggttgtactctaccggagggcatgaccctgcagcagctacaccaccctaaactagcagctacacacctgtacaccctgcaactttacattacatcattattaacttgcacctgcccaggcaggtatcattacattactacctgcgttttggaagggattttataaacccaaacggacatttcaataccgtatgattaattaagtcttaactactcttttttaaataaatagattaatataatattttaaagcaactttcgtatagaatattattttaaaaacatacaccatttaactgtttgaaaaacgtacaagtgaaaaacaagatgtaaggctgtatttagatccagggttaaaatttttgccgtgtcacatcgtatatacggacacacatttaaaatattaaacgttgtctaataaaaatacaaattacagaatccgtgagtaaaccgcgaatttattaaacctaattaataaatttcgtctcgcggtttacacgtggattatataatttgttttgttattagacgacgtttaatactttaaatatgtgtttatatatccgatgtgatacgctaaaattttataccccaacacaggttgtgtttagttcagcgcaaagtttagattttggttaaaattaaagatgatatgactgaaaagttatgtgtatatgacaagttgatgcgatggaaaatgactagtttgatctacacagccacgtcctcatcctgaattcatgatgcgc

SEQ ID NO: 86421 - DNA, 6678 bp, Oryza sativa
tatgttgagtgatatgacccgaacgaagtacgttctccggcggatcgggatcttcgtcaagcttcgccaagtcgtcgtcactatggattttttgacaagggatacttcaactactttggatctgggaagtcaaacccaaccagagtacgtgccccgacaagatcggaaccatcattgtcaacaatttggtctatcgagatcatccaagcctcaagatacgcggcgtactaaaagacgtcagatcgtataatgtacaatgagtacgcagtaaggtaattggtggattggttttttaaattaatctactaatttcgtagatacatccggcatgtatctataaaagtacgcaatattttatatgcaatttatcgtacatattcagatcatacaacattgtcagatctataatttattatgtttacctagagcatgttttttatacaatatcaattatgcgagtgcttctgatgttaggccaactacggtttaatgctgggggctcgctctattttcttccgtataaatcatgcttgtttacggtttacataatgcctgatatttaatctgctcgttatgtcctgaaaatactagaagattcatgcaattttctaagtacatactcgatatgatctgctatatatcttgccttctagaaaaattttcaggaacaattgagcactcgagtaggttgtggtcaaacacacacaatatcgagaactttatcgataaatgcggagttgtcgcacccaacctaccaacgaagaccgacgacctatctcatagcaccggccatagctgggctattcgagaaaaggttgttaacggataattcctcgtgaacgttgtcggcttgatcacacgacatgattgcgaatggatatccggatatgctataagttgggtatgtgagtcatgctggccacatgagatgcacatgtaataaaccaactttagcgcccctataggtgattgagagacgcctactcgttggttctcaaccagtcaatcgtagcgatctctagcacctcaacttcaatcggtcgagagactcctactcctggttctcgaatcagtaggacgtaacgatctctcgtgccacgacttcagatggtcgaggtacgactacggcaatagcgtagcggtcctcgcaccacgacttcactcggtcgagagatgaggctactcctggttctcgaaccagtaggccgtagcgatctatcgtaccttaacatcactcggtcgagagatgaggctactcctggttctcggaccagtaggctgtagctatctctcgcacctccacttcaagtggttaaggctacacctggttctcgactagcggtgtagcgattctcctactatttccacttcaagtggtcgagttaaggctacacttggttctcgaccagctgctgtaacgattctcccactatttctactttaagtggtcgagttacgactaccacctggttctcgaccagcggtgcagcgattctcctactacatccacttcaagtggtcgagttatgactacccctgatcctcgaccagtggtgtagcgattctcccactacctctactccagcaaagttgatatcaggtacacagtatcgccaagtgttttacccagagatcccttatcacgacaacacctagagttgaaaccaatcctactgtccctttacgccgccctggcaaggcctccgaggaacctaagggaacttcggctggggacgcccagagtggataaggccttgtcaggtaatgcagagacgaacgatcatgtaagatctggtcatgtaagagttctcaccatgcgtattaatcaagccgtgtaatcggaaattgggttttccaacttcacggctaggggctagggtaagtgttttttcaaccaaggcaggtcaagggtccaagagccttatcctccgaaaatgattctccgacaacaaggatgggggctagggagagtgtatgactcaacaaactgactgatcgaagtcggtaaaagagaagacgctcgtacacaaaacattggtctgtaaatttaattcattttcagttttccatacatattataacatgtcaccctttgaacagttttccaccacacatcctatgtcttatacggatacaaccttaggatataggaggagtttcgcataaggaaggatgaatagagttctacatggaaacgacaaggactactcggattgtatcaatattggttttcctagttctacttggataaggggacacctatataggtataaatacaagaccccctaggaggaaaggggacacgcaacaatagatcaacatacaagccaacatacgccaagacaagccgccgaatatcaacatcggagataagcttagtagtccccatacggtacctacgactaccgtcaggagggatctagcactatctttgatctcgccggacatggattcgaggaggaagactaccctgttgtcgattacgtgtctgcacttcagaccgccatattgataacagatagataggctaccccaaatattgttctggtgtgattatgatgaataagagcaacgaccggcttcggccaacaggagtagggttattacctgacaatttaagggcccgaacctgtataagaatcctcgtccctatctcttttacctcagtctcgcatataccctggtgccaatgatccccgtactatgcaaataccggcaaataccatagtcatgacatcagacatcgacaaggctaacaactatccatgtcaattcgtacaaggaagtacatacagtacaagaactaaaaaaaatgcaaaactagaatacaatttctaaatatgcaccgaagtactgtaaaagtgtagaaaaagtacaagactagactaaaattttattagaatacctaatgcgatatgtcttcataattttcactcttcatcaacagaaggtagagaacctgaagctaaatctgaaaaatgatattatataatgtaagtgatacaaattatgagaacttaattatttgtaggttacaaagcaatgcatgacatacctctaggtaatttgtgcttgcgcgtcctcaaagcatgataatgttctataatctgatgatcttcaatgctagtaaaaacatcccgctcaatatagcaaatcatgcagtgattcatccattcatcattcatcttgttccgcagctcagttttaataacattcatagctgagaaggctctttccactgttgccgttgcaacgggcaaaatcaaggctaattcaattaagcgatataccaatggaaaaactgtgtgtctatcagtttggaccatcttagcagcaagtttaccaaggtcagagcagcttgagaaatccaaatcagatctcacattagagataaatgtgtcaagttggtctctaaggactaaacaatcatattcagaaaagtcatctgcataaatcttagcaagttcaatgagcttatcttcatcatagttggcaaaagaattccttggatcaaggcaagcaatacatctcaatagctgagtagacctttcagcaaaacgattgtttaactcaacaataatttgatcaagtaccacattaaatatgcatgtccggccggccgctcgccgccctgcgcagtcgccactctccaatcggcaatcggtgatgtgagagacagggaggagatgaggagagctgagaacgtgagagaagagaaagaatgcgaagcggcgctcggtgatgcgggatacggcgtgatgcgagagagagaggaggtgggattagggtttgtgcatctattgggttgggctgatgggctgctattgggctgagggatgtggggctgaaacaggccatgtgtggggctgggccttggggatttggggaaatctgaaaaaagtcaaggtactagtccactaaaatttttttcacgagtggggcttgcgcccaagctgccctaggcccagttccgcccatgttaagtaagaagcagtatgcacgtactgttttttaaagttagtatagcaatacatactgttttttagtttgatagcagtacatactgtttttagtttaatagcagtatatactgttttttttgttagtaatagtacatacttttttttaagtagcagtatataccggtttttagttagttgaagtacatactttaatagcagtatatactttttttttaattagtagcagtatatactgcattgaagatgttcatctttcctttttttttttgaaggtatacgtttttttatatacctttattggtgaggaacattatataccttttttattcggtagaagtatattttttatttagtagcagtatgtacttgtcatgacacaaaacaataaattttaagcaaagcacatatacgtggtatgatatattgatttttttatgtaagccacatactgaaatagaccggttgtatacctagacctgaaatagagccggtatataccatttagagttcataagtggtatgtgctattttctttttataagtagtatatatatactacaatcctcatcggaggagtatatacccatttttttcagtatatactacccatgaagcaatatatactttttgaaagtacatactgttttttaagttagtaacctcatatgcacctcctaacaaaatgatttcattacgtaaagaaccgggtcaactttattgtagctataattaatgtaacaaacgggaagtaacccactgaatttttgaaacaatttcttgtttccacatgaaattagttgatctcgtagtaacagtaatcaacagcagattaaatagagtacaattatgacgataatggagtaaaattaagaagagatgatggcaaattagatcaatacacgcacacataccaatgactataatctgaaacgaaatcacaacgaatggaaaagcgcgtgtttctaccagacaaatcctgctattcgttggatggtctgccgtgatcttcgatcggagggggacttgccgttgccggtgctgtaggcagtgctgtgatgtcgccggcgccgcttgctgccgttgccgtatgatttcatcaagccgatggatcgtgtcgtcgcctcaggcttgccgatgggctgcgccacgcacgcatggaccctgatcgatcgccgatcgatggatcgcaacgtggccgtggacatcaatcgcgatcgagcgacggcgcccgtggacgtcgatcgaatcgctgccgtcgacgccgagttgtcgaaggatctcgccgtcagctccgacttgctgatggactacaccgtggatgccgagtcgccgattggtctcgccatcgccgctgccaccgaatcatccgtagatcgcgttctcacctaggaacccgatttgttgcgatttggtttagcagtaccgcatgggaacgagagatttattccagcgttcagtataagcgcggcttcacgccacgcccgttaatgtgcacgttttaaaagtaactaaatgaaatgctacaatacagcaatatataatcgagtagatgagtcaggtggtattccaaaggaaaataggacacttttttgggagtgactgtggatcggtcgtccgatcgaaaacttcaaaaatcgggacgtcagcgtccgatttacgtacaaaactattttaaactgatttttctcttaaattacttgtccaaatcatgatctgattgcaccattaaactcgttgcaattaaatcttcaaaacaagaccacacatggatgtattccgacgaaatttttttttacagtagcttattattgtattatttttaaattgtttgcacgatgttccactaggtatatcagaattgtttcactaagatcgaaaatgtttcactcgtttaaatcgggtgttgtttcaccttatataaaaacaatgtttcagtaaatagcgaaagaatgtttcagttcactgcaatattatatctatacatagtgaaacattgtgagtacattgggtgaaacatttttcggtggaacaaaaaaataaaccaaattctcttaatagggggtttccaaaatatgtgagttttttgttgcaatggaatgtttcgttcactgcaacattagatctatacataataaaacattgtgagtatagtgggtgaaacatttttggtggaaaaaataaaccaaatttccttaatagagagtttctaaaatatgtgggtttttattgtaaaagagtattttaattcactgcaacattacatttataaatagtgaaacattgtaaatacactagatgaaacatttttgtgaaaaaatgggagagaagtaagtgagccctgtataggcacatagggggaggggcgctgaataacatgcaccaaatacgctaatgcagatatgacctgaacaaataaataacaaaaaacaaactcttttatcattcattataataaagacaatcgacaactaacaaagagtatctagagggacttacaaactgcactagagcaaagatgaataatatatctctagtaacgaagaaacgaaatttcaatgttcgccatttcctatcagtgtgaacatgaaccctcaaatagtaaggagctttacaagtggtgcaatgcgaaaaggcaaatccttcctgtacatgagacaaagaaaatgccaagcaaagttagttttcttacgaaaca

SEQ ID NO: 86422 - DNA, 1886 bp, Oryza sativa
ccgcagtcctccggcgccgccatcacggggaagggtaccgttgctgccgacataatcctcggttgcttggcgtttctgatcatattggccgccgcgaccagtcttctgctgcactggcacatgagaagaattaacaacaacgaccatgacattgtgagacacttcaccaagaaggagctccaccgagccaccaatggctttcaaaggttgctaggaagaggaggcttcggggaggtctaccatggggtggccaagtcgctacacccacctgacatcgcggtgaagaagctcgtcacctccaacgagtacagcgagagggagttcgcgaacgaggtgcagtccatcgggcggattcaccaccggaacctggtccgcatgttgggatactgtaaggagagggagcagcggatgctggtattcgagttcatgccgggcggctcccttcggagcttcctcttccagaccccacggccgccgtggagctggcgtgccgaggccgcactcggtatcgccaaggggatcgagtacctacacgaagggtgcaccttaccgatcatccactgcgatatcaagcccgacaacatattgttggatgataggaacaatccaaagattaccgactttgggatcgccaggctcctcggtgaccagcagatgtacacgacggtgaccaatgtgagaggaaccagagggtacattgcccctgagtggttccacagcgagaggcgcatcgacaccaaggtggacgtgtatagcttcggcgtcgtgctgctggagatgatatgctgcaggaggtgccaagacccagtaaccagccgtggcgagggcggtgacgatcatgacaactccgtggtcacactgtttggatgggcaagccagttggtcaaccatggcagagtcgaggttatcctgcatagcgatgacgacgctgtggaggatctggagagagtggagcggttcgttcgtgtggctttcttgtgtatcgagacgaatccgtcgcttcggccgatgatgcatcaggtggtgcagatgctggagggtgtggttgaggtccacgcgatgcctcatcttccgagctctatagatacattaccgtccatctctaaggattcacgtactcccaggttcttcttctccagttgaactcgatttgatttctcacaagaacgtactgcagccttcatctcatggcttcacttatttctgataccataccgtgactagtctcagcctatgtgaacatagaaggcaagcaaaagcatacactgtgtgaaatcttactactttgatatgcgcttcatattctgtgtatttaagtttgtttttttttttgagcatttacggttttatggtgtggtaaacaagacacgtcgttgtaataaataacagccgcatacatcaaactagatgatacccatgcgttgctgtgggaatttgtgcatataatttgtatatgactttttaagatatattagtaagggcaatgaaaatattgaacaaaatgtcaagtaatgttgattgtaatacggtaaattatagcatgtactattcgtatgatttaagtaaatgcatgcagtaacagaaaaacatgtaattgtgtaatattgtaaagtataagacagtagttgaaatgtaggagggatactaattcctatctttttctttataaaaaaatatgtttgtttgtgatgctgcaaacctgactaaattgtacgaagattgttactgtttttttatcggccattcattgttgatagttatacaacacaaattggactttcggttctttaattgcatccatgtatcttctttggatcttctcatggaactagcatagtaatcaacatcatctagtgttttgcctggaatcctgaaggaaatagttg

SEQ ID NO: 86423 - DNA, 1182 bp, Oryza sativa
attcctgcagccccggtgcttctcaaacttccataggtgtgtccatgatcctgaataaattcatgagctatccacatattcaccaatatgccaggctcaaaataatagccttttgggaacaaaccacagaatgaaaaacattgctgaaggtgctctggcaagcattcatagcttagacgtaaaattgtcataatatctttctcatttgataaaccattttttagaactcgattccattcatcatagttgaagtttaaactaagatgcccagcaacggcctttattgctaatgctgagccattcaacttttgcacaatgcattcacctatagacttcatttcttgatgttcatttggatctctagtgctgaatgcacatcttctgaaaagttcccagctatcttcactctctagaccactcaaagagaacggagtggtacagcctaatgtatttgcaacaatatccattcgagttgtaactaaaatcttgactcctttcaccccatgccgtaaaggagcaaataattctctccatctatcagcatttataggccctccaaccttttcatcataccaaacgtcatccaacacaagtaaaaacttcttcatttttactttgttcttgagttcttcttggagcatgctaaaattgaaatttgttaggtcaatggtcttatcaatagatgttagaatttctttggtgattctgaccttatcaaagacatgtgagacacatatccatgccctcaaatcataattatcctctattcttttatcattgtaaataagttgagctaaagtagtttttccaattccaccagtaccgactatggttattacctctgatgatgttggtcttgctccttcgcttcttgacttaggtatgcctacctgttctaacaattggttcactagttcatctcgctccttctgacgaccgaccacaaactcaccaagtgaaaatgagctggtaatacgccattggagcggctcaggcaacatgtgtgagctacagttttctggtccaatcactctgacaagcatgtcagcacattcttttactctactcaagcttttaagcatctttcttaacttggatctaaacttatcatggccaaccaaacgcttagcaatggaaatagaactggagcctaagcttctaagatttcggggctgcaggaat

SEQ ID NO: 86424 - DNA, 2064 bp, Oryza sativa
aattgaggaccaaattgttgaaaacctaaaaggctcagctctagccattaaggtgactggaggccatttaagtggcaaatacaacgctctggaatggaacaaaattcttcagaaaagtgtactcaaccctaatgacattatgacaatcttacgctcaagttatgaaagcttaccaaattatcttcagcagtgttttacgtactgcagtttattccctaaaggttaccgcattgatccaaacaggctgatccatatgtggcagctcagggttttgttcattcagacagaaatatcaatactagtctggaggatattggcagaggctatttcaatgatttgctacagcgctcatttttccaagtgttccgatgtggagaccaaatttactatattatgcatgatgtattgaatgatctggcacttcatgtttctgggggcgaatgccataggattgaacatggcagtccgagtgagttaccccatcatattaggcatttgtctgtttctgctgaactcctggaaaattttgtgagttttggtagtttgggaagattgcgttcactactagtttttaacaagtcttggttttgctcaaaactcagcctcactcatggtatacttgccaagctgaagggggtgcgggtgctggatgtaagtggctgttgcatgaaacgcttgcctgatgctgtgtacaatctcattcacctccgtttcctagctatacagcggacatgttacacactacctaaaacaatttctagacttcatcatctaagggccttgtttgtacagtatcattcatgttattcctctggaaaatttagctcacattgttcctctcacaaacttttgaatctttcatgggggcaagtgaacatagctggaggttgtttcagtcttcctgaaagcattaacagactcagtaacttggtgcatgttgatatagagaagtcatatgctctcatgctaacaggcatgcatcaacttccatgtgttgaaggttcaggagaatttcatgttggcaagaaggggcaaagtattgttgggctgaaggatctgaatgaacttcgtggagagcttgcaattagattgctggagaatgtgaaaacaaaagaggaagctgctaaggccaatcttgagctaaagaagcacataagaaagctggagctagaatggggatcgggtgaccatgatggtcacactagcaatggttgtgatgtgcttaatgtgctaaagccgcaccctaatcttgtcgagctaactataagtggatatccaggtgctacttctcccacctggttgaattctggttggctgagcagtttgcaattgatttgcttacgtgattgtaaaaaatgggaggtacttccacctttaggggatctaccattgcttaaagctcttgaagttcggagaatggatgaattaaaaatactagatcaggagttcttgggccgtaaaggattcccctcattggagagactgctgctggaacgcttgcccaaactagaatggagtattgtagagaacgaccagttgtttcctgctctcagagatctctcattttctggatgcccaaggttaagagaatacccgacctatgtgcgtaccctcagacatattgctatacttgataaggaacaaatccacttcaaggtttttatggacaactttgaactcacaagatcattttgctgcctgttgtcaagcttcttctatgtcttgcgtgttcatcacctagagtttgttgaaaagctgaagatctacgtagatcatttgagagacattcctaaggtagccttcaataatatgaagcaactcacagagctcacaatatttggtttaggatcatcttgggagaatacataccccataattagcacattgtgggatgaggatggggttactgtgcttcctacatcacttcaacgtcttgaactaataaagtgtcagtgtgcgagcaagttctttatccaagttgctgaacaacctcgtatgcctcacacactagaccttggaccttgtgatacaggaggaatgccatctcaattatcattaagcatg

SEQ ID NO: 86425 - DNA, 1727 bp, Oryza sativa
tgaagcataaagattccatgggcaaccttctgcacaatgagctcttatcctcctcctatcatttctaggcatcttgatctcaaccctattccttacactgtactcagtaattgcttgtctcaacttctcaacagatgggaaaacaagaccaaccttgaaattaggattgttcaagtcctcttctgcaaatgacttgaacttgagcctgacaccctcatcatcagaatctgctgcattaagctcttcctcatcagtatcttcactttcatctcctctaggcacaattgcaagatttcccttcaacctgcttcctctggctttctttcccttcaatattttctttcctttggccaccccctcatctatcacattttcatcaacataatcaacaaacaagtcatcatcaccatcatctaattcatagtcactatcatagaattcctcatcactgtcatcactctctgtcccactgtcttcttcatcacaatcatcttcttgttgctccctgttgttatgctcttttagattgctctgtggctgccttgttccctgttgttggctgctacttctgctccttaagattaccctttttgctggttgttgctctcaccttattatcttctctacacatataactttattggggctgataacctttggtaaaggtgtacctggattgtctatgatatcatcccagtcaatccctgcaactttgtcatcatggtcaatatatacaactaaggtcctgaacttttcaaccattgatgccatcacatttgtatcagtatcactaaccaccactcttaacccatctgaaatgtccttaccaggtaacagccaataaatcttcaaggtgggagtcctaaggtatccaagatcctcaacgaactggtccagccatagtggagaccaagtgtctatctcgacattatcaaaccaactcactttgccattcaaataagaacggagattaccatgcccaacgaaaaaacccccacggtgaaccttcactgtgaactcatctgacccatcacctagtaaggaagaaacaaatccttcaatccacgatacagcatgtaaacttgtgcaaacaaaaaaccctagctttgccgtacggcaaaacatgcatcgaaccgagccagcaaattccaaattttctaccaacagcaaggtacattactgcctattatcgatctaaacctgctagcatacaaggattagggcttgattttactcaccgtacacaggcgcgtctccacctagtcgacgcaatcttgccaccattctctgccgtcgcgtccgtcgatgggtgcagacagaatcactcccccaccctctctaccaatcctatgatcgattggcgttggttgtcggcgatcaccggcgatcaccacctcctctcgcttgcgtcgcccacttcgcccttcccacaccgaggataacgaggagtcggggatttcgtccttcccgcgccgaggaaaaaaaagagtgggggatttatcgtctgagggctggcgaaaaaataaggggcttaatgcataatgcaccaccccggctgtctcctcccctccacgttggcaagccacgtcagcgagcagaccgagtcaaatggggtttggacaggcaatgtacggctaagcaagtttagggacctgtaaatgcgatttgagagtttggggacctagatgacacacccttacaagtttgaggaccgctggtgcacttta

SEQ ID NO: 86426 - DNA, 6155 bp, Oryza sativa
gctccttaagtggtccgcaggtaaaaataatcattaaaaaattaattaaaaatgtgagaacttcgaatcaaattttatggtcttaaataaactcatatgaaaaagttgccaaaaataaagttgtagaagtcgttgagatctaccaattttcttttggtcatttctccatccgagtttgattgaactatataaaatttgaattttaaaatataagaaattcaaatagttttttaggtagtaaatgatttcaaatggaaaagttatcaaaatcaaagttgtataacttatcaagatctacaacttttgtattggtcatttttctatatgactttgtttgaacagtctgaatttgaatttcaaattataacaacttcaaacaacattttcagatactaaatgatttcaactgaaaaaatcgtcaataaaaaattggtgtaactcattaatatctataactttttattttggtcatttattcatccgacaaagtgatttgtaagattattcacagaatgtacatatctattatatagttttataaactataagagagagatgtaaattttgtgaaaatgttagtatcactttatcaaataaagaaatgaccaaaatagaaattatagatcttgatgagttatacaactttgttgttgttgactttttcagctgaaatcgtttattgcttcataatattattgaagatttgaaatttaaattttaaattgataaaacaaagtcacaagaaaaaatggcctaaataataacagtaagaacacaataacatgatagagcatgattttagaaacatttaggaaaaagaatcatccaatttggagttcgtatgagtgagatacactagtttcaattttattttcgcatgcgggcgcttaagtgagccgcatggaaaaatcgatttttccatgcgggcgcttaagtgagccgcatgcaaaaatgacatcatttttgcatgcggacctcttaagagacccgtatgggaaaatcgatttttccatacgggcttcttaaggagccgtttgcgaaaatgccacgtgatttttgcaggcgccactagttatggtccgtttgtaaaaattatggggtctcgtacagaaaaatcacttttgtagtagtggatagtccattcctttcttccaacgttgaactctccgtataaatggaatatcatgggcaacagcaggtagtacgtagacggttgccttttaagtgaccgctcgtaataacacttagtacatacgcggttgcctgagacatcacctagaaaatatatatattcacacgggtggcactgtgtagagatcattcatgtataatctattttttctagatggcgcactcgtaattatccacttgtattgttgttcttttcgtctttctcacggcattacttcaagtgtccaattacaaatccactattatcggttttcgcatggattccggtcatttcctcttccataatttctcaattgctccgtcaaagggagtttgccaatctgatcccatgatctctccatttcctgataaacttctccttttttggcccctatgattaagatggttagcaggttaattccctccaataagctcaaatggagtactagtcaaaccccattcttctgaagccatgcaagaaatgaatcttgtaccaccacactgaaactactggtcacttccagcagcaaatcatgcagccactaccaccacaaaaacaaatgaaacatcacatgcaagcaccttgttggaactccagctcagctgtggggcatgatgctgcactgaaaaatcctttctgatgttgcactgaaatcttactatgtctttttcttttttttttttacagtggtgctgcccaggtgagtggccactggccaccattctttccctccatccagccacctttgcaccgtgacgtcaccatcttatcttctccctgttcttaacacccacatgctcacctcatctcctttccaacatcttgtgtttgatactactactaaaatgcttgctcatgtagttagcctataacacttggatttttcagatgtagtaggattcagacagcattaaccagtggagtactactccctccggttcgttattagttggtgttagagactagactgtttggatggagaaaaaaaaagatgttttagctttggtgtgttacgtttggactaatttaccccttcgtgtatgcaaaacacattaagctagccacacggatataattattatgggtataataggaaatagtcactctaattaattactcattagtatccaaactcttgtctaaagcgttaaattaataaggaacctgagggaggagtaaacattccattcatttttaaataattgatgaccacaactatcttattttaaccataaattatatgtaaataattatattataatgaatgaaagttataggttacatttacgatgcttcgcattccaataagatgacatattttcaactatttataaatcttctgtaataaaggcaagcggtcaaagcttaaactaaatacgtagcatcaatgtcaattactccctccattccaaaacaaatttatttttcacacatcccacacataccaataaaaaaaatttaaaaaacagaataccctcacctttttcaaatctcaatgcaatcattacttattttatctattcccaatatatttatttcatacttttataaactccgatgcaatgattagccaaaaataaatttatttagaacaaacggaagaaataaaaagtgaacttttattgtcttattgttactagaacagaggggttaacttcaggtgttccccccctcctgcaaaagtttgagtgctctttctgcagcagtgttaggagtaccagttaaccagtaaacttaactcaggtgctcactcccttgcaaaaatgtgagtgcctttctatcatgctgctgcttctgtcccttcactccgatgtcctctcaaagtgctaatttccatgtgtcttttgctccttttggatgacagaaagtttggtgccccctttatattttaacttcagttttggtgagccgtgaatgcatccttgtcatgcaatgtttgtccatgatggagtaggatactcctagcttcattggcgaagagaccaagaaaccaggatactagcgaatacgattccttcaatgcaagccaagccaagaaaattctggcctttttttctctgaatttttgcctgcttgagtgacgcctctctggcattctgccatactccatgtatatgcagtggtagcagttctgcatctcctgcagagaacttctgtgcctgtctcgtttctgcaggggtttgctgctaaactaaactgtggttaacagcaaatgttgttacctctgtctcaaaataagtacagccatgggatattcgtgctcaacgtttgaccgttcgtcttatttataaaaattatgaaaaatttaaaaatatttagtcacacataaaatactattcatgttttatcatctaataacaataaaaatactaatcataaaaatttttcaaataagacgaacggtcaaacgtttaacgtgaatagtacaaaactgcacttattttaggacgagggagtattatcaaaaaaaaaaaaaaacaacagatgttgcctgtcggcctgttgctaggtcaggtatcaggtgaacccccaattgtcagaggtggaaaggacagaacacagcttctgattaaaaaaaaacatcctggcaaatgtgttccaagaaattgatacaggaaatcaaactggagaaaggaacactatactgcctccgtcccaaaataagtgcagccgtagatatccgtgttcaacgtttgaccgtccgtcttatttgaaaaatttgtgaaaaatttaaaaatatttagtcacacataaagtattattcatgttttatcatctaatagcaataaaaatactgatcataaaaaattttcaaataagacgaacggtcaaacgttaaacgtaaatagtgcaaaactgtaattacgtaataagtttaatcaacgggtaaatggacaagacgcattggattttacggcaacaatattcagaatatcagaccatcagcagctaagaatctctgtcgcaccaaggattgctgtctgctatatcttcggctagcatgtctgttgccacgttggagacaacagctctgttcctcattggaatattcaccggtcacggttcatttgaaacgcgaaaatctaaacaatttttataggaaacagtataattcctaaaatcctcctttgcattagacattagacctatttcagtgatgtcaaatccattaaaaagaattttccatgatgcaattgcaaacacaagactccaagatagtttaaccatccgatgatcatagacagcaatttctgaaacatgtggcgactggtacatagatgaaagctgttaatatcatgattcactccagaagtttttttacaaacgcgcaaaccggacaaggacctttcttgcgtacatgacattaacatatagcaacccatcagataattgaagttaagtgggaactggaatggaaagaatactagtggaaaatgacgcagaagagcatctccacacaagctaaaatcagatcgggcaaacctaacgagcaataggtacagcatcaggcagggagctccagagaaatagtggcagaagagtatgaacaacgggtgcaccaaaagcctagaagaacttgttgaactggccgctcagggtgtccttcaggttcgagtacagcccgtagagggagtattgccgcaggttagacacctcataccacgagttcagaactgattcgtgtttatcggtgcctgagaaagccagctggatgccgatactgcagtcaacaggtccctggctcttgcagctctgtgttctgaaggcacaggtttgcttgccgatgcaaacaaggcttgaagatttcgcgcaagcaccacagccatccttcttccaatgcaagttttgaagcctgcctttattgaactcaagaacctagacaagtatcatcagatggagacaacattaagaatattctttgtgtcacaagttgataggtgatgggcatagtggtacatctttggttccataccagggtgaagctggagactgtatatgaggaattggacacaaaggttggaacagaccgggctgcatacttcctaccggcaaatgctaccatgtacccaccagctgtggcctaggaaatatacacagaagaattttggttatatactgatccatcatttgatgcattatatataaaaggactgaacaaaaaagtattagatccatcaatgatcttattagatgcataatatgcagaaaacaaaaaaggctgaacactaaacctaatcagtgtccagtaagagccagtgagctgtgacatgataaaattgacgatgctgagtgatcacacaacttagctaatgaaaaacaaagctgaaggaactggttcctcacaatattactatcttatcaaatgttggaacaatttgtaaagaagaagcattttctgttctctctagagcattctaagcaatagtagcaaatatcaacatttgtatgatgaacacattataagctactaaattgacatatatgagggtgaagaccaagatcaacaaagtaaataagatcaagagctacaggtaacattttgaggttaacagtaggccatgttatcaacaatcagagtgtagagttcacctgtttttaaagaaaaaatataatgaaaaaatgacgcaatcaagaaaagctaatgctgaacattattggtggctacagtcaaactactaggcagcgtgcatcatggagcccaagtcagcaaaataaatccttgtgataaactcaagatagaaacgtgcataatcaattgagatacaatgatatttaaacaatttagccaatgcataacctttaacaatctactttatttgaccaaccttttgaaaaaataaataaataatagccggtacgaattgctttggagtttaagggcatgtttggcacagctccagctcctggagctagagcttaggcaaacagtttcagctccaccaaaactgggagtggagttgggtggagctctctcacaaaatgt

SEQ ID NO: 86427 - DNA, 3572 bp, Oryza sativa
cttgaaaggaaaatcaaacggttgaggtctgatagaggtggggagtatttttccaatgagtttgcatccttttgcgaagagtttggaattattcatgagatgacgcctccctattcaccccaatcaaatggggtggccgaaagaaaaaaccgtactctaactgagatggtgaatgccatgttagatactgcggggctttccaaggaatggtggggtgaggcagttttgactgcgtgtcatgtcctgaataaaattccaatgaagcataaggaagtaacaccattcgaggaatgggaatggaagaaattaaatctctcatacctacgaacatggggctgtttggccaaggtaaatgtacctatagccaaaaagcggaaacttggaccaaaaactgttgattgtgtgtttcttggttatgctatccacagtgtgggttatagattcttaatagcaaactccggagtacccgacatgcatgctggtacaatttttgagtccagagatgctacattctttgagaatgaatttcctatgaaatatacacctagcacttctagtaaagaaactgtcatgccccatgagcactttgcaccgatagaacacaatgatcaaatgcctgaggaaaatcctgaggaggacaacattgtagatactcgcaagagtaagagacaaagggttgcaaaatcctttggagatgactacattgtatacctcgtggatgacaccccaagaaccgtagaagaggcatattcatctcctgacgctgactactggaaggaagcagtacgcagtgaaatggactcgattatgtctaatggtacttgggaagtcgttgagcgtccatatgggtgcaagcccataggatgcaaatgggttttcaagaaaaagcttaggcctgatggtacaatcgaaaagtacaaggcaaggcttgtggccaagagttatacccaaaaggaaggcgaggacttctttgacacatactcaccagttgctcgcttgaccacgattcgagtactacttgctctggcagcctctcatggtcttctcgtccatcagatggacgttaagacagctttcctaaacggagagctggaggaggagatctatatggatcaaccagacgggtatgtactagaaggtcaggagggaatggtgtgtaaactattgaaatccttgtatggcctcaagcaagcacctaagcaatggcatgagaagtttgacaccacgcttacatctgcaggctttgttgtgaacgaagctgacaaatgtgtatactatcgctatggtgggggagaaggggtgatcttgtgcttatatgtcgatgacatactgatctttgggaccagccttaatgtgattgaggaggtcaaagactatctgtccaagagttttgaaatgaaggatttgggagaggctgatgttattcttaacatcaaactataaagaggagatgagggtgggattacacttgtgcaatcccactatgtggacaaggttttgagtcgctttggatatagtgactgcaagccagctcctactccttatgatcccagcgtgctattaaggaaaaaccgaagaatagcaagggatcaactgagatactctcaaatcattggttcattgatgtacttggctagcgcaacgaggcctgacatctcatttgctgtaagcaagctgagccggtttgtctcaaatccgggagatgatcattggcaggctctggaaagagtaatgcgctatctaaagggcactatgagctatggaattcactataccgggtatccaaaagtactagaagggtatagtgactcaaactggatatctgatgctgatgagataaaagccacaagtggatatgcgttcacacttggaggtggcgctgtttcctggaagtcttgcaagcagaccatcttaacgaggtcaacaatggaagcagaacttacagcactagatactgcgacagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacagctagaaatctggcagatcagtttatcaaggggctaccacgtaatgtgatagacagtgcatcgagggaaatgggcttgatacccacctaaggttgcataatagtggaaacctgtccattgtgatcggagatcccgtgaatttggatggtgaaacaaactattgtgtgactgagagaagagacccttgaaaagggctcattttcatgatgtgcttctcttctttcctgcatggtaggatggcttatgtcttaatgtgatccgagtggcttttccaagcagagatgttgacctgcagaacatctcagaaggaacacacctatatgagttcgactgctagtcacagtctatgaggtttgggcgatcactagatactcatgaaaggcctggagtttgacttatatgctccaaacagaggggatgcgaacggcagcccagtgccagtcaaggttctgagtgaaacctgatcacacaaaacttacaattcaaggcatagtccattgttcagttgtggtctgatgtagctcatttcctaggtggaagttcaacttaacagtctccaccaaaaccctggtatatcaaacaggcacaacattgagaacatttcttatgagccttgaaatttggtggggattgttagaataattgggctaggcccaatttataatattaaatctcaaaggcccataataaatgttgaggataataataccacctcaggatttaagcgagaaatatctcaacctaaatagggagttattggaggctccctgttgaccagttgaggtgggggtcggaatgctacacgcgcgcgcgcgcgccgggccggggcgtgggcgtgggcgagggcgtggcgtggctggctggcggcgtgcgtgcgtgcgtcacgtcgctatccttttgcagccactaacccacgttcccacgattccctccgcaacagcgcgtccacgttttttctcctgatagataaggaggccgcgagtccgatccgagtttgtcgcttctttcccggtgttagtttctccttctccgcgcctgagttgctctcgcttccccgcttctgatctcttgcgcgcacgagagattggaaggagcagtgcctccgaaaccacaccttcgcctgagatctgcaccgggtaggcgggtgatcaggtttttggggagtgcctcccgcgcacgactgctcatcgccatgtctggagttgccgccgccactgctggcggaggtggtgcgccgccgccgacaggagctggatctggatccggagctggtgcgccaggaggtgccgtgaacgacaacaacaacggaggcaattctgcctcaccatccagcggagggccattctcggggtataatcttctcctcctgctactggtggtagcgctatcgctat

SEQ ID NO: 86428 - DNA, 3133 bp, Oryza sativa
tgattaactctgcttatcaattgtccctttttgtcctgttttcacttattattaactctgcttatcaattatctttatttccagtcaggagtctgacaagatttttaaatccttcttattacttagctgtagttgattagttgtactatagatgtgtatttcatatttgactgtatatttttacttgtatattttcatatttgacattcttcttgccttactcaggaagatggtatgattattatatacacatttttatttttttttgtaaatcaatttaccctttttttttgttctcttttgtagattgtcaaggagatgaaagaaaatataatgaccaattcatcttttgattttcaaaagcctccagtatggttcttctttatttttttcttatgttttgttttaaaaatttgtaatcttcaatttataacttttttcaaaaaaaatatttgtatttgattcttttttctttgtttaattgcttttaaaggttaagaagaagaaggcccatgctaacacagagtcttcattcacaagattctctgtgaaatatttttctgaagttgtgtcctctttgtctgattatcaaaaatccattatcaagaaatttgagtttgatttcttgctgatgttcaatagtagttatgtgcctatcaagtttgccacttggattgccaataaagttgatgtcaggacatcagagattattgtgaaggaaaaaattattctagtcatagttgaatcagttcatgatattcttgggcttcctttaggtggaataccttttagcaaagattatgaacgtggcaggcaatgcatcctttctatgtttggtcagtctgtattgccttcagttaaattttttggtgatctactgattcagcagaaagatttgtctgaagatcaaataatcacatcttttcttattgtcgccttggcttgtttcttatgccccaactcttctttgactccaagtgtgaagtatttgactattttcgaggatgtttctcgcttgaaatactttgattggtcaaaaatttacctatgattggttgatgacttatataaaaaagtttcagaagaacaccactttcggaggctgcttgttttattgggctgtaagttttatttcacttctttagttttttttgcaatgcatttatattttttttattttaggttttgtatcttgacaatgttgattttggctcaagaaatgttgaccaaagttgtcctcgtatttctgtttggaaagatgacatgatatcaacattctctgaattagacaaaattgatgagaacacttttggattaagacctctgaaagatttccaggacacttgctatttcaaggtatgtacttctgtcttgtaatgtattttttttcaatgaagtttgttgattgtttttatatttttttagcgtgattcaactcaatctagatcagtgataattcaagacaaacttgattcagctattggtagtatgcttccagattttctcaagcatgaaatctctgaaatgttgagttctcattgcttcagtcatcatttagttgacagtgaatcatgtgaagatttggttgtttctattttgtcgctgattgctaaagcaagtggaagtgatgctgtacaagatcagaatgaatctgatattttacattctcaagttaacactgaagctggcccaagtaattttcaacctgcaagtccaaaagacatacaatttgatgttcctcctataaattgtagtaagtttagtttgcttactcttatttcattccatttttcttataatttttttcaatattaattttttgtttttttatgattttttatatttataggctcccttcgctctgctcctaatattagaagtttaaggaatgatgaaccatttgataagtctgcattgaagtctattgaaaaggattgcccatcacttgatagaattgctggtatgtttatgaactgttttgtacttttaaactatatttctttttattaaatatgtactcttttttttcatttttataatagctttgtatggttcttctgtgaattgtgatgatggcaacaataatgagtcaatccacatcaacgatataactgtaagttttttttttaattttttttttacaatgttagactgattgaagttttttgttttagggaaatggcatgaattgtgatatatctgatccttccaataaatcaaatgttctattgtcatcaatgaaccgtggagatgtaatccttctttttatctatttttctcattttgatttgttttatttgtaccaacaaaatttttttctatattttattataggtggttattaatggttctggtaatggtattgctcctagttttgctgctagtaatgtactaactacttttcatttaattttctgtttgttcaatttttcattttaatttattatatgtctatgtattatcaggtcaacctgttgctactcctgatgttggttatcttaggaacataaacaatgatatgaatcaatctaatgcaggtgtttttttgcccattatcaattttaaaattaattcctattttttaaaagtttgtatttattagttcttttactttaataattttgctaggatcttctgttgctgcttttagtcttgtgaagaatgtggcaaacaagtttaggtccagattaactcagttaaattcaagagcagctatatttggtgaagataggccttcttttaggttgttagattctgatgatgatgtcagtgattgtgataaggacaacgaattaggtgtcaatgcattgatgcaacatgttctcaggtactacactattttttcctgttttaatttatatgtttaaaatagaattctttttgcattgatgcaacatcaatttttttgtaccacaacattatttttagttttgtagggctttatctattttcattctgttgaggacactccaattgagataattcgtgggtatgaaaatgttggtactaaagaaagaacaaattgtcaaaatcccaacaagaggttatttcaagatttaactgtaagtttaactcttagacattttcttaatgtattgtttaactcattcccattacatacagttcatgatgt

SEQ ID NO: 86429 - DNA, 724 bp, Oryza sativa
gggcgaattcgagctcggtacccgttcttagtgaggtgcatcacgtcgattgcatggcggacgtctaagaattcccaatagggtaactcccaaaatatagagttctttttccacatcgccgcgtgactatcttcgctctctataggctggctggcaggcccctttccaaacactactttaagatctttcaccatagcaaattgttttcctgctgcaatgtttaggcttcgtacggtggtccgccttatgttcaaagagcttgcctttcttccgtactgggtggtttgcagcaaggaatcgacgatgacctatgtacacaaccctcctacagtgcttaagatacgtactttctggttcatccatacagggagtgcaagccttgtaccccttgttagactgtccggatagggtgctaagtcgaggccaatcgttgatggttacaaacagcagggctcgtaggctaaactcctcatgtttgtcctcgtcccacacggagacaccttccttcttccacaacagtttaagatctttgaacagtggtcttaggtacacattgatgtcgttaccatgttgcttggcgccttgaataataatcggcatcattatgtacttcctcttcatgcatagccaaggggggaggttgtagatacacatcgtaacgggccaagtgctatggccgctggccgttgctcatctctccaaaaggattcatgccattcgtact

SEQ ID NO: 86430 - DNA, 2827 bp, Oryza sativa
ccagtaactgcacaagtcaagctacttgctgaagatgaagaggagaagcttgcattaacaaactcgttgtctagatatgaccaagcaaaggcttttggaaaaacaacaattgatgtagctcgtattgctgccgggttgccttgtggtagtgagagcttcctctcgatgtttgctcgatggaaaaaacttgagagggatttatataatgaaagaaaggagtgagtaaaatgtttcacttttagacttcttgatgtcagaaatcattttattaaccaagtataacttccttctccaatcacttatatagtgctccataaattttactgcagccgatttgacattacacaaatcccagatgtctatgactcctgcaagtaagtgaacaaaccatcttcaagtaactaggttatttagaaagaaatcaggagcgtgaattaactgtctgttttcattagcaatctctattttctagcttttctgaatccaaagccgctaatatatttgaagggtacctaaatactcattatgacataaagttatttaaatttgacacagaattataacgtgatgccattattcttccttatatatctaatgtacttatttgaattatgaaagatcatttacatctgtcatgaaccgcacaatctaagtgctgaattacattgcagatatgacctcctgcataatgcacatcttaaccttgaaggtttggaagagcttttcaaagttgctcaagtaaggaaccttaacgttctgtacttccatttgatctctcttttaaatttgcatgaatgttactgatggacttcttgagtagccacgaagtcatattgactaagtacttcctgcagaagagaaatcagtcaattgcaattgtaaatatatactgatatgcaattgcaaaatatggccatattatttttgtatgaacaactgggtagatagggcattgaagttctgacttctgaggatatcatttgacacaagtcacctgtgccacataaagaatgacattcctagttttctttgcctccacaagtcttggagtgcagactattgcattgtggtcacataggccttgaaaagatcgcaagtggttaaattatacagttccaatgctcaggtgatgtgactatgtgagacaaactgtatggtcagtgcttatgttatgatgattcctcatagaaggttcaatcttatattctttttgtatagccttatgagagatgtgagtcttaagttcattatgctagatcttgtggagtgaagtgacctggaacagacattgtttgtttagtgcatctgtttggatgattcaacgtagaaggtccaattccacattctttttgtataatgttatgtgagatattagtgagaatttcattaagctagatattagtgagatatgttcttttcttcatacttttatcatttcgtataaatcaattactccctctgtagaaaattgtagggcatattttatttggaaaagaagtttttaagacaagactttgaccattgattgcgcataaatatattcataatatctataaaagcaatgtttatgaacgctctttgaaaaatgaatgtattggtataattttatgcactaaaatatacttataatttgactaattgtttgtcaaaaatttacaaagtttgaccttctgaaaaattatagcttttatctattagagccacatatgatgttatagttttggattttttttgttagtttatttgtgtagattagttctctttgacgtttttaatattttcatcatagcttatctaacattgattgttgtagcttcttgctgatggcgtaattccaaacgagtatgggatcaacccaaagcaaaaactaaaaattggctcaaaggtttgttttaagaaagacgttactgtttgttccatccacagatgattatatgctctttgcatgccacaaactgattaatcattttgaatgctttgattggttttcctagatagcacgtcggttacttggaaaaattttaattgatctacggaacactcgtgaagaagcaataagtgtttcagatccaaaatttacagaagatgaagctacattcttaccaacgaaagaatcagagtaccaacaaaaacttcaaactagaaatgaggatggaagaagatctagttccacaagtgagaaatcattggatcaggaagatgaagatgatagagaaactaaataccgcttagatcctaagtatgcccttggttttatcaatcctaatcaatcctaatcacatgtgtatttaatttctctaattcactttattccaggtatgctaatgtaaagacacctgacagacatgtccggacaaggctttatttcacatcagtatgcatgagacttcatgttcagctttgcttttgttcttatcatcatttttggatttaattgttattctaacattctctttaacaggaatctcacatacactccttaatgaatgtccttcgctattgcaacttggatgaatgtctacaaggggaggatagccttgtctgccaaagcgctttagaccgactgcatagaaccagggagcttgactacatgagtaatattgtgcttagaatgtttgaaaatactgaggtatggatctttttcatatggctcacaagaaaacttgccttgttacaaatgctatttttattctgggtaagatttctgtttttcacaaaatacatgagaccatatgtttccaaaccgccattttatgtgcgatgaggtcctggatctctttatcttatttccttgactattctctgttttgcacctacttatgttgat

SEQ ID NO: 86431 - DNA, 8648 bp, Oryza sativa
aggtgcttctaaagatttatgaggggtgaaaaataaagtaatggttagattcaacactagcaagtgttaaaactcatagttatgccaggcggttgtcctggcatatacaagatacaggctagacttgtaatatactcgtaaatgatctagcttcctgagattaaagcaaacatgccaaaacatatacatatctaattgtatcgtatatggaactggttgacatggtaagtatggacatgacatgaattatacgggacttgtaacaagtaactgtcatgggtaggtggttttggccccaagcgtcactgaccaggagctgtgatgaggaaagcaaagaagacaagaggcagtgagagaaacaggaagacagaataagtgtcatcaggacaggatttcctaataacagaatctcatccaaaatttccatactcttagctatatcctttaaatcctcacaggcaatctctaattgatctctcgatggaaatctcctaaccaaagaggagtatcaatccaactaagctgaagaggatgcaccagtgccagtccacagtagcaccagacagtatataccttaaaattaacctcttcgcagtatactatgtgcttgtgtctttttgagcttcaatacttcagagttcataaacaaatacggggtgtttattaaatatgagagcaaacctttgcttcatccatctcgatgctagcatcttccaatccatctagcatagatgagtctttacttactagagagacctggagaagttagtacaaaggcagagttgagaaagaggcaggagtcacaagtaagcaacaaaaaggatctaaattataagcaacagaccagtataggtgttagttgcccttccaaatcaagaaggcctttggcaaatgctgctgctgacatctgacaagtacaccatcatgaacatatactcagatgataaataacattacaagagaaaataacgcatagccacatactataagacaagttgcagacgatccacttctattttgctgctatcttctctctactatacccagtgatagcatccacttttatgattatcctactgaataacttatcctatcatttctgcaatatatttttctgtatttatgtgttcgagtacaacaatttgtcagtgtataacagtggtgtaattttatcaaagtagtgaaagtaccaaaatgagcgtgctgggcttgaatatacagatttgaagttaggctattagttatgacaatagtatattttgcctggttttccagtagtccgggaaatagtgaaaaaatgcaattatctaggagtacaattagattacagagtttccaataaagtttgaatatgcattgattaatattagactgattattgcttccgagccatcctgaacacggtatggatatgatcaagcagatttagcactatctgagaagaacaaacatcatatatcactgagaccaaacaattttcatcagcttaagttatgtttgcccccatccattgttccgtatttgataggttaaacacaagcaggtatgggctttattaccacaggaaataaaaagtagttgaaaggtaactaacaacaattacctatcaacaggtaaaattttcctaaatcctgttggcatgaccaatgtcaacatagaaaggaaaaacagaataaattaaaaaaataaaactatttcagattatctaaattgaactatttcagaggggctataaattgaaaaaaagaagaccaaaagtatacctgcacacggccttcatctgaactgtatatttttaaatcatgtctgtacgtgctatgaaggcgaagcaaaccagttccttcacctatattcaggataacatactagtaagaaaagaatattgagtacaagaaataaactttttttaaaaaaaaaaaaaagagaaaagaaaaccaagatgatacaaggtcatcatgcaagacaaggcagcctgacagagatcacatttcattgagaacattacattacttaaaatgttttaaagcttaaatacatgcaactttattcttaaaaaaaagaaacctgcaacagactgtaatgtcagtaaagttacttttcctagccaatcattgcctataataatgccaggttcttattgcatttatatctaaagaaaataactgaaattttcactagaaggcccattaatgacaggtgtgctagggccctacttgacaattctgtcgtttatgtcaatgagccaattgtaagctgaaggttttgaaaaacataattgatgtaggtattgtacagatatttaactagctaaaataagttgcaaagataaaaaatgggtgttctataatttcttgtttgctagcatcaagaacttcatctaagcagtaacttcaacaagccacatcaactactcacatacatgttattatgacagctaagtcaccttttacatgaacttcctttccaaattaattagaaaattgttgtagtaaactaagtggaacaggtgttcaacatcacaagcctgccaaggacctaggccactactgctcaagtttatggatctccagtgtaaatttctcttttcacttgaaaagaacatcaaagataaaaaaagttctttacataataacagaagcaacacaatgtgaatcttacctggatatatattgtttctgaaaaacctacccaactcttcagcctgaatgagaagcatgaaaaataaaatcatgacgtaagaataaagttgatcacaaatgcaactgtatgaactttgttcctgttgtatccaaatttgctcattcggttgtaagagttatttgtggattgatgataaattgaaaattgtataaaaattttcaaatttctattgtacttattctagatcattacaactcatcgatatttggctagtacgacataatagaacctagttgactaaccatcccaccaccacctattgagttggtgggaccttctatggatatgtttttcttctgatatatatatagagccttgcaagtttacaatattctggtatattcatttaaattccattgcaacgcttaggtactagcctagattggagtaacagaaaactagtgattgatacagaataattctagctctgaggcttattaaattaaacttagattaattaagttgtaatgagggagggtggatatttaccatgagaatacataatactccctccgtcacgaaataagttcatttttcacccatcacatataccaatagaaaactaactccgatgaaatgattgctcaaaaatgaacttattttgggacaaatgggagaggccaaaaatgaactcattgcgggacagagggagtaacaaacagttgaaaattaaagtaaaaagttatgagtacaaaacctgctttctcccagcatgagtgagtacaccgccatattttagaatcatcagtgcttcaattggtcgttcctcttcaccatcaccacagcgctttggaactctaatccatttcagtggctttagttgcacttttctataaataccagagaaatgcccaccctagtgttgcaatgataacaaaaattatcatatgtcagcattcttgtaaaagaatggtataaccttgttatgacagatatgccagcaccctttagaaggctggaggatatatacaagttccgtgctccttttaccactaggttcattatgtttgactacaaggtatgcaagacaaatatggcaccttgttccattaacggcaggaaaagaataagtaactaagagtgaaaagattattatagctccaaaaaaaattataatttcttgaattgaccaaaaattaacaaaaatctaacaatgttagtatcagagtctactggtttataaattaaaagtttgagaaatcaatagtaaatagcattcatgcctccatttgtggcatcatgaactaagtggctacaaagcacactgaatacatttgtgttagctatataatagtaaagagcctccacggggtatatctagtgtaaacctgaacaaatattaggaacaagaatattagggctcaaattaatgaaaagaatgttaacaaattgacaagaaagtctatggattgatagcaaaaacagaaaggaagtgaggttccgtggaagcggaaataacagcatgtatttctattattattccatagcgagttgaataattgtcccactttgtttcttccagcgcatagtcatttgaaatataaatttctaaataagggactaccccattcatccagattcgagtgtttgtcatgcctatttgatgccaaactgaaaaggttttgcatgcataatactagctactcgtatgagtttgcgcaagatatgttcccccataacctggtgaagaaatatccatatcacatggacaggcagatttgaattaaaaattacctcctccagtactgctttgacttgacgaagcttttcaatatgctccaaatcctcagcatcactgtcactttcccggccagacctagataatataaatttggttgagtaaatagaagatcaaactgactaaattaacaagtttgcgaattgtggcaagccaatagaagaataaacttgcacagacagctaattctggattggcttaccttgttggtggtacaagctgccttgtggcatctagcaagtcttgtagttgcacggcacttttcagttttgtctacaaggaaatcaagaaaaaatgatttagtttaagcaccaacaggataatgaaaaatgaatattccacaaaggggatacctcagctcttggctttccaccattgtatttcaacatcaaattcaggagtttttcctcagtaactttcaatttcactttctgctttggtgtccgatcgccactaaacagatattagatgtcaagacacaacaccaatatttatcattcaataccagcttaaccagcatagaggcagtaatccttactggcgtatcacaacaatgacagaacgtaattcttctgactgcccaaatgtgccaattattccacttccttgtcgtgtaagaccttcagtgggctgaactggttcattagatttccaaggaaggcttggagggatggttgaagaaagatgaggtgcctttgcatctagaaatatctttcgtaagatgcatgcagcatcgtcataatacctgaatgatagaaaaacttacgcaaatctttcagaactaattaaggtccatagacagtctgtaagaaaagaacactaggattaaataaattacttgtacgagttcttcacaaagctccatccattaacgtcacaaacatatgatcttccatcacaccttaagagatcaaaaccacaaacctatggaaacaagtcatatcagaacataataggaatattaggaaatactatgataaacgcaaggcggttatcatgaaaagaagatgagaagcaagcaaacacgatagatgcaaagtatctaaagcataactatagagatagtaaaacatactacttcccccaaaaattggacaacatgcaacaccttatctattcagcagagttgcaaattgaaacgtaactagattatataagtctgctgcagtatcagttgaagaattcactctcaagcaaaacaaaacaaaaataaaaggcacaattaatctaggcgttcatttcataggatattcaaaataaacttaagatataacaaagtaagctagcttaccatctgcctaaaagcactgcacacgtctcttgacatttgtttctctgtaggggtcaaaagcacaggataccgtaccttcaagtaataaaataaaaggtaagaaagatgacaggtaggaaacaggaatatcaagaaatgaagaggatgacacattgttcatggagtagatgaaaagctccgtgtcaagaaacttaatttagagtcataattcaaacattactaaacaacatccattaaatagccaatagatttttaaactactgtgtgtatcaattaacaaactccatgatcttaaaaataataaggttttattaattatcattagccataggttgattgctccatgcctgtccacattggtctgactatagggtagccaattacagcctggtgcaatacagcaagttctcaccccaaaaaatagtccgactatttcttctatgcactgatgagtaatatacaataaaaatgctagttcacgatatattgataccagagtttttaccatactccacggtataatcatttaacaaattgccaaaccaccaaaaatcaatccattgtcttgttcttggctacattatgtaaaattgtttgcacaaagcatgcccagtttaagttgacttcaatatcgaataaaaccttaaagctggtaataacaatcagaagtccattgtggaaaacggtatcaatttgacctaacagatgtggacatctcagcaaagagacctgcttgactgtgaatttgcttggaaacacatgaaatatgtgcaggtttcataccagtgatgataacacaaattttaggtggattttttctattttcatgtagcaaataccatggcacaacatgaactttgaacaacacaaatcaatgcatattcaaatgaatttaacaaaaaacatgtgtaatcgctcacttctttcccatcagggttcctcataacaacaccatcaacaactggtgatttacgtgcctcagcatgtgcatatcctgggccaactgtgtaaacctgaaaatagttttgtgataatttagacggaagccagaaaagtgaaatttttggaacatatgttccctgcatgatttactcaatgcaaaagctctccaaaccgttgaatgaaccatgtcaaaatagacaaagaatccaataaaaggagctgagcacactgaggctcgactttcttttattggaaaaaataggccaaatgatttttcttttgtgaaatgtgaacatggatagtttccacatttggtgagaccgtgagaagcttctcatccataaataaattgtatatggctgactgcaaggatataggtccattcaatttcaggttttccaaaacaaagctgaacataggaaagaaatagattcatgaatccttttaagagaacagccagaaccattaaagtgaaactaatatgctatttttcagtgtacagcagttgaaacagaacacttgcccaactaaaagaacagaacacttgcaaaagttttcttactttaacatccgtcccaccagtaggcatgaactcctcgtaaatgtaagatccttcacgcctcactctcctgacatcaggatgaaattcactagatcggttaccaacctacatttaatcagaaatataacaaaaagtttatttttgtatccagatacaagaaaaatacataagaatacatgaagaacagaaaatgttgtttggtttcctctgtttagaaaccacctgacatgttgacaaacaaaatataaaggagctaacaattgaattctgcaaagggaaatgcaagggatcaagcattcaagccatgtgatagcatagcaattataattaggtaaacattggcccctttttccttaaattgcagaaaataaaaggcatggatcctcaactcaaaataactccagagatatgttttcatgtatctttgttttccagaagccaaagaatcaaagcaattggcaggtttaaggactcaagggggaaaggtaattacagtcacccggtaaaagagtggtaagtatgatgcatgaaacttaaactgttgtggcgtgctacattcaaaattacctttcggaacagttccttcattccaccaccagcagaattaggataatatatcattattctatggtcatcccctgaaaaggattaaggaatcagttatcgtataattgatcattgtgagtgaaacatagactaacaagccatactactataaaaagggaggctaaaatgatagtatttcgttcactgttgtaccctcagcacaaaaaaaaatatagtgtatgctttcatgcatacagcaaaatcaaccacagcagtgccaatgaggcaatggaaacaacaattcaaagagacgaatcacagtacagcagaaataagttaattagataaatactggcaattaccattgacaggtttctccacgaagggcttcataaatcgctttccatgaacctcaacaaaatcttcttgctcaataaagtagtctaactcttggtacggatattctctattgacaagagcataattgggtacaggaattccatacttctccagatgcttaatcatgaaaatgattgcatttagcaaaatttagtaattattccaaagaataacttggaagagtaaatgagaaatcatgaaaaacacatcccataattactagaaaattattgcaacttgaggaagagcgacttggtgtctgataaacaagatgtggaagatacatacaaataaaatatttagaatgctagccaattcggtcagtggcaatcaaaagtacacccaagctgaaataaccttagattttttaaaaaaaaatgtcatctgttaaacttcgtgcttcagtactcctgtaaacatatgtgctgccagtacaatatagaagaaactaggtgcgttggtggtcgtca

SEQ ID NO: 86432 - DNA, 1109 bp, Oryza sativa
attatgaaacttactgttaagacaaccattgcctgatcaggcccaagcccattagcaagttggtaatctccatgtaagttgttggcaacaatagtcatttcaaatgttgccataccatcatcccatcctggctgggaaggataatttgaagtaagctgattattgtttgtgacctgaacaatggaatataagtcaactatgtcactatttacgttggtactgatgaaccaaaaactaaaactttttttttctatagcaaggtatctgatgacagggctttctgccatttgacatcatgaatgtatgagattgagaacatgagaaaacctgcagatagcccccatttaaaagcttgatatgaagcattgaattgttcctttcgatgtaaaatgattcagtgtctcctggtgaatctgcagttgctgagatcacatctccattacttgctgttaaaaactgacctttgatgcaccggaattgatattcacggtaagaaactctccaaagctgacaggagcaccaagaaaatgcaattaggatggaaactcggccatttattaaccagtgactcaagcacttgatggtcttgttgatttttttaataacactttgatttctagctgtttcctaacttcaggaacataagtagtgcattaacagaaaaataagctatgggcctaaaaactgatgaagataatgccatttttcatgcagctttcacagaatctccaagtaggaactgagtaatatatgcatatgataaaaaaatatacgcgtaatatcgatttatgaatcgtcaaaatctttagcattgacacagaaaagacaacaaaccctgaaggtctcccatgttgaagcaacatcctgatccactgtcaagttcccgccgccaccaccatttgcgctcaggtacttctggagccccactgacttcagctgcacctgagtgccatcctgaggcgaaaatccgacagtcacatgagaagaaagtaaaatgcaccgacattgccacaacatgagctccaaacctccaagaaccagagagcctacaagcatgttcccgtttgagatgccatcaaacaacgaaggcttgatccacccctccacca

SEQ ID NO: 86433 - DNA, 6697 bp, Oryza sativa
ccccgtgccctctatcgcccaagcgccgtcgccctccaatccgccgctgccgccgccgctccggtcgccgctagccgccgtgccgtcgacgccgtcgcgttcgccgtcgtgcgggccgtcccgtccacccctcctccgttggaatccgccgccgtgcgccggtgagcaccgccatggccgccgtcctcgccctctcccattttcctctctccctctaatccctctcatcttgttcgctaggtggttccggagctcgtcccgccgtcgccgtcgccctccatcgctcgccgtcgccgatcgtcgccggtgaggcccctgctcccctttctccctctctcccgcgccgcttagccgccgcgccgccgcctagccacttagccgccgctatcgccgtcgtcttccgccgccggccggtcgccgcctcgcgtcgccgctgtgtgcgcgccgcgccgccgcgcgccatggccgccggaccggcttgagccatgcccgcgggcgccggccgcgagccgcatccgccgcccgatctaccgggcggtagatcggggccgtccgttcggccgcccgcgtggccgccgcgtcggcgccacgtcagcgccacgtggtgcgccgccccatccccggtccgtggactcggtccaccgtgaaccaccctccccgagtcactgccatgtggggcccgcatgtcggcgccgcccctctctctctcccgggatttatttattgcgcaataattcaattaaggatttttctgtttatagtaaaaacacagtgaatcttctaaaattcatatctaattcatccgagctccgtttaagcccgttcaagtctcagtaaatcaagaaaaatgtgtagaatccattaaaaatggttttgttctctgtttcagtagtcttatagcctgtttgtattgtttgctttgtatgtcgcttagattccggctctcccgacgctccggtgtacttcgaaatagtcgccgaggttcctccagctgcagagcaaggcaagtcatgcttgtcacttgaacatgttgatcctatattgcaaatgctctattgtttttcttcaaatactgcattgttttataatattactatgggatgtttacatactgtcatagccatgctattttgtaccatgttcctttgttagcttgggatataacatgactagagattggattagagagtgcttagccatgtttagttcaactagcacgcaatgggggaaatcatattaatgtatagactgtaggtcctaatgttaatgttggattagtaccaccgtcctggtgttgcttaattaaaataaatcctatggtgggctattggtgcatggtttgctagtcgcgcccatggcacttaaggaccggttcgcgggaaaccctggaagaattcctcgtacttaccacaagctagcgtgggcaacggctgggcttgtagtgtagctttcctctagccgacgcatccaggcaagggtgggcgtgatggagtttggatgggccccgcgacggcctatgcggcttccggattcacctaggcacgagaggagactgcccactgccttgcaaggagtgggggtgaaacctgaggtgtggtgtgcttggttagagggggttatgcgaagggtcctgtcacggcctctttccggtatgtcgtggtggcatgtcggcgcatggaaacgtgtcgtggggctgtgtcttgtgggtacagttgtacacctctgatcagagtaaaactattcgaatagccgtgcccgtggtcacgggcggtcaaccagattcaccgtgattagtctcaccctagtgtagtctgttggaactgattagttcaggtggatggttgggcctgttgcaacgtggtgtagcgttgaacagtggatggttaatattgattaattattacaactgttttacttctttcaacttctatttataaatgtccgctttatgcaaatgaaccattatagctatcccttgataattccctgcatcatacccctattccggtatgacttgctgagtacagagggtagtactcagtcttgctctattttccccaaaaccccagagtttgagtatgcgtcagatggtgccttctccgaggagtaggcttcgtccgtgccgtcgaggatgcctgtggagtggtgttcccgccgcggtgcaagtcaaggcttagctccagttatctttttattttccgctgcatttatataaaacttttataatgtttgtaagacgtggatttgtatgtcaactttgtcgtttgtgtaccccggccggtcctagacggggattttaatgcacactctgcttggaattctatttgggaatttctgggcgtgacactcctcaggctatgtctctggatcaatcaaacgatctcttctacacttggcaagttgatgaaggtagttggacttggttcttccaatgtggtgcataggagtggtgtcaaatccaagagtcttgtagagccgaacgggattctcacagggaaatcatgagatgcccttccagccccagaactgcgaccaccacctctcccgcgacctcttgtattaggggcatcacttgaccactgtcaacatccctaatctgaacaggacggttactggattgccttgtaaatctaggagaagtacgagtgccactgccactgccgccctcaaccactttctctttacccaaacgaccacgagtataccgaataggaggactctcatcaccggacacatcctgagaggctttctgtcttttctcacgagtcatagtacatactgcaacaggaatcaataaattggagtgcagtagttaggcaaaatttgagagaaacaagaatggcaggctagctggacagcgcccggaggttccgggtgcaagaacaccggaacttccgcccggcaaaaatgaagaacataggtctcaaaaatagccagtgcatgtgaacaaatcctatagatcggtgatctacaaggtagcagaaacaagactatccaagtggttttctccctaggttcacagatttagagatcgggataaaaacacaatgaaccgagagagggaatcaaaaagtgctaccttgagagaagaaactgcgaatcgatcacagaaagaacctcccagccaccaatgtggatgaatccacggagaagaaacgaatttgattggatgaaagtgaaaatcgccactaggagcactttggcggcgactagggctggcggtggggagagagaagaaatgaggagagagaatacggtttctaactccccctgagtatatgtactccccgacaccaggaggttccggacagggaggcccggaacttccggcctgacagataaagggcagtcaggcccaaaaacaaggaagagatgagaattcaacgaggagaaatagggaactatggacatgcatagacttatgacgtatatgaccagccaacaatcaacattacataaccatggtcaatatacatcacaagaagggaataaaagccaaattttcgcaataaaaggcactcaaaggattttgcaaaaattttcataaaagggtttttggatatagggggaatgtttgagctttattcctggtatcaagaccatcttctaccaagaagtgatctcaaggcaaaaaagctctttttttttaatggcaaaatttgctacagaacatccaaaaaacgtgtaattagctcgtggacaccacaagaacgagaatttgttgtcgggcatcacaaaaaacgtgtaattagctcctggacactcggggctttattttattattttctatgaatttggagagaaaaacaccaaataaagacaagtttacccttgggtctcgacctggacaatgacgacgcattgggttggccggcggcggcgacggagccgaacaggatgcagcgcttgtgttctgtccctatgatgggtctgagcagcggcggccatcgccaggatgctccgcactgtggccggcgtgcgtgggctcatccccttggtatggagctaaccgacgtgttgatcgacgacaccgacgcaatgtccggcgaccggagaacacggcgcctggtacgtgggcgatggtggagagttgtgacgtcgcggagctgctcctcgccagcctcgacaccggtgtcccattctcccaccgtgtcaatggcagctgcttcgcaattgcaagggagagaaatggggatcaaacaacaattcatcagcatgtattatgaaagtaaacactgcaaaaatatcaaatgttcagttcaattagtacctgaacaatctcactatccgggaatttcctcacatccttgccgagcggcgcggcgccggagccgattaacttgagagagctgagatcatacttacctgccctcccgtgcttggtgagcgcgataatgaccggcggcacgcagaacaggtgcgtgacgcggtgcctctgcacagcctccatcagggagttgatgtcgaaccgcgacatggagatgatggcgttcccgcgctgcagctgcgcgtatgtgatgacggagaggctgaagatgtggaacatggggaggaagtagaggaacacgttggggccctcccagcgctctaggggcttgtttgagcccgttgagcgccttgtggagcttgtacatatggtttggcaactttggatcctcgaaccccggtggttgctccacatagactaactccaagaggggtccattgagaaaggcgctcttaacatccatttgatataacctgaaatcatggtgagcgacataggctaaaagcattcggattgactcaaggcgagcaacgggtgcgaaggtttcaccaaaatcgagaccctcgacttgggtgaacccttgcgcaactaaccgggctttgttccttacaaccactccatgttcatcttgcttgttgcggaagatctacttggtgccaatgacattttggtcgggtctctccaccaatgtccatacttggttgcgagtgaagttattaaactcctcttgcatagccatcacctaatccagatcaccaagtgcatcttcaaccctggttggttccaaagaagagacaaacgaatagtgttgacaaaagttagcgacacgagaacgagtagttaccccctttcttatatcaccaagtatgttgtcgacgggatgatctctttggacaatgtgatgtattcttggatggtgcaccgaggggacatgagcccgatcaggatgctctacagtgccctcggcatcaatcccatccacttgtgccgtaggcacgccttgactatcctttgcctggaacttcctagcagatggacccagaacttccgggcctggggaggtccggaggttccaatcatctggtcccggaacttccgggtcaactgactcttgacttgttgtagggctattggatgtcgatgacgaaggttgatccctatcttcttcgtcatcctgcgtcttgactggtcgtatgtctccaatagccttagaatcaattgcttgtctaggatccgcatcatctacaacatgtacaacaacttgctctccttgggagccattagattcgtcaaatgtcacatcccttgtaacttcaacaatactggaggttttgttgaagacatggtaggcatgtgcatttgactcatagccaagtaagaatccctcgtccaccttacgtgagaacttagatgaacgaggcctcttactcaaaatgaagcatttactcccaaagacacgaaaatatgaaacatttggcttcttaccactcaagagctcatatgaagttttctttaggattttgtggaggtagaggcgattgatggcatggcatgcggtgctcacggtctccgcccaaaagatatccgaagtcttgtactcatcaagcattgctcttgcggcttcaataagagtttggttcttcctctcaacaatgccattttgaggaggatcataggggggtggagaactcgtgcttgattccctcttcatcaaggaattactccacgtgcgtgttcttgaattctcctccactgtcacttcgtaccctcttgatggtgagattatagaggttttggccttgcttggcgaagcgcttgaagacatcttgagcctcactcttgtcatggagaaaatacacccaagtaaagcgggaaaaattatcaacaatgacaaaaccatacttgttacctccaatacttatgtaggccacgggcccgaataaatccatatgtagaagctcaagagggcgtgttgtagtcatgatgttcttgataggatgtggattcccaacttgtttccaggcttggcaagcactacacacataatctttctcaaatgtgacattagtgagcccgaggatgtgttccccctttagaagagttgccaaattccgcattccaacatgggctagtctatgatgccatagccaacccatggaagatttagcaatcaaacaagcttccggattcactctatccacatcgaaatcgaccagatagagatcacccttcaacttgcctttgaatgcaacggaggagtcatcccttctaaagacggtcacatcctcatcggtaaacaagcaattataacccaacttacacaattgagaaacaggtaataaattgtagcttaatgaattgacaagaaaaacattagagagagattgatcattggagatggcaattttacctagaccaattacctttcct

SEQ ID NO: 86434 - DNA, 647 bp, Oryza sativa
attcctgcacccccgcagtcgttccggtaattgcgctacttctaacatgctatatatttgctctaaatctgtctgcatgccactttatgagttcaatagataaacacttaatatctgatgctgtcatgtcgcgtactttgctaggaaaatgttccaggcaaggatattgataagggaatgttggtggtatctaacattgattcttccatctccaatgatgatcttctccaaatgctcagtgtttatggtgatgtaaaggaggtagctatactgccataattgagtaattgactacaaaactgaaatccacacactatggtaatcatttgttgtttatagatttccagctctcctataagctgcaccaagaagtttgtagagttctatgatgttagagcagcagaagaagcactacatgaccttaataagggtggaatttcaggcccaaagttcaaggttgaacttagccaacatggagaggcaggatcttggtaatttgcttggctgaatttttttctacccgtttttggtattatcttttcatactcgtgctagctatcgttgccttccttcatactatagggttagtatgttaggtacctttgggagatgggataatatcataataaaaatatgttcactgtttt

SEQ ID NO: 86435 - DNA, 8148 bp, Oryza sativa
catgctggcgccctcctcctgccccgtcggttcacgtgtgccacggtggcaggaggatggtgccccaccctggcgccccaaaaagaacagtttctgggataagttttttcagggatctatttgtgaaataagttttttaaaatgaccaaaatgtgaaaaatccagcgacaagtgataactggcaaaaccagtgaaattttagagaagttctgtcaaaatcttgaattctagtttgattttttctttcattggtcggattatcaggcagccttaaacccttgtttgatgcttaggaatagtttctaccagctacaactattcttaccagcgtcaacttcccctgcaatccgtccaaattctaatcttaagattttgggtgcattagcttaccggccatacttagccaacatatatcaataaaagttgtcgtaattgtctaagttgagacgaccaaatccattctgacacatttagatcttaggttcagtttgggagagcttctagcagctacagcttctcacgtaatctttagcttctcccaacaatctagattatcagttatcacccgtattttaaaaaaaccaacttctacaaattctcgaaagctggctaccaaccaacaaattctcgtaatcttaaaactctccgaacatagccttaggaaatctcatcataccttttaaagtaattgacatatgggatctaatttgttaaaaaaaatcctaccaatattatggtaccaactaaacagctaccaagttgatcaaacttgtagcaaaagagtgacgggcaaccaaacacccctagggctgtgttcacacataggtgttcccatcctgaacagtgattacggaaaatggagcggtctattagcgtttgattaattaagtattagctaattttttttcaaaaatagattaatttgatttttttaagcaactttcgtatagaaactttttacaaaaaaacgcaccgtttaacaatttgaaaagcgtgcacgcggaagaggggatagcgaacagagcctagcatctacataatccaaaaactaagccaaaagctagagttatccgacttattcagattctcatcagctgattatagctgaattctttgtaatctcgccagcaaaataaccaatggacatatctcaaattatctagctcccaaagcggctcgagttcgataactgtttattcaaaaatccacgtcgatcaggaaaggatctatcaagaaatagcagagagagagagggggcagcggaactaaataaactagttgtgacttgtgaccactcttttctattaatgtaaacagaaaattttataagagtttgaaagggtcaattagccctagagggggggtgaataggctaatttaaaactttatgtgaaagctaaaactgaaataaggtcggaaagtctgatccacagtcagactatccgaaaatatcagatagtctgaagttggatcagactgtctgatccaccaatgaagcacaactagatctatcacacaaacaagagtaaagcacaaacagcgactagatctatagcgacacaattaagcaaagctaaaaggaggatgaaggaagattaccaatgatgttcacgaagttgttcccggagttcaaatccttgaggggattctactctccgttgaggagctcactaagagccgggtctttgctaaccctttcctcaagaggttgcactaagcactcctccttccactaaggggtatctttttccttgcggaggcgagatccggccttcacaaacttctctcggccaaccacacgtagatcggtggctcgggagtgacacctagccgtctaggagtcctcaacctccaagagtaacaaacaccacacaactcttggtcaaaccctagtgctcaagatcgagtgaaacacacactaggccctcaaacaccaaatccacaaccaccaagatacaccacacaaagaacaaggagggatttgagagagggagagagctcaaagatccaaagcaccttagcaccaagctcaacccaaagtgaatgagaatgaaatgagttgggtaaccctagaaaagggttaggtggggggtatttatagacccccccccccaaaaaaatgtggccgttggagggaaatctttcagcccacgtcagatagtccgatacaagatcggatagtccgatattttaaacctccaaggcaacgagaaacagaaaacgaagttccatgaaatttcgaactttccgagacatcggactatctgatgttaaatcggagtatctgatattttagaagcaaaaacttcgtcctcaaacagagaatcaagttctatgaaatttcggagtctctgtatcatcggactatctgatccgacatcggatactccgatacttagaaaaactcactcgataggatttttttaaatcaagacagagagtgaagttctgtgaaaaatcggatagtccgatacatcggatagtctgatttcaaatcggatagtctgatgttgctcaagtaaaactgcaataactttttactccgaactccgatttcgaagatcttggagtctatggaaagctagtttcgtgggctatcaaacccaacataaaacatggtccaaaacctttaagagatgttgaaaaacttgcaaagaaacccggtgtaagtgttgtgacaagtgaaacaactcgggattgaaattttgacttaggtttttcaactcacacaaagatgaaccattttgagcactagtattctaccaataatatgcatgtggtttccctcttaatagtacgacattcctacgacacaatgtaaggtaaaagatacaatataccatttgatcattgccacattgcatcgtgatgtcgcattcatggggtatgcatctcattacaacatgtcgaggacataacaaccttcacatttgcttgaataaaagtgttagtcctctctaatcgcattgtaatcaatcatcaaaatcattagggacctagatgcactttcaatctccccctttttagtgattgatgacaatacgattagatcacaagagagaatgaatataatagatgattttggtgcaaagatttagtaaaagctccccctaaaagtgtgcattaaagcaagtagagagctccccctaaatctttgcatccacattgaagctcacaagacaacaaatatatcacattacataccaagcattcataattaaacaataatgtcttacaaagcattaaactaacttaagaaacacacatctctcatacaaataaaaaccactcatgatcgaccataataaataaaaggatagatcttctccccctttggcatctaagcaccgaaaagggaggatttttgccggaattttgatgaaaacattttgcaaacttttggaaatgaattttttaagggaattgcaccgggaattttgaagagattcaatttttcacaaacttttgatgggagttggagagaaaggaatggccgaacattctggccccatttgagttcatggctagcacacaatcaaccacacaaaacaatagccacaagtcaaatggatgatccaaaaatcaaatgagagtgaattatcatgagacaagatgattcaccctcgagagagggaatgtacgaatctatagcaaattgtgcaaggaccaaaattcattagagaatgagatccccgtacacatagattcaagctatccactcagattatgactagtgttcattcatgaattgaatgttcactttgtcatgatgtggcatgcaatcctattctagtaattgaaaacaaatgcatgcaaaagatcaagccacattccgagaatccaagatatttagttcacttctcaactcacaaaacctagcttcatctagaggcttggtgaagatatccgccaattgtttgtcgattctcacatgttggatgtctatgtcgcctcttgtggaatgatctctcaagaaatggtggcgaatatctatatgtttggttcgggaatgttggacgggattattggctatcttaatggcactctcattgtcacataggagtgggattttggacacattgaggccatagtctctcaaggtttgcttcatccaaataagttgagcacaacaactccccgtcgaaatgtattccgcttcggcggtggatagggcgacggagttttgcttcttggaagaccaagaaacaagggacctacccaagaattggcaagtacccgatgtgcttttcctatccactttgcacccggcataatccgcatcggcataaccaatgagatcaaacctcgctcccttaggataccaaagaccaagattaggtgtgtgcactaaatatctaagaattctcttcacggccacaaggtgacactccttcggagcggcttgaaatcttgcacacatgcacacactaagcataatatcaggcctagatgcacaaaggtaaaggagtgagccaatgatggaacggtataccttttggtcgacgtctttaccttgctcgttgaggtcgaggtggccatttgatggcatgggagtgtggattggcttcgcattctccattccaaacttcttgagcatgtcctttaaatactttgtttggcaaatgaaagttccttccttgagttgcttgatttgaaggccgaggaagaacttcaattcacccatcatggacatctcaaaacgcttggtcatcatcctactaaactcttcactaaaagacttgttagtagaaccaaatataatgtcatcgacatatatttggcagacaaaaatatcattatcatgtcttttagtaaaaagagttgaatcggctttcccgatctcaaagccgtttttcacaagaaaatttcgaagacactcataccaagctctaggggcttgcttaagctcgtagagtgccttgtggagcttgtacacgtggttgggatattttggatccttgaagcccggtggttgctccacgtataccaactcgttgataagcccgttgaggaaggcgcttttgacatccatttgatatagcttaaaattgaggttagtagcaaaagtaagcaatatgcgaattgactcaagtctagctaccggcgcaaaagtttcaccgaaatctaatccttcgatttgggtgaacccttgcgccactaacctcgctttgttccttatcacgaccccggcctcgtcttgcttgttgcgaaagatccactttgtgccaatcacattttgccgagatcgctccaccaaagtccacacttcattcctggtgaaattgttcaactcctcttgcatcgccatcacccaatccggatcattaagagcttcttccacccttagaggttcaagagaagacacaaacgagtaatgctcacaaaaatttgcaatatgagaacgagtggatactcccttgttgatgtctcctaagatgttgtcggtggggtgatctcgttggatactttggtggattcttgggtgagctagatttattgaagagggtggcacttgctcgccttcttcaccttgatccaagcttgaagtagagggatcattggcttgggtcgatgtaggtggctccacttgtgttgaggaagaggccccttgttgtggctccctaggacgtacgtctccaagagccaaccttttgattgcttctctagggtcctcctcttcacctaacacatgtgagtcaacttgctctacttgagagccgttagtttcgtcaaatgtcacatcaggcgcgatctcaacaataccggaggttttgttgaaaacgcggtatgcgcactcatttgacccatatccaagcaagaaccccccatccactttaggagcaaactttgaggatctagccttcttattaagaatgtagcacttactaccgaaaacacgaaagtaagagacatttggtttgttaccggtaagaagctcatagggagtcttcttaagaaggcggtgaagatagaggcggttgatgtcgtgacatacggtgttgacggcttcggcccaaaagcggtccgatgtcttgtattcgtccaacattgtcctcgcaatctcgatgagagtccgattcttcctctcggctactccattttgttgaggtgagtatggagccgagaactcatgcttgatgccttcttcatcaaggaaactctcgatgcacgtgttcttgaattccttgacgttgtcgcttcgaatgttcttgatcttgaggtcgaactcgttttgggctcttcttgcaaacttcttgaagatggcttgtgtctcactcttgtcatgcaagaagaacacccacgtgaagcatgaaaagtcatcaacaataacaagaccatatttgttacctccaatgcttagataagcaattggcccgaagaggtccatgtgaagaagctccaacggtcttgtagtagtcattacgttcttgactgggtgatgtgctccaatttgtttcccggcttgacatgcactacacaccctatctttctcaaattgaatatttgttagtccaaggatgtgtcgtgctttagaagtttgtgaagattcctcataccaacatgggctagcctccgatgccaaagccatcccatgttggacttagccactaagcatgtgtcatgtttggctttagttgaggaaaaatccacaagataaaactttcccttgagaacacccttaaagactaccgagaaatcatcccttctaaatatggtcacatcaacatcggtaaaaagacaattgaatcccatggaacataattgagaaacggacaatagattgtaatttagagattttaccaagagggcgttggaaatggaaaggtcatttgaaattgcaatcttacccaatccaattacctttccctttccatcgtccccaaagatgatgttctcttgagaagtgccatttggatcaagagatgaaaacattgattcttctccggtcatatgattagtacaaccactatcaatcacccaacttcttccaccggagacatattcctacaagagatcaatttctagttttaggtacccatacttgcttgggtcctctcatgttagtaacaagtgccttaggcacccaaagcactctcttgatagaaatatttttaccccttgggccaacatacttagcaacaacgcgaccactagcgttcttcctaagaacataagatgcatcaaaacaatgagaagcattatcattaggaaggatacatttggccttaacaaagttgctaagacattggggcttcttgatcatcacactcttgtccacccttcctttaggtggaggaacatacccaagaccttcatggttgaagttgtccctttgatagcctaggtactcctttagggccttactacccatatggcacttaagtaagccattatgaaggagtcccataagcttctcgttttgcttttgcaaagcactcaaagaagtagagttagtagcacaagtttcaatatcaatatctttgcacctcacacatggttcattgcttgggacaattttggagcacgatgcctcgctagggaaagagacactattctttaaggtttcgaacttctcttcaagagagaggtaagctttgtccaagtcatccactctctcttgaagttgagcgttcgccacctcaagattagcatgagactctttggtttgcttgtaaagccgtaccaaagcctcatttttctctctctccttagcaagttcactcttgagttcatgagaccgctctttctcacgaatgagcaattcctcttgcctctcaagagttgcatattgattctcaattctcctaagcaactcactcaagtgtggtatggattccttggctatggatttgaacaactcgtcatccataacctcatcctcaacatcttcctccaaatcactaacaagatcaacattaaatgacttgaggggagagggtaccttaggctcctttgccatgaggcaaatgggagcatcctcatcacttgagtagttgaagagtctcggtggtgatgaaggcttgacggcgaacgtggcaactccttcttcatcacttgagcttgactcggagtcggagccgaagatcatcccaaggtgagcttggccatagcgatcatgcttgctatgcttgtgcttctccttcttct

SEQ ID NO: 86436 - DNA, 1083 bp, Oryza sativa
aaagccgacacaggtttaccatatgccgacgagaggggtcccagaccaacaacaggttaggtcccagaccatactgtgctaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaaatccaaggaaacggtccttaagtgcgagagcgggaaaccgtacacccggtacgttccccggtccgcggttttggaaattcatttagttcgcaagcaccgacccaggtgtcgggttttccaagtcttttgtaaaacccaagttttacccaagttgtttttcaaattttaagtttgaaggcgaccgtcgatactcgcacagagtgcacgaatatcgaggcgcaactagatggttacaagggaacatggtataacaattaacaaaggaaggatcaaatgcaacaaactaggtaggtctgccaatctgccttgcagacgggacaaacagattaagtgcgatcctatcaatgcataatatttttcaagcaacataattaagttcaaaggtggcttgccttgctcgagatcttgggcttgatcctcgaaatcctcgcactgcgggtcttcgggctccgaaactacactcgaaacgggacaactcaacaaacggcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaaggatttaattaaatcctttttgaaaaagaaaagaagagggggagggaaattagacttttcctcgggcggctagggcgtggcccgagagaaaaggggcggctcagccgagctaaatgggccggccggcccaaagcggcccaagcacgcccgcgcgggaagggaggagagagagagccggtggaccgggctcacctcgcgtggtcccgggtgggacccgcttgt

SEQ ID NO: 86437 - DNA, 3316 bp, Oryza sativa
aaacagttgccacagaagcatgagcatgtcatatattgccgactttccagaaggcaaaggaacttgtatgaagatttcattgcagctcagagacacaggcaacattggcaagtggaaattattttggcatgattagcatcattatgcagcttagaaaggtttgtaaccatccagatctttttgaaggccgtccaattatcagctcttttgacatggcagggatcaacatgcaaatcagctcttctgttggcatggtccttgataaaggcccattttctcaggttgacctgtcagatatgaattttgtatttactcaaaatgaatataatatgacttcttgggaggaagatgaggttgctgccattttttctccaagcataaccctcaggggttctggcatttctcgctctactaatgatggtcagagaagcaatgggacaaatatttttgaagagattcacaattctttgtgggaggagagaataaaagaagctaatgaaagagcagcttccattgcatggtggaatagggtaagatgccagaagaggcctgtttatggcacaaatattcgggaggttttgaccataaagcatcctgtgtctgatattctcgagaagaagaagaaccctttatgccacatggaattttcatcaagcctagcaaatcttgttctatcatcggtggatcgcttcaagacaatgcttgattttattgagtcatttacttttgcaattcctgctgcacgagcgcctgcaccattattctggtgcaacaaagggaaatctcctgttcttattgaaccagcatacagagagaaatgcatgaatgagttttctcctgttttctctcctataaggcctgcgattgttcgccgtcaagtgtactttcctgacaggcgtttgatccagtttgactgtggaaagttgcaggaacttgctattttgttgaggcgtttgaagtcagaaggacacagggccttgatatttactcagatgactaagatgcttgatatactggaggagttcattaatctatatgggtatacgtatttgcggttagatggatcaacccagccagaagagaggcagacactgatgcagaggtttaatactaacccaaagttttttctttttatcttatccactcgtagtggtggtgtgggaatcaacctagtaggtgcagacactgtcattttctatgatagtgactggaatcctgcaatggaccaacaggcccaagacagatgccacaggataggtcaaactcgtgaagttcacatctatagactgatcagtgagagcactatagaggagaatatactcaagaaagccaatcagaagcgagctcttgatgatctagtgatacaacgcggtagctacaatacagagttcttcaagaagcttgatcctatggaattcttttctgggcactcatcacttcatgcagagaatcagcagaaggattgctctctgtctgctggaccctcaaacggaactaatctggcgctgtcaaatgttgatgttgaagcagctattagacaggcagaagatgaagctgactatatggctctcaagaggctggagcaggaagaggccgtggacaatcaagagttcagcgaggaggctgctggaagacttgaggaggatgatcttgtaaacgaggatgacactaaacctgatgaacacaccaatgaagagcataaatatcagtgttctgatttggtcaaggacaagcatgttgctttatctataaatcaattagatgaagaaaaggctataactttggctggaggagatggagatattgacatgcttgctgatgttaagcagatggctgctgcagctgctgcagcaggtcaagcaagttcgtcttttgaaaatcagctccggccaattgatagatatgccatgcggtttttggaactctgggatccaataattgataaagctgctataaactatcaggtcaatgttgaagaggaagaatgggaacttgaacgcattgaaaaactcaaagaagatttagaagcagaaattgatgaagaccaggaaccactttcttatgagtgtaagtgtttttatgtttatgttgacccaacagcccatagcacttacgaaaaaagtttcatctcatatttgatttatgcaacttagttttaggtagttgtctctgctatactcacccttccttgtattatgctttgttgtgttgacacatcatcttaactgcagcatgggatgttgattttgctactacagcatatcggcaacatgttgaggctctagctcaaaaacaggtcagttcatacttctattcttgtgttttcctcttggggctagtggctaattatgtcacctgatgtgatacccacagttgtttgaggaacaagaaagacaagcccgtgaagcagcaaaagagttggaggaaaagaatgataataggtatagactgagaaattgtgctctcactttggtgttcattgtttttggctcttaggccctgttcgatagtggggataacctgagcttattagctccacgcaaaatgatgcagatgattagggtatgattaattgagtattaactaccataaacttaaaaatagatttatttgttttttaagaaactttgatatagaaagtttttgcaaaaacacaccgtttagcagttcgggaagcgtgctcatgataaacgagggagtagctccccctagaagcacattagaatggggccttagtgggtagatgcatatactccctctgcttttttattatctaacagcgggcactattcattttcacactgtgatcactcatcttttttcaataattttacaaatgaaaagatgtcatgttattaaagtgtactgtatcgtaagcataaacaagaaagttcaattcaccattaattctttaatcctaaacttcaacaagaaactttaatcctaaactattaatcattttaataattttgaccattaatagttcctcgcaaaaaaaaaaaggtcaaagtagaaacagtagtagtcaatgttgacagtcatgaaaacagagggagcttttgtgctgttttgcacttcactttggtgctcatctgtagggttacatggtatgcctgcattttctttccaattggttttagatgtgtccatatgctttcatctatttactgtatcctaaaagaataacttttgtcaatctttgacagcactcaacgaaaaaagtcaaaaaagaacaagaagaaggcagcgaagttcaaatctttgaagaaaggacgtttatcatctgagtcagaggttatggttgaggaaacatcag

SEQ ID NO: 86438 - DNA, 1155 bp, Oryza sativa
atattgatcatgtggcatgtttcgaattgagtcatttcagacttattttagtgagtgagaaatgagaacagcgagaaccatggtaaaaatgtaaaatttgtaaaaatttaaggttgtcagcatattgagaactatcccactaactactcccttcgtccctaaataagtgtagttttagctagtcaaagacatattaaggggtcaaaagactactaagcccttcattaatatggagagaaagtgagtaggatgagggagtactattggttcgatgactaaaatgagaagaaaaggatgtaggtggtattaaaaaggtctaatgctagtggaccactctaaaactacactcttttagggacgaattcttatgctaaaaactagacttatttagggatggagggagtagatgacatgagtaaactgacctcagatactttcaagatagccttcccagtcccagaaggaaccttctcactgtttgaattgtctgttgctgataagatgtgcttgcagactaattcccggaatctctcacagcaatgcacagggtgacggtatcttcctctataaaatgcaccacctggtacagaatgaagagaatcactagccagttcccaaagagggccgtactcatttacagttgcacaaagaacagcatcttcctcagttgtccacgagtctgaagcacaatcgcgagaccataggctcttcttcttcaatctctcaggcttgattaccatgacacgctttactggcatgcatgggacagaaattcggccatcactcttaattcttgcccccgatttgggatcagaatcattaagttcatctttcaacttaagctgcttgccttcaagaaaatgcttaggtgataaggcctcggaactgaaactcgatttaggggctttcttgagcttcttcaggcttctgctattgctgttctcttcctcattggttgacattatcctcttatgcttgttagaatgatggtgtgctgattcatcgctcattagctctggtgagggtgcattgtcatcaatgctcatagtatctactgatgtttcctcaaccataacctctgactcagatgataaacgtcctttcttcaaagatttgaacttcgctgccttcttcttgttcttttttgactttttt

SEQ ID NO: 86439 - DNA, 4711 bp, Oryza sativa
tcctgcagcccccccctcccccgaaaacctccgcccgccatggcgaccgccgcccaggccgccgccgcggcgttcctctccttcctctcctcctccccgccgcaccacaccgcgccctcatcctccgtctccttcctggcagcccgtgtgctgcccgcctccctcagggccgctgccgcggggtccccaacttccgcctcccgctcccggggccgaggtgtcgcggccgtcgtcgctcagctccccaccgcgtaagagcaagctactaatgctcccaaccccactcatcaatgtttatcatgaaatactccttcacttcgggtgtttctcaaagtccctagtccctctcttcgaatttagctcataagagtaaccaattcgattgcgagatttgagttttgtatttttggatcctgccacttttgatacggtgattgacgtttttttcaggaatccagaggtggcttctggggagaagaagatccggtgagtacaatttctcttgatattccggttccatctgtctatattggggagctgacacgggtttaggtggtcatcacgagcggtgaggtcatttgcaatggcggagctggaggctcggaagatgaggtacccaaccactggcactgaaggactcctcatgggcatccttgtcgagggtgaggcaaatgatcttggattatcactgaaatttgttcgcttgcatctctggtgcctaagggggtgaattatttgtgaattgtgatggaaattggaacagatgagtggggaaagagaaaaaatatgatatacaaggctataggggttaaacctttgtagtggcatgaaggttttacaaagatactataatggcattttccttacttaaaatacgtttatacaaaactgtagaagtcagggtaattttggtgcacgtctacatgcctcatgcatgttgaaaaatatggagcagcatgccaaatgcaaacacaatggaatactatcgaataataaatcatctgccttataggttgtaatattcatcatctgagtgcagagttattaagttctcaagttcctattgttctatccatgtacatccgcaatagtgacacctggagtctctagtcatggaaaatataagaaagaaaaaaaaaggccattttaatgtagcctcattggtatttcttccagaatgagtagccaggataacacagtaaactgtctaaaaagtaaacatgcttcaatgtaaaacagttgggagtaagacaacccttttggttcataatgttaacaatgtttagacctttgcttgctgacttatgtagattttgtgtgatggcgtccacaaataaatccaatgtcttctataaaaataagatggagagagactatgataatttaggggtgttggtaaactctgcaattctagcctcaacctttgattggttttcagtggttcagatatgattgttttttttcaggttttattttgatttgttgggacagtagcaaactgcgctgtgctctgagactatgttcacgagcctacataagatataagcctctaaactgtcaggagttcttattgacatcttaaaactgtaattgacgtatataccatgaaagtacccagctgttgaactagcattcgtagttcctttttggtttgctacttcattatgctcatgggactgcacttagtcgcaacttcattgcttacaggaactagtgatgcagcaaaacttttgcgtgctaatggaattacgctgctcaaagtgcgcgaggaggcagcaaatgtgcttgggaaatcagaaatgttctactttagtcctatgcacccaccattgactgaagctgcacaacgagcgcttgattgggctatcaatgaaaaactgaaatcaggttacttctcttttaaatatgaatccatttattgttcaattcttatttaggtccagaagacaatcagttgactgtctttagttttggtctttgatgaaactcatgtctttttcttactgttttggtactcttggacaataggcagattttttttttcatgtttgtagaacagaagtgtttgcatattgtatggttacttccatttttagtgatgttttactattggatttagttgagaaaattatttgattcatggagcacattgtgttgcttaataattctacacttgaatttgttttttattctctcgtagtttacatcttgattcttgagccttactattaattacactttgactatcgtaaatttatagtctatttcatgcaattcgatcagatatatgcatctactgtctccgattcatcggagcaacggtccaaaatatgaattttcacgcaacaccgctggcatatcttgtgatttcatttctggaaagttagttgcattgattatgacttgttctcaataagtcaatatgaagtattggtgagttgctttgcttaatcactaaggattcttggtcaccgctcaatgtggtgtctggcattgttgagctgcaataaccctacaactacatggtgcaaccttcataaattaccaccttccttcagaacgtagtaaatataaaatgctttgtaattctaaacttcttatcctagcatttcagagtcaatacacttgtatgctactggtactagctatatcggttgaatgaaggatgtaattttatttgccatatcatgttcttgtttgattggtttgttcagcagagtttagcttctttcattggctgatattttattgtcttagatatatttatctagtatcttagacaacatttgtcatttctgtggattacgataatcttgtttggtgccatttcttttagacaatttggcatttgtcaaactgcctttgttttcaatttatgttgtaaagagtattattattatgttctgaaaatatggaacaattggcgggagagacatgacagtttaacgtatttttgtctaaccttaatttcatctataaaaccaactatagtgactatgagtaatgctcggatattttatgataagctaaaaccagaaacaaattaaatgatgtgttcgctttcactcctctctagacagttatgttgggctccaatgcaaactaagaacaatgatacagttatgttgagcttcaacgcaaattaagaataatggtacttcattcagttagatgatgtggtccaaactggacatatgatcctccatactgtacaaagttaccgttttcagtaatgatgaatcaagaatagacttattctatttcttttactaacagtggtttctacctattggagtaggcattgcatgcatcaatatgataggtgtaccaataggattgcactaatattctaggacatatgttgttagttttatgactcttttgacattggtcccttggcttgttgaactaatcaccaaatctcctgtttgaaaatccctctccttctttttttttttttgtaaatgatccatatatttatcaaatgtctgcgagtgagagaatggctgtacagaaagatcaagtggcatagaagctccagtgaataggacttgtcatggttgaaccattagtctgtatagcaaatatcagaaagtgatattctgtgtctccttcagtacttgtagaccctgcccttatgtctactttatggtgtaacaaatggagtaagcataagccaacaattcacaaacttggttctaaatatttggttgttcattggaatcagtatacttttgatagttgccaaaattatgtcaggattatgttgacactagcgtctcagtttttttttttttgacgaatctcgctaaatttcaaggtaacatgtctgtttgttcaaatttcggtgcaaattgctagtgcaaaatgtatcaagcccacccaaatgtgctatttagtgacttaaaaagcataggagtcctaaaacctacttaataatttctttaaatacatctttgttgcttgatggtgtattgctaagttccttcctgttatggtttgagaaaactaattcagagaatcatacataccagatatgttgcaactagacagtatcttgcatgcaacctagtatcctagatctccgtcagctaatgctgatttctcagcccagcataacatcatttgatgtcattttgcaaaagaaaatactgtttagtgtttaaacagtattgtgtcatttttttttgtgtgtgtgtgaagaggatttaaagctgcagtggtgccttagcaattgtctgcaacgaagcggtacataatgatctgatagtctgatgtattactcttgcactgattatgctgattcagtagctcttagcccatagcagttagtaccataactagcttggtttgacaattctagctccaaattcgtgagatgttatatgcagacataagtaacttatgacagaccaactgtgcagtgttatgccagtttctgtttgtttgaaactccaacatggctgatttaaatggagagaatattggatcaagcatgaagtcagtattgaagcttttctggatgtcattttgccttagagattgtatttttttagaagtatctggaactgaagtcatattcttgcctcttggtacttgaatgtttggtataatactccctctgtctcaaaatataagaatctgacatttcctagtactacgaatctgaactggagtagatatcaactatagtaatagttttaaattgaat

SEQ ID NO: 86440 - DNA, 987 bp, Oryza sativa
ttttttctggtaactcaggaagcaaacacacccatctcgttttgattctttcctctggattacgacgtaagtgtggcagctatgtcgtcgtcggcggcgccggcgaggaaagcagcaatggcaccgtcgccgcccccgccggctcatccgccgccgccagcaacacgttccacgggctcaactccggcagcgccgccgccgccgtcgcagccggacgtgcgtatgttcagtcgccgcgagcgacggcgctgcggtcgcgcgaggtgcgagccagtcaccaactacggcatgttcccgaccaccggcgcttcggcggcgaggacggccatggcggggcgaacgatcaatggtggcgcgtcgatgctgacgacgacgacgacgacgacgacgccaccgcacctgatccagcagctcatggtgttggctggctggaccacccggagtccgtggctccagaaccacgcgtccatgtcgccgcggggctcgccgtcgtcgttctcctccgggagattctccgacccccgtgggatgccgtcgacgttcgcttaccgaacacccggagctagtagcggccgcgttatcgacaacggcgccgtcgccggccgtggcaagcagatggccggaactagccgctcacttgagattatcgccgttgataccggcgccggaagcagcaagaacgcgtcgccggccggcggccatgcaaatgccggcgtggtggtgaaacgtttggcccctgtgctcgcgatgccgagtgccggagccgccggcaaagggaaggaggaggcggcggcggcggcggcggctccgtcgccaaatggccgcggccgtaagcgcgcgccgcccaaggtgagcaatgatccggcggcgggatccgacaagaagccgaggaagagggccaagaaggcggcggccgctggcagcaaggtgaccgtcccggctgacgtgatcatcgtcgacgacgacgtcaaccagccgagctcgaac

SEQ ID NO: 86441 - DNA, 1510 bp, Oryza sativa
agattattgctatattcggttgaggaaattgatctactaaaggaagcttatctagaagagaccgagttcaaagagaatgcggcatggcaaatatatctattaattaggaatagtttgttagtttccttttatctttaggaaagtgtgtttagtgtcctatcaggactttatgttttccttttatctttaggaaagcttctttcttgtccgacaaggacttgtatcaacccatgggtataaatatgtatacccggggtctatgtaatttatcgctacgatcaatacaattcggcgcatcgccaccctttttacttctacttttgtttttacgttccggcggaacttggcacccgacgcggggctgcttcgttttcgatctctggcgaagggataagtccaatgttccgtcggtccaggcaattgtatcgtctacgtcggcgtcgttcaaggctacatcagtacatttgacctcttggattgctctggtttggatgatatatttgcctacctatttatcatatgtctctgttaatctagtcttagcatatcaatttagcaatatcggctgcttctcgttttagggtttctgccggtatcggctaaatcgcgttgctagattagattagcttagacatctaccaccctgaaaactcagtcaacggcttgattgtatagatattatgtttcttttcatacttagtgctgcatcagttaagtttgatctactaagtcgagcttagaaccataatctctagcctgcttcttgattgccaataagggtttcatcggggtttcagccgatgagttatctggacgttgcatcggctcataaggattgcatatacatataagttcgatttagccgatgacaacaaaggtttcactgtttaatctaaacatgtggatttcatgacatcggacctccaaccgatgtgtgctttaaccttcagatcgatgcttatttatcatatcattgctagccaattggtttatactggattatattgttattttattatatcatcatcagccgattgcctttatatcattatctacattggacataaagccaattgcttaaaccctatcgctatcggctggtatcggcatcggctattatcggctatcggctggaactactccgtcggcttgtcagccgatcggttgttttgatctactatttgcatatcttgtcagttgcaggatcaaactgactggcacgcccgcatctcaccaacctttggacctgcactggagcaaagcagatctcccaggccagtgtgttcgattttttcatcaacacaaattggcacgcctggtgagaccacgaattttatatccacatgtctgaagaagaagtcaatgccaagatcatggtcacggtggagaatttaatgaggaacaacaatatcggctcagggggcaagcgcatcagttccagcatggtggagcacatcagtatcggctcatgaaagccgattgcaagaaccaaagcaagatcggttttgga

SEQ ID NO: 86442 - DNA, 1011 bp, Oryza sativa
ctgctcttaacaattgcaaaagtacccgagtagtaaactctgatccgtgaaactttgttccattaatgacaaactcatgtcactcatatgcatgtttgggaagcgcctaggccgactcccgatgcttggtggttatgactagtcgggcagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccgccgccgactggtgtttccgcctgcacggctggcctattatgccgccgttgttgggcgtctacgtcttcaccgaccggcttgccttcgccgccgccgactggtgtttccgcctgcacggctggcctttatgccgccgttgttgggcgtctacgtcttcaccgaccggccgcctcgaccgccgccgactggtgtttccgcctgaacggctggcctttatgccgccgttgttgggcgtctacgtcttcaccgaccggccgcctcgaccgccgccgactggtgtttccgcctgcacggctggcctattatgccgccgttgttgggcgtctacgtcttcaccgaccggccgcctcgaccgccgccgactggtgtttccgcctgaacggctggcctttatgccgccgttgttgggcgtctacgtcttcaccgaccggccgcctcgaccgccgccgactggtgtttccgcctgcacggctggcctattatgccgccgttgttgggcgtctacgtcttcaccgaccggcttgccttcgccgctgccgactggtgtttccgcctgcacggctggccttatgccgccgttgttgggcgtctacgtcttcaccgaccgg

SEQ ID NO: 86443 - DNA, 8535 bp, Oryza sativa
cctttctcccttactttactaacaaacttcctccaactcccagttgacgcaacctccactactctccactgccatccatgttgacccctcactggccacacggcatttatgacaaatttatcgtgcactggatctaccccaaacatattatacaaccaccctaacacgtcgttcaaacccatatgctccggtgcattcagactagtatcatggaaggcatatagagtcaaatccaccccgctatcacatatttgtataggagcatcgccataatacagacgaatgggcatatcacctgacatcctgataaaacatgacaaatagtctcacgtttaatcatttaatcattcgataattaccctattacaacttatactacattgccgtgtactaatttacaactattagtaacaaacaactagtttaataatccaaataaaatataacacctttgtacatattttaacacacaacatatcaataatatgtactaactaagaactaatttaaccgtacaattacttaaatacctctaccaacatttagcaataacaaatatgtgctaaccatacatactaacatcgaacaatgcgaaacaattaacaactcttaaaccaattttttattaaactttcatatgcattgtacttagggattactaatgtataccttaacttcactgctggagggcgtcgccaaccctttcctcccggccggcgcctcctctccggcctgctattccctcccctcgctccctccggcgctcacggcgacgatgtggcgactctcgacggcggctggcgatgtggtcctcaaataaatcgaacaagcatcgcgggctggggagacggggctttaaaccggcttgtcgaacgcccattgttcgacagggtcggtggagggacctgtcgaacgcccccggttcgacaggcctggcggcgcggggtggtgggccctgtcgaactctctccgttcgacaggcgagcgtgtcgaacgccagccgttcgacagggctctgtcgactgcccgtcgttcgataggtgccctatcgaattgcacccgttcgacagggacctactctcgcgattttccccggttggccactacttttgcgattttccataaaaataatattaatcctcaaaaaaatccgccaaagctaggtcgtcgtcactcttgcctggccccgcctccggcatcgccgctcctccacttgctcccggcaactaccaatagccgcgcagacagcagcgaaccaaccctagggtagccacttcaaggaccggaggaagttggatggtatgtgatgtgcttcttctctgtgttatttctgctcttgtcttggattatttcggttggatatcatccgatatatgcacacacggctaatacagttttggaatcattccccattttaacaacctaacatgtatttagtattgagtacggagtacactttagtatttaatcctagattttatttccatgtacatccatatagatacatttgaatttgaattatatttagacaattcagaatcttcgggggatgtgaattggattttgtgggatccaaatggggccaacaagtttagggcccctttgaatcgcaggattgagaaaacagaggaataggaaaaacttaggaattgaatgccacatttattggattcctatgggattttgaaacacaggaaagttttcaaactgttgtttgattagcacacggaaaaaacgcaggaaccttagacacatgaagaggaaaacatgaggtgagacctcatgcttattttcctccaaaattgctcaggtaaggttcatttcataggaatttcaaaggaattgataggaaacaatcctttgtttcaaaggactctataggattatttaccatagaataaaatcctctagaattcctatggtttttcctttgattcaaaggggcccttatttttatcatgtcatggtgataaatcattttatgatgataatcagatgttagggtaaacccaggtttgtcctttgtaagccaaccgacccggtgagagtactagttccggttcaaccgtcgggctggtatgttttttttactatggctacagtaaacatttgctaatgacttttactatggctacagtaaacatttgctaatgactttatttgctaataacgtattaattaggcttaataaattcatctcgcggtttactgatggattctgtaattatttttttattagtgcccgaacaccccatgcatcactctactccctctgtcccataatatgcggtttactgacggattctgtaattatttatttattagtgcccgaacaccctatgcaacaccctactccctccgtcgcataatatagcaacctagaaccggatgagacacttcatggtacaacgaatctgggcaggaagtatgtccggattcgttgtactatgaagtgtctcgttcggtactaggttgctatattataggatggagggagtatataatatctgatgtgatacgtcaaaactttacacccttgaatctaaacaccccccaaagtcagaaagtgcctttttcttctccaacgtgcgcacggcacacaaaatctctaaacctatcaatagaagctcccgctccttccaaaaaggactctcaccggaagcatttgttgaccgcttttgttgagagtactttttggaagggttaaaccacagcttctgttgatagctaattaagagtttataaacggtaaggccatattgcatacgtgtctctactgtcgacaaggaaaaaaaagttacttcagtagcacatatgcaagattacattttctttaggaaataatatacgtttgagtgaacagtacgagtagaatgttggatggtactagtagctgttccctccgtcctatttaaagcgcaactataagtttctgtgtctaattttgattgattttttctgaaaaaattaaaaagcataagtaagtattattcatgttttatcatctaataacaataaaatattaatcatgatttttttttaaataagaccgacaattaaagttagacacggaaactcatggctgcgcttaaaataggacaaagtaagtattaaaaaatctgaagctctacattcggaagcttgtgaatgcgaaagtaatccaaaatgtcactacgaacgaggcagcagtgaccgcgtaaaggattggatcatttccctttccatctccatcatccggtagcgaatgacctgaactgggagcacactcgctcccttctgacgctgggtgtaggaggttgtttccttggtagctatccatatcaaatgagccgaactgaccagagtttggtatacatcctgataagttgttgtacatcactgagaacacggacagtgatgacaaacgagttaactgccatggtattgctccactcagcttgttgtgggataggtctaagctttcaactgaactcatgcttgcaaaggttgctgggattggtccggcaaagaaattgtaggacagattgagggccttgatatgtcccagatttcccaactccctgggaatttgtccagacaacatgtttgcagataagtcgatgccagacatccaattgatgaaattgtgtttgtatatgtaaatgttgcctttagtacggaagctgaagcctctttcttcatagcatccgatgtaatcgaaaattgggtacctaaagtgattctcacagattagcgaccataaagggataccaactggattttgtccaaatgagaggtttccaatacatgatggcaatggccctgatagactgttgtgtgagaaatcaagtatccttaaagactggagctgacaaaggctgggagatatctgcccttcaaacttgttgctgcccagtgaaaggtacttactttcacctagatattgtacccattcaatgtttccgttgaattggttgtgactgagatccaaagccatgacagtagagctattgaagaaagaaaaaggtactatatgtccggacaaagaattatgagagacgataaaaaaatcaagctctaatgcggtcatacagtttggtatagcccctgaaaggttgttatgagatagatccaaaagcataattcttgtcaaattgcaaatgcttggatggatttcaccgattagactattgcccgcaagactcaaggtgcataaagtggaaaggttccattgtgaaaaatcgagtttacctgataaattattgtcatgcaaatccaatgttccatgagcatcgaaatctgctgttagatatcgcggcagtgttccttcaaatttgttgccatcaaggtataatgcatgtttgatcgacaaatgattcgtaccaccaaatatggggccaccaagtttgttgtttgagaccttcaaggttgtcagtataggatattcagtgagcaagcaattaggcaattctcctgaaagactgttatttgataggtccaggtattccattctagtaatgttgcacaatgatgatggtatttctccagaaatcgtattgctagaaacatcaagaaaactcatatttggaaatactgagctgatgttagccggtagatgtccggagatacggttcataggaagactgatagcttgtagattcatttggggataccatattggacctaatgaccctgttagtgagttatttccaagattaaggtaaactaatgtggcttgctctgtaaataaccaattgggcatgctcccagacaggctgttattcgacaaatcaagcacttctagttgatgctgtgtgcgtaaaaaaattggttctctaacaatgttcttatcaaggttgcagccagagaggactagcactttcagttggaatgaaggtgaccagctaggaaagttgaccgcaacaaccaaattagcatttcctgagacatctatcttttggagcttggtgaggtttctcagccagaagaaggaaaattcaccactcaaattattcattgaaaaattgaatgtctttaacgctgacgtaatatttgaagacagtgtcacaggaatactcccctcaaagagattttgtgagagactcaagtgctcaagacgaggaagtgagaacaatgatgaaggaatgcttccatttagtcgattggaacttaaatccaattcccgcaggttccgaagactttcaaaaactgcaaaaacatgcatatggatgattattataaattgcaaaacaataataaacatcaatatattttcttctgctccaggaatactaggaagtgttcattttggacctgaagacggaagtactccaccaacgccagtaaactgaagatgcaagacttccagggaaaccaatttcccaatagatgccgggatagtaccattcaagcagttgttattgagcttgagataccgaagcttggtcaatcctagtaaacctggccagaacgtttccatttacaaaagtaagttctgtcaaccgtggatcatacatgcgtgcgagacatggaaggctatggagccatgcgactcgtacttaccatcccagctctggaaagtagcattgttcatggacaaatccaggaactgaagctccgggaatgaagagaagaccgttgtgtcgaaacgccaaaacgagtgaccgagtgcatctagcacttcattagaatcatacaggtttgagaaatagagatgtgatactcgcccagtgatgttgctgcagttgacgcgctcccacaagcagcagtcgtcgccgcggccccatgaacgcggcgccgtgccatttgagcgcgtcagagaggagccgatgtccatcagcgccgtcctctcctccacgaagcagccatgggaggacgtggagatattggaatctggcaagcatagcacaaccaagaagaagcagaaggatccccacggaaagctgcagctcatcttggaacaagaagctccaccttctcctacgcttggctcactgagacacctgagaatgatcaatggtggattgctagattgtgtggttttatcatgctgctggggaagcaactttgctttttaccactcttgggctctgtaaaaacacgggtatttagctataagttttaatcatgttaatgacttagtcacacttgctgagagcagtgttgattgtgtcacgatgttaactaggacctattaacgtattgaattgttgattctaatttgaatttcctgagttatttattaactgttcatcgcttgatattaagtcatatgcatatgcatatgcattatcgatatatttattagttagaataaattctgtgagagtgcattatttcaagaatatcaagtatggttcatgccacgttgttggccattatctgtagcgcggattagttgtcactggagaggtagtgaggtacacgaatgcacaatagaaattagaaatcccattctttataatttaccagtacaagtctgcaacatacacgcagatacttgtacactaaaattcttacactgtatgcatcttatatatatagtacatatgcatggttatacaatatcaactgaactcatacactgcatacaagtctaaagaagaaaaatatgatttatcaagaaatgttgtgctatattagagtatacaatttgattctaggaggttaaggtcataaaagtaaaacccagaaaataaaagtgaaactagcgtgttttatttttgaatgcatataatctaatggtcacacaaccaaaccatatataagtgcaaatagtaattggacaatatagtatcatcttaaatttaatggattcttaaaaggataattcaagtatagatcagccatctcactacatagttaacaacaagaattatctctgatgatctacaagtgcatttgagttaaggattatatctttatatagttctataaatcaatgctcagtaaatccatcataggatgaattttgaatgcatgcatagttagaaataatcatcgttctatttaacctcaagagcttaagataagatcaatattgtgctaccatttcaagttaaataggcagagcataaatggttagacattgatctattctcagtgtagaaactaaatagagcatctaggatccattagcagaatcataggtaagttggctcttactaagaaatgagccgtagaccggtattttaccttggaagtggaatacgagggttgctacaggctctcggtatgggcatggtacgtacccctattttgtgacttgtgagtttgacatggacccgtagcttaagttaatgagagtgtcggagaggaggggaatggataaattgaaaagatacgtaaaacgagatgagctattagcatatgattaattgagtattaattattttaaacttgaaaaatgaattactataattttttaaaacaactttcatatataaaacttttacagacatcgcatcataaaacttttaccaacatcacatcgtttagtatttcagaaaacatgcgtgtgaaaaacgagataaatcttttctcaatgttccgcgggcgaagttgaaagaaaaagattgagaagatatgtaaaatgagatgagtaattaagatataattaattacttcatccgtttcatattataagactttctagcattgaccacattcatatatatgttaataaatctagacatatatgtgtgcatagattcattaacatctatatgaatatgagcaatactagaaagtaagtttaattattttaaattttaaaaaatagatttttaaagtaacttttctataaaaaaaatctttaaaaatacgcaccgtttaataactcaaaaaacgtgcgagccaaaaacaactcaatttcagctagcaagactcgtttgcacctgggttctggaaggccaagtgggacaatagtaacgcggttacgcggagatctcatgacgagaatatttgctttcggcgatagctgaaattgaggcaagttggggagtcacttgaagattatgacgaattttgtccgtcctcatacgtatccttgcccattttctaaatttcttgtgtgagcaattgtttttcttgatgctgtttcttgactaattaaacaagctactgcaatctaccgagtgcttcaatcagtttggaccggctcagcatctcaactagagccaactctgcacctcgaaatattagaagagaatcaagctcaatttatgaggttacccgtcaagaaccagccagaattaatgtcggttaatttgttatccagtaactatgagctcctctgaacttgcaaaaaacaggagaaagtctgcaactgaaaggagatctcccaagtttcggatcgtctctctctcacacacaaaaaaaaaaaaagtttcggatcgtgaacggagaagcagtgccgcatgctgacccttgactttgtctaacagtgaccactaattaggcaaattccctgtcaagtaagctacttcatgattatctcctatctcgtgtttatgagacactgaccaatttgactgtaacatgtgaacaggggaaaaa

SEQ ID NO: 86444 - DNA, 3686 bp, Oryza sativa
ccactcctcctggtcatcagggaagacatcctgtcgaaactgattcaaccaacttttcgtaggcccgtgcccatctgtgagatcctccagtgcaacaggcagcacaccaccaaaactggccagaaggtcatccgcccatccagcattcaccattgttgggccaactgctggcccagctatcggcagccccaacaaataagacacatcctgcagagtgggcaccatctctccaactgtgaggtggaaagtgtgggtctcaggcctccatctatcgacaagagcactcataagcgccgcgtcaatgtggattcgttcggaccttgcacgtgaaggctcgactaaccgtgcaaacgtcaacaacccagctgctctcagcctacaacatgacagagcgtaagttattaatacatgaaaatataaacaccttgtattagtaaaaacaatatattttcacacaccttggaacccaacgaggatcaatacgccaatattgatccggtcctcgcatctttagcacattgcagaaagttcctgtactaagacgtcgcgatcgatggttcctatcgatctccttgtctatcagctgcccatcattttgatcagccatacctgcagatcgaaaaccacattagtacaatgcacgtatggtaacagtacaataaatgtatgcaacataattcaattaacaaatttgcatgccatttcaatttaaaattacagtaccagcacacatagatacagataagaatagttcagtacatttcaatttaaattacaattccaatacaaatacatgacgatattaaaagtgcagtgcagttcaaaatgaaaattacaaggccattacaaatagattcgggtaataaaagtgcaagaaagttcaaattaaaattacagacgcactaaacataaattgaacgataacgatcttcaaagtagggagtccaccaatgataatagcgaattaaggattatttttcttcttcgacttcccctttggaacgcgacgaacatcagcgcctgtggcatcttgccctacattgtacatgctgcaatctttacgggaatggttctccccgcaaagaatgcaagctttcttacgacgagaacgatctttcacttcagcttcatccataaggttcttgatcctgcgtgactggcgacgacccttagtatcaactaataaatttgagtcaggaacccaattggcttgccctggaggaggacgagtgaaatcacacacggcacgccaaccacgcaattcaccacgccaagttgcctcccacgattcctttctaaagtagggagaaacaaaaatgtttccatcaatacccccttttgcggaagcagcaagaacatgggaacatggccgatgtaacaggtaaggcttgttgcaattgcatttgcaagcgtgatactctggccacaacgtgcattccaatgtgatgtcagtagtcccaatgccgacaccactcttgtcacgaagtcgtatctcaaataacaactctctattcccagcaggccacactctgtggattcctcccttcttacttttctcatccatgtactgtgtaatagcggggctatacttaacactgggtttgctgaggttcagactagccatggaataccttttacagagatacttctgtgtacccctcgtgatgccctccaggatagcaacaagtggtagaggtcgtgtattcttcataacccaattatacacttcagcaagatttgttgtcatcacaccatacctcgatccatctgtatcgtacaacaacgaccatttctcccttggctcaaattctacccactccgtgaagcacttcgtggcccttccacgcttcctgcgccgagtaatacttggtgcttcattaggaatgggttcaagtccctccgtctcctcctgtctggcaactatgggttttttcctaacctcttccatgtgtgtagtggtcaaacgatccagttgctcccatatggcatcaaactttctttgttgattctgcttgcataacttcttgaacaggtccatcaatctcttactcttgaattgtctataaaaattagccccaaaatgtcgcatgcaccatctgctatgtaaatctggccatggcacggactgtgtgacatcttcttgaagcttctgtatcgctgatagcaaaccggcgtgtcggtcatgcagaacacacacatttggtctgttttcaacaacacacattttaatgtgccgcaaaaaccatagccagcttgatgtgttctcgctttcaacaaatgcaaaagcaacaggaacgacatggctatccgcgtcgactccgatcgcagttagaattgttcctctatacttgcctgtcatgaaagtgccatcaacacagagcaaaggaatgcaatttttaaaggcctctatcatgcacccaaatgaccagaaagcccgacgaagaacattctccccatattcattcacctcatcgagaatagccatgtgtgtgcccgggtttcttgcctgcatcacctccaatagtgggggaagattgtgataagaatcctcataagttccaaacctcatctccaatgctttctgttttgccctccaagccttgtcgtacgatatctcatatccgtactctttctcaacgtcatgcattatggtgaaaggggacaaagatgtttttctaaccacctttgaatataccatttgtgccacaaatgccgctgtcaggtttctgtgcaccagacgggtattctccaacaaacacgtatgttgctcaaccctcgaagctacccataaagtgtcatgttgtgtcttgtaaccatgcactctccaaggacatccaccctgtatgcacttcacgtcatacgtcgtcctatttgaaaccttcaccctgaactcacgcttctggacaaatgcccacctcttcaccgcatcttgtaagtgacctttgtcatgaaacatctgtccaactttcacctgcttactatcataacaccagtgggcatctaaaccatcgtttaccttcatacgactcattgatatggtcgtccaattatcgggtatgtaagtttcgttgtcccacagtgttgtatcttctccttccactacaagcgcaatgtattcctagttttccacttccatctgatccactaccgcctcattctcctccgctgcatcaacacgcataggcgaatccggttcttcatcgtccgagtcgttggcctcacgattagtaccacgaacaatgacctctccttgtgtattaccctctactacttcttcccctcgaccttgctcagtccgccaaacattttcagcttgtccaccttccaacggagtttcttccaccacggcatgacttgactcccccgatcgatcaacacattttgtcttctgcaccactattgccaggctatagcctttctcccttactttactaacaaacttcctccaactcccagttgacgcaacctccactactctccactgccatccatgttgacccctcactggccacacggcatttatgacaaatttatcgtgcactggatctaccccaaacatattatacaaccaccctaacacgtcgttcaaacccatatgctccggtgcattcagactagtatcatggaaggcatatagagtcaaatccaccccgctatcacatatttgtataggagcatcgccataa

SEQ ID NO: 86445 - DNA, 5547 bp, Oryza sativa
gggtagttttattttcacctaatggcatgtgttatgaggcattggttcatttggagtattattgtacaaataatcaagccgaatacaatgctttattgttcggcttacaagttatggagatggttggagctaagtacgtggaaacttttggtgattcggaattggtggtgcaacaagtcgccggagtctacaaatgcttggacggatcactaaataggtacctcgactcatgtttggatattattgccaatttcgataattttgctattagacatattgctaggcatgataattctagagcaaatgacttggcacaacaagcatctggttataatgtgaagaagggattatttctgatattagaagagccggtgtttgattttaaatcttcgtgcgaaattggcaaaactggacaccagtggcggtctgaccggcattgcacggcaggtctaaccggtgaccagaggcggtccgaccggccgcatgccgccggtctgaccggcgacccagagcggtctgaccggcctggtgtggccggtctgaccggttctgggcagagcgctagggggcacgtttcgatcaatttggaggccgaattaattgtgaattcggacatttgtgcccaggaagcagaaaaggattggacaattcctttgattcgatatttgaaagatcccacagttaaggttgatcgaaaaattcggcggcaagcattcaaatacacattgcttgatgaggatttatatcgccgaaatatagatggtgtcttgttgaagtgcttagatgaagatcaatctaaagtggctatgggagaggtacatgaaggaatttgtggaactcatcaatcagcccacaagatgaattggttgcttataagagcggggttctattggccgaagatgattgatgattgcttcaaatattatagaggatgcgagtcttgtcaacggttcggcaatgttcaattggcgcccgccgccgtgttacggttcggcaatgttcaattggtgcccgccgccgtgttgaaccccataattaaaccatggccgttccgatggtgggctttggatttcattggtcaaatttatccttcgtcatcaaaggggcataggttcgtgctagttgctacggattacttcaccaagtgggccgaagccgtgcctttgaagaatatgactcatacggaggtaattgactttattttgaagcatattatccatagattcggtattccacaaacattaactacggatcaaggtgcttcttttatgtctaaagaagtgaagaattttgccgaatcttatggtattaaattgttgagttcttctccttactacgctcaggctaatggcaagctgagtcgagtaataaaacattgttgaagttggtaaagaagaagattgaggaatacccaaagagatggcatgaggtgctttctgaagcattgtgggcgcataggatatctaaacatggtgccactaaagtcactccttttgagttggtttatggtcaagaagccgttttaccggtggaggtaaatcttggttctcttcgttatatcaagcaagatgatttgtcaagtgaagattacaagacgttgatgggagacaaccttgatgaagtcatcgacaagcgcttgaaggcattggaagagatagagaaagagaagaagagggtggccaaggcgtacaacaagagggtgaaagcaaagttgtttcaagttggagacttggtttggaagacaattttgcctttgggtactcgatccaaggagttcggtaagtggtctcctagttgggagggtccttatcgagtgtgcggcattgttcgagggaacgcatactttttggagacacttcaaggggagcattttcagcgagcaatcaacgggaaatacttgaagaaatacttcccgagcgtttggcaagacgcttaggaggtactatggccggtaattggattatcgtcctaagaccaaaaacatgttctatgcttttagattcacgttgttcatcaaaaaggcaggggggcatgtgtttataccaaaatttggcacctaggattaaaataggaaagattgccaaaatttggaagtctaccgatttcctccgagtgggccggtctgaccgccgtgtgttgggcggtcagaccgccggttgagggccggtcagaccggcggtgtgtggccagtctgaccggcaggtccaagtccgactgtgtttcatcgggtttcgaggtttccttgctcgggaaggcatgtttcgggtttcctttagtttctaccccgagttggatgtggaggagggcctgtagagggcaagaccaacccctatataagggacatggccggttgatggtaaaaaccaatctacaatcaatcaatcgaatcgttttttatattgcttttagttttctcttagtttttccatcttggtcggtttgcaccgtaaaccgtccgccgccgctacgagagtgcgacacctctttgtaggtttgtgctgaaaaccttcagttttgcccacgagacggatagttatctagaaatcggctccgctagccggtttagttatcaaaacccatctaggtttagctctttgctaaatcgaggtggttggcgactctaggatcaccgcaaggcttaaggtgctgcgatcgtgcttgtcaacttgtcaaaaaagttgccaacacaaattaggccattttctccatttcttctatctgcacaatgctagctctcagttgattctatcgcgtccatggccggtgcttccccttggcctaactacatggatgatcttctcggtgaactcccttagcaactttgcagaaacatacatactacgtatgtcttactggctcttatgttgatttctgattttattttcaggccaatcttacatttttttttcccgatctgttgtcttgctgaccttttctgattggacattccgcgggatcactatcatttccttgctactgtatttgtctgttttccttgctactgcctactggaactctctgcaggtaaatatggtcaaattgtgaggagatatcgtacattcgactaattctgaactttcaacatgtgattctttcttttgcagctctaagcggctacacacattaattaaaggcctaagttaactgaaactgaaacaagatgtgtagtacatctatgtctttatgcaagttcaagtggttcataggcaagaaattaaccaatcaatatcacaggtaccttctaatcatagagttcagttttacagtttatgaagacattaggtttacatgtgattcctttgttcaggatcgcaagttcgacccatttctgtagtttttacacagcaaaagttacattatgtgctatttctgtacctcactaataaaagtataatactttacaccattatattggaagaatatgatcaaattacaattaatgataaattattctgcatccagttgtcaatggttcttttcgcatttggttatccatatttacagcttgtgcttcctcatcataaattcataatttagaaaataatagcacataattgcaatttctgcagcgaaaaaccagatctgaacatatccttagctttatattgtgatatttaacaaaatttatagctgcttttgttccatttaagttgtattaatcagcagtacagtagtggtgtgttgcgcctaataagaaatggtagcggtatgttagtagactacagtagtaatttttttaagaacattctcattcaaaattttggccaactgctgacatttcccatgccatcacatattctcagcaaattcattgctttttatcaagttactcacactaatatttcacattttgtgaagtagagtacttaatttgctatgcccgcagcaacgcgcggggttttacctagtatctacagtgaagatggcatagaacataggatgcacataaaacttgtgcacaaaattgactcaaactgccacaaatttgtggatgcctaaggaaagaatgctacactgcaaaaaaaaaaatgatggataggctccatgtatagaatgttatatacatctaatagatagtaaggaatatacagttatttgactgtcatgtatagacatacagttgacttaatagaatacttattcttatggtttttgtgctttagaaataaaggcaaatcaggttaatcattcagattaaatgacaaaaaagtaaataaaactgatgaatagttatccaaacagatatatgtatttgtatctctaaaaggaaaatgttttcaattcaacatgccttgatactaagttgctacttaccctagaaaagttaattagtgtgtaatgacaataagttgacctcacgaaactgtgaataagggctttataacctgcataatagcattggatttccactaagatgcatgtctccattgacagcctgagttataaacaaattgacagttttactcactgtgatacataaccttgtttttttttaaaaaaaaatattttcttataagaatatatatcatcctgcccagtgcccatatccactaaactgcaggaacactcaacgtctcaacatggctttgttaatacatgcagtccgagatatctaagaagtgtaatcagctaggagtactaccttggcacttgacttcccaagtgcaaacaattgctagcagtgtgctaacgctgtagattgccctcaaaagatcgatacactggtggagaagtagtttttactcccggttcgtaactccactttagccccagtttttcaaccgggactacgaatccgggactaaagatcgctatctttagtcccgggtgaaataaccgggagtaaaaatctatcttaccaaccgagactaaagatagagcatctttagtccttaccaaccgggactaaagatagagccaggctgatccctggctgctcctttattatattcttttcttcattgtttttaatatattgatttcactccatccccatccccaaaatcccaaatcaattatcacctccaaatcctcaaatcgatcatctccaaatacatcacaaaatcttaaaaaaaattacatcacaacatctacaaaattcatcacaaataaatcacatattcaatatcacaaatacatctcggatccggaccacaaattctaaaaaaaaaaggaaaacaagccgccatcttccgcttgccgcctagccaccgccttccgccttccgccagccagcgccgcgcgccggccgccgcgcgaggccggtgccgcgcctgcagatcggggatgagtaggggggggaggaggagcctcgcgcggcgccgctgcctgcagatcggggaggagggggggagggggaggtgaaggagaggagggggaggaggagaggatgctccgcgtgtaagatagcgaggagaagagggtatcggaggagaggaggaggagaagaagagatagaaccgggagggaggaggggaggaggagatatgtatctcgatcccgcacgcctcgatctctccgcacatgccgatcttttttcccggttgg

SEQ ID NO: 86446 - DNA, 1775 bp, Oryza sativa
caataaaagttaaattaattctctgtcctaagtagttttccccggtttctcttcttgtggtcctgtccatgccagatggtgctcactcgcagcaacgggaatggccctaacaacaataacaataacaacaacaatggaagaatcccacacttgcccaagtcttggctcaacaggcacagcttatgaacatgatgatgcagcaactccagaaccagcagaaccagggaaataaccatgcacctccccagaacaagttagcaaaattttttcgtgtgaggccgcctattttctctagcaccattaatcctgttgaagctggtgattggctgcatgccatagagaagaagttggatttacttcaatgcaccgatcaggagaaggtctcatttgcatcacatcaactgcatggccctgcctctgaatggtgggatcacttccgccttaacaggactactgctgaacctatcacttggcttgaattcaccgctgctttccggaagacgcatataccatcgggagtggtgtctctcaaaaagagggaattcaggtcgctcactcaggggtctcgctctgttacggagtatctgcacgagtttaatcgtcttgctcgttatgctccggaagatgtgcgcactgatgaagagcgccaggagaagttcttggaaggacttaatgatgagctttcttatccactcatgattggggattatcctgatttccataagttagtggataaggctattcgtcaggaggacaagtacaatcgcatggagcagaagaaacgccggattgctcaattcaagacacaacaggggaataatcagaagccgcgtcttactttaggaccccagtccatgccacagggaggttcttcgtctgttgttcgtccgcagcgtcagttcttcaacaacaatgctggcaacaacatccgcaatcaagctccacgtcctgtttgcagcctcgacacagcaacaacctgccaagagggagcaaggcagcaagcccgtggtgtgtttcaactgtggagacccaggacattacgctgacaagtgtccgaagccccgacgtgtgaaggttgtccctacccagagcaactctaccgtaccagcatcaaaggcccgtgtcaatcatgttgctgctgcagaagctcaagatgctccagatgtgattttgggtacgtttcttgttaacttagttcctgcaacagtgcttttcgattctggtgctacacattcattcttatctatgagttttgcgggaaatcatgggatggaagtagaagatcttagacgtcctttgatggttagtgccccaagtaatcaagcactctctttgcaacgtagcccctctgtcagaatagaaattcagggagtaccatttctggccaatcttatcctgttagaatccaaagaccttgatgtcatcctagggatggactggttagccagatataaaggtgtgatagactgtgctaacagaaaagtaactcttaccagtaatgatggtcgagttgtaactgttcatgcattgtcttctgagtctttaaggtcaagactgaaccaaataacgttggaagagattcctatagtccgggagtatcctgatgtgttcccagacgatttacctggtatgccgcctaaaagggatatagagttcagaatagatttggtaccaggaacaactccaatccacaagagaccttatagaatggcaaccaatgagtttctacgaatatgcacatacttataaaaagacacatgggtaccgagctcgaa

SEQ ID NO: 86447 - DNA, 1736 bp, Oryza sativa
cttgtgggtacagtggtacacctctgattagagtaaaactatgcgaatagccgtgcccgcggttatgggcgggtctaacaatgtctttcgtgattagtctcacacctctcatcataataaaagatgttataactggtaataatttgattagcttctggtttggaatggtatattcctggtctggagatagaactgtgcagccgggatggttgttcagaatggttgggcctaggcaacagggtatgttgtgtagcgttggattaatactgtttaattaatacttaattgttttatcaatttctgaaatatttgttaaatgttgtttatgcaaatgaaaccctactatgccatcctttggtatccttgtgcacttgcatattgctgcgtgacttgttgagtatgtcatatactcaccttgcaatcattcatcagaggaagagttctacagaaatgctgatggtgtggaggattaggcgtagccctggtcaagttgcctgtggagtggagtcgtttgcgccgtttatcttattttccgctacttagatctttattgattgagaggaactatctacctctgtaatgacattttattcgcttattatttagagtaataattgaactctattatcaatttgttattgtgtgcctcggctgattcctggacgagggttcacacacatgtaagcgtttggaattttggatagaaattccgggcgtgacaagggaataagaaaagaaaaagaaagaattgaatttccagagattaaataatgcttgtgctcatttttagttggttaaaattatttctagagctctgaaaattccactaaaaatcttgttagcatatttcgacatgtagaactcaagaaaaattccacatgccaatcccaattattatttgcattaatttattagggtttctctcttacttttacaccgatatttcctctaggtaatttataaattcaatttaggcttgggaaagaacttcagggtttgacaaacctacctcccttaaacggaatctcgaccccgagattcggaagagctggcgaagaggtgcggatgggcggcctttaactcatcttccctttcccaggttgcttttttttctgagtgatggctccactgaaccctgtagaacctggtgaccttgtttctagtccttctttcactggtctcaaggatacgaactggcttttccacataagtcagatcttcttggatgtcaatgtgctccgaatcggcttgttcttcgggtaccctcaagcacttctttaatgggacacatggaacacgtcatgaatgccgatcatgttggatggaagttctagctgataggcaacttctcctcttcgttccaagattttgtacggtcccacgaagcgtggtgccaacttgcctttcgtctggaaacgatgcactccccggagcagagtaacacggaggtacacataatcccctgcttcaaaagtgagctcccttcggcggttgtccgcgtagcttttctgtcgagactgggcaattctcagtctctctctgacggttctgactttctcttctgcttccgttagcacttccgttccgaacatttgatgttcgcctgtttgatcccagaagagaggcgtgcggcacttccggccatacaacgcttcgaacggtgccatttgtagactggcctgatagctgttgttgtacgagaattcagcataaggcagacttttatcccatgcccc

SEQ ID NO: 86448 - DNA, 5242 bp, Oryza sativa
agcatgctgtcttaaaaaggacttggaaatattaccattaggtgatcagacaattataggagagagaggcattaacctaagtggcggacaaaagcaaaggatacaaattgcacgtgctttgtatcaagatgcagatatctttctgtttgatgatcccttcagtgctgttgatgctcatactgggttgcacttgttcaaggtatttttcaaaacaaatctttaaatcctatttctatatgtgtgtaaatcatcactgaatgcttaaactaataacttattgttggtacttaagacttctaatactacaaaatatatatttacatcatatgatttcaacgccattttctcccagtcaatttagggggtttttttttaaccttcttcagttgtcagtgctagtgccgttatcaaatccttagacgaatagaacatgtttgttttgtttgatttttcatttcccaacttccaaaataagtaatagcagtttatctctttgcatagtttattgtgtggacagaaacctaatgtcttaatcagatcttttgtatgtttcagctaaacagtttttaggtagcctgttcttgaacaatatttagggttcaagagtatatctactgtatgaaagttattcatcacgaccttgtatttttcaggagtgcttgcttggactcttagcttcaaaaactgtagtgtatgttacccaccatgtcgaatttttgccatcagccaatgctatcatggtgagcttccaacaactatcaaatctacttatttattctactcgcaacaatcgttttaccatgtcaattcatttccctgttctaggtcatgaaagatggacaaattatacaagttgggaattacgctaaaatacttaattctggagaagagttcacaaaattagtattttcccataaggatgccatttctactctagaaagtttagaacactcaagtggcaatcccaaaagtagtcttattcctggtgacagtggaagtacgcttttcagataagcaaaaggatgataatcaaggagcagaagaagggattgttcaaaatggtcagttggtacaagaagaagagagggagaaagggcgggttgggatttccgtctattggaaatatattacaatggtatatggtggagcacttgtgccgcttattttgctcgctcagataatttttcaagttcttcaaattggaagcaatttttggatggcttgtgctgctccaatatccaaagatgtgaatcctccagtcaatagcttgaaaatggtacttgtatatgttgcgttagcttttgtgagctcgttattcattttcataagatcccatcttcttgtcatggctggatgtaagactgcaatgatgctatttgataagatgcatcgatgcatattccaggcttcaatgtctttctttgactccactcctagcggtcgaatcttgaacagagtaagtaatttaccttcaccatctttattttaatgagaaaattgaagttatctccttggaataccattagaatttttattcatattcaattaatcatgaaagttgaaacaaaattgtaggcttctagtgatcaaagcacagtggataccagcatttttgacctgatgggatatgttctatttcctgttatcgaacttcttggaacaattattttaatgtcacgggcagcatggccagtcttcgtaatttttgtcccaattattgcagcatctctgtggtatcaggtattctttttattatatattttatgttggatgccattttttggttccagtttataatttttaagtatgtggaaggaaaaatacattaattcatgacattattgacaatttttcacagattcaattgaaaattgaaaatcagtgtttttttcttttcacagatttaatttgaaatttaaaggcatggcaaagcaattaaatataatacataataaaaacatgaggtacatatatgatgtgattcttttcttggcaaaaatgttcccaataaaatttctaggttgatgctactgtatataggagaacttgtgcatttccgatgttcttctgaacaatcaaacttttagtcttaaaatatgctattaaccaataataattgtaatcatatttcaaaattataactatgtcctatggcattattggtttcaatacgactcatgttttgtttttatttttaatcaccataattccttcccttcagcaatattacatagatggtgctagggagttgcagaggttgactggagtttgcagagctccgctgatgcaacattttgctgaatcagtagctggatcaaatattattagatgctttggcaaggaaagacagtttatcaattatgtcagtcatttcatggataatttatctagaccaagtttatataattctgcttcaatggaatggttgtgctttcgcttggacattctttcatcctttatcttcgcatttgccttggtacttctggtcaccttgccagctgctctaattgacccaagtaagtacagtgggctttaatttgattggtccgatcaaattagttctttatgtgtattaccatccttgctaactattatttttatttttattgtattctcacagagacagctggtcttgcagtcacttatggattaagtctgaacatgttgcaagggtgggctattgcagtgctctgtagtttggaaaatagaatgatatccgttgaaagaatttttcaatacatgtttattccttctgaacaactccttacaatatcaaaaagtagaccaaactgccagtggccgacaaatggtgaaattgagcttcgcaacctccatgtttgtctcttgaactctatgttgttatataagttcacttctaacaatgtcggagctatgtcaattattgattagaactctcaacatttctattcataatattttctgagaaaaacagtgtgttattaaattaattttatatcgaagttattccacaaaaattggcatgcagattttttttctagtactgtagagttgcaatcctctttcataatatactattttgtacgacttccagcataccactgtggaaataccctcacaacactatatcttctttcttaacatggaaaacatacaacacctaatgcagaaatttctggtgaagtgttattttttcctctaagtgctttgtatgtgatgcaggtaaggtatgcaacacaattgccttttgttttgaaaggccttacttgcactttacccggagggttgaagaccggcatcgttggaagaactggcagtggcaagtcaaccttgattcaagcgctattccgtattgtcgagccatctattgggcaagtgttgatagacggccttgatatctgcaccattggactacacgacctacggacaagattgagtatcattccacaagatcctgtgatgtttgaggggaccctacgaaataacattgaccctttggaggagtacagcgatgaacaaatttgggaggtcttttaattttaatttactgacattttaattcttcaatgtgcacctgtcaaactaatgcataacttatatttgttgtgttatccaggcattgaactcttgtcatcttggcgatgaagttagaaagaatgagctcaagcttgactctgcaggttttatatctatatcagaaagctataatgcattgctccacagtgtcaaactcataagtcataactgatattttaatatgaaatatagttacagaaaatggcaacaactggagtgcaggtcagcgccagcttgtttgtttgggaagggtagttctaaagaagcgaaagatcttggttttggatgaagcaacttcttcagtggatccaataactgacaatttgattcagaaaaccctgaagcaacaatttttcgaatgcacagtgattacaatagcacataggatcgcatctgttcttgatagtgagaaggtcattcttctggacaatggttagtcatgtgctttgtgtttaattagtagccaacggttaatagcttggttctcccgttttaattccatgttgttgtaaacaggtaaaatcgcagaggatgactcgccagcaaaacttctggaagacaattcatcgttattttcgaaacttgtatcagaatacaccaagggatcagagtattaaactatgtagatgaaagaggggccaaatatatcaccgaaactaaatttttggcttaaatttaaatattctttcttggtaacttgttgcaacatgatcagttgtgtattcggaatgtgcaatggaacattcatatattattacatttgctcattggtttgcatttacgtgtgtactgactaagaaaattgcaatgctgacgcataggcgatgatgtgtttgcaaatgtgtttatctttcagaaagcactactccagaacttcaccatagacaaaaatgctactactaatatattcaccatcttattgtgttatttataacaattttttataaggcttctaaaaaaacgtacatgtgtcctttgctatcgaaatctcgaattgtgacgtgacaagtttttgaacgatcctaacaaggtgccaaatagacaaaagactgccgttaaaaataaatggaaaaagtatgaataaccccccaccccctatcccccgaactatcgcggtcgtccgaattaccccatgaaccataaaaacggacattcttcaccccccaactatgcaaaccggacgaattacccccctcgaaccaattcagagaggttttgtccaacgtggcgcacacgtggcaatccagttagcgtttttttaattaaaaaatgcaggacccgcctgccatactcttcttcctctctctctattctctctctctctcgctcttttctctctcgcggctcgcacaacacgcatggcgaggacagcgcagggacgagcggtcggcgaggacggcgcggacgtcgacacggagacggaggcgacggaggcggaggccgaccgggcgcacggggacacacagcgggcggcgggctcctcctccgcgcggtggaacaccgccgccaccgcgggctcctcctcctcctcgtcgtgggcgcgcggtggccggcggcgcgcggggactaggtggcagggcggcggggcagggcagtggacgaggcgagcgacggcgggagctcgcgctgctcaaggcgaggcgaggcggcggaggcggggtacggcagaggaggcgagcgtggcggc

SEQ ID NO: 86449 - DNA, 674 bp, Oryza sativa
aagtatttttaataaatggaattgcatttcacgaataatttaaattgaaaaaggattttaaaagtctcttttggctttgggccgaaagtcggccgaaaaccttctctctctctctccttcggcccagtcggcccagtccagctgcagccgccgctcgcgcgcgcgtccgcccgctgacaggtggggcccacctgtcagtcttcgtctacctctggccgccgccgcccgaaaccctagcgccgccgtctccttccaaattcggccgcgtctttcccgatccggtgaaatcatttgaggggaaacaatcttcgggatctcctctaccttttctcttttggaatcatcgtctaactcgctttggaagttcgtggatttgaggtcgaatcggattcctctttctctcccgaacccgaagtttccttcgcgtcgccggccgccgtgggccttcgccgccgccctccaacccctatataaggacccccggtgtctcctctacccgccgccaccctcgccttcgtctctcgccgtcggaagagctctagcgccgtgtgacctagcgccgccgtcgtcgccgtcgctccagccgtgcttcgccgtcgcttcagccgtcgccgtcgctcggggagatcgccatcgtggtcgccgtcgtgtcgccgtcctcgtccgccacttcg

SEQ ID NO: 86450 - DNA, 2508 bp, Oryza sativa
gcagccctggaccgggcgcatggcgacggttcacggaaacgaacggctgagatcgatccatccaaaacggacggccgagatcgatcgggtctacagcggctcacggcagacggccccgatgacatcggcgatgacgtcaccaccggcggcggctcgggcggcgcaaactcgccggcgaacaacggcgcttcggcatgaacggaggacaccaggacgtagagggcgacgcggcgaactcaccggtgaccaaaacgtcggcggaagagcaacggacggcgacggcgacgaagaagaagcggcggcgaccttcggcttgacgacggcgacggtgctccggcggtcttcggcagcggcgaaggggcggacgaggacggcgacgacttggcgaccacaatggcgacctccccgagcgacgacgatgaccggaacggcggtggcgcacggctggagcgacggtgacgacggcggctcaaggttgcacggcgttagggcgcttccgacggcgagagacgaaagcaagggtggcggcgggtagaggagacaccgggggtccttttataggggcaaggaggcggcggcgagggcccacggcgaccggcgacgaaaaggaaagttatggctcggagagagagagaccaatccgaatcgacctcgaatccaacactttccaaacgattttagccggggattccaaaagagaaaaggtagaggagatcccgaagatcatttcccctctattgatttcaccggaaacggaaagacgcggccggatttggaaggagacggcggcgctagggtttcgggcggcggcggccagaggtagacgacgggcctgacaggtgggccccacctgtcagcggcagcgagcgcgcgcgagggcagctgcggctggacttgggccgacttgggccgagaaggagagagagcggttttgggccgactttcggcccaaagccaaaagagacttttaaaatcctttttcaatttaaattattcatgaaatgcaattccatttattaaaaatacttccttagctcaaataaatcccaaaaaaatctaggaattatagaattaagcaaagtatttaataaaattttatctggccccattttatattggaatttattaattaaaattagatcttctcttctagacttttaaaataaattctaataattccaattaaacgacaatttatatattttggatttttagggtgtgacaaacctaccccccttaaacagaatctcgtcctcgagattcggaagaactggcgaacagatgcggatgagctgacttcaattcatcttctcgttcccaagttgattcttcttccgagtgattactccattggactttgcaaaaacgaataactcgatttctagttcttctctcgtctatttcctagatacggattggtttctcaacataggtcagatcctcttggacttctatctgttcaagattagcttcttcggtaggtactcttaaacacttcttcaattacgacacatggaacacattacggactcctgccaaagattgaggtaactccaactgataagcaacctctcctcttctactgacaatcttataaggtcccacaaaacgcggtgccaatttttctttggtgtgaaaacgatgaactcctcgaagaggcgtgacacgaagatacacataatctccttcttcaaaactcaaatctctgcggcgattgtcggcataactcttatgacgagactgggccactcgcaatctttcttgaatgattttcaccttttcttctgcttccctcaggatatccgtcccgaaaacctgacgttctcccgtttgatcccacagaagcggagtgcggcacttccgaccatacagtgcttcgtaaggagccatctgaagactagcttgataactgttgttgtacgaaaattctgcacaaggtagattcttatcccaacttccaccgaagtctaaagcacaagctctcaacatgtcttccaaaatctgatttaccctttcagtttgtccgtctgtctgcggatgataagcagtactaaagttcaacttagaacccatctcttcctgaagcttcttccaaaaatttgaagtaaactgactgcctcgatcggacactattttcttagggacgccatgcaaacacacaatcctggccatatacaattccgccaaccgacttccggaataagttgtgtttactgggatgaaatgagccactttggtaagtctgtcaactatcacccaaatagagtcatggcctgatgacgttctgggtaaaccagtgatgaaatccataccgatttcctcccatttccattcaggaatcttcaaaggctgcaacaaaccggcaggtttttgatgttctgccttgactcgctgacaaacatcacatactgctacgtactctgcgatttcacgcttcatacttgcccaccaaaatctttccttgagatcctggtacatcttggtactaccaaggtgaatggaatataa

SEQ ID NO: 86451 - DNA, 5908 bp, Oryza sativa
atatcgattgagcatcaacaccttttcaatccttgggaccaatgtttctcattcaactcaatgaaattattggtctcaatgatctggttgtcaacctctacatgttgatcaaccaatcgcgcatataaaaggaagtggatgagtattaaccaatatcacaagtgtcatgtactcaaatgtaaagatcccaattaaatgcaagtgaaaaacttggatcaaatatgtcacgcccagaaattcactagtaatttccaaactaatttgtgcataaaatcctcgtccaggaatcagccgaggtacacaaactgacaatttaatatacaaatccatcataataataatgttacatacttacaaaagaaaaggaaaatagcagcggaattaacggtctagcgatggcttcagctccactcccacaggcagctcaactggagtataagccaaacatcttctccttctggatcctttttcttcaactgaggtttgatgattattgcaagaatgagcatatgacatactcaacaagccacacagcaaatatgcaaatgcacaaggataccaaaggatggcataatataggttcatttgcgaaagcagcattaagcaaacatttagaagtaaatcagtagagtaattaatcatcaattttaatcgacactgaacagcaccccaatgctgcacaggcccaaccaaacctgaacagccaaccccggtcgtacagatcaaacctccaaaccaggaattatccattccaaaccaggagtcaaattaattatcacattattaacattaatgagtaatgtgggactaatcacgaaaaacattgctcaactcacccataaccgcggacacggctattcgaatagttttactttgatcagaggtgtaccactgtacccacaagacgcaatcccacaacatgtcaccatgcgccttagcaccaccacggtacctcggaaaggaactgtgacaatacccctcgcacaacacaactcaccacagtgcaccgttcctggatcataatctccccctcaaaaccaaaggcaatggactccccagcgacccccatggacttctcgccgcttcacagtctggtgccccgtaatgaatcatgctatacaaaaggtaaagccgttgctcacactggcttgtggttggcacggtaaatgtttcacaacagtagctcgcgaaccggtccttaattgtcatgagcacgaccttcaaaaccatgtgctcacaacccaccttaatccagttttaattaccaattaatttacataacataacacgattaaccatcgtgagctaccattaaatataaccgtaattaataataatataatatgatttatatttaatcccctttaattagctaatgtttaagcatgactaagcaaacatacatatggcatttagctgaaccaatccaatatataaggtccaagctaatcaaattataacccataggaaaataaagtcatgttcggccattatttaattgggaaaggctcatcacccgatgacattcgaaaataatgcataagttgaaataaatcattagctttaaacgggttcaacatgttcaaagggttgtttgggatctgggtgacttgccttgagcttccgcaaacacttccgaaccttcctcaacgaaaacgctctcctccggaacgacggaaactaaagcaaatgaacaaaatcaacaaaacagtacaaaaacaatcataaacagtacatgtggatatttttaacatgtagatcttgattttagaaaaacttagcaacttgaaccactcgaatcggagctacgatgaattagttatgaatttccgaagttttaaactatttgcatctattaaaaaaactaaaaagaaaaggttatgacgtcatgctgacgtcatcaatgtcgactcgtcatcggcgacgacctcgccggcgctaggggactcggccggacttttggagggcacctacgcgtagaggagaacaacgcgatctcaccggtactaaccaatgcgacgaacgaccacggatggcgaccggcgacgagcttgtgcggcggcggcggttcggtggacggcggcggcggctctccggcgaccggtggcgacggcgaagggcggcggagcttcccctcttccacgcgcacccgacggcggcgtgaggaggcggcggcgacggctaaaacgacggcgcgaggcggctgttcgccggccggcgacggcggcggtttgggtggcgcggcggcggcactacgaggcacgagagagctcgggagatggggcaaacgaaagagggcgactaggggatgctatttataggcttggattgaagagatcggactccaaccgagaggatttgagccggaaaaaccgagggttagttggagagataaactcaaaaacgaattcgattccaggcacaggacggctggctcaggcttctgtccaagcttgaagatgaacagtgcccagggaagcaaactagactttcggctgggcttctacttccaaggactgattaaaggagggacacaaagcagacttcgggaaagagagggaaaggactgcaagctgagaggagactaggccgagagtgagaggactttccctaattcggcccgaaaaggaaaaggtgaattttaattacttttccaattaaattaatcactgaaatgatctttgaattgttaaaaatacttccaatgctcaaataatttcaagaaaaatcctgaaaatacttggacactcaaagtacttaacaaaattataatcagaccatttaatgattaatttaatatgtggataattactgaattgttctttgtatgattaaaattaagagttgagctccaaaaaatccgagaaaattccagagagtataattaaccatggagaatttaataaaaattaaatacatccatgctttatatttaggaaattttattttccacaattaacttcacttgtaaattaatgaacatttaatataaattctaataataatttattaaataatttataaatcctaagacgaaaatcaggatgtgacaaaatacatgcataactaaggtataggatttacccccctaaatgtatgcatacaatttttttgtgtgtgaagaaaaagtatgcataactagagataaaacatcgtgagcttaccctatacaagaatagaaggtatttatcatatgtagacattaaggtagaagcataccttcatcatctccatattctcaatgtgaagagactaaacaagatatggctcaacaaaacattagtctcaaatccatatgtcaatcacatgaaaatattatatatgaatatatcaatatgtgcatagagagaaagatgtgatttaggtcaatgcatttcatccttgtgatttaggtccacgaacaattaacatttctatttcaactcatatgaagtccgggaatcacctatcacaaacttcactttcatatccacatgacactaggcaaagaatgcttataaaaaaattagtctcatataattggatttatcattaatcaccaaaaccaaattaatagcacttgaactttcaaaagggaagaggttttgccttacatattgatagagcagagttgagggctgagcctcagaaaaaaaatatgtacaggacatggtcaaagagagctaatgttgaaaaaaccttgaatcttatggcttcattcatagagataactagaaagaaccttgaatccataatagagttgttgaaagactcacacatgttgttatcagcggagtcacaatttgacactagctggaagaatgccctgctccaatgctcaggtgtggtggtcatcatgtccttggctccttgaggggtgtcttgtgctagctttgctctattatagttgaaaagctccctacaagatgactttgcacagttttagatttttttctgaagcttctggtcagtgtccttttttctccagtttgcatatatttgccttgcacacatcctatgttctactctagtgataagctcagccactgcctttatgagtccctacaagacaggtaattcaaaatatttattacaacttaggacccattgcacattttgttaaaagataaatagttaaaaagcataccttttactggtcagaaattatcacccatccttcacctccatcatttatattgagatcttttttagctacccaagaaaccaataccatgaatcatatatttctttctccactgatgcccatgcaatgggatacatctaattattagcatctcttccaatagcacatattagctcgccattacaagcacccttgaagaaacaaccatctagcccaattactctcctacaaccagcaagaaacccttttctgcaagcatcaaagcatacataaaacctctcaaatactttcttgtcaagtatatctggattaagggtcacaactacaatactcccagggttgctccttaacaactccaattgataatcatacactcttgagactctcccctagttttatccaatgcttcttgtagcactaaggctttggcccgcttgcactttgaaatgggcacatcaacaagcatgtcctttagaactgacttcttaatatgttccactttccatgtcggattatccttgataacatcaaaatatttatttactatgatcctggatgtttttttttgaagtgaaagcggcaaaagatttgccggatatatttaggagattagaaagccaagtttacaaagttgagattacaaatatttcttaaaacaaccaactctagcaatgagtacaggactttctcccttcatggaggtttgaaaaccatatcctgctcctgtatgtcgtcgaggatgagtgatattgttctttgtagacttggggcttgggaattgatttttttttccgttttgttgcaaccaaacatgccaccatgtctttaacaggattccgatccttgacctggtttggcttttaaggccagtggaccctagagaacacatccactgttagtggtggaaatgttaggattgggaataatccctttttcagcggcaattcttgcccatacctgcttgatgaagttgcattggcaaaacagatggtctgtatcttcaaaagcttctctgcataaagtacagatccagtcgcattcccagtgtctaattagcaggttttctgctgtaagagccttttgatgaagaatgagccttccaatttaggttgaaaatatgatcaatcaccgaacccatgaattggaagcggcaggcgcttttaccgagaagattcatgaggcatttcttgtccaagatatttcatcatgatgttgatcagaaagagttatttgattgaggagggatcccaattgcactaattcatggatggtttctatattagtgatctgtctaaaagaatgtagccaggtgttgtctatcatttatgtttccaccttcctattctttatttttgccaatttgaagaggttgggagcaagatctttcgggcacaaacctggtaaccaattgtctttccaaaaaagagttttttttgccatctcctactgtgatttttgtgcatgcctggaagagttgtacatctcgcatattgcaaggcatctccatcagctcccaaggtctgcttgtatcaaacagccacaaccatcgtagcctaagcgtagatgtgaatttttccatttcgagaattcccagccctcccatgatgatcctggatgtgactagcttgttatctctcctaggtggacaacaatgctcattattaaaagtggccacttggaaccatttagacctacttgtctttgacacatatattagccatttacatcctggtcaatagcaggttgccctaaccttgtccctttcatcctttgggaatagaatat

SEQ ID NO: 86452 - DNA, 3899 bp, Oryza sativa
gtcatgaagcgaggcttctaattgttcccctgaggaaagctgatctgagctacctttctatttcggtccattttgttgcgttgctcttcctgacggatagccttgtccacgagcttctcaaagtcatcatagactccggagatcagctggttggtcaatttatcatcgagaccaaacaaaaacttctcctgcttctcggcatcggtgcgcacatccttaggagcgtagcgcgcaaggcggttgaactcatgcaagtactctgtaactatcctggtttcttgatgcagtgcgcggaactctcttttcttttgtgccataatcccctcaggaatttgtgccttcctgaagctttgacaaaactctgcccaagtaacctccgttgaatctggacgggtcaccacgtagttatcccaccaagcagaagcgggaccttgcaactgatgtgtagcaaaagcaaccttctcttggtcattgcattgcagaaggttcagcttcttctcaatcgcacggagccagtcgttggcctacattgggttggtggtgcttgagaaagtgggtggctggatatgatgaaagtctaacagtttggacaggtgtgatgatggaggaccagactgctggttctgctgcgcctgctgcaacatctgatggtaatgttgctgcatctgttgtatcatcattgtcatcatctgagtgaccgttgggttctcgggcggtggagatgaactgctgtcagatgcaccactgatatgagctccatcggtctgctcttcgctgcccctagcgtcattggaggcacggggatcattccctgtcttcaccatctggacgaggataggtagaaataagagaaaggaagaaaacagatggcttggaaactaatctttcttatagatttaagtgcaattaatttaatcttgattaaaaaactaaaaagaaagcaaacaactcctaattaaggcagtcataccactaacacatgatatcgaccgccgactaacccacaagcaacaaacctaaacacagaaactagcaagcagccaaaactaagaaaatgttaaggataaaggcggcgactctgaagcttggagcagcgcttgcgatcagagaacaggtctgacatctaaagaggacagagggataggaaccaacacatgctcaaaaccaaattaaataaagcaacaaatgactcaaataactcgccgagcatgatgatttttatgcgtggaacatttttcatgaacccagacaaagatactaatgcaactgactaaacgataaattaatgcacaaaatagatgcgtagctataatatacacataaaaatgcccatcgaatctagacacgacttagtgcatatcacctaacaaattcccgactgaaggccaaataaattccaaataaagttttgctagaaccctagactgcctctagccgagaaatacgattaaatagcgatcaagatttttcccacaaatcaaaagagcaaaccccaaaattataccgaaacaaatccaagtgcaaaaggcatgtgcaaatgaaaaggtttaagaggactcttagggtttccagttggcttgtcctacggtcaaggtcggctctgataccaactaagaatttctaagctgaatgtgtattaaacccctgtccaggaccagccagggtacacaaacgacaattattgacatacagatccacgtcttacaaaaatataaaagattacaaatgcagcggaaaaaagaggaaaaaaacgagctaagcctgaagacttgacttctacagtgggcgactccattccacaggcatccttgacggtagcgacgaaaccaacttctttgtgacatcttcaactgagaaggacttcaactctagtgtgggggaaaagagagcaagaccgagtggcgaaggctgtcttgggaatatcctcttcccgaattctcaactgatgatagcctgatcgcaggtctatattggaaaacaccttagctccttttagctgatcaaacagatcatcaattcttggcaacggatatttgttcttgattgtgacctcattaagggcgcgataatcaacgcacatcctcttggtcttgtctttcttttccacaaagataaccggagcaccccaaggtgaagtactcggtcggatgtaccctttctgcagctgttcgtcaacctgctttttgacttctgctagctcattagctgccattctgtacggcctcttgtagattggagcagttccgggtgccagatcaatctggaactcgatttctctcttcggtggcattgtagtgaggccttctgggaacacctcaggatactcttgtactataggtatatcctccaacttcttgggatttttttccgctatttctgtctgatcctcaataacagcctgattcagactcgctacggacttctgtgacactggagaacggaaggtgatcttctcccctttgtcgttgcttagggtgatagtgcgacttgcgcagtcgatcactcccttgtgtctggtcaaccaatccattccgagaatgacatctaggtctttggattcgagaaggatgaggttggatagaaaccgtgacctcttgatctctatagtcactgaggggcagtagtgtgctgtcctcatgtcatttccaggggtatgaacctgcatcagtattttaagttccactaccgataatccatgtgccccagcaaatctcttggatataaaagaatgcgaggcaccagaatcaaagagaactgttgctggatatgagttcaccggaaacgtgcccagcacgacctctggtgatgcctgtgctttctctgcagacgcatgattgacgcgggcctggacgaacctaggtccaacgcgctttagcttcggacacttgccagcaaagtggccgtgcttgccacagttgaagcagggtcttggctttcctgcagactccttcttgagctgttctgactgagctgacatagctggcggatctgactgagctggtgccattaatgggggtgaagtcgagttgtggttatgctgcttactgttgttgtgactgccaccgttgtagtcgttgttgaagttactcgggtggtaaggatggtgctgacggatgatcagggtggaaggctcacctagctgtcccgtcatgaagcgaggcttctaattgttcccctgaggaaagctgatctgagctacctttctatttcggtccattttgttgcgttgctcttcctgacggatagccttgtccacgagcttctcaaagtcatcatagactccggagatcagctggttggtcaatttatcatcgagaccaaacaaaaacttctcctgcttctcggcatcggtgcgcacatccttaggagcgtagcgcgcaaggcggttgaactcatgcaagtactctgtaactatcctggtttcttgatgcagtgcgcggaactctcttttcttttgtgccataatcccctcaggaatttgtgccttcctgaagctttgacaaaactctgcccaagtaacctccgttgaatctggacgggtcaccacgtagttatcccaccaagcagaagcgggaccttgcaactgatgtgtagcaaaagcaaccttctcttggtcattgcattgcagaaggttcagcttcttctcaatcgcacggagccagtcgttggcctacattgggttggtggtgcttgagaaagtgggtggctggatatgatgaaagtctaacagtttggacaggtgtgatgatggaggaccagactgctggttctgctgcgcctgctgcaacatctgatggtaatgttgctgcatctgttgtatcatcattgtcatcatctgagtgaccgctgggttctcgggcggtggagatgaactgctgtcagatgcaccactgatatga

SEQ ID NO: 86453 - DNA, 2339 bp, Oryza sativa
ggacaaaagcaaaggatgcaaattgcacgtgctttgtatcaagatgcagatatctttctgtttgatgatcccttcagtgcggttgatgctcatactgggttgcacttgttcaaggtatttttcagaacaaatctttaaatcctttttctatatgtgtgtaatcatcattgaatgcttaaactaataacttattgttggtacttgagacttctaatactacaaaatatatttttacatcatatgatttcaacgacattttctcccagtcaatttagggttttttttaaccttcagttgtcagtgctagtgctgtttgaatagaacatgttggttttgttggatttttcatttcccaacttccaaaatcagtaatagcagtttatctcactgcatagtttattgtgtggacataaacctaatgtcttaatcagatcttttgtatgtttcagctaaacagtttttaggtagcttgttcttgaacaatatttagggttcaagagtatatctactgtatgaaagttattcatcacgaccttgtatttttcaggagtgcttgcttggactcttagcttcaaaaactgtagtgtatgttacccaccatgtcgaatttttgccatcagccaatgctatcatggtgagcttccaacaactatcaaatctacttatttattctactcgcaacaatcgttttaccatgtcaattcatttccctgttctaggtcatgaaagatggacaaattatacaagttgggaattacgctaaaatacttaattctggagaagagttcacaaaattagtattttcccataaggatgccatttctactctagaaagtttagaacactcaagtggcaatcccaaaagtagtcttattcctggtgacagtggaagtacgcttttcagataagcaaaaggatgataatcaaggagcagaagaagggattgttcaaaatggtcagttggtacaagaagaagagagggagaaagggcgggttgggatttccgtctattggaaatatattacaatggtatatggtggagcacttgtgccgcttattttgctcgctcagataatttttcaagttcttcaaattggaagcaatttttggatggcttgtgctgctccaatatccaaagatgtgaatcctccggtcaatagcttgaaaatggtacttgtatatgttgtgttagcttttgtgagctcgttattcatcttcataagatcccatcttcttgtcatggctggatgcaagactgcaatgatgctatttgataagatgcatcgatgcatattccgagcttcaatgtctttctttgactccactcctagcggtcgaatcttgaacagagtaagtaatttaccttcaccatctttattttaatgagaaaattgaagttatctccttggaataccattagaatttttattcatattcaattaatcatgaaagttgaaacaaaattgtaggcttctagtgatcaaagcacagtggataccagcatttttgacctgatgggatatgttctatttcctgttatcgaacttcttggaacaattattttaatgtcacgggtagcatggccagtcttcgtaatttttgtcccaattattgcagcatctctgtggtatcaggtattctttttattatatattttatgttggatgccattttttggttccagtttataatttttaagtatgtggaaggaaaaatacattaattcatgacattattgacaatttttcacagattcaattgaaaattgaaaatcagtgtttttttcttttcacagatttaatttgaaatttaaaggcatggcaaagcaattaaatataatacataataaaaacatgaggtacatatatgatgtgattcttttcttggcaaaaatgttcccaataaaatttctaggttgatgctactgtatataggagaacttgtgcatttccgatgttcttctgaacaatcaaacttttagtcttaaaatatgctattaaccaataataattgtaatcatatttcaaaattataactatgtcctatggcattattggtttcaatacgactcatgttttgtttttatttttaatcaccataattccttcccttcagcaatattacatagatggtgctagggagttgcagaggttgactggagtttgcagagctccgctgatgcaacattttgctgaatcagtagctggatcaaatattattagatgctttggcaaggaaagacagtttatcaattatgtcagtcatttcatggataatttatctagaccaagtttatataattctgcttcaatggaatggttgtgctttcgcttggacat

SEQ ID NO: 86454 - DNA, 3954 bp, Oryza sativa
tcccccctccccttcccccttttggccggaaatggaaggaaggggagggaagctgccccgggggtaggtgccgatgccgccaccacctggagccaccgccgccaccaccctcccctctccggccccccagccggatttgggaggagggaggggagcctgcgcagacacaaccctgctccctacccccttcggccggatctaggtgggagggggcaaccacgctggggtggatgtagccacagccaccaccttccagtcgctccccttcatctagatctgggagggaggggaggggagccgcgccggggaaatgggaggggaggggaaaggtgggagggaagagagacttaggctgtgtgaaatttgcatgggtaggtggtgatttttatgaggtataaatttttgcaggcgaaccttttacaattaccctacaaaaatacccttatttttacagacggacctctagatccacctgcgaaagctaatttttgcaggtgacactagatttatagtatctttagctattttttataaacggtgattttatagtctgccagaaaaaaaaatcataacgttgggaaaaataatttttctagtagtggtaactagtgggtgcaatcagtcagacaatcaaatattttgaggaagctagttgtcagttaggtgtgtggttacagttttcagataataaaagcttttattgaaccctaataaaaacttccattatataaaaaaagtgattgaaatattataaactgatctaccaaaatattaatcccggtatgattaaatatattttcttatttaagtacggggagttcaaccgctgaggctacttcgaagtcctaagttgtcaatatttcacaaatatgttatctagtaagatttaaagatatactcctttgtcccaaaatagaccaacttttacctataaatatgacaaagtcccaaataaactaacttttttaacctaaagctgatttattttggaaaggacggacttactagcaagctctaataactgattcatatcaatttttctttactctcccttcttcctccctattttctcaagtttgaatttgttgcattgtatcttgcgcctagagcccatcttaagaaaaatgtctactcccttctctctccattgtatgaaagacgaacaatcaggtttatattaataatattgtacattctgtatggtttttaacatggtccaatgttgccttaggcaaacgttttggacaatttgaacatttattatttataggctatatttttgtaaccgtgtaaacgaaatgtcttttgcttcaaagtcgacggaggtgcttgcatgttgttggtacttttacttccttctgtgccaatgcaacgaggcgggtcttctgcctctgctcccaggaagaagaaaaaagtattttgcttcacttatctggtcttcgagtatgaattcgttgtgcatgcatgcatgctaccatgttgacacatattgaatatatcagctataactctttaatttgtttaaattaatggcatttcttattgttcttcattttgtcgcggataagagattgatgtagtatatatgccattttatggtgcgtggtcaatattaattggagccaggaataagatcttaaccaaggcaggtgatagagaagtttttgagatgccattcgctaattactgttctcattcatccatttacctctatattattttccagattacacacaagcaagtcacgtgtttccttgtttttaaggtcaaaattgccatgaacctgttgggatacgcataggctacgatagcataaatcaaatttttttatcgcgtaaagcaggaacaatgcaagtattagattatagatcgttaccactcaacgcgctgcgcagcggaagaagacgctgagaagtcgaaggaactctcgcgaagtagcgcacgtcgatgtagaggaagtagtcgatcgcaccggctcgaccttctcctcctcgtgcgttctcctcgccgtactcccacgccgatcagcaccgcaaaccagcggcgcctctaccggtatccacacgtacaggaacagaacgccacgcgcagatgtgctagcacccgcgcgcggctagggttttgctcggggagggaagtgacggctagggtttctcacatgacgcaatgcctccgccggtcacacccctcacgaatatataggatccatcactcgggcctctaaggcccgtaggactcctattcggatccctatccgaattaagctcatattggatctccatccaatccccttattccagcccattaagcgtacgaccctgtaggttcatatatactcggctgtaactcgaaaactccttttcggtccacgcgtcaacagtggcccctagcagaacgtattgacccaccgggcatacataaagatcatatcggctgaacctctagtgtatacttgtatgaacccctttgcctcacgatatcgattaagctcaaggctagatatgtgccatcctctaatagctcaatcattcactcgaacctgttgatagattatataacttgtgattgactcctcaatcacctttggcatggccatgcacttccataatctacaacatcgaggggcccagagatatctctccataggaggggcaaatcccatcttgattattcatatcccactatatatttcatagcatatccgaaaactacttttataactacccaattacggagtagcgtttagtagtccctaagtaagctactacacatgttgggaaccataataatctcaggtttaaagattcaacaccaacactaaatgagatcactgatgacacaacacatatggctcttgcagtgtctcatgttggatctatccaacaacatgttcaccaacatgtgtccacattattaatttggtatatatataccatgatccatgagacatgatcatcaattaatacatgtgctaatcatctaaacatatttgttccacatatgatatttgatcagggatcctttagaaatagcaacacacaacataaagagtctcatgaaagaatcacatattcattaaccaataatgagtttatctatttcaaggaacaaagtcggataaatgtgtaaacatagtgtgtgatacaatcatctctatgattgcctctagggcatatcactaacagaaacctgctgaaactttcaacttagctggttgatatatgtaggtgaaatgtggctagatatgtacttcatcagcctaatcaagaaggggagattgtcaacacctggaattgttcagaattctgaaggtgcacatccagactttcagaagatagccggcaaccaagtcaccgataggtcgacttctcatgtaaaaatccatcgctcaagaatcactgagaagattaaatgaaatccaactgctggacaaagagatgataattactgttggatcggatgactattctccataaaagttcatgtttgcatgtttaataatagttcacctcgttctcatttactaatgtaaaaactgagagatactccgtatctctttactacagtgaagtttgtccaggctgtaaaatatttttagatccgctagtgcttataacccattatgatggtgaatggatgatacaaacaacaagttctctggctagctaagtagtagttcactggttattcggacctcatatctggatgggtggagtgagagactcgaagggcaggggacactgctgcacaaaccctctgtagtcccggtttctaaccccctatagtcccgagtagcaaaccgagactacgaatccaaaactaaatcgttatctttggtcccggttaaaatacctgggagtaaagatgtatctttagtctcggtcggtgtgtaaccaaccgagactaatgatggttgagccacgtgattgacgtctccatctttaatcccggggc

SEQ ID NO: 86455 - DNA, 6823 bp, Oryza sativa
caagatcgccgccccaagaaaacctcccccctccctccccaacccgcgatcctccacacccaacaacaaaggcggaggagaaggtatggtgccctttgaaggcagacgaggatctcaaatccgaggcggagatcggagtggaggaggagagagagagagagagagagagaggatcggaggagaggtggagggcgacttggagttggtcgttcgttccaagaaggggaggagagagagagagaggcggcgctaattgtaagtaagtttgttgagaggagggaggcctttgggatgtctcggtttttcgttggattggatcatggatggaaggagggcggtgtgaggagggtggtgagtgagtgtggttgctttgcttgactgggtctggtctttcttgccctttgcctctctccaattctatcctaggcttccatcggttgccattttgcttaaaatggcttatttggtttattagaaaattaaagttaatttataagtaaaacttttgtagatttgttcgtagcgacttaaaagccaacattaacaaaaattacgttaaaagcatttcaaaatcaacttcaaaatcaagttcaaaaattcaaattttagcttattctttggctgtttaggccaaacgatggggctgctatactctcttttttttgttgttgttgttggataagaggaatttgtaatggttagttgtcttgaaattaactgttctgtagatataaaatatcatactttccaatgattggatctttcttgtctcgagatgaatttgaccaaattatcttccatgtgcttctttttcgtctttaacatcctaaatagtctacctgtcttgtgttaattttggtaccatccttattccaagcacagttatttgttatgtgttttttaataacgttgatataaaccttagcttgtgtccatagttctacatattgagttttttttaaaaaaaattggttaaaagttctctaaaaattaagttatatattattaattatggactaaaattctgcaaagacacttggcacgtgtatgccaccttagtaaacatggataaggaggaatgattgcacatgcaaggacatatgtatgagagatggaactaccggtgtgtagtaatgcactaatgcgccagtatcaatagaaattaaataattccggcaatcctagaataccaaggtctggctgatgattttctcgattgacttgagccaagagcatccagacttcttcacctggcatcgggagagccctggatgctactcgatgtgatctgcttacaatgcgatgttctttgagagtgtcaacttcccaacattcctaatttgggagagaaaagcccctagcgttgctagtactttgcatggttagttgctaactgacgatgttggatgaccgattggctgagtaagcgaggtttgcctcacccagccttaagtgtgctttatgatcaacaggaagaaacaattgatcacatcgaaacatgtatctcatcaattttggcagctgatcctgatcgccatcgggcatccatgcttctttgcaaaaaaaaaaactttcttcctctcatggtggtgtgagtgcaagaagaaagtaagcgggtagcttcaccgaggattcgacaccatcgtcactttagccacctggttgatttagaaggaaaggaacaatcgagtgtttaaccaatggcaacagacctagaccgaagtgacacgtgatgcggaaaaagatgtgctttggtgtgaagttgggctgctaaagtagcatcacaatatagtatcttggtcgcacaatggatgtcatgatagataatcttgtttacactttgtgtttatgtttgtttttctttttcacttgttggctgggttagcaagatgcacattaccctcttcttaatacaaaataaacacacatcttatgcatattctgcccccaaaaacaaataatttttgtctagaagcactgtagtttgttataaatttacaacaactttcaagcggactaatacttgtctcatgggcgggggtgctagcccttgctagatagatccggtagccttttcaaaattaaacctataaatgggagacctatcatgcacatgtgaggactaaaatagtaaagaaaaaaaaccctatgtcgattttgtttctaatttcgaataattctaatacgaatagtatacggaacgaaaatggtggtatgcacattgaggaaattcctatatttcttcctcacgcaacactccatcagcaacttaggtcttgtttgaggagcttctagtaacttctcttagaatctaaagttttccaaatactgcagattcttacctagcaatggtggattaggctcatcataaaagcccataaagcaattgaaccagcccaacaattgcatgttactgtgctacatgcacccagccatcccacacgtgcaatccccacctccgctccacccgagcctcgtattggtagttcagtggcattgtcttagcatctctcacccaagcgtgccgtgcgccaagccaaatctcgcctcccccctcctcctcctcgcccttgccctgttcgtcatcccactctccgctcccctctactgctgctccatggcccattcctcttcgcaaccattgtccctgtccccgtccacggtggtcgcacgcacgccactcgtcccggttctcttcgtgatcggcgactccacggctgatgtcggcaccaaaaactacctcggataactcacccgcgccgaccgcgagttgtacggccttgagttcgacactcgccacaacacggggcgcttctccaacagtcacatccccatcgactacatcggtatgtatctatgtatgtgtcgtccccttctcggcactatggctagctcgaggacatcctagctggtctaccgagcataaggcaaactggcgcgtgctaaccatgacagggtcccgatcatgaatttgttggcgacttcgatagggaatgatcactcttgcaatagctgaaaccccacttctccaacatgggctctcgcaccaatcttgatcaagacaacatcatgaccgcatattatggagagttgttgaaaactgatcgccaggtgtttgagactcaacttgaagaattgcttcaaaagatggcttcgtactaccgtaagacgaggcaaggcatcatcaagcaacaaaaattcatgttacccatccatgcaaaatcaaaggtaacaacgattctagcagtgcctattctaacatatgaagttgtgatggtgatgttatttctagtttaaataatcggtttacttctttgaatactacctttgagaaaacctttagtactaccttggaaagccctagatgatcacatgagtgagttagagaatcgactaaatagccggttccttggtggtgcatgtatttcatgcaacaacgagcatatgcatggtattccttcatattttcatataccaaaattttctgtacaacaagattggccgatgaaaaatacccacaattccctcgatacaatagatcctagattcactcctacgatactgtatgctggtccgaccgatgtgttattgctggtcagaccggacgcatcgatcggaccgacgggtgtaataccaccagtccgactagaggcagcagccgatccgattggagggacatcaccggtcagactacgctcggcatgtttcgtagaatcagctcatgtctggtgctcctctaaaagacattgacatgtggggtccacgggctgactcaacaagattggataaactgcctcctaaaccgttcaaggagtcaatttgtaatggttttgtgagttggaggataggttatagggatgcgattcaaccatgggcatgagttgagggaagcaaagtagacttagggcctgttcactttgatgaaaaaaaaaaccttaccaaattttggtaggcaacttgccaaaattttggcaggatttcttatatagttatcaaaatttggcagcaaattaaatatagtcacttttttggcaaatttactaaaatttggtaaggttgaaaatgacatcaaagtaaacaggcccttattacccacgggaatggtgtggggtgggctggtaatataagcccagaaaccaatccatccagcccagcaactgcgaggtcggctgctagtctaacgtgcacccaagccatcaccccacacgtgaaaaatccccgctccacccgcgccgcgccgcgcccaggtagttcagccgcgcgccaacccaagctcgctcgccggccggaaatggcgctccccttcctcctcctcctcgccttcgccctgctcttcccgctctccgctcccccgcgctgctgctccgcggcccccgcctcctcgccgcccccgtccccgcccccttcccctgcggcggcggcggcggccccgcgccgcacgccgctcgtcccggcgctcttcgtgatcggcgactccacggcggacgtcggcaccaacaactacctcggcacgctcgcccgcgccgaccgcgagccgtacggccgcgacttcgacacccgccgccccacggggcgcttctccaacggccgcatccccgtcgactacatcggtacgcgccccccaccttctcgatcggcggcgccatggctgtggcccctttgctctctcgtgaatcctccccccccccgcttcaaaggttgcaggtggttctggaatcgtcgatccgatgctgctttgcctctcgtacgcctatggatgcagcatgttgtgggtttagtgtaatctgggttttgggtttctggtatacgaaggttttgcttagttgttggttcctatgaatttggggcatctgatctcatacatcgggggtatgtggatttttgcccaacaattgctgaagctgaagagtaatcagttcatagcactctcctacacagctgaccacctggatctcacatacatagactcctgcggcttcctctccttgatctcacatagcaatgttgtgggtttagtgtaatctgggtatttgggtttctcgcatgcgaggggcttgctcagttgttggttcgtctgtgggtttctgccgaacaattgctgaagctgaagagtaaccagttttgcagcacaaccaccacagtctgggcatcatttgatcctgctgttcttagcactcctgcagagctgaccacctggatctcacgtatctatatagaatcctgcggcttcctctccaaatcagtatccagtatccaccaccgttatcagccgttgaggcaatgcattggcagaatgccagaacattaagaagtgccatcataatgtacaccattagtccatgcatccagaaaacattgccagaatcctgcaatgtatccatttgatagtcctgagtcccgaccagttgtctacatgctccagtctctttgccaccacacactgttaaatctctcttgtccaatgtccaccacattctggacagtttcaaggtcctcacaggaagcacagctgcacaacctttgttaatgttgctttaagaaagtcatatctactcattagtttctttgggagagtaaggagggaaaaggcataggaaagaaacatttaactagggctactggctcactatgtgaaagatgtttcccttcaatttcatttagctggtgttctttatctcttttgcccgtctctgtcagtacttatgtttttcatgaatcaatagtatcttgttctttcttctgtttttaaattattttttccgtgatttcttaatcttagacttttttgtgcatttgcagcagagaagctggggcttccttttgtgcctccataccttgaacagaacatgcgcatgggtgtcggcagtgtcgacctcagcaacattgatgggatgatacaaggtgtcaactatgcatccgcggcagctggcattctctccagcagtggttctgagctggtttgtcctcctaacttcccaacaactctatttcacgcttataatctagcaggaatgtctttgtgagacccttctctagaggacgaatcagaaggagggtgtttcaacaacagactagaagcaatgactcttctcatagtgtctacatcctctctagttaggaagaatacttgctcaaccatttgaactaatgctgaaagattctcctgttcggctgctcccttccttccatgtgttccaactagtgtggattatcagggcatcaaattcccttcttagttcctaggaattcatgacttatatatgcttcctaccagatgtgagattgtctacacgagacgattgatatgctggtgctgatggggggtttatttatgctgctggccttgtccaagtttgcttgtgaagctacagtgctataagttgtatggttgttttattttcctgcacgcataaagcaaaaggagatatatgtagccatctactcaaagctaatttatcataatttttttattgtctgaaactaaaaaactgcatttgttctatactatggcttttgggatgatcaaggagttagtaagaatcactgatccggcaccaatgtgatgaaattgatgtatatcatcctgaacattccattttcatatcaatctttattcctgcttatgttgttgaatctccaatctttgtgcccaaaacaacaaaaacttgtggagctgcaaatgctaattttgtcatttcaataaaacatcatggtggtgtctaaagaggagaaatgtttacgtatgaacattgctgcaaagttttcctttatgtggctatatgttttaactttctataaaggattggagcctcttggttagagt

SEQ ID NO: 86456 - DNA, 2955 bp, Oryza sativa
accaaaacgatgatccttctggcaaagcctagccactctgacccaccgagccaaaaggaaagaaaaagaagtaaagaacagtgcagaacagccggttagctcgggtagtcgtattatcattttttttctatgccctgttaaattgttagcataatctttgtttggattgatacgtttgaacatggaattccttacttcttcatggattagaatattaccagtagagtagtctggctttgtttgtcttgtatgtttttccatagggaacatacctttgcccaagttggtggtatggtgctgtcctgtttgcatgttgggtgtgcttgtgggtgacatggtttggggtgtgtacattgccatttgccaatataaccaatatggcctgcttggagaaaccgagaaagaaaggcactttacaccataaccgccagctaattttaaggaatgaaatatgtgtaatcacacaaataattatgttaactttatcacttgaacaaagagaattgttgtgaccatatttcagtgcaagcctcctaaatgtgatcaaattctaatatctatagcttctcttttttagctcttttctgctaatacattctctgtcttgatacactgctatatttcttttagctcctttgattttttttattcctcctttttttttatgcaattcatttgttgtggtttgtgccactagccactgtaatgtctattttgttcactatgtaagcatactggtatatggagcaaacagttttcttgtgtcatgctccagtgctccatccattacaaaatactctcttaaaaatagatatgttttatgtattcacatccgatagctcctgtcggatctctattctcagtcacacttcatccctaagtttaacatgtttgagcgtagagctctagattggagctgtaagaagagagtaaagaatatcagaaccatgtagttatttttccctttctggaaagctgaattatgttggcaaggctgtatgattttaaatatatatgtggtcttcctgaaaagtcaatgacattgtgcaatggaagaaatatgtgtgtctgtagggtgttgggcgctgcttcattaaggtttatggtatctgtagtgaaacatggaacaactaccctttcaaataattccttttcgcaaaaaaacagattcctgtctgaattttctgtatatttcatttattatttcccacaagtggaatttattgttgttatctacaggttgtccacttcagattacttgagaatccaaaagatgatgacttcactttggagctgtatgtgccaggaatatttgaacatacatataataactgacatacctcctttgtctgtgatatgactcactgtttttttcccctcctattttcatatttgtgaagttcaaagcgtttcacgtatgatgatgttgttgaaaaagttgctaatcaacttggactcgatgatccttccaaactccgccttacacaacacctcccgtattcacagatgcccaaatctcactacattaagtatagaggtcttgatcatctttcggacatgctaaggaatggcaatcaggtttggcagctttatggagtattctgagcaacttcttttgtgccttttacatgaaattacttgcgcttcctttggtttggcagatgtctgacatattgtattatgagatactggacatccctttgccagtactgcaagatctgataacattgagagttgccttttatcatgctacaaacaatgaggtttgtttgaactcgttttgtgcttgtaaccacttctatatttctgatcatgtcctgtgctaatgcttacttatcaggtgtcatctcactttatacggttgccaaaaggtagcactatgtctgatttgattgaggacatgaaatccaaggtgaatcaactgctagttttctttcaagtgttgtgtgtgcatggcaatttaatgattttttttcaggttgagttatcttatagtgatgctgaattccggttatttgaggtctacaaaaacaagatacgcaaggtatttcaacagttcttctgtaattcttaaaggcttattcttagggtagagaccattacacacaaaaaaaaaatactgcaaagctcgtttctgaaactggagggttgtattgttgtagaaaatcagttcctgctgtaaaataacaaagatctctctgtttgagttgatagattttttctttcactttgattacgaaaggtagtcaacctggcaggttttgcctgactcttccaagttttaccaaaaatcacgtcatatgctctttaagaaaaacacataatgctcacgtcatgatttcattttaccatgtaaagtttcatccctgctttcatcgtagaaaacaatattttctattctttcatcaaggtacacgtatacttaatagtggttgaaaatacctcttttatgcatgatcaatcacttgcctcgttaatttttcaggtgtatcaaccttcggagaaaatttcagttaatgaattcaatggactgttatgtgttgaagaggtaagcatttgcttatacggaaactttattgagatgttctgtcctttaagcaatctgaagttcaggctacaaagcaaatgacctacagttgggcatgctttgttaaaatgagtgggctcatcaacacgtcatcccctgtaataagatgacacaataaaatgtggtcatctcatgttggaataaatcatccatggaataacccactcaaactgaacatgttgttaattagtgtacataattagctaccttttctccacatattccttttctgttggtcaggttcctgaagaagagaaaaatgctggtgtgcgagaccgtttggttcatgtctgtcacttcatcatagaaaaacaggtatttatatatttagaacctaatgtttcaatactgcttgtagtcatttggta

SEQ ID NO: 86457 - DNA, 2823 bp, Oryza sativa
  unsure (1)..(2823): unsure at all n locations
cagttgatggatttggacggtggtgttcccgtttcacgttggtccgtgggccgcccgcgggcctcgtttgtgcatgccgtgttgcgtcgaaaacgtgcggtgcggtttggcggcgattccggccccgatagaaagtttcggtgcggcccggtttcgacacttcggcacaaaacttcaaaactacgatatatttcatctaattttgttagatgaaatatatcctactacgaatctgatatgctaaaatatatctcatacaatcaaaacttcttgtattttggaacaaaaggtattttggaacaaagggagtattgtagagcagaaatattatttgctaaaatgtggtctggtagatattagctgacatagtttctcctctttccaacttttactccctaattttttgcgtacacgttttcggatctatactacctccgtttcaaaatatagctacgtctaccgtgcatagtctcaagatgaagttatttcttcacctatcatctcctctcaatcaatcataaccattctccaattgattttttttcacttttctcttctcaatcaatcacaacctttctcatttacacatatttcaatacccatagacaactcagaatcttacattttagtatggatgaaatatttttttgcaaaaaaaatctatatgaaaattactttaataaaatcatatgaatctaattttcaagttttcttagctaatacttaattaatcatgctttaacgagtcaccctattttttgcacgggaaaaataagttctcaacctcggctaacaaacacagcctaattccacataaccgtcatttttgctcattaagtgctcgtagggtcaaaagtacagccctggtactacacttccctgcgatcagctggacaagaacctcttcgttggggcaacgacaataattctgggggacgggaaaacaaccagcttctaggactcgcactggctcgagaataagagacccgaggatatcgctccagctatcttggcggcctccaaacaaataaccaggactgtgcacgaggctcttgcccttaacacctggattcgggatattgacctactgcgtactatagatgcagaccatctatgctagtacgtttgtctatgaaccatgatacaatgcgttggccctctaaccgacctaaaggacctcgtcgtatggaagctgacggcaatggaatctactcttccagcacggcgtagaggctacaactccttggagcggcgggacgatttacaaccagaccatttggaagtgttgagctccacctaaatgtaagttcttcttctggctcattatttaaaacagagtctaaacggcggataggctaaaagaggtggtggccctgccanaacaaaataagatgcaatctaaatattgcgaataggggattaaacacaaaggaatagatacgattgaggtggtagatctaatcgacccggcaaatcaacacaccaattattaggggctctaaatttatagtcgccgactaatcaagcgaggacaagagacaagtgaatgacacttggcaaaattcaattaaacaaaactcaattgttctagagggtgtacatagacatttatagaagaaaatagatcaaaggtttagtgctaattcgtggaggtgggcctagtgtattacaaggtccaagtaccaagttcggtttcagcaacaacattgtcttgttttgacaatttccgtttactcggaatgaatttgtatatgaaaccggatgcgtttgaaaggtgacgagataagctttccatcaagtctaacatcacccgaatcggagttggcatgaagacactaggtccatttgaagtcaatgctgtctccggaggtcgaactggattccaaaactcattggagatgtatattgtagatcctccattcatccgatgtattcttgggcaatgttttatatttctcatgtttggttgtatacatatacttgatctcaacctattggcaaaatcctttaggtatgtttggataatgggaaatgaatggtgggattgggattgagaaattgatgaagggttttgattaaatagaagaaggagaatgaatggttaggatttaaagatgtatttttgtgggtaggaaattactttattatcccattagccaaacactgccttatactttagaccggaggtagtattcaaaagttgtttatggtaattggctgcaactcttttatatactctttataaaacaaaaacatctttgaatttgccgttaccaaaatcttcatcattttttttgaacggaaaaatcttcatcattgaatcctcaatgtactgctactgaacaatgtaacgcattttcattttgccaacaaaatggaaagataatgagtctgtgtaccgtcacgtcatcactttgttaattgtgggcctccatcagtttttgggcttaaggccttaacacctggaccactcgacgcaacctagctggaggcccagtacagtgccagcgccgaaaaggaaaaagtatacttcgattccctcgactatcacccgagtacgattcatatccactaactataaaaccagctatatcgactccttcaactattaaaaccggtacaaacaatatctctcaatgattttggagattgttttggctgacgtggcgcctacgtggtagtcttgaccaagtctttgtcgtacgtgacgcttacgtggcattagaataaaataaaaataaaaataaaacaaatatatgggacccatatgtcattcgcaaggaaaaaaaggcattgtgggacccacatgtcatcctccctctc

SEQ ID NO: 86458 - DNA, 8235 bp, Oryza sativa
  unsure (1)..(8235): unsure at all n locations
attgtgttggatgagtagaagcgcacctcgtctcaaaagaggtacaaaataataaagcagcaggttgataagcatcgacaaaggcatccagagtgacaattgcatcgtttacaaaatccaacacctgaaggaagttggatttacaacaatatagaaaaatcagatgaaaggacagcagacatatcataaactatgcagtataggtaaaacttgcctctgagaaatctttctgaagttgggtatatccactatcattcggtccagatgaagtgagcgcctaaaatgaatttattatggttaagttctttttatgcatagttctccaagatcttctgtaaactactaaactgtcatcagatcaggaaggtgtgaaactacaagatcaagtttatatcaatatcataggtcctcaacttttaatcgtggtgagaaaacatacttcaatctcaatttaggataaaaaagaaacagagacaaattaatagtaaacatcataatcgtcactttctatctaacctaccaagcaatgtatcatggttgttgaaaggaactgggaagaaagtatttgaaacaataacagatataacaagtaataacaagtatattcgtcaatagcacaaatgaataacctgaatcctttgcagaaaacgataaaagttttagcatatgcgattgggactacagactaaagtgaaaacagctgttataatgatatcatatggatgttcataccagataaaggaatacagaatcctataacagctatgtgcagtgatttatgaagaagatcacaaaataacctgtaatgatttcatgcacctctcctgcattgtgtggaaaatgcccaggaattggggaaggacaatattaatgccatccagaatatttggctggacattgatagcgttttcaacctacagatacagaaaatgtgcacttgttattaataaaattataaaagtattcatgccaatgaatagaaaaaggttatctgagactaagggaatgaattagaatttgcatttaagttagcatctgtctgcaaaatgaaaaggagaaaaacaacaacaataataaacacttcaggaaccaaccagtgaacttgtcaatttgcaattgtcatgcccataaatagcacaaatgtccaacaacttgggtaaatcaagcaatcttttctcctgcaggagggctacaaccgaacaacgtgaatatagtatatttgaaccaatggtcactatccattctgctctaaaaaaaggtaaactcaaacagtgatcatatgagtagttctaatctcacctgcatgctccttcatgctaagggattcacccctgaatgctccaggatccttgtttgaagatctaccacccaaacaagagccatatcatgacaaatctcatgtgaatctgaacagtgtgcattatcttatgaaaaatatgtatacaagaaagatagcgaaatggtataaatctcacatgcggtacaggaccataaagactcgacggcaaagctcaagctccccgacaactaagccagcaactgtccctttgggtgcacgatgaggcaagtcataccaccgatgcctgaattgtaggtaactgtccaggaactcatgcagggaagtattctgtgccactgggaaaaggtaacgataagcattaggaaaccattggtaaagttcaaatgcacgcggatttattcataagttaaattctaggagtgaaacaatggataatcacagatctaggcgtgtcctcaactcaagcttttatgttgactcatctactcgctcaattattgttcaggcttagtttgcataagaaaaaatgccaaattcctctgattgtagggtagttattcctgtcaatctgaagttcctgtcaatctgaagggactaggattaattccttcccattaaaactatttcaaaggatcataggtcatgatagtgataagaatatgattgcataggctttgctttgcttatgcaactactagccacttcaactgcaaatgtagtaataaatttaactgcacgcattttatcttgcgcttaaaagtgcaaactgacatttgaacaagcatacactagaattttacacataatccgtagccttagataatcacagagaccgaagcatcagaagatgcattcaacaaacacaattgaagcaaacaagcagtaaacaccgaacattaagtggttaactagttatcgcttccaagctttcagctctgatttcccaatcccaaaataacaattcacgccttccagctacacggtttcatgagcacagtaatgcacaagcgagcgtttcggttaccctggcgccagaactcgcggggcttagcgcggaggagcgcggcgagggcatcgttgaggaggtcgacgacggcctgcgactcctgggcgtcgggcccgccgagcccggccgcgaccacctcgtcgtgcggcaggtacgccacgaacccatcggcctctccgcccaccctgccggcgccagatgcagacggggaagccgatgatcggagggcggtggtgagcgtcggcgggggcgagggtttaggtgcggcgggcttggggacgtagcgctgctgcggctgcggctgcggctgcggctgctgctgctgctggccgtggtggtgcctcggggcggcgttgttgtggcggcggtggttgtaggagggtttggattgctgcggcggcggcgcggacgacatggctggatcggggggaggagggagaaggagaagccgtcacggcgtttcaggacagggagaggagtaggctttgtagattccggaggggtttcccggaattttggggagacccaaggtttcttgtgacaatgtacaatatttaaattgccatgtgacaatttccacctttaaaaattgtaaaaattggaaggggcgtatttcgatcatttttgttttttttttcgtctcaagctcttcatatgatttggtttatagtttgtattttgtctgttcaccctgtcgggtagaaaatcaaaatactaagccatgttttatgaaagagtgcatatctgaatattagtaggagcagtactactattatttaggcaaaatgtgctctaagacactcaaattttatagcctttgtcgtagaacacccaaaaaacgtgtatttattgcattacaaatttgtacttttcgctttgttggactcttctatcgagggagtgagaatggactaggtctggtttggttcaaacaaagttatcttacaagccgattgacacaagggcaaaattgtaacttttctcttggtgtaggtctgatccgaactagatctggttgggttaaaaagaaacatgcaccataggtaaaaagttgtcttttttgaaagtttctctctccatttagatccgatataataaaataatacgttcagcatccaccagctaattaccatgtttttagtggtgtcatgtaataaatacacattctttggatgtcatacaacaaataccattaaancctttgnnaaggggaaattccccccttnttttttttttttttttttttggggggcccctgatatttatggcgaattgaggataccttagctactagtaaggtttcttatgatggnacctgctntctnnnnnnnnnnnnnnnnnnnnnncnaatacccnnatcccnnnnnnnnnnncgtttaaaatagcaaactatgatgggatgagacccatctaagactatgaatctggacatgagacatgtccggaaggagtaattattttcactggtagcgatatacatgttgacagcgagtctatgatgtgcttgtatttatagctaattatttttagtggtggacaacgtaccatattacttgtggtgacttcgtcgaactcaaaatttgtaggtatatacagacaccagtggtgaccggtaacctcgtcaatcttaacatattactaactcaatcttcaaaagtattcattagaaccaaatgtacacgtgtgtattatataagagtgagcttatatgtctgtgatgttttcatcgagctcaagatatacggaccaatttttttagaggtgctcatgagataggttaagtacgtatgcattaagaacaaattcgataaatgaatgataaatcagcaaaaattaattatcaaaaaaagacactaatattacttcgccatttggtgagattgtggttgcatagagctagcgtagaagattaagaagcaataattcaaaaaagatgaataaataaaataaatttagacgattcaaaaaagatgaataaataaaataaaattagacgattaagaagtcaaaaattaattatcagagccaggtttcgatcctgggacctgtgggttatgggcccaccacgcttccgctgcgccactctgatggtgttgtttaggatgttaaacgtttctaatttaaacaatgctctataactaatcattcggctaagaacactaaggcatcgttcgtttaggggtgataggggagattggctctcgttttccgcgcgcacacttttcaaactactaaacggtgtgttttttgcaaaaaatttctataggaaagttgctttaaaaaatcatattaatccatttttaaattttaaaatagttaatactcaattaatcatgagctaatggctcacctcgttttgcgtatcttcccaatctcctcaatccccttctcctcaaacactccctaactcattcattattaggtataagaacactaactcatccattctcgaacactaactcatccattatccattctcgaacactaactcattatacattctcgaacactaactcatcattctcagtataataacttcactaatcattcggtattcagatataatataagaactttctatctcagattttttccgtttgtcaactgagcacagcctgcgatgtgtaacaatcgaatgctatatatctcccataaatgctcgaagaaaagcgaaaaagtacaaggacgatattacagtgctttggtatgttaagcatttttttatacaaaaagtcagacttcataagaatacaagtccgcgtaatttataactcagatagcaaaacatcgggaacaactagcactacagcaaaactaatactatgaaaatatagaaatctcagatgaaaaatacacttctgattctagccagctgttggctcctcacataacaattcgattcaagggttcaattgttcgttttgcattgctctggcctctggagcacacttaacatctatagttagaacacattatctactgtaaatccatcacttggaaattccaaggtgtggggatataggatgtcgtggagatagtaaccatctgattcttcagctcaactcgttaattgcatcaagatgagtatcgtatcaatattcacagtttacatcctacggttcaagctctttgttttcctgagttgatttcccagttttctgtgcttgactttctttcttgcgctgcatcgattattagagagaaaaaaaatatgaggcaaagcagaactcaattgaggtaatttgatctagcctaagctctatgtgcagaagttagaaaagcggagaacataagccacataaacaaataacaatggcaaaattggttctagagcatccaaagttcatgtgttttaattttaaagcaccgaaagttaatgttcactttaatagcactgaaaagttccctccattcccgctcttagcactcccgtttctttgggtgagagatggggttccagctgcttgatttagttgatctgaagatgtgttcggctatttcagttgaaaggaggatagggttggaatttcaggtgcttgaatgagtcaatttcggtcaaaactgacgtcacatgcaagaaaagaaacgggagtgctaagagtgggaacggagggaacttttcggtgctattaaagtgaacctgtaactttcggtgctataaaacaaaaacatgtaaacttacgatgctctagaaccaattctgccaataatttaataaaagatcccatggattcagttcatgcagcacagagagctaaaagggcctcaggtgctgttttatcaaatatatatatatgattaattctggtttaaaaaactgtggtttagttcttgaagtcacaggcacacagtggaaacctatctaccgctgtcgccatctcctcaatatcagcaatctaatggatgaatttagatatctcctcaatattagtaaatgcttatcattagtaaaacatgacaaactcttacaaagaactgctattctgccagtcatgtatcaaccaaaaaagaaaggtacaagaattttaagcaatagagacattaataactgcaaccagttaataacagcaagagattcagcactcaataacaagacagattaatctcccatcatctttcaattagttctttttttctcttgcatctataatgaactacagcatttggttcatggtgaaatatcaacagatcacttaatggaagaataatgatgaggtcagcagctccaagagaatatttaggggaaaatagcatcagaagtgtaacatttcattttcaaagtattagcatgtcggtgagcggcataccttcggaagaagtccttctgcagacatcagctcatataacttgcgcatgattgtttcttcttccacctgtacagaccaacattttcaaagtattactatctaaaaagttacttccaagacatagtgacgcctcatactccaatactctccatataaagctcacctgaactttatgcaactcgtgggacattgctcggtaagtttccattagggcttgattttgcttgtccaaatgcctgcagatcccttgtaagtagtgtaatgaactaaaatcctcaagaattaagggacggaaaagaaattcttacttggacatttcagctgaatgctttggttccattctcaccaacagcctgataccagttcctgcaaattgctttacattttaaaaatcatttaaaagcaagctagaaagttgaccgttattttatattaattgaggaattctgagttcacgccttgagggtgcagtgaggatggaatcgtactgctacattatgatctcattcaaaaaaaaatgaaacaaatatatgcaattgtatttgtttcttacgcataggagagctgccctggtaccctaggatgcaaggctcaattcagcaatgaacgacacatgaatgacatgattatttgatttgacatctaaaaacattgcacatatagtccgatgtcatcttgtcattctggttttctagaatcaagacacattttgttctctctttattggaaatttaaaagaactaagaaatagctaagatgaaaaaaaaaacaacatgtaatcaaatggacatggcaggctgctatttgacatggctatatttcaacggaacacaaagctcgttgaggtgctagagaacagtttacatactacacgggcccagtaaattttcgtgggggcatggacacatcacgagttattaacaccactgttcataaatcatagtagtatagtattattttgagaatatcatgcgtccaaaatatcctataggcacagttgcaatacaatctgcaggggcaatggcgggactaacatgggggcaatggggttgagatgaaccctaaataacaggaatcggcgtatgaaggggatgggctaattggagggaaactgggggaaaaaaaatcgatctcctatctacgcgacgctgactcatgaagtgggcgccgaggagggaggagggatacgagagaagaaccaataataccttagttcgattcgagcagcgatggaggccggccgtgcgcgcgaggaagcccgcacggggtgaaagcctgaagcaggctagggcgagttcaggaagaagaggggaccgtgctcaccgcgccgccgatctgctcgccggccgcggacacgatgaggcgaggcggagcaggtgcaccacggcgcggagcggggcggcggcgttgaagctctggctcaccgtgctcaaaagtcaagacaggcaggaggtcgattgtggggcggggccgtgcagcgctctgctaccgcctgcctgtgggtcatatgcacaggcccatgaggctggaaagaacaaatttttcatctcggaaaaagttcacctaaggtcccttttcttgacgtcgagttttaaaaccgttcctgaactgaaataccaaga

SEQ ID NO: 86459 - DNA, 2985 bp, Oryza sativa
gatggctgaaaacaggcagaagtaccagaaaattaaaaaggtaatagacattattctttggattatcagcatggtccaacatatcactaatgttactatatcttactagaagtattataattctatgaatacaacctttttatataattttatttacataaactgtgccattttcagtagttaggtgtggcatgtatgaccttgtgatgatttgactcattgcaggaacctgcaaaattctcagagctccaaatacagtcgtacctgaaaactgttgctttcaagcgagagatagatgaagttcagaggggtgctgcaggcaggggtgttggaggcgtccaaacatcaaaaatagcatctgaagctaacagagagttcattttctcatcatcattcactggtgataaacagtaagtactagtcttcacatatagtcatttgttaactttgtgcatgtgagtgtgcatcacattcggtcgctgtacttgttaaaattcaattccaacccatatagatattgatgatacttatctggatcaggacattagcacaaagaggcggaaaggagcatattgtcgatagcattaaatcaaagagggaaatcaatcctgctgtcttcaaatccaatcccactagtagttctagctcaattaagcctaacaacagtgagcctttggggagttttggacctgatgttgagacatatcgtgatgagagaggaaggattagagtaagtagggtcaaagcaatgggaattcgtatgactcgtgatattcaaaggaatttggattttatcaaagagcatgaacaggtcagaaacagggggcatgactctgtagttgaaggattagctaacaatgaagagcctccagattttccagaacatctttttgaaggtaatgggctgcggagttctcttcatctcagcgaagattatgatgaaactgctagcgataaccatcacacatcatcactagtaggatctgacaaaatttctgagggtgattatcatggaagcaaagaaacaatagagatatcctttgctgacgatcaaacagaagtgaaggacaatgatgaccaaattttcttgcatttagcttctggagcttcatccaacttattcactacagaacagactgatggctctgattgcattacaaaagaaggcgtacttgaaagtgaaacacctcctatgcaagttgatgagaaggatcaccaagcatcactgatggacaatttctgtactgatgatgagatagagtgggaagaaggtggttgtgatgttcctggaggtccttccagtaatgaaaacgatcaatctaaagtaccgaaaggagatctagaagaagatgcccttgttcaggaagctataaggagaagtttagaggattttaagaagcaagaacatgaaaatgtgacccctgaagatttacaggcatcttttgaagacaaacctttgcaatcttatgatgatgttcctaagccagctggagctgcaggaaagacagctgataaaattgggaaggaaataaattgtgaagagaatgatatagtgcatggatcacttgtagttgatggacgagaaaacgagaatcagactcaacccgagaatagtgatgggcatgccgatatgaagagagcttatttgttggatcctctccctccatgtaatatgaccgccagtactagtgctgcaaaatcacctgagggctcagaagttcagcaccacaattcaatgttacattcaatcagaactcccgagtggcctaagaacgatagcgataaagttatgacgcaatacagtttgaattctgataattcaaagtgcaaaatagatgattcttgtactggagaaacctcgaggtcactccaaaatgaccttttgatggatgaactggttcctgacactgctgtacaaaaagaaaatatgatccagagaactacggacttatccacatctgagataaactatacgaaactgaacgataatgttggtatatatagtgtgtcagctagtaatctagaaaaggaattatctcttctgagacaggaacaagaatatctcggaaatgaaaggcggaagcttgaaagccacgcagagtctgtcagcagtgagatgtttgctgaatgccaggtttgaatacaatcaccttttccctttgagttgaggcaaggtttacctcagaattgagatttagtggaagtttgaagtaaatggttttagcagtacaaaatgttaacatatgtatgtcttgtattatacaggaattgcttcaaatgtttggcttgccatatataattgcacctatggaagctgaagctcagtgtgcatacatggaaatgactaaccttgtcgatggagttgttactgatgattcagatgttttcctgtttggtgcaaggaatgtttataagaacatatttgacgataggaaatatgttgaaacatacttaatgaaggtcaattttctttctgctttcaattttactctcatttttatttcattgccagctgaagcaatgggaagtccatgtccttgctggaccttccacagctaatattgtaatacattttcaggacattgagtctgagcttggtctaacaagagaacaattaatacgtatggcaatgcttcttgggagtgactacactgaaggaattaggtgatatgctaacaagaatatgtatcctgtaactttttttgcagtttgtataaaaataagatcagaacttcatttttcttgttgagttgcatttttcgttgaaaggaaatatgaactgaaaaacttgctgttccagagatcaagtgcatgctctgttttgttggacaaatttgttatgtatacagtcattaagaatacagagcattgtactttaattatgccatctcaatttcttattttgaaggggggaaaatgccatttcagtttctgttttgtccagtgtatttatttatatactgattatgcagtggcattggcatt

SEQ ID NO: 86460 - DNA, 8939 bp, Oryza sativa
agtctgagcttggtctaacaagagaacaattaatacgtatggcaatgcttcttgggagtgactacactgaaggaattaggtgatatgctaacaagaatatgtatcctgtaactttttttgcagtttgtataaaaataagatcagaacttcatttttcttgttgagttgcatttttcgttgaaaggaaatatgaactgaaaaacttgctgttccagagatcaagtgcatgctctgttttgttggacaaatttgttatgtatacagtcattaagaatacagagcattgtactttaattatgccatctcaatttcttattttgaaggggggaaaatgccatttcagtttctgttttgtccagtgtatttatttatatactgattatgcagtggcattggcattgtgaatgctattgaagttgcacacgcatttcctgaggaagatgggctccaaaagttcagggagtgggttgaatcaccagatccaactttactgggaaaacttggtatggaaagtggtagcagctcaaagaaaaaaaagtctggcagaaatcattcagacggaaagggaaacagccttgagcctgaatacgctaaaggttctgatgacagccaatcttctaatgagacccaacgcatcaaggaaatatttatgagtaagcatgtaagtatgttgtctttatagactgaattgtcaattgctgtaattgcatggtgattatagatactgctttactaatatttcttttgcacttgttatcatttatttatcagaggaatgtgagcaagaactggcatattccttctacttttcctagtgaagcagtcataaacgcatatatttccccacaagttgatgattcaacagaaccattttcctggggaagaccagattcaggcttactgcgcaagtaagctttcttgaataaccttatgttctcatggatgcgagcaaacaataaaagataccgttcatttcatttccctgcacttttttgtattgaatcagtttttaagagcagcaatgtttttcttgctggaaagtggtggacaatgtagtccaacatattggcagtggcattaaccgctcaaaaacctaaaatatatccgatatgccagcaccagcttgtttctggtaggtgttcagactggtaccgtggagcgcaaaaccctagacaagttttaccagaaagcagagtgttctgttacttttagctgcctgatatgttataatcaatttgtttttatgatgtggaatgtgctttttagctccttatcattaccttgacaatttgttctgatctttttcttcacaagttagttctgtttcaaaactaaggattatgattatgaaaaaacacacatgctctatttcttttctttggcgcaacaacagaagatctaatgttgagttccttcaggttatgttgggaaaggtttgggtggagcaaggaaaaggctgatgaactgctaattcctgttttgagagagtataataagcacgaggttagtctctggaagactgtaactattatttatcctattatagaatggtttgatgtgataatatgtttatggataccattgaattctgttccctaaaaaaatgagttactagtaagttagttttacggtttgagaacatcaattgttaagatgtcagcatttcacctctattttacattttttttggatcggctggtgctggtttgccatgttctgcaacatttgcattttaggcatctgtaaaaagcaagtttttgacaattcgtttcattgtctttaagttattttcatttaggaaatcgctgccttttgaaaatagaataggcatgcttttctgcttggatttcatttaactaagagtgatttaaccggaatgtcagcaatccaaagtctgcaaaattgggttatttaaattttacagtttcatgtgtcacacacatgcagactcaactacgcatggaggcgttttactcattcaatgagagatttgcaaaaattcgtagcaaaaggattaagaaagctatcaagggtattacagggaaaagctttctagagacagatgaacttgatcatgatagtcccagtactagtaataccagcaagaagaaagagagaacctcctctggtcgtggtagggctaaagggcaaagaaccaaagatgttgggcctggtaacacaggaaatcaggactatgacattgctgatagcttagtagatgcaggtgaacatactacagaaaaaagcacgtccagtaagaaaagaactgcaaactcctctggtggttcaagaggcaaaggaagaagaagcatgaatgctgcacatgtgataattggaaatggggaagattctgatgtctctaatttagcatctgatgaggattcccatattagacataccaacgactatgaatcagagggattgacattacgcagggtaagtactccttatggttttctgcacttcttattgtatggttctttctcatgttctctttgatgctgttattgaaggtctccgtactgtaatattgcccactaatttgatgtgatctaaacctttctggcctagaaaattagcttccatttattgctagctgtttagcatatgcttgtagtcctcaaaatatcacacatgcttgtctttgagaatcaattcttttttgaagtaaagaatcagaattgtttatgcatttcttctgatctgcacatgaagagcagtaatatttgcactggagagtaacattattatttttttcatgctgatgttgtttctgcagtcaaataggaagcgtaagcaggtcacatacgcggaagatggtcaggaagctgatgataatgatgtttccatacatcaaatcgatgaaaatcagggccaaggttctttggaggaggacatgtgtcacatggctggacttgacacacaatctaatctgctccatcaggatacgagtgaattaaacatcgatcaaacgcatacagatccctctgatatgaacgaagatccttcgggctttgagttacccgaggattgccatacggacactgcaccaaaagactatctcttcaccggtggtggattctgcatggaagagggtgacgagcaagatacgggagtggatcaatctggtgcagaaatggagcatgaaacacgtgatgcctgtgagggtattgacgaggtttctgaaagtcaaagcggtaaaagcatgagctattcggcgactggagagggcacagagaatgcaaatacagaggcccgaggggcgtcttcatcgcagggacgcaatgcaagccgtggttcaggtgccgtgccgaagcttacaaagcgtaggagaaaatcatgactcatttgcagcagatcatgcctcgcacatcatgccgttttgttcaactgggcaaggtcacgtttcgatttgttcggcagccaatgagttgcgggcttgcggcgttgtcgtctgtaggccaagtctgaagactgaacaaaatgcaggtcggcattctgcacaccgttttcaggctttttcaggtttctgtccattgtttttctaggacagttatcgtatatcggtgtaaactgattgaagtgaacatttaaacctgacgtgattccttgcatcaggatgtatgtgtaacgcaggcttaccaacaaaagcaatgcacccgatgaaaatactgataaaattgaaatacacccaaaaaaactgacaattgttctctatctgaatatgtttattttttcatcaataagttcgattatacagtaatactatttgtttgtttttttaataaatgatgttgttgacttttaaaataacgtatggccgttcatcctattaaaaaattagtgcaaacatgctaagtataactcacatttaaagttttttaatgatacaataagtcaaaataaaataaataactttgatataaattgtttgaataaaactaatggtgaaacattatactattaaaaattaacggtatcatctattattaaaaaaaacggagcgagtacgtcagaataaaaattaaagtgcactactgtcgcgtggatcccgggcccggcccactggcccagtcaactaatcctcccgctccgctgccttcgcgggccgtccccttccactccgacgagctcccgtaaaccaactcgacggtcgccaccgtcgccgttgccgtcgtgtctcaggccctcgagggttcgtcagtctagtactgtgtgagcggtgaggtggcggcggctggtggatctcacgggagcctgaggtatggtgcttggcgctcgcctcctcctgggcctcgccctcctcgccgcgctgctcgccgtcgtcctccagctctaccgcctcaggaagccggtgcgttctctacttctacttctcccgaaattttccactggcttacctgtgagtttgaggttagatattgcgtgttttttgttatctaatgtgtggaagctgcctttgtgcttgcaactgatccggaattctggatccgaaatcgcccgcaaaatcagctggttgctagttgctattagtactagatgttcccagttgcaacttcgcagatttctggtgaaattaatgatatgccccgtaaggctgtaactgtatggtgtatgctggactttactgctgctacatatttagatttactactaccttcgtcccaaaatataataattttttactatgaatctggacacacagttatccagattcatagctaaaaatgcttatattttaggacggaaggagtatctgttttaggcttttggctatgttccttttgatattgtgaatagtaaaatttgatcgtatagtgagcactattttctcttcttcctgtgttatactcggcagaggttgtggaccaaggaagagttagcagtgtacaatggaacggacgagagcttgcccatactacttgggattttggggtattcacacttatctcacgtatgcctgcaattctattaacacaaattatactagtattgtagtggcttcaagtggcaatccatgatgcgaagtttgtcctctgttgtttgtggattgtaatacctatatccatatcatagaaacttattgtgttcagttgtaaatgcaaattcttataagcccgttcgctgtttttaagttttgttatgcattatggattcacttagttgttctctgttgtattttccattccactgcatggactatttacaaacttatttttcccttttgtttgataatgcagctcggtgtttgatgtcacaaaagggaagtcgaattatggtcctggaggtggttatcatcacttcgctggcaggttattatctttcaaggcctttggaattctcacaaggagcaatgcaatagcaatgctttaggataattctcaaaaggagttaacatttactagcagtattaagccttgttaggataattccagagaacttatctcatcttgctgatactaaaacagcatttccataacagggatgcatcacgtgcatttgtttctgggaattttacaggtaaatctgctatcttattgcttttggcttgcatagtaataggtttacatagttgatgttcatttacattacccacaagccacactctatatcattatgatatccactgtttattgcacagtattaggaataaattacactggctgtgttgatcattttagctaaatttaggacacctagatctttatcgaattataaatgtttactgcagacatcataaaacattgcttcctagcaaagcatcaacaacatacatctacatatgaaaacagaagtaggtagcacatgggtattgggtacatttaagattgatttgtgtcgaagctgtaaatggggcttggatacataaaatgcagttggtcaggtgcgatgaagagtaggatacataactttgactggtttattttcattgttgaagttcttggaagctcgccaaatttcaatttctgccagaaattgatgtaataggatctgcatccacatctttcccttcaagtatgttcataattttattgagggtagtcgagatgtgaagtcgtcatggctatagaagttcatatggacttacattagaatatcctcttttttctaattcaacaggtgatggtttgacagattctttacagggcttatctagcatggaggtacgacaagagaacacagttctcatagtttatttatatttataagtcttgtagaatctataagaaaaattgtaaagtttacagctagatggtcaagaataaattgttgagagaagaccatacataaaaggcgcaagcataggaatattgtgaatttcaattagtttggtctcttgctcctcgtaccagctaccaacatttttataatttggaagttcatatagtaactaaatcttcatcttatgtagtcatgtcactagtgtgcctagcttgcatcacgatctgtagaaaatgtttacattgatatagtgatcagcataacactgtaaacagttgaagaggtcattagcatattgatctcatgtatatttaaataactaatggaaaccttaaacttactacctccatcccataatataagtgggacggtgggagtagtaaactgaagataacacatcttgtagttatgagccacttctgcagcttatatttgaacatatgttggaggttgctctgttatgagccacttctgtagcttaaaagcccaatctttttttttcctgtttccttgttgctgaatttttcataatcagtattatgcctgtgtgttctctaaaaaaggtattattggttttgtaacttcctttcaggtaaacagcattgttgactggagaaaattttacttcgagagatacatgtgagctgctttttcttcattgatttgtcaagttacttccatttcatttgattacttgtcaatatgaggacttcatgtaggacatcttcatgctcttgaatcttgatgttatttctcctgatgtgatctctctatcctgatgaatgctttaaatttcccgtgtttttaaatcatgtttatgtggtattcttcatgttagagcgcaaggtcctatatgctatgtgaaactcgctaaagttatcatgcaaattgtggatcgtgtaaaagaaaaccttgctagatgatgtgtcttaccataatatttctgtgaacctgtaatgcagattcgctggtaaaatcgttggacgctactacgacgatgaaggcaaccctacaaaatatctcaagggtatagagatgaaggcaaagagaggtgctcagcttcttgagaaacagaagagtgaagaagctaaaatacccaactgtaattcgaaatggagccagcaagagggtggtgaagtaagtaccctcatatcgattttcaactgctgctgttttcagtttgattttttattagaacatctcatgaaaaaattaataatgaaattaaacctcgcattaccaattgtcagattcacacatgaaaattgaactgaattgtgattttccctaatttgacacacaaaaatcatgtaagttgcactgttggccattgggagtatgctcacagttctccatacagccattcgcccattggcagggcagtagtgcactgttttgtactaggatttatcattcttctagtgcactagtcttctcaagcccatttttggactggttactaatgggtctttgcaatctcgatgagcattagcaaggattatgctctatccccagaattcaaccctgctaattactgatgttcaacaaagctggcaagtggcaacaaaataaatcatggagaaatgtgttgtagccagaagaaaagcaaatgaagcaacgctattagggcctgtttagttcacgaaaagaaaatttttaggtgtcacatcggatgtttgactggatgtcggaaggggttttcggatacgaatgaaaaaactaatttcataactcgcctggaaaccgcgagacgaatcttttgagcctaattaatccatcattagcacatgtgggttattgtagcacttatggctaatcatggactaattaggcttaaaagattcgtctcgcgatttcctccctaactgtgcaattaatttttgtttttatctatatttaatgcttcatacatgtgtgcaaagattcgatatgatgttttttggaaattttcgcgaattaaacagggccttaatgaaagtccggaatggagtaactattttctcttgagcaaagcaataatgtagcactaacttgatgcgacttgttgagattgctcgaaaaccagagcctttggggtgctgttttctgatctttcccctgcacttttgtccttgcctacctactgtaggaatcatatctttgatgggtgcttggcagtggtattccagcctctgagatagcatcatagcagtatatactctctatacctaaggactacggctttcctgggggtgtgctatgcccgtaaggccttaaatttgttgatgcttgacatccatagatcgagttgaactaatatttgtctattttgttagtacttcttaaaaaaaaagagagtatattttatggttactcctcgttctagagactgaagtctgaactctagacaaagcattttggcttaacaaatttgcctaatgtgaaaccttctttaaaactctgctatgtgttaggtttggtgcgaaacaggctatccaagattagtcagaagaccaggtgacatagctctgacggggcaagttagccagcggtgtgcctgttacaaggaggaggagttggacaaggctggcctggttgtgtacgaagggtgtgattatttgtctacatcttgcaaagtgagttaggatatgtacatctccttctcttgcccatgtagttgtctacggctgcccactgcttatctgcaaggctgctaatggtaatcatacacgaaaagc

SEQ ID NO: 86461 - DNA, 1946 bp, Oryza sativa
tacaattgatgttcccgcaactttcccaacaccagacgaatggtgctgatggctttcctctgatggtgagtatatcagaatgtcatcaatgaaaaccaccacaaacttatccaagtattccatgaacactttgttcattaagttcatgaagaaggcaggtgcattggttaaaccgaacgacatcactgtgaattcatacagtccgtatcgcgtggtgaatgcggtcttaggaatgtcttcttcacgaatacgtaattggtgatatccggaacgaagatcaatcttggagaatacagtggcacctttaagctgatcgaacatatcatcgatacggggaagagggtacttgtttttgatggtgacttcattgagagctctgtagtcaacgcacatcctcttcatcttgtctttcttctccacaaaaatcacaggagcaccccagggggaactactcgaacgtatataccccttttatttcaactcttccaactgtttcttgacttcggccagttcatttgctgccatacggtagggtcgcttgtacaaaggagtggttcctggagcaagatctatccggaactcaatctctcgcttgggcggcataccgggtagttcttccggaaacacgtctccgaactctctgacgatggggatttctgacagtcctatctgatgaagttctgaactactgacagaggttgggggtgcaaagaaaacaaccggttgttccggccctcggtacagagtgacagtgcgtctcgcgcaatccactactccttggaattgagccaaccaattcatcctaaggatcacatccaagttcttggtgtctagaagaatcagatccgagggaaaaggaatcccctgaatttctatagggacggcatggctatagtactttgctgtcataacccctccaggggtggtgattagcagagggtttctaagcctttctacccccaactgatttccccacaatggcacaaatataaacgagtgggaagctccagagtcgaacaaaatggtagcagggatggaatggatgaggaacgtaccaacgatgacgtctggagttgtcagcacgtcctcggccgtcacgtggttcacacgacctcgtatgacgtccttcccaccgttgttggagcgggaaggcgctgggccttgctgacgcctcggctttgggcattaatccacaaagtgcccagcctcgaagcagttgaagcacaaacgctgttggccttgagcgtccttgcggccttgaccaggctgcacagttggcgtaggaggacggggcgcacgagtccctggttgattctgctgctgctgcggctgtgggacgcgcaccacaaattgaggtcggggcgcggagcgaggttgctgctgctgttgttgctgctgcgaggaggatccccctggatagggattggtgtagcggaccctttggttagcaccctgttgattgcggaaattcgccaagcggcgcttgtgcgactccagttccttgtgcttggcttccaagcggatgctcttgtccatcagacgttggaaatccggatagtccccggagactaggcgcacggacagctcagggtccattcctgccaagaacttctcatgcttttcctcatcttcccgtacatcctccggggcgtaccgggccaggttgttcaactcatgcaaatactccatcacagagcggttgccttgcttcaactctcggaattcccttttcttaagggccacgactccggcgggacatgggtcctccgaaaagcggcggtgaagcgggctcaagtaataggctgccgctctggctgtgtagcctggaaatggtcccaccataaagatgcgggcccctgcagctggtgggcggcgaagatgactttctcctcatcgctgcactgcacagtgtctagctttttccccacggcatgcaaccaatccaa

SEQ ID NO: 86462 - DNA, 1437 bp, Oryza sativa
  unsure (1)..(1437): unsure at all n locations
aagttgctaaatttttctaaaatcaagatctacatgttaaaaatattcacatgtactgtttatgcttgttttttactgttttgttgatttttattctttcgctttagtttccgacgttccggaggagagcgttttcgttgagcaaggttcggaagtgtttgcggaagctcaaggcaagtcacacagatcccaaataaccctttgagcatgttgaacccgtttaaagctattattttatttcaactatgcattattttttaatgtcatcgggtggtgagcctttccccgttaattaatggccgaagatgatcttattttcctatgggttataatttgattagcatgaaccttatatattggtttggttcagctaaatgctatatgtatgtttgcttagccatgcttagaaacattagctaattaaaggggattaaatataaattatattatattattcttattaattatggttatatttaatggtagctcacgatgataattaaaacctggttaaggtgggttgtgagcatatggttttgatggttgtgctcatggtaattaaggaccggttcgcgagctactgttgtgaaacatttaccgtgccaaccacaagccagcatgggcaacggctttaccttttgtatagcatggttcattatagtgtgccagactgtgaagcggcgagaagtccgtgggggtcgctggggagtccatttgcctctggttttgagggggagattatgatccaggaacggtgcactgttttgagttgtgttgtgcaaagagtattgtcacgatttccccctttgcaatgccgtggtggtatttcggngcatggcaacatgtgtggaatcgtgtcttgtgggtacagtggtacacctctggccagagtaaaactattcgaatagccgtgcccgcggttatgggcgagttgagcaatgtttttcgtgattagtctcacatctctcacaataattatggatgttatacctggtaataatttgcttagctcctggtttggagttaaatctgtacagccgggtatggttgttcaggatggttgggcctgtgcagcatgggtgtgctgttcagtgttgattaaaatttctgattaattacttcactgttttacttctcttaaatgttttgctaaatgctgcttttgcaaatgagcctatattatgccctcctttggtatccttgtgcacttgcatatttgctgtgtggcttgttgagtatgtcatatgctcattcttgcaataatcaatcaacctcagttgaagacaagttgcgaaggagaagatgtttggcttataccccagttgagctgcctgtgggagtggagccggagcttcggtagattttattttccactgcagtttttttcatggtgaggactaagtgcctcttaagtaagtatttatcgttttagttaat

SEQ ID NO: 86463 - DNA, 1370 bp, Oryza sativa
aaagagtgtttcggtccactgagaaccatgcgatcaaatcttagtatgctgtcccttttgagataagcaagagcgcatccttagggttatatgcatgcttaaaataacatgtgattttactactataatacagagttccgtaaattgcaacatcagaggttgactatgggggaaataactctgatgtcttcttgaactatgcagacagatagggcagctatgctagatgagatccttgattatgtgaaattcctgaggctgcaagtaaaggtttggttcactatgctattatctagtaagcataaaccacattttgtgtttttagttgtttgatagagcatgattctatggtggtaggttttaagcatgagcaggctgggtggcgcgggtgctgttgcacagctggttgctgatattccactttcagttaaggtaaatctgtggccattaactaatatatagcactgtgcccagttactttctctcgacttagtttttactgccattcttaatatacttccttcggtcaaaattatttgacgttggctatgtggtttatttgttagttcaaggttttcttctctcttgtataaaagcaatacatcaagcatatcatcctcataactatgtatagtaaaattgtgaactaattgctctctgcagtgcctatttttcattcttttaaattatatgctacttgttcttgcccattctctctctcccttctcctcctcttgctcctccctcctctctctgtgtgtgactgcagagaaattgatggatgtttgctacatgggaaagcatcagcctgtacttaaatcagatctccatacaaaataaaagcacctttgtctttgtttcatactgacaattactctgtatttccactttattcaaacaaaatatgaatcagttttcccttgcaagaatcattctacttctgattcctctatttttctctcgtgaagtttttcacttctttcttctagacagtggtgctgaaaggcagttcccactcaccacattattttcactgctggccttttattgatttcttgatctaattgtctatgtcagtgcaatccatttgtacttttgctatcagtgacagtgattgtagcttttcctgtctcttcttgaacataaaacttctatgtctatagtttaacaataatgaatagtgttaaagtcttagcaagatgaagatatgacacatttctaccatatgacaacatgtcttgtagatcccacattaaaatctctctcatctctagtttcctgatgagcacagtgtctccattaggcttttgcttgcttcagagcccaattacaaagacttgtatacttcctgatccccatcgatcgctcca

SEQ ID NO: 86464 - DNA, 665 bp, Oryza sativa
aaaagagattgatttgttcttcgatttaggtttctagaaccttagtgtcttgactttgatacggtactctcaagagtcagcattgctaacctactcctttttattttgacccattcaaggacgacattgtttctggaattgaaaagcgtgtagctgcttggacatttcttcctgaaggtaatttcgcgcgactttatctagtttgtcttttggagtttggagctagattaccattctctggctggtctctttcttgatcagaaaacgccgagtcaattcagattctgcattatgagcttggtcagaagtatgatgcccacttcgattatttccatgacaagaacaaccttaagcgtgggggtcatcgagtcgccactgtgcttatgtacttgaccgatgtcaaaaagggtggagagactgtatttccaaatgctgcggtatgcaattagctttgacattacccccttgtaatttcccaagacatctagtttagaagttctttgccattgcttgcagggaaggcatttacaactcaaggatgaaacttggtctgattgtgcaagatctggcctggcaggtagccttcaccccctatacatttctgaacgaaatggacaatatgaattgcctttctgcacaaagttaattaacctcagtagtaggaa

SEQ ID NO: 86465 - DNA, 1824 bp, Oryza sativa
acatgtgggtcctgagtattttattattttttcggctcgaattgccacataagcgccacgtcaatgccacgtcagatgaagaccgagttaaattagccacgtaggcgccacgtcagccaaaactgccctcaaaaccgccgagggacctaatctgcactggttttgatagttgagggactcgttgtgtctagttttccgggttgagggatgaaaattggattcgttgacaagttaagggacctcaaatgaacatattcctttagcgggcgatgaaccgaacggatgccgttccccttcctgcgggagactgagctgtctgaggttgaaaaacgaacatttccactgtctctataaggatgaagctatgaacacaaatacctatcttaaacaatgaaacttaaaaaataacctgtcttggattgaacaatgatgctatgaacacaacatagaaaacaacctatcttgaactgaacgatgtagctatgagcacaaaatagaagaaaaaaaaagagagagaaattgctttcgttgagagtcgaactcaagacctcccgcttactaaacgggtgctctaccaaactgagctacgaaagctctttgttgcttgtctttcgtagctcaaaatctctgagtttctttcgagtttatttacttctcttgattgtatagacgtcaattgcttaatgtgtgctacgcacaagcatcttggttgctcatttgcttcagagctcaattgcttcatgcttgtcaacaacaggttgaagcttgaggcatgaagcagttgagttctatcccatttccataagagaatgatagagaagatgcttatgaaatgggaaatgatagagcagtatccatgttggaatgaatttacgcagagaagaataaatacagaagcatcggtcctgcattgtctagatgcaagcaatttactaacaaaaggtgcattctgaaccacaatattttgttcaaaatgccatactgagtcgacaacagtacaatgatatcgaaaaaaacatggtaatgcacctttaccctggcacaaaataacaaatgatggaccaaggtacaaaagcatggtaccaggtatttaggttatgatacaaagtttgcttatttatcagctagttgagtaaaacagggaaatgctgaatccttatcatgagtaacaaaaatcaacggtaaagactctcggactccaagtttgcagcaatctcagtctcccaacgatcgccgttctcaagcaatttttccttgtcgtatagcagttcctgtcattgcagaaaaaagatgcatgtatgatatcccagcaatatgtcaaaaagaatctgcagcagaatcaagtgttttacctcatgggtttcagtagcaaactcaaagttaggaccctcaacgatggcatcaacaggacaagcttcttggcagaagccacaatagatgcatttggtcatatcaatatcatatctgcaaaaaggagttcatcacaacagagcttaacagcagatgaagaggcagtaaatcatttttcaataattcacacggatcaaagaaagccagccacgggattaccttgtagttctacgactaccgtcttcacgttcttctgcctcaattgtgattgcctgagctgggcatatctggtcatttgtaatgccaagtgagcaaaagagattggtttacagaacgcataaaacgcaacaataactacccttaatcagcatgagaatcatcaagccttcaagttaaacatgcattgctttacataagtaaagctgattaccttaagctttacaagttgactcctctaacattccaaacaaacca

SEQ ID NO: 86466 - DNA, 4653 bp, Oryza sativa
ggcggttgattgggaaggctaccattccggtggatctcaagggcgccgaggcgaaggccgcggtggtgcatagcggctggatctgtgttgggaagaagagcggcggcaagggcggctccgcggcggcggagctcagcctcaccgtgcgcgcggagcccgatccgaggttcgtgttcgagttcgacggcgagccggagtgcagcccgcaggtgctgcaggtgaggggaagcatgaagcagccgatgttcacctgcaagttcgggtgccgcagcaaaagcgacttgcggagatcggtggttcagacggagcgggacgccgccgccgccgccgggaaggagcggaaggggtggtcggtgacggtgcacgacctgtcggggtcccccgtggcgctggcgtcgatggtgacgccgttcgtggcgtcgccggggacggaccgggtgagccgctccaacccgggcgcgtggctcatcctccgccccgccggcgacgggtcgtgggagccatggggccgcctcgagtgctggcgagagcgcggcggcgcgggcgcctccaacagcctcggctaccgcttcgacctcctcctcccgggcgtcgaccacgccgtccccttggcggagtcctccatcgccgcttccaagggcggcaagttcgccatcgacctcacctcgatgcagccccagagccggggcggcacgccggggtgcagcccgcggggcagcggcgacttcagccagtggccgctcgccagctacagctaccgcggcttcgtgatgtcctcctccgtccagggcgaggggcggtgcagcaagcccacggtggaggtcggcgtcccgcacgtcggctgcgccgaggacgcggccgcgttcgtggcgctcgccgccgcggtcgacctcagcatggacgcgtgcaggctgttctcccacaagctcaggaaggagctctcccacctgcgctccgacgtgctcaggtgaccaccgctcgccgccggtgagcttcccgcggctcacgagcaaaattgtacataagtagttgagactcttttgacacgagatgttctttagttggttcgttggtgtgttagtgttagtagtggtagttcagttttggtgatcagttggttgagttttagatagatctctctctctctcttttatcccctgcgagtgtgcttgtgttcttttggattggctactttacttcaagccaatctcggtaacttcctttcagatgtctataattgggagaaatttgtgaccatatgaacctgtttcttccagaactagaaaatcgaaagctcttgcggttccgattctgatcgtgacatggaatcgacgagctcctccccatatgttacacaaacccaaaagcttcattttagagttcgtttcaggtgacaccgtacggccttcgacattgcttttgcaaagcggcatgagcgggggagtacgccttccctcccaaaataagtcgattaaaattcatttatatatcttatttattttttttataattagtatttttattattgttagatgataaattttatgtatgaattatttttaatttttttataatttttttaaaaaataaaattaacggtcaaatatagtaaacagaaacaagtactccagtcaggggtagatcatcggctcaaccgctcccgctgaagcagtggatcggtcaagcaagctgcggcaaaaagagaagagaaaaagaaaaggaaaaagtttcctttgccctgatgagttgagtgagaacatgaaggagcaggcagcagctggatgtcagtggtggtggagtggagtacgggcgatccgtctcgctgccgctggcagtagtggctctgctgctgctgctgctgctgctacgagtggtgccagtgtggaccgtggcgtaggagtagtactagtgctacgagtggtggatggtttgttgggattggcgactagggccatgcacatttcccgttggttgtctgctgccatggagctgtggctgggtccggctccggtggggaaaaaaggaatccaacgcaaccacctcccctgtgcccacaccaccagcacagctacagctctctcctttttcttcatcatgttttctcactaatttttcctagtatttgaacacacgctggcgcgcagtatgcatttcgcagccggtgtggctttctgatccgttaattaagccggttgcccatgcttgtctcggatcgctcatcgtccctccatgcgagacgtccggtgattgctaatctagagctggatggacagctacggccagatggatggatatggggtctcgtccagtccagcgtggtgctgttgtgttcgatttgatcgattgatcgcggagaaaacgatgcgtgcggcggacaaggcggcgggcgatgcgcgggctgaaatggctgccacgacgactgagcgcgagaaattagtaagaaaatttgttcaaacaggtgttctcattatctgaaaaaacaaacaggtgttctcatccgcttcagaaacacatccaaatcatgccagctcaagctttcctggctgtgatttgtactgtacaattgtcaattgtagctaacgaatgaggaaagcttgtgtgtattagctagacaagtagacaggtatccatgaggaaaaagaaaaggcagcagacgattagaggatttcccacagagattggtctactagagtttacaagtaaatcacatgttagtaactaacaagacctggctcgttagttttccatccgcactgttctttttcaactaaatggatgagcaaattaacgagactcgcttttcaaatttctaaacaatattatttttataaaaactttatggacatgattattttaagaaataaattcatttttttaaaccaaagccatgctaagttgaagttatattaagaaaaatagaaagtatttacaatatcaccaaagaaagtgaaagagagaaacaagggaaactagggaagaaaacataaaagaaacacacactaaatgaaacctaagcggatattctcgtgatgttttttttctccacacatgctctatagcttgatttcattttgtattttggcgaatagttgcgacatgattttctcttgattttggaacaccttcatgtttcgttcacaccatattttccataccaccaataagtggattgacttgagtgctttagccttgtatttttcctccttgagatgttcttctgatccaccatttcaacaatacttcattttcatcatgtgggtggtctatttcgctgcagttcagtctactcatgaccctatctcagatctgacacacaaaagtgtcaatctttaaaaagatgttaggcggtttctaggtttctgtagcatagttgacagaaacagttgtttggtcattgtctgatctgtagcatgtccgttgtccgaatcctattctgcagtagacgttcaactttagttaaatcatttttaactttatattagttataattcattcgtttgtgaccttcaataaacgttcgcgcgtttcatattgcagcgtcggatcacccgtggctttcgatcgagcctggctagctagctagcaatgttaatttgctcttaattggcacacacacataaatgcttaatttgcaagttgcatggttcctaaaactcgtatagacactactagaaaaactcttttcccagtcggccgaatcatattttcacagacggacaagccatccgcctgcacctcaacgcctgcaaaaatagttgattttcgcaggcgcgcgccaggtccgcctgcgaaaatagcttcgagcgctaaaaaaaaattgggcagtcacccctgtttctggcggtagcttcccgttctcaatccagttcacaccccttccccatccaatccattcaattcatccagttcatccaaaaaaaaacaccgaatcaatttatccacagttcattcaaaatcactgaatcaattctaaaagaaagcgaaataaaaacattcaacaaatcacggcggctgcccagctttggtccgccaccgccgaacagcgggggcccgcggtggtctgcgccgccgccgcacggccacggaccgctgtcgtcaacgcgggcggctgggaaccgccgccgccgcctcaactgccctcgccgccgtggccgtgccgccgcctcgaccctcctcactgccaccacccgccgccgtgctccccccgcccccctctggccagatccgacggccaccgctctccccccgccccctccggccagatctgggagggaggcgccgggagcgcgccgccgccgccctccgccgtcgggaggggaggggagaggagaggtgaggtggggataggaggagaggtgaatgagagaggtgaagggataagcttaccggccgtgagtggtgaaggtgtggagacttagaaaaaatctcctcctatcccaagtctatttatattcaagtctattttcgcaggcggaccatttaagcggcgcctgtgaaaatcaatttcaccttgattttcgtaggtggacatcaaatttcacttcgatttatatttttgtaggcggtcatttagctctaagggtcatgtccgcctgtaaaaataagactcccacgttggaaaaaatgctttttctagtagtaatctagcctata

SEQ ID NO: 86467 - DNA, 1036 bp, Oryza sativa
tttgacataaacttcctcctgtataaaaccatttagaaaagcacttttcacatccatttgatacaatttaaaaccttttgaagcagcaaaagccaacaaaagtctaattgcctcaattctagcaataagagcaaaagtttcatcaaaatccaaaccctcaacttgagtaaaaccttgagcaacaagtctagctttatttctcacaatcaaaccatcctcattttgtttatttttgaaaacccacttggttccaataatattatgtccagaaggtggttcaactaaagtccaaactttgtttctctcaaaattttcaagttcttcatgcatggcgttaatccacgattcatcagttaatgcatgtgacacatctttgggttcaaaagaagcaacacatgcagaattttcacaaacatcgtgagtcgttaccttagaccttgtagtccactcacctatattaccaatgatttgttccggcggatgtcgtcgttgaaagtgcaaaggagcagcgacttctgaagttgagccacgttctgtatcagtattggtcgaagttgtaatctccggaggaccatctcgatcagcatcaacaataccggaacccgacgaacctggccggtctgaccgctcctcctgtggcggtctgaccggaggtgtgccggcggtctgaccggcctggcgcccggtctgaccggccgagccgacttcgttgttgtagtcgtcgtcgctctcgtcttcaaaactacgaccatcctccccctgaacctgtgacagtgtacctgaaatatcgggtctagtacctggactagtctcatcaaaaaaaactttgcaagtctcaacgattttgttagtctccaaaataagtacaagataaccacaagtgtgtgcggggtaaccaagaaacaatccatcggtagaatgtgcctcaaacttatccaaatttctagatttcaagataaagcacttgcaaccaaaaacacgcaaatgtgaaactttgggttgatgtccaaatcgaagttcataagaagtttttcca

SEQ ID NO: 86468 - DNA, 1154 bp, Oryza sativa
ggcggcgacgaaggcaagccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaaacaccagtcgacggcagcgaaggtgagccaacggtgaggatgtagacgcccaacagcggcggcataataggccagccgtgtaggcggaggcaccactcggcggcgacggaggcaggccggcggtgaagtcgtagacacccaacagcggcggcataataggccagccgtgtaggcggaaacaccactcggcggcgacggaggcaggccggcggtgaagtcgtagacgcccaacagcggcggcataataggccagccgtgtaggcggaaacaccagtcgacggcagcgaaggtgagccaacggtgaggatgacgatgcccatcaacggtggtgtgaccaaccgaccgtataggcggggacaccagtcggcggtgacggaggcaggccggcgtgtagatgacgatgcccatcaacggtggtgtgaccaaccgaccgtataggcggggacaccagtcggcggcgacggaggcaggccggtggtgaagtcgtagacgcccaacggcggcggcataataggccagccgtgcagcgaaaacaccagtcggcggcggcgaaggccagccggtcggtgaagacatggacgcccatgaacggtggtgtgaccgaccaaccgtataggcgatgacaccggtcggcggcgacggaagcaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaa

SEQ ID NO: 86469 - DNA, 7303 bp, Oryza sativa
gacgccccccagccgagcaggcggaaacaccagtcggcggcggcgaaggcgagccggtcggtgaagacgtaggcgcccaacagcggcggcataataggccagctgtgcaggcggaagcaccaatcggcagcggcgaaggcaagccggtcggtgaagacgtagacgcccaacaacggcggcataaaggccagccgtgcaggcgaggacaccagtcggcggcggcaaaggcgagccggtcggtgaagacgtaggcgcccaacagcggcggcataataggccagccgtgcaggcgtggacaccagtcggcggcgacgaaggcgagccggtcggtgaagacgtaggcgcccaacagcggcggcataataggccagccgtgcaggcgtggacaccagtcggcggcgaagtaggcgagccggtcggtgaagacgtaggcgcccaacaacggcggcataataggccagccgtgcaggcgaggacaccagtcggcggcggcaaaggcgagccggtcggtgaagacgtaggcgcccaacagcggcggcataataggccaaccgtgcaggcgagaacaccagtcggcggcggacgaggcggccggtggtgatgttctgactgatccattcctagagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactcattacgtttaaacgctctgcccaactagtcatagccaccaagcactgggagtcggcctaagcacttcccaaacatgcatatgagtgacatgagttcttcattaatggaacaaagtttcacggatcggagtttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagatgaatattataaaaaatatgatataacatctgtagcccccgactcactactcaatggaagaccaattggtgtagtgaggcagaggaaaaggaaaaatatcatataaagaataaaataaatgacgacttagctttgtaatattccccttggtgatggcagaagtagccaatgtgggaacgaagcagtccatcaatggtgacaaaaacaccagtcggcgccagtggaaccaagccagtggtgtagatgatgaagcccattaacagcggcgaagtccgtcaaccgtataggcaaaaacaccagtcggcagcggcgaaggccagccggtcggcgaagacgtggacgcccaacaacggcggcatgataggccagccgtgcaggcgaggacaccagtcggcggcgacgaaggcaagccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggagacaccagtcgacggcgacgaaggcaagccggcggtgaagtcgtagacgcccaacagcggcggcataataggccagccgtgtaggcggaagcaccactcggcggcgacggaggcaggccggcggtgaagtcgtagacgcccaacagcggcggcataataggccagccgtgtaggcggaaacaccagtcgacggtagcgaaggtgagccaacggtgaggatgtagacgcccaacagcggcggcataataggccagccgtgtaggcggaggcaccactcgacggcgacggaggcaggccggcggtgaagtcgtagacgcccaacagcggcggcataataggccagccgtgtaggcggaaacaccagtcggcggcgacggaggcaggccggcggtgaagtcgtagacgcccaacagcggcggcataataggccagccgtgtaggcggaaacaccagtcgacggcagcgaaggtgagccaacggtgaggatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcgaggacaccagtcggcggcgacggaggcaggccggcggtgtagatgacgatgcccatcaacggtggtgtgaccaaccgaccgtataggcgaggacaccagtcggcggcgacggaggcaggccggtggtgaagtcgtagacgcccaacggcggcggcataataggccagccgtgcaggcggaaacaccagtcggcggcggcgaaggccagccggtcggtgaagacatggacgcccatgaacggtggtgtgaccgaccaaccgtataggcgatgacaccggtcggcggcgacggaagcaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagctcaaggttaggaatctgtacttcacccatatgtaaacatagcaaaaaaaacatttggtttgagagatcagcgcacattgaaattttgaagaagctaagtgtgcaagttaagaggtcattagatgaatatacggaaaaaaattcacatggacaatgaagagcagaaaaacagaggcgcacaacagcatcaaacatgggtagtgcgagtgatagctaggtacaaacatcctgcaattgtaaagatttaatatattagtgcatggtatggcatcctggtaatttagctagggatcatccaggaaaaccagacatcaaagtataccatagatgtgactgcttgcagtacttcttggtaaacaacatttttggttttcgtacaacatgcctcgtcctcatcctctatgagaatcctaagaccttctcttgatgttgatctagaaacagcaacataaagttgcccatgtgtgaacacaggttttttcaagtacacgctgactcgtgaaagggtttgtccttggctcttgttaatcgtcattgcataacaaacacgaacagggaactgtcttctctaaagcgtaaaaggccacttaggacttgtggtggtaagtgcaattcgtggtatgaatgttgtctcgccaatatttgtcccagttaaaattacacactctaacaacctattaccaagagaagtgaccaataaccttgtcccattgcatagacccatagattgatttaggtttcgtagtagcataatcgtcacaccttttttgagcacaagcttgtgcgatgggaagttgttgacattaattgaattcaaaaattcagggggtaaaggatgtcaaagtcaggtaaatgatctcttgattttgaaattgtatcacatattaaatactcctttgcgtcgctgggtatcatgtcaacaatacaatcatttatttcatcaactgttgagttattcgggcaaacaattgcccgacatgcaaggtaagaatgatctgtatagcaatttgcaaagtgtggaaagatctcatctactatagcccttattttgtcaccgcatgtcttgatcaaaaggtcatcagggatatcaatccatgttggctcaaattcgtcaagcttttttgttgcaggcaacctaccgtcaccaagtgctaggacccaatcgccaaagttgctaagatcgacacggttttggtcagtaacgttaccatgaagaagtctcatgtttattgtcagtctaagaagaacaacatgccgccaaagaggagagttcgtgatggatgcatcgactatagaagcacgtgaaccttttcttatgaccggcaatatttgacggaaatcacctccaagaacaacaactttaccaccgaacggaacaatgctgttagaaggcgtgtgctcagaaagcaaatcacgtaacgttcgatctaaggcctcaaagcatcgtctatgagtcatgggagcctcatcccagattataagagacgttttctgaatcaaatctgcaagcatagttcctcttttaatggtgcaaatgttgttttcatctatgtcgatcgggattttaaatctagaatgagcagtgcgccctctaggtaggagtagagaggcaacccctgaggaggcaaccgctagaacaatttttttctcggatcttattttagaaatcagtgtattccacaaaaatgttttgcctgtcccaccatggccatagacaaagaataacccaggcctgttttcgttcacccgttgcatgattgtgttgaaaacatttctttgatcagtatttagcctaggtatattcaaattagcttctgcagttagggccgcaacatcaagagcaagttcttcgtcaaccatcctatttcctgtaatgtcatctgaataaattgccggctgcggtaagtcgtaatcatcaatgctaccaccactgtttgaaaacacaatgtgaagttctttcattaatagagacaggagcctatcaggaggtattacgtacgaaggattcgataaagcagttctgacacgtcgctgaatgtcatcggtaaaatatgtccaatatttttcaaagagcgagcgcacatatccaacagaacaaaacattacaacgggagcaaacaactgtctcaattggcccgaagacgcagatactatagcctcatcaaatagcaagtgccattcgttatcgctttcaagtaggcctcttgcctcgcatgcttgcctaaaggtcggataaacgataccatcataggtcctaacatcagcatagcacgttgcacctttcactatcattaatagcattcgtaggtagtagagctcaccgctaactgggctgacatagtatatcctgcctattttttcacatggtgttctaggacgccaactacgtgagatgctgtcccatgtccactctctcggaaaatcacagtaagtaagcgttcggggactgttatgttttctggtagcctcgaaccactcggttagcatcgtttttttggctacagggctggatagcaaggactttaggtcagaaccttttttgtatcggacaaagttcatgtttggaaggtgcacagctaggcgttctacagaaggcactctgtagtgaatgtcaaattcaaatgcatgccaaagggactcacaggtggacagaaatcttgcatcgatatattcttgtatttcatttcgtggagcagtacagttttcagctggtttgttcggtgcatttccagaaatctcaaagaatgcttttgttctatccgcccctttagtgacatatttgaagagatatttaatcatattagatttattgcaccattctacattaatctgagcctggtattttttcagaagttccatgttgtagggaacaacccatctgttgtcaagtttaataccatttttgagaacataccgaccatcattgctacgtttgtaaacagtgaatacaaattcatccatgatggtctcttcttgaaaagatttagggaaatgcttagagcactctcccttcttcatacaggagcatgttttgttcacatcgccacaagggccatggatcataaattcatcaaccaaggcatagcctaaagggtcggttagcacatcaggtatttcagcggaaataaaaccatcgacaataggagcactaaactcaatatttcctgcagcaagccaaaccaggcaatggatatgaggaaggccacgcttttggaactcaactgtatataacactacatatagggatagccaatgttaggacctatacagaacataaaaatggaacttagaaactaggtaaacatcctactagcaaggactggaccaaatgtctttccttctctaatatctgaaatgaattcattcactttcatgttaaacaccctcacaatcatatcggaacgatcgcttggcacctggcctggctcaaacagcaaagcatcatatatttcttgccactttgagttgcatgtaaaggtcacaaaaagatcaggtgaaccaaaaacccgacaaatagccatcgcatcttggtaattttgaaccatgtaacgacgccctccagtaaaactggagggcagcacatatcattggccgacagaatccccggaatcaagaccatgatcaatcgcatcagctattccctggacagattcagaacgcaggtcgggctggttgtcgaaaatgtacttaagcctagattactcaacagttgagtatgagtcaacacataaggaatcgctaagacgaccacagcaagtatatggatttggtttgttcaatcggtaatgtaaacgatagtggtagtactcaagcatggtaacatagcgtctggaggcaccagtgatgctaggaaagtcagtgtactttatacctagatggaatcctcgttcaccataaggaaagagcaaagggtactgaagagccatataggatgggtgcaaagctgagacacgtcgcaatctagcatcgcaagactaaaccatcacatcatacatgtattcgccagctgagtaatctccagctactataccagcaatatcaccactcgttggcaaattgtactggatttcatctcttgaatcacaaccaagcaatctaagtgcaatcttttgatcaccattatcttttagccgatctctagcaaagcggaatgccttaaccaaatcattatgctcatcaagcatagaactaagcccattaacaatgtctgggtctggttcatcagaaggattgtctttttcgtaaatattcattctgtttgcagtttcattttcagtgtcatatatgtaaagttgtgcaaatttaggtcgtgagccttgctgtggcagcaggctgccaataccttggtggacaaccccattaatcttgaacacaca

SEQ ID NO: 86470 - DNA, 1744 bp, Oryza sativa
  unsure (1)..(1744): unsure at all n locations
ttagatctagcggaaacttttgagaacctccgctccgcccgcataaagctgaaccccgataagtgtgtgtttggtgtacctgcgggcaagcttctcgggttcttggtctctgcccgaggcattgaggccaaccccgagaagattcgagctattgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacggaggaagctgaacatgccctcactcagttaaaggcatatctcagctctcccccagttctagtcgccccggagccaaatgagcccctgctactttacttagcggcgaccccccaagtagttagtgcagcattggttgtggagcgcgatgaagacaatcctcatttcgtgcacccccactctgtgctaacttggcccgggagcgagcggggaggagaggcccccgagtcggacggtggcctacggcccctgacgaccggagccggccctctgcccgcttgtcagacggtgctaggtgcccccgaccctcagaagggccccaaggccactgcgggaaggccgcacttaacgccctttgaccccgaggctaaccctgtgctgactcgaccgggaaagagcagggagaagaggccnccgagccgaacggaggccagaggcccctgacgaccggagttggccctttgcccgcttgtccgacgatgccaggagcccccgacccccaggacggccccgaggccactgagggaaggccgcccctttcatcctccgaccccgaggtcatcggcacagaaaacaagtgcgcccccaaaggccacttgaacgaagaaccccccgggggtacggcccctagtagagaggatcagccccaccgaagggtgcagcggcctgtctactttgttagtgaggccctccgggacgctaagacccgataccctcaggcccagaagatgctttacgctattctgatggcctcgaggaaactgcgccattattttcaggcacatagggtcactgtggttacgtcttaccccctcggtcaaatcttgcataatcgagagggtacaggacgggtggtaaaatgggcaatcgagctttctgagttcgatctgcactttgaaccacgccacgctatcaagagccaggccctcgccgattttgtggcagagtggaccccggctccagagaccgtctcaatccccgaggccagcacgaacccctcgcagctgcctcacaccacccactgggtgatgcagttcgatggttctctgtccctccagggtgccggtgcgggggtcacgttgacctccccgaccggagacgtccttagatatctggtccgcctcgactttcgagcgaccaataatatggcagagtacgagggactccttgccggactcagggtggcagccgggctggggatccgccgcctcctggtgttaggcgactctcagctggttgttaaccaagtctgtaaggagtaccggtgctctgacccgcagatggacgcctacgtgcgccaagtacggcgtatggagcgccattttgacgggatagagcttcggcatgtgcccagacgggataacatgatagccgacgaactctcacggctcgcgtgctcgcgagcccagaccccaccgggcgcctttgaagaaaggcttacccagcc

SEQ ID NO: 86471 - DNA, 634 bp, Oryza sativa
tgccgactggtttcttcacttccatggctgcatgattctgccagtgttgattggccttatcttcttcaccgccggtcgtctcgtctgctgctgactagtgctctcacctctacgtctggtttatacagttaccactactgatggacatcatcgtcttccgttgccgactggttatgccgccgccgactagtgcttttatcttcacaactgcgcgtcttcgctaccagtttgcttctgttgccgccgactcgtgttcacttcatcacggcgatgcaactttgtcatcatggtggagcaacttcatctttattatcttcggcactggcaaactctattgctgctacttcgcaagttttactacttcaccaaccacgacgtctttgtgagcctcgacatctcggcatgcgatgccatgttattttactacaacaagaggctctccaatattcaggatttctacttatatcttcaatcaagcaatgactactcgacgacaagaagctataattctcgactctatgttcagttgtttcccaactaaccaaagagtcgggggctacacaaatataaggctcaaaatttgacaaattttatgtcaagctgaagaaatcaattcatcagccaatgagtcaac

SEQ ID NO: 86472 - DNA, 712 bp, Oryza sativa
gactacagagctctcaatgaagtcaccatcaaaaccaagtaccctcttccccggaatcgatgatctgttcgatcagcttaaaggtgccactgtattctccaagattgatcttcgttccggatatcaccaattacgtattcgtgaagaagatattccgaagacggcattcaccacgcgatacgggctgtatgaattcacggtgatgtcgttcggcttgaccaatgctcctgccttcttcatgaacttaatgaacaaagtgttcatggaatacttggataagttcgttgtggttttcatcgatgacattctgatatactcacaatcagaggaagaccatcagcaccatctccgtctggtgttgggaaagttgcggaaacatcaattgtatgccaagcttagcaagtgtgagttctggttgtccgaagtcaaattcttggggcacgtgatatctgctaaaggagttgctgtggaccccgaaacagtgaccgccgtcaccgattggaagcaacccaagacagtcactcagattcgcagtttcttgggtttggcaggatactaccggaggttcatcgagaacttctccaaaatcgctcgacccatgacacagttgttgaagaaagaagagaagtttgtgtggagcccgcaatgcgagaaggcgttccaaaccctcaaggaaaagctggtttcctcgccagtgttaatcttgccggat

SEQ ID NO: 86473 - DNA, 979 bp, Oryza sativa
ttgcgatctatatattttatcttcgtaaccatttgtaacattctttgaattaatttcatgtattatcttcgttgtagaatatagctacgtagaagtaagcgtagctcaactgattatgttcctatggtgtaaccatcccacctggactcaggtgctagacttaacatgggtagttgggtactcatatttacggctaaattattatctattatattattaaatgaatagaaaaaggagcctctatgttcgctctcatggcctagaaattctcacattaatcagagaaaaagaaaaagcagagtccatatagaaatacaatttagaaatagctaaaattcggaattaaaaaataaggaatattagaagaggagactagagtccatatataaatacaatttagaaataattgaaattcggaattaaaaaataaggaatattagaagaggagactagagtccatatagaaatacaattaggaaataactgaaattcggaattaaaaaataaggaatattagaagaggagaatagagtccatatagaaatgcaattaggaaataactgaaattctaaattaaaaataaagaatattagaagaggagactagagtccatatagaaatgcaattaggaaataactgaaattcgaaattaaaaataaggaatattagaattggagtatagagtccatatagaaatacaattaggaaataataaaaatttggaattaaaaataaggaatattagaagtatagtatagagtccatataggaatttaaaactaactaaaatttgaaataataaacataataaaattaaaagtagagtttagagtccgtataaaaatacaatttacaaataactaaaattataaattaagaaaaacatgggaagaagagtttaaggtcaatatatgaatacaaatataggaatacaatttagaagtaactgaaattcgaaattaaaataaagaatattgaa

SEQ ID NO: 86474 - DNA, 3054 bp, Oryza sativa
acaccctctatagctggctggctggctcggtcatcatccaaaatcgatttatggctctacttgactagataaacactatcctgattcccgagtctttgacgagcaatggctttacaacgagtccctagatcttgaagcgatcaatcaggacagaacccgaagaaatagctgagctaattcatgcagcatctttgataaagtttgagctccacttgatacgctcgcggttttagttcgcccgatcttttgttgagttgataataactaaaatttagaagaaatgttcaatcatacaagacgctgctatgttacgccttagtgattgatacatctctctgtgggttgttcatcttgtcggtgcaatatcaacattttttttgcaagtataaatcgaagaaacaagtacggacaaaataaaagcaatatgaattaaagctcacgataaggtggagttccgaagacgagtaaggctatgttcggaaccatgggttcccaacaagcacagtgtgcacgaaaaacagagcagtccattagcgcgtgattaattaagtaggagtattaggtattttttttcaaaaatggatcaatatgatttttaaagcaactttcctatagaattttttttttgcaaaaaacgcaccatttagcagtttgaaaagcgtgcacatggaaaatgaggcggaggagctaggaaccagcagttctgaagacaacctaattaggcggtctagccgacacgtgtaaatacaagggctaaactttaatctaaacaaaacctgaaaaactctgaaggggtacctatttattaatggaggtgggaggataaccaaggggtcactagggtcgtgctccactagattgggacgcaccccacatgagctcaacttgggtcgaggtctgaaacgaagttacaagcccgaaggtcattataggtgacgcaacacattgtttcttgaattgtggccgactgagatggagtttggagatgagcctggatctgttggaagagaacttccatagctttccatcaagtactcatggatataaaacggaggtcgtgcacatctggcatccgtttcaagtcaacgctgctgcaaatggccgaacttgtctccagaacttgtgcgacttgtctcctgattgagctataatgtaagtaatggttgtatcaatagcagctacggccacatcacatctctccgtctcctatattgtctctggaaaaaggatcagatgcagccgtttttcggagcatgaggacgattggatatataaactgtggttttctcaagctacaacactaaccgatctctgggagtagtataatttaataaaaatctcttaggctaacatggcctaattctctctgaagccatggatatttttattaatgccttctgccttttatttagaaaaccttccaatgcttttatgccttaaaagaggttgttatctttaccaagtaacttgatcatataaataaaaagttcaaatcttgggacataccgcaataaaagaaacagtgatgtcatctaccggacccatcgttttgcttattcgcggcatatttacaaacaaaaagtaatttgtgaataaaacttttatatacttgttttagcgatctaaaagtaaaaaccgaaaaataaactttgatgagaaaacctcaaaataagctccaaattaaaaattaaaaatttaaattttggctgataagtataagtataaataaaaatatgagtccaaataagttttcaaggaggggggattcttttgcgctgtactgtaaaatggtaccgtgttcgagctgtaatctttcgtttgagtgttttgagatagtgatactcaagatcatacttacatatgattagtacgagtgctgtggttatctcatctattaagcttcaaaataaccaaatttcaacctcaccaattgttcgtaagtgtcatggagcatttatcttttaataaagttgctccatatattttctcatattcacacttcgagtagtgctaatcctaagtaagggtgtgagatatatatgcttgtacgcgtttgtaccagcgctaaacaccaaccctacctcactgttactgttaaacccaatatgttcatccagtatgttatatggccattgtgaacttaagtgacaaaacacatctattatatttgcatggattatgtaagagaaaatacatctactatattttgtatgagttatggaagagaatatttattttgtatgagttatgtaaaaaagataagggtactaaatatagtaatacccgagattttaaatgttcccgcctttttatgcacttacatgcacgtgggttttacgaataaaatacaccactgcataccataatatccaaattttaggccttattttgaatgcaagcaactttccctatttccataaaaattggacatgttattacgaaatcattatgtttttaattaaagccatgtgcacgaacaataagtaaaaaaactgtatcaaaaacaccaagagttgcttgaaaagataactacattaacccctatacaaatatgaaaaattcatattctttttcttcaacaaatacctagaaaatcaagacacatttaataccctcaaaaatactaaagatgtcaacctgatcctaagagactaaaattcttggtaatttcttgcaaaatcaataactcacaaaaaatatacgttttcgatcatattctaaaaaaaatagttatagagtctagaaaaataaacttgctgcttgtaatctagtaaaccctacaactaaaacaactggatccacacaaagaagcatacacaattcccctcagacacagaaagagagcagcccgggcccacgcgtcagcctccaccgcgcgccgatccccgtcgtccgtccccctatccgccacatccccagccatgtctctagtcgcaaatccttagactcacccggaaaggcagcgacccaaactctccacctcctcttccagccctccacaccccccacagtctcccccacctcctcccccaatttccctcctctcccccggcg

SEQ ID NO: 86475 - DNA, 1840 bp, Oryza sativa
aagcaggcctgccaaagttggacaaacatacttatcaaagcctcaaaggtcgttcaaagtgtgggctcaaaccacacacactaacttaatttgccgtaatcaacgtcttgtgataacatatagacttctaacctaaaattgtaagagttgtaaagatggtgatgaaatagtcaacaaggttaaatgaagagtgattataaactaaaatatagacttccaagaacaacatgttgatataaggtataaaataaactatcgatcgtacagtaacaaatattatacgaattaacactagagatcaagtatattgtagtgaagtatataactgatgcgaacaatatggtaataggaatagcaataaaaaaaatggttcaaatgggtgttgtggatgcgccacattaatgagggactttccaatcaatcaagttactaaggcaatgatgtggccacgaaggagaagaatgaggtttggacaatagagaaaatatatatctatcacctacaatgtacaaagagcctctagtaaagcccttgcaattttcatgaacattgtactttcatcaggtccagtgttcactgttctgcctccggacaggcagctgtttaggttaaaccactaccaaggggagaccattggaattcatcaagaaggttctcaatgaaccattggctcattgcagtgtcatcagtcatagttaatttgcaaagggcccaagaacaatgagtacacaagaacaaaacaatagctggctttcaactaaatttggcaaccaataaattaaagctactaaagaagcataaattgcaaggagccaaggatgacagaaaggtagcaactagcaaggatactgcaaaagactatcgaaatacaaggtcaaaccaggtcctattagtagcttcaatgttcacaaaacaaattagcttgtaggaggagtgcctctacattccttttctttatattcttctactatatacaatctagagaggaaattatcagctgataaacaaacataaatcaaagatcattgaaatgaaaattgccacttaaagcacacgaaggcgtcagtcacaagatgccaattccatattagcatcaaacttcagtgaatcaagccactcgatacaaaccaaaccaattctcagtgaaatcttaagtatgcaactaaacagcaaaattctttcggcacataaatgaaatatagcacataagtttgattgtacaaaagaacaaaagattcaccttccagcaagggtggcgtcaaaggtgaaggcgacgaggaagcggcccgggcactcctcatcaggctcaatccgaagagtctccttcttgaggttgacgtcgttgcggattgtgatagccttctggtgctcgacgtacggcgtcggcatggccggctgcaatccgcaggggtgcggccgcccagagaccccaggccaccccgggtagtgttgcgggtgcgccgacggcgggaactcccctccggcgggcacccccgcgccgccgcccctgtggtggtggtcgtacggcgccgggaggggcacctgcagggacggcggcggcgggtagtagttcccgtactgagggtagtaccgcggcaggttggggttggtgtactgcggcggagggtacggcgtggcggcggcgaacacgtagtggctcggggacgactccggcggcggaggcgggggaggcgaggacggctggtggtggtggccgtggacctgatggtggccgtggccctgggcggcggagcctcgtcggcggtgaccaggggaaccccctccgccgttgctaccggcgttgcccatctcccttccgcggggcagagatcaacacgga

SEQ ID NO: 86476 - DNA, 8225 bp, Oryza sativa
cccccccctccccgccgttccgctcagctccacgtcggcccggtagaagggagaggcggcgccgcttcgctcgtcgacggaggtgggggcggccgccggcgaagatcgagggcccggcggcggctccggatttgcctcgatcgctttgcgaggagagagagagaggaacgagggcgagcctggaggaggatgagactgagcgaggggtagtatggtaagtcaacaatttagaaatgggggagccctgaattttcctatttataataggcgggggaaaattttcttatcgggaaaggaaacagtaatacacgcccagatagagaacggacaaatcgcaggcgcagcgaagaatgaacggatcacttgaaaaccttaataaatgtggtggatggctattgtacatgtgcctttttaaaacaagtggtacaatgatgcgaaattaaacgtttccaaaaattgaaagcggacgaagcgatccgacactctggtagtattaatgcgttacacgtgacgttgtactcgttattatacttataccctacgtgtgtccgaaaaccttatttgtctcgaacacgaaatttattatagcgcctagaaagaagagaaatcacaagatctataaaacgtagtagtatcaccttgtaaacgtgaagagtatgtcaggaatgattatagatcttaaagtacgatgatgagaaataacataattgatataaagtataagataaaaaagtaaacgattgaagataccatgaaccctgagataaccacatatctttagagaagaaaccaataaatctgtaagttaatatttttgaaataaacatgacaaaaatctaaatcttttagtccatcttaatatacttgcaaggctagagatttttttgtctgataaaaaatcacatatgctttcccctctaaatcaaatcttcaaccatcttcatggatacaaaaccaaatggaataaaaaaaacatttgcaaacccttacatgtaaatcaaagcggctgacggcgcagatccgcgtatgcgagctagcatatggagaccaaggggatgagaaaattattcagggatgctcttatttatagatggaacaccttaccctaggagtgataagtacgtgtacttatcatctgcttatcaacatatcaatcagctcatgcacttattgactgtgataagccactggatgtgataggtgataaatccgctggagagaaggtggtgggggtccgctggagccattaacgcaaaggaatccggtgtggctgggtggagtggatttgctttttgatgacctttcaacaacccaaaaaaatgccttttgtttaatgacctgatggttaagaaacaaaactgaccattattagcaagatttcttaacaaaatgtgatgcctaatgtagcacttaatgtctcaaaacatatcaacatttatacatggaacctataaataacctgtctcaaaatagaccaacatttatacatggaatctagacataacctatgtctatatttatggataggtattactgcctctgtctcaaaataaattaatttttcacccatcccacacgtaccaatataaaattgaaaaaaactaaaatattcctacgttatcaaatctcaatgcaactatttctcaatttatctactcacagtacaattattttgtactttcacaaactttgatgcaacaattattctaaaaatgaacttatattaatggaagatgctaataatgaacttattatggtacgaaagaactacaaaatttgctttattttaggatggaaggaagtagtttggaaagataattatgccgtgagaaaatttatttttggtatcaacgaagttgaattgtacaaaaataccattataggtggttgatgctttcaagaatgaaattcttctgcatgcttgcaaaatgaaggatactcttagctctcccattcttagctagttacaaagtttgtaatttctagggattttgtttttgtttttctgttctttctttgtacatatatttctgctcttaataaataactgctaggcaaagccctgatagaacttaaaaaaatcatcgtacaagccttttctttcacgtttctattgtcatttgatatttgctagcccctctaaaaagatcattttgtccttaaaataataacatatttggccatagcctcataaattatatttctaccaaatttgcacgtgcaaaattatcttcagaatggcatatcaaaatatgcaaaactttttaccattcaattatttgcaaaattccattgtatggacaaaatggtcttttggcggggttatcggatgtcaagtgacatagtaattctaacgggagtgaaaaaaaaaggggactataaatacgcttgtaaggtggcatttgtagaccgtaactttgtccagtttgtagaaccaaactctttggtagcgacaacatgtagaatttatctttttctctaaaggaccatgtatccaaattgcatgggcttttggaaaagaaaactaactcctaattaatttttaaatttaaattttgggcagtgacggattctttatagggtattacctccgtctcaaaataagtgcagccatagatatccgaatttatcgttttgaccatccgtcttatttgaaaattttaagaaaaatatttaaaaaattagtcacacgttaagtactattcatattttatcatctagtaacaataaaattactaattataatattttttcaaataagacgaacagtcaaacgttggacatgaacagtgataaaactgcatttattttggaactgagggagtacgtaaactaccttgctacttatgcgatactcttgaaaacgtaaaaattacatctctcagtaggaagggcctaattgccgtattttttatgccaacgcttgaggttttctccataatctttcttgactctctgatcaacctgggatagataggcttgacatgtaaaacctccatctcatgattgatggatgctctccacttggcttttgtaatgaagtttcatgaatacgtcttcagtgatacaggaggcagtctctttcataaatggagatttttattgctcaaaataacctgatgtaagcacagattgtccatatcacaaaacacgcatgaacgcatttctatcttcatgctcactgtataacggattccttgggtacaataactcgagatataaactaggatacaggctttgtggcaaaactgcgaaccccttagaaaacccagaaatatgatagatgataaacaagctgggggggggggagggggcattatgatagatctggtgcaaatgcaggtacgctgctggcagagccaactggttcttgtagagcaaggttcagtggaaacatctcacattgagcaatgtgcgccatcagctggtccatgaggactaatgcggccatggactccaccatcggcacagctacaagagttaattgattgagaaaatgtcagattatactatcatgagtgagtggttaagggaaggaaaatttaggtactccctccgttccagaataagttaatctagtacgggatgtaacatatcctactacgaatctggataggtgtttgaccaaattcgttatactggatatatcacatcccgtactatattaacttattctaggacggaggtagtagagccgtagatccattaccgcgagggacaacacatgggtcgtggcggccccttgctaaaagttcaacatcctcatgctcccttgaaacagtatgttgtttcttctggaaaagcgaaatccaatatctcaaataagtagcaatatagccttttaagaaatagaaatcctcaaatgttacatatgaatatatgatacaccgtaaaagacacaaaatgtactatgagaaaacactggttttagctgcatccacaagactacaacaccatagtgcttgccatttaaaaaacatgacatagcactatttctaaggatagatttttttttaatatactgatgaaaaaatgagttacttgaaccggaatatctcaccccaatagtcgcggttggcttgaaagctactttgaagtatataatttcaccatttgatatccctccctgcatggacatacacattataaatactaagacaacggtgttatactatttactagtatttttttaatctagaatgcagctagatgtagcgaaaacaataaataatataactgtaaaacaacaggggactaggataaaacctgcacaccgcctgaacgattagttcttgttctcacatttccagcctcatccatatagaactcatcattatgctcacttccagtgtagtcagtacctgggcacaagttattagttagtattgaggccagtagcaaagtagttggcatgcacagctatttgcaaaaaataaatcaactaattatgtgcagattaattcaattacctgcaaatccactgccgatctcaaaccccttgcttgcaggaagagaaagcatagctttcgccaattcagcctcaagtttgtcaaatacaggagagccaatcccctacaaattgtcgttgctctatcatatcagtagctcaacagagaaaaaatatttttctaatgaatgatcaagcttcaatgttcaaacagattttgtgcaaattccaaagcagggcggtcataagcagagagtgcaaacgatgagcttatttagtttattttagctggaggacatatatcaaaataaacataactgcagggtttaaatacttacacgaggaacatttcttgcaatgcatgtgaccacaccaccaatcgaatcacctctaactcgtactttatcgattgcatcaatcatcttctgtgcatattctggatcaggacatctaacaatgttgctttctatctggaaaataaaataaatataatattcagcaaatgccttcagagactgtccagaagtgttaaacttgaaaatggtgggaaccacagacctgttccattgttacagtgtcataatcaacggcatcttctggtagtacaacttgatgcaccttggacacaaacgccaagatctgcaattgaaaatattttgctgctatgagacattggacagaatttgttgcatggcttcagcatatttaggatgtatattcgaatgctgattcatttttcttcagcgtccaattgttcatggataagtaaacatgtcaattgcgatgcttgatacaaatcttgatcagttaagagtaaaaggttgccaagtaggatcacacctctactccagatttgagcttaagaattttctttgcaagagctcctgcagccacccttccaatggtctctcttgctgatgatcttccacctccctatcattcggttgatagaagatgttggttaggcattcaagtaagagaagtttaggtaccacagttttagacattcaaataagagaagtttaggtactacagttgatggttcaatgaatggctatattacacattataaaacatgaaaaaaagtacctgcactgctctaacaccgtatttgaagtcataagttgcatctgcatgtgaaggtctgtaggccttagccatttcactgtaatcctgtgggaatgaatatggttatttccagctttaatatgttactccctctgtcccaaaatataagcatttttagctatgaatctgggcaattgtgtgtccagattcgtagccaaaagttgttatattttgggacggaggtagtatttcaatacattaatgcgaaaaaacttaggtacttacaccccctctctgatctgtgttcgggacaaaaacatgaattggtgtcccagtggtcattcctgcagaaaacccatcaatgctatcgtgaatatgagacaagctaatactctaaattcaaaaatattttttccaagtttatcccatgtcctgaaagacaccataccttcatgtgtccctgaaagaattttgcaagtgtcagtctcctttcttggggtggttattctgctctggcctggccgtctgtgataatcaaaattttatgtcagttaacattatggtgtaatgtaacataacaatcatattctgcaagaggttagcaggattgcatttgcataatcctgtttttgacagaagccagctgtcagcacagaaataatggatttttcaagagacaaacctccggtcgagttctacttgcatatctgcttcagtaagtgggattctgggtgggcatccactgattacgcaaccaacaccgcctccatgagactctccataagttgcaacctggaagtagttcccaaatacatttgcagacgccttcacctctgttttcaaatttcaggagcaacggatttaattaagtcctttcgccatccttctaatagaacaaaagtaatgcaaagtagcagatttaaatactctatttctaactaagatacgtgatcagtatccacgatgacactcaaaatccaaacacggcaacattaaagctagttgtcatcctaatccccaagatctaaattctcaatgatactaaacaaactcttgatgctaggatagaacgaagcagccgtttttctctcctttcaaattaccctatacaatagacacaatcatggcataaaaaaatgctaaaaaatggtaagattctttcttagccagacaacgagtggcaaccctcttcacccacgagtagatgaccagacaaaactcaaagccgagagaggccagccaagcaattcccagctgccccgtagccgcgcaggaagcaaactctacccgaattccaccgaacggacccagacaagggggggcgaaacgattccaataggcggacctaggcgagcggcgcggcggcggccgacggagaagcggagggaagccggggcggactccgggaaggcgcggaacccgccgccgccgccgcgggggaggacgcgcgccaccggctgcgacgacgttggcgcggccatcggagcgaggttgttggtttggttggtgagagccgaagcgaggcgaggacgcgaggtggggaggggaggaggaaggaagccgccggtttaatacgcgacgggggtgtcgcctcgccacctacccctctccccactccggccgcccggctcttcacctacgaccaccggtccggtcagtccgaccggaatgggattctttttcaataaaaaaaccgcccggttcaccagccgaactagcttgaaccgcccggccgattcactgatccggtgtttgaaccggacagacgttgtcagattttgacttgtaatctgacctcgccattctgatggagtgatcgaatctggtaacacctaccaaccgaggacgccatcggccattctaaagtggtcgcctattccaactcccagcagcagccaggtaaccaaaggtttgggatcacacgtttactttgattttaccactagcaaaaaagaacaaagtttgaagcgtgatcccaacggcaacggcagcttgaccattgcaattagctatctggccatgttgcaagtttatttccatgcaaaaggtaagagcaatcagagcagaacatatatggtgtcatctcatctcatcaaggcaaaaatataatgagaatcatgaggaaattttgtacaaatctggagtccatctgctgtaactctttttactcctgatggagggaaatcccattaagtatgagatgttctccacttcttcaggttagggcaatagtacacgcatgaatccatgtgatgtgtatatggtacacccactccactcctcttggcatctaagaccttcacccacacaggtcaggtcaggaagccacattatgccagaagcttacatgctaacatacactggaaggtacacatctgttacatctcctccccatgctcaaggcgagagcgcagagcgcgatacggggaaggtcggaaggccccaatctaggatcatatatcatgatcatatgcgcccgacattgtcgcagctacacctcttccctgtgtgggattggcagcgattgggatggctgctgctgatgctcttcggctttgctgttgactttgatcggtgaatcgggtgacggctgctgctgctcttcagctttgttgttgactttgatctcaagtagccgctcaacgggctgtcggcagatcgggcaccgggtcgtctggtacctcaggaccttggcacactcgctgcacat

SEQ ID NO: 86477 - DNA, 13163 bp, Oryza sativa
agcaactaaatgtctttaaatgctgtttactgcaaccctaaccctttatattataattcccttgtactcccttgcatttattctgcatttgtgggtgtgtcttgttgagtacggtggttgtactcagtcttgcttaattttcccaagcccagatgaggagttcctggaagatgaaggctttggtgtctagctcgtgcctgccgtcaagcgcctgtggtcgtcgccctagtcttccgctgtctttcgttgtctttgagtgtgctgggccttcgttgcccgtgtaataattttatatacgcttccgcttgttaaactctgtattgtatcaacttttggtgtaccttgcctcctgggacaaggaataatacacgcacgtcgggaacgcctgttgggtgatttccggtcgtgacaattgattgggcttacatgaggaagaagaacaatgaagtgttcaaccaagtgatgcaagtgtgccacaacaagaatcttggagatattcttgccttggagtatgattggaatgaggaggtcattgcacagttctatgcgacagcattctttggtactacaaggaagggaaccccttatgtgaagtggttgactgagggtgttaggcacaagatttccatggcacagtttgctaagatgttggggttagatgatgaggatctcattaggcccaacattcatagtgaagcacccctccccatgatcaagaccaagttcatgtatgcaaaggatgctcctaggacttgcatgggatctactcatggattgcatcccaactacaaggtgttgtactccatctttcgttggtctttccttccaaaggttggagatgctactgctttgccatccaagcatgctcatcttctcagttgcatgcgctacaatcagcctcccttcagtgtgatgaaattgatttggtatgagatcgccaacaccattcttgagcctaagcggggttgcatctatgctcctttcattataaagatgattgagacagtcaccggggtattctacatcaaagatgggcaccataattcttttcgccctcgtgctccacctttctcttctccagtggtccctcgatctgttccttctacttcagctggtccttctactagtgccccaccaagttcctcgagttcttctcccatcaagaaggcacttcaggcaatttttctgtatgtgtgctaagactgccaagaaagtgaaaaagatagaaaggcgtcagaaggaagatagaagagaggctgggaaagaagtgttagatgattctgaggatgaggtctatgttgatccatttgaagcttatgaggcagccagcaacgttgccgttgaaggtccatccaccttcttcaatgaagaatcttcccattctgttgatgatgatgatgatgatgatgatggtgatgagggtgacaccgaggcagctgctgaggatgctcccactgatgttgatgagggtgacaccgctgctcagtccgatgagtctcatctctccggcgatacagagattgttccctctgatggagatgagtgatcatcttcttctcttcatagtttctcgcctttttggtgccttgatgccaaagggggagaaattgtgaattgaagggggtcatttaaatccttatcctttttgctgccttgactgttgtctggtcatttgaccggaagttccgggtcctatgatctggaggttccggccaggcagatttcctctctattatctctctctatatggacatgtaatcgtattctattttggttggatgtaatgtctgttagatgctttattatcctttatgtcagtaagttagaccatatggatgttgcattttgatgtgatgttgtgttcttttcatcttttttgagtgattgccatgtcatctagtctttctttttgcatcactcatcattcaagcactttcatctacatctcttatttgatgagggcagtgtgaagtttcttttgagctttccttcatcttatgcataatgttttcatttcaagttctttatatgcatatctttagggggagcttcacacttctctcatcattcaaaatttaaattctattatctttttgtgtgctttaaccatgttgtcatcaatcaccaaaaagggggagattgaagatgcacttaaaccccctagtgggttttggtgattaatgacaaggtggttaaagaggactaacatgtttatcaagtttattcataggagtttagtcccaaagcgagttgtgatggctaagaatgcaaggagaccccccaatttgaatgttcctaagtgcaaaaaacaccgaaggtgattagactaggtttttcactttcgaaattgagtttagaaaaaaaaccgtactattaagaggggtttcaagtgtggttctagggtatacaaagtgagtcaaaatatttttggaatcatttttgaaaaatgattttctcctcgggacagagagggctacccggaggttctggccggaacttccgggtgccgtttatttgcaaaaagtttcctaagtactgcccggaagttcctggcacttttgcccggaacctcctggcaggtttccagttcaaacttgtgagtaacggctagatgacgtcacctagtcgttatatatatggatttcgtccctaggtcaccctttggccattccacttctgttcattcttgttctagggttttctagccactcccaagcttcctttacttcctccactcaaatctagagcctatcttgtgagattgagagattagatgagagagtaggagtgttttggggatggctttaagattaggtttgattgagcactttggataccttgtgggttgtcacttgggcttattactcttggagatcttctcctagacggttaggtgtcgcccgtgagcttctaaagatcttgtggatgtcccgggaaagtttgtgaaagttttcctcacctccgcaaggaaacaaggtaagtgagtaaagattcttgtgctgagttttcagaggttgtcctaggtagagcaacttgcacttgtggtcttttctagaagaaattttgagttggatcttggtggtcactcaattctagaaaatgacctagaagtgttgagttgaaggctgtggacctcttctgggatctttgcataagtgaggcaaggggttaattgagacccggctctttggagcacctcaacggagagtaggattcatgtgatccgaacttcgggaaaaaatcgtctttgtctctcttgtgcatgatctttgtgtgaatctgctgatattctgcaatcttcatcttgttcctctgtgtgcctaaacttctcttgctaggacctgtttttcatctctgttttaatttatctctgctgcccggaaattcctggctcaagaactccggaagttccgggctactcatcctgcccggaagttccggtgttcatcaccaggaggttccgggccctgtcaatttaaccgctgcgattgttgagaaaatttcaggaaaacctattcacccccccccccccgccctttttaggctacatctctgatcgttcagacttaaacccgggtgcttgcatttacgtccaattattttttcagtggtaagcagccgatagtgaggcgtttgtgaactctatcaatttgaagatatgcacctgtgtttttgttgtgtttctgaaagaaaaatcactgaagcaagtcgtatatgtcaatcccaaagtcagtactaaaatttagttgcttctgtacaactggaagatatgatgaacccatgaaagacgttgaaggcagcaggtaattgttgcgatagcgctttttggtttaactattctctacatacatccaatggcgcaaaccaggtaagtcaatgtttcgtggtgaaaaacacgattacctgagaaacttacagatcatgtttacctagagctatggatgtttgtagaatcaacgatttatgtaaacaccaccaccaacctctttttctcacatgatgatgcgtctcagactgagcaacatctggtaatgttacaacttaaaatatacatcatccccaatccccatcttccaaagcaggagtgaaatagcttatgtaacgtccatcatatgtgcattgctcacatttgagaccaaacagtgcaaagttccgtagcctgataatgatgccatgttaaaattctcacttctcatgtggagtttctcttcggagctggagctggaggccctggcgggcgagccaaatctaagttctgcatctcacttgcaagaatcgcccttctttctttcaagaaattgagtcgatttgtcagcttggctaatgcagatggtgccccggaatcctgaaatataatagcaaagcacatacttttagcataaacttcaatccacccaagtggcactaacaaccacatttctatagaaggacgcgaaaaaggaggttcatgttggccaaagaaacataccatctggccgactagctagaactgatatcagttaaggagtcagtgagatttacctctgttctagatccaagcctgcctaatagtggattatttgagtattgtttctgtgcaaggttccactttgatgccaatggatcttggccatccttgacaatctcacccttagaaatcaacattctttgagcctgaaatgtgatatgaaaataacttaagctgtgttcaggagtattagttggcaacttcttcccctcgcacgcaaaacgaagcgactcattaacgtatgtttaattaagtattagctaaataaacttgaaaaaaatatcgatatgatttttttaaagcaactttctaatgtagaacattttataaaaaaaaatacaccatctagcagtttgggaagcgtgtgcacagaaaacgatggagtagaagttgggaagaggatgtatagaacacacccttaatgatagaattgagaccattaataacttaaaacacacccagaactgattgcatgctcattgttaacttcgttgagctggatctttgctacgtaatctcgttttattcccttggttgtctacagaaatgaaatatgagagattgtgatgtaacaaagatatttagtttttttcctgcacatttgctactgggcacctcagacactttaggtctttatgcatattcaggcagacataactaatgtgactatcttggttacacagtttcaaaaacatctgttatgatttccatttccaaatgttgggattatcatagagcactcagagacatgcacatgcaatagtaatcccagactaaagagtgtttggctctcatagtcttaccatgtgtgtagccgataccatgtcagatatagaattgggcccaacatttgatgatgtggtactctgttcacctctggagaaagatagtccacaagtaccctttcacattactcaacgttctaattgaacaacaaaaaagaaaacgacatacagtgctaaaatatcacagaatgctctggacagaaatccttactcggttagcttgtctgtatttagcagtcgtttgttgcatgagtcacataatgaggcggagctcatctggacctggttgttgagttgtccacggagatcagaacccttttgtttcaagttcaaaatatcagcttcagcagtagcaacttcctcaagatcagccttagtcttttattagcagaacaatttttttttcaaatggtgaaaaaacacttgcactttaactcaataataaaattttaaaaagaaaaccttgttgtcaattgttgatgggaaggacgcctgccctcttcgcaaattcatcagccctgactccaatgagaccctcaaatttctctccttctgtagctgatctcgcaaattttccacctgttgagtgcagaaacagcaaaaacattttcttgtttaacagtgaacagagaatgcatgtttcaggcagatattgaagatgtataaaatttctggtgtgcttgacatagatttaaggatttcttatggatgtagagactaaatcataaaatctacctgggcgttctctttctagaaaaaaatataatacttttcccatagtttgagctcttacttctttttcgagtgctaatcggcgtttatgcaattctactttccttctttcgagacttgcttgtaggattgaattttctttcgcctgaaatagacagcacatcacctcatgtgtaagtatttaatgctacagaatctctcattgattccagggaaaagtctgtacctccttagtaattttagattggagatctgtcttgctgttctcaagcttctcaataagagtcctagttgaaaatttcgaattaaaagaaatatctcaaaatttaacaacagtgtaaaagctgtttgatatcttctcttaaagtttccaactgttcttgatttgatatttttaaatatgttaaccaaagataagagacaaactctaaacagtacaatacagaagcaactggaaaattcaccaatcatgcaatggaagaaccaaaaaattccaggaatgattatggaagtgtgcttttattttaacttcacaagcacttctatccactactaatcctaatgggagtggaagggaagttcaagaaaatgttggggcaggagaaaatgggaaaaaccttctatagcttttgataccatattagcataacagaagatatatatatttaattgttgcaatgaagacaagcgggatgacaagtaaaagctaaaagagtaagcaatatcacttatttgcattattaccctaacaaaactcaatttcccattgttggtccaccatcaaaggagtagttagttattgagacaaaaaggagagcaaagagataaggtagaatcacaaagggaaaaataattcagtgcttctaaaggatatgtctggaactcttccaacagcacaatacaataatatatagctggatacttactcgtcatcactgcaatagtcaatctcctctgctgacaggtcttttcttgcctgtaaagaatgtatttacccaaaattatgagattgccctagtctcactaatgtgtaagagtatgcaaataacaattgcacgcactgaagtacggccccataaggtctttttgctcttatttcttgagctgcttgatttctccataaattttgctcttgctgatgatgagcgaacatttaacttttctatttggtctgtggatccatttgattcgtataattcttgttttcgattggatggatcattgctttcaatttggcaggtgtcttcccttaccgcaccatgtcctgttcttgctgctttcttaggaggttgtaaaccctgatcgttgccattagatgctgtgccagagttattgcttttaacctacagagtgtggatcaaggcattgtaagggtggcgtagaaattgcatttgcattaagtcagagacacaaagatgtaattctgggtaatcagtatacttaaccacgtcagttacttattcaaggtttctacaaagttgtggagatgtagtcgatggtcgtgttcattttcacatctcacatcattgagctactgtgaacagatcgttcttttcatgtcagaacaaagttacaagcatccctatgaaagatttgcacttcaattctaagttagcttgaaatactgattcaactttgggcatatagcttgaaatactgattcaactttgggcatactttttcagaggtaacctaagaattgctcatatcggtgatctaaaagcataaaaaactgtagcagacagtggggtagcagctactgcagttctttgtacaattgcagcagcataacagtctcgtgctggctttcagtatattctagtttgcatacatttcaggttcaccattagcatggtcaaacatttaagcctattattggtttaaaattataaactaacatgttctactatcaatgttatattacgttatcaaaagtggaaaaatgatcaaactcgtaaaaacttctatttaggagtggagatagtatataagaagttaatccaagtatgctaaccatttagaaggacaattacaacacaaattcagcagttaaccactgaaatcaacaaaaaaacgcatcggcggatcataaaaggcaacacaagggaagctccctcgttactggacctttagacacaacacatctgtaatgcttgaaatcaaaacgatgactagttttttgccagaatgaccgaaggaggtcattcaatgtaattaagattggaaaaacgatgactagttgaagtaccttgtcatcagagacactggtcttaatgttgttgtcacattcactgccaccagatgagtgctcagtatcatcatccatgtcttcttcaatgttatcttcaccagaatcataagagtcatcctcttcagggccatcgttgtctgtggaatattccttgtcaaaatcaccgtcttcggactcagtatatgcatctgaagagtaggaaccgtcttccaagtcctatacaggtaactgctaaattagaatccatcaagagtcaatgcagtataacttcaaatggaacttgactgtgtagaaaggaacatgtaaaggaaaaagaggatacatcaaatatctgatcgtattcttcgagcataatgatgacgattgcttgagcatggttggcagcagctgcagcttgaagcagctggaatgaaccatccccagccatactaaagtcgctatcaatttcacattcaccgagaagaagaggtcggagaaggagtggtgccatgcaagccgccaaagcagattgagacatcctattcacagctttgtgtgattcaacaatctgcatcatcttaagagtcctaaaagaaaactagtgagttttggaatccataggtggaacatgaagctactccatccgtttcacattataagtcgtttgttttttttcttagtcaaagttttttaggtttgactaagtttatagaaaaaactagcaacatctacaacactaaattagtttcattaaatttaacattaaatatattttaataatatgtttcttttatattgaaaataatactacatttttctacaaacttggtcaaacttaatgaagtttgactaagaaaaaaaatcaaacgacttataatatgaaacggagggagtattattgtactacagtctaatctaaagctaactcatacattcataataaaatgattgagaactacaaaaaatgagaactggttcttcacaaatgaaaacctcagacatacacaaagtgtgtaatttcaaaaaaaaaaaaaaaacatccaaggtagatacctctgcaaaagttgtcggtttggttctgggaaaacttcataaattactctattcatagcatcaagccttcttgtcttgtcagttcctgtacaatcacacgtctatatcagtttgtaatcctaggaacatcagcatgttttcaggttaagggcatgcgctgagctgactttagaagatttacttatgcatcagttaaatgcaagactacattgattgattgttgaagtaatatataaagtaatgtggatggtgtttttagccggagttgtggcttagagtgcctgtttttgctgtaaagtaatgtgcatcgttgtaacaatagcggttgtacagctcttagcctccatggcagctgtatctgttgtactagtttgaacctcttctcaatcttaataaacttcggccgcgtatcttacgccggcccggcgaaaaaagaagtaatatataaagaaaaattgaagtcaatcttacggtaagctccaaccagtgcagtgcaacatggtgcaggaactggagatgaaggcatctctcgaagaacatactgtagcaaagaagaactgaagatatgttactgaagaatgtggtaactctatgttgtcactatgtagtcaacgtttggcaaaaaaagattaccttgatgcagtcaccaataacatgtgcatcctcttctggggagaactcatttttccctataagatcacattagtgatttaaatggtattatttatcatgtgaacaggacataggaaattcaaggatctgttatctatgcttaacggcttacaagtgacataaatatcctcaggagtcatgaataaacattttattatttgattagagtacagctcttgttagagagagagagagagagagagggagagagagagagaatcacccttttcatagtcccgaactcttcgtttgacttcttcaacatcagcagactgacgtaggattccttccaccttgacacctacaaacagagtatgtttctgctcgtcactaaactacagattaataaatatacatacaatgagttattgttttttagataaatatcatacttctatttgactgttactgatattcaccaggatagcatgaaattaaaatttgaaaaaaaaaacactcaccataatcttcaatgaactttaaggccttctccaggaaagctggactaccatcagcatctacaagggcaaactctgcaggtctgccaatgatagatttattgtccgctgcaatggaaacgataggatttgcctgttcaagtagaatgtagggtcccaaccccctagctgaatctagtactttagatcgtgggcaactgatgaaagttatcttaacttacactgttcagctggagcttcagcaggctctgctatgtcagtgctgaaaattggattttggccaacagtatttgctacaacaggtgcctgtgccagagcattctctagtgcacttctccattcattgagttcttctgtagtttctgcctgctcaatgaaaatcattccattacagtacgataggcaggtgtgtcaaacatgaatggaacaactccttgtaattgcatgatctaatctcaaccaaacagttggtctgccggagatgatcatcccctctctcttccctcgtctttattgctgcattaatcgctgccacccaatggtagcagtacatactgcagatgaacgccaacagtatattaaaaatgaaacaggtgtgcgaccaaccttgagagtgaaagttcgcccatcgcggccatcaggaaataacactgttaaaagtttcttgtcttctttgaccacaacactgaaatcatagctcaagaatatgtttatcagattacaggaactatagcctttaaacaaacattaatttctcaatgcataccttccggagttattcaagtcaattccacctagtgtaacaatcggttcatttcctctgggaggtgcattctgaaattaaagcagaaatttgggatgagttatcatggttataaataccttaatctttttcattttgaatattatcaaatcaagtaaccaaccctcatgatatttcaataacaatctgaaacgtacattattatgaacgaaaaataatatgcttaagtagttcttttaatcatgtgattcaagtctatccgcttcgacatggctacactgacagccagtagtagcctcagtgtttgttttttcactttcatatacaactaatagtatgtgaaaaaaataagcattccgcttcacattcaggtccgcgtatttcttttttctttttccataaactgtgtaggcataggtgcttaaattatgaccaagccagaatgctattgctggggtgtatgaatgctgatcaggtacggatattttctaaaaaaaaatcctcattcaaaggttcgggtttcctatttctgaatattctacaattataattcgatttctatatttagtgctcaaagaccaaaatgattactgtgtttgtcaggtgttaaaataattttatgatgaccagaaatagcgtatatctatatcaagaggccccaaatacagaacctatcaagaccttgtcagattctacctccagtgataataatgcaatgagtaaatatgtaaaacaacaaaaagactaagagaaagacaggtcaaagccatagagaagacttttttatcccagcagtcagctagcagtttagcattgctaaaactttattaatttacaatgtaaaagtatgaaaccatagagcattctttgttacaattaaaattatcttagcttgaatagcaaaataagtcatccgcatcagctttgtgagtgaacaactgatgcaaaggaacataacaaagtagatatgctataatacagtattacgtcaaaaaaggaaaagcacacaaagaactactgttataatacagtattacgccaaaaaaggcacagcacacaaagaatcactgtgatatatcttacaggatcacttctgaagaacaccaatgatgcccttgtaagaataaaccagcgctttttccatgttgtccaaccaattcctgttacttatcacttttagttgaatatgaagaatactgtagattcaagtattacaaacttttaagaacttttttgtttttttaaaaaagaatcattaggtaaccaagcttctaaatttgccacatgcaaaagatggaactaatcattctcatacacctatgcaaactacaagcagaagttcacaacaaaataagtccaaaatacttttgttggcttgactctgttctatgtggggcttagtatggttaagtgattcttaagcaaatagaaatttggcatttcaaggtattgattgtgttatactatgctgaaacttttcaaggatctgatttttagagaggcgttccctataagttctgcgggtaaataataaacacatggtatattgatgtactttttgtgctcgatacaacatacaaggcagactaaaatgagtcatggttatcaattttataatatacaattcaccatattaataacttaatttattaacttattatggatcagttttgtaatttattatgctacctaaacatccatgacaaatggcaaaactgtcattattcatcaagacattgtcataattgtgtgacttcaggataacatgtattattggttcttgtgtacttgaagtgcatggggacgttatatttgttctatttagcccacttcatggacaatattcatatccatagatatattactgcaatatttctaccacaaacatatgttttcgatgtaaggatgtactccctccgtcccacaatataagggattttgagtttttgcttgcaacgtttga

SEQ ID NO: 86478 - DNA, 803 bp, Oryza sativa
ggatccaacacgtacaagaaagggctaattgtgcaagagaaaccaagcattggtatgttgcattttctgttttagttgttgcgtgaatgaatcccttgcattcttcctggagatgaacatcaatgatatgtaatatatgatctggaaagttcctctccacaaaattggtaatggtcagctcattctcgaacatagagtctgttggtcttttgcctattagcatctccataagtactaccccaaaactataaacatcaccgctggttgatgcacggacactttgagcatactctgacaaaagggattaaatggtacttattagtgcaatttgaatctttatatagcaccatatgtggcaatgaaatttacctagagctatgtatcccatggttcccttcacaacaattgaactgttacaaccagaattcccatctgatgtcaatgaagaatcaagaacaagacttgcaatgccgaagtcccccaaatgggcactcatatcctcatctagaaggatattcgtgggcttcacatcacaatggacaataggccttccacagtcatggtgtaaatagaccaaagcatcagctatgttgacagctatgcttactctttgatccatggacaaatgtttgcgaactacaccagcatgtccatgatgcaaccatttgtccaaattaccgttatgcataaactcataaattagagctttgaaatctttacctccattgtctatcgtggagcatgcagctagtacaggaagaaggttccggtgccgaatggttcttaaaacctcacattctgat

SEQ ID NO: 86479 - DNA, 5150 bp, Oryza sativa
tttgggcatagagattcaccgagatagaacaaagtatgcattgggactttctcaaaagacatatatagaaaaggtgttgaagaaattcaacatgtacagatgcagtgctacacctgctcctataatgaaaggcgaaaagtatggggcatcgcaatgtcccagaaatcagtatgagctcaatgaaatgaaaacaaagccatatgcgtcagctgtaggaagcctacagtacgcgcaagtgtgcacacgacctgacttggcattcgttaccgggttacttggcagatttcagagtaatccaggcctagagcactggaaattggtaaagaaagtcttgcgttatttgcaaggaacaaaaggcctcatgctatcttacagaagatcagaatcactccagatagtggggtactcagattctgactttgcaaaagataatacaaagtcaacatcgggatacgtgtttaccctggcaggaggagctatttcatggaaaagctcaaaacagactatcactgcagggtctactatgtatgccgagtttatagcatgctatgaggcaacggggcaggtgaactggctaaagaagttcatacccggtttaaaggtggttgacagtattgagaaaccactaaagttatactgcgacaacgaacccgcagtaatgtacactcacaacaatcagtcaagtggtgctgccaaacacattgacataaagtactatgttgtgaaggacaaagtccgggatcaaacaatcagtctcgagcacattaaaacagaaaggatgctcgcggatccgctcacgaaaggcctaccacccaacgtgttcaaggaacatgtagccggcatgggtttaagggaagccttatgaatcctggactacagggcccaaaagtaaagtatctgtttctgaatagagatgtgtatagtggctgtcgaatccatcggcgattgaccgtgacgatgaaacatgctctatttacaaatctgtgatggaatagaaaaagctaaaagaaaaagtgagatcaagggggagaatgttagatagatctctctccccttgagcccaacggctcaagggggccttgaccgcgccctgatcgggggcgcccagcccaatggctggtgggcccccgtcacactgcgccatataaaagaggggtggaggccggcacggcacaaggtacgagattcaccgccgccgccaactccaccctacaaaccctaatccgatcgagagggggcgcagccagtgacgggaagcgccaccgccgcgccacacctcatcgccgggacatctacgaccgtcactcccgcagccgtcatcgtcgtcgacctcaccggcgccgcatccacgacaaccgagcgccaacgacgacgatggccggcacttcttcatcctccaacacctcaaccggtcggtctatctaaaccctctcccgttttcaatctctacaatgtcattcatcaaacccaaatagaaccacccgactagatctaacctaggtgatcctagtgcaaagtctaacaatggtatcagagcaaccctagggcttagatcggttcgggaaaagaaatccaaagaaagaaaagcacaagatccgcacggatcaaaagaaccgaaaaccctaaccctaatcttacctcgtcgccggccgtcgccgacgccggcaacggagggggggaggggcaaagaggcgccgcctaggagccactcgacggccgcgcgcgcacctgcacgcgcgtaccgtcgagggggcccgcggcggcgccgccatctccgtcgtcgccatctctctctcacacggtgggggttagagacggtggggggagcggagaagaagagaaaaggcgccggccatggcgcggcggcgcgagggccgccggcgtcggcgacgccgctccgcgcggccgcgcgcccgcgagagaagagaagctagggttttcggcggccggccgggagagggggttttgatcctccgatctcggcgcccggccgtccgatcgaaaccctagctgatcggacggtcgacgccggtcgggccaaaaacggcccaagagggagagcgcgcgcggcgactttcccggcccaggcccaggttgcggcctggtgggaggggggagcgcccgcgcgcgccaaaaaggccgcgggccgacctgaaaaagtccgtatgaggtccctcgggggccgaaaatgaataaaagagaacagtagcaattttccattttattttgtcaattttcatgcaaattttcaatagaattttgaatagatttttgcatgttttacctctgtttaaatttgaaccaacgggagaattttcacagagagagaattacagagattttgctactgttcatatgttttttatatagttttccgctgcaaatagatgaaattgatgaaaattagtgtttctaaaattaaatttcgaaccaacgggagaatttaattttaggaacattaattatgtgctatgatgttgtaatttttctgaccaacgttgataattgcaatattatagttatggttatatgtgttatgtctatttctgcccaacggtgatgtaggcttaatgcataatattttaatgttaattttgttctcaccgcacatgattatttcaggtggctactccttgatgggttgcattaaagatattccgaccctgaaaggagataactacgcagaatggaaaagaaaactcgaccttgcttttatcttgggagaggtggactgggtgttgactaccccatgtcctatagaacctgctgaacttgtcagaggtgaaaatgagtcagatgctgactggcaaaagagacagagggacaatgctcctctcgtcatgtcgtatgacattgaacaaaagaaatggtccttagccaacaagaaatgtttggctgtggtaaagaatacgattgagcctaccatattgggctcgatcccagagtgtgacgctgtctcagagtaccttgaaagaataaagagtcagtttactggctcttcaaagacttatgctacacagctgatcaagcagcttgtgacagaaaggtaccatggaggtggtgttagagaccacatacttagaatgagcaacatggcttccaagttgaagccaatggatttgggcataacagatgactttctggtccatctggttatggcctcattgccaaagcagtttgacaattttattgtcaactacaacataagtccagagaaatggaactttgagaagctcattgctaattgtgtgcaagaggaggagagaatcaaagaatcaaatggtggttcaataaactatgttaaagataagaaaaagaaccacaagtctcccacctcaaaaggtaaacagtctcagcatctgcctcaacaacaacagttcgctgttgagaaagatcaatgtctccactgcaagaagacaggacactacaagaaagattgtcctgactttttgaaaatgatcatggcaaagaaaggtgagaacattattacatttgtaaatgaatctcattatgttggttactctagatccacatggtggattgattctggagcaactattcatgcttgtaattgtttaaaggcattccgttcgacgaggactacgcaaagaagagaaaacaccattagagttgccaatggagttgaagaaaaagttgaagctgttggagatcttcctctagagctcgcgaatggcttcatacttttacttcgagatgtcttttatgttccttctttgcaaaggaacttaataagtgtatcaaagttggattttgatggatatgattgccgctttggaagtggcaaatgtgaactatggcataataatgcatgtattggtcttgctgtgttgcgagacgagctttatttgttatctctttctgagaatgtgaatgttgtgtcctcgttgacaaaagaaaacaagaaaagaaagcgaactcccgatgtctcatcgaaattatggcactgtcgtttgggccatatttcgagggggagagttgagagactagttaagaatgaaattcttcctccattggagttctcagacttagaacaatgcatagaatgcattaaaggaaaatttgtaaagagcatcaaaaagggtgcaaaacgaagcgcaggaattttagagatcattcatacagatatttgtggtccattttctgtgaaaagtgtggatggctatgactcgttcataacattcacagatgattactcccgctatggttatatttatccaattaaagagcgatcagaagcattggataaatttaagatattcaaagctgaagttgaaaatcagcatgatataaagattaaagtagtaagatctgaccgtgggggggagtactatggtcgacatacgccttatgggcaagtccctggaccttttgcaaggttcttgctagagaatggaatagtagcccagtattcaacaccgggcgaacctcaacagaatggggtagctgaaaggcgcaaccgtacccttatggatatggtgcgcagcatgatgagctactccacactaccactcggtttatggatggaggcgttaaaaaccgccattcatattctcaacagagttccaagcaaatcggtgcccaaaacaccgtatgagctatggacagggagagtaccctcgctaactcacctccgtgtgtgggggagtcctgcagaggccaaagtatttaacccaaatattgggaagttggaccccaaaacagtcagctgccattttattggctatcctgaaagatcaaaacgctatcgtttctactgtccaaacagttatacaaagtttgtagaaacgagacacgccgtcttcttggaagacgaaatgattagggggagctcggtagttcgagaaattgatcttgaggagaggcgggtgtctgtacccgctccgtcgactcaggaacctttcttctctctacctgctgatgttgtgcctgcaatgcctgtcattgaggtaccagcacctgttgttacccctcctgtggcaacaatgaatgagagtgaggaacctgttatacaggattcaacagaaatggttgtcacaccagaggaggagctacaacagcctcaaatagataatgtgccagtacaggagactcatcaagagcctcaggtacaggatgtgccaaatgtgcag

SEQ ID NO: 86480 - DNA, 2978 bp, Oryza sativa
atgtcatcgttcacgtggcgtgccacataggcaagaccatggtcaaaagtggctttggacctggatgatacaataaaccaagtttagagattttgatgtgcgctttgcaagttcgtgaacctaagtaaaaccttctgacaagtttaaggaccgtttgtgcattttactcttcttttttttacacgcacattttccaaaccgctaatcctaaaccctaaacggcttttttttaaaaaaagtttatatagaaaagttgctttaaaaattatattaatctatcttttaaatttattttatctttaattaattatacgctaattgatcaccccgttttacgtgaaggttggtgaagtttttaaccactaccttcaaacgcagcctgaagatgttatctgtggagatatatatatcatataagtcgagcacacacaagtattatattgtcattgcgaggtagacgggaattaggagtggttaggcctattcaagccagagcccgcagtaaataagacatgcagtgctttatgcatacagtctaatcagaaaacaaaacaagagaaagttaacgaacctctgctcgaacagggagcaccgccacggcgaactctccctgtaatcgtcggtttgccgtagactagagatactaatgccgtgtgtttagttttttcttcaaactttcaatttttccatcacatcaaaactttactacacatagaaactttcaatttttccatcacatcattctaatttcaacaaaacttccaattttgatgtgaactaaacacagcctaattaacatacatatatagcgggtttagtcccctggatacataaaacgcagttccacggctctacagtagtgttgcatccactgccatggcccattgctaagagaagagaagacagagcgactcctttggtgtttactgtttactccgatttttcgtctccaggagtttgtcctctttgctagtgttctctgattcgcgtgttagggaaatgggaatgaaatccggcaggaccgcagaagattttccttttcttatctttttcccctcttaaggtagtgggctagtggctgcatatgcttctcgtgaggaagcgtcttcggcgtcgaataagttcacctgacgtcccttaactttacattgaatttgtctgagatccccaatcctcaatgccagaaatctctacccctcaactatccctgaccatgtaaaaaaggtcttgaggcagtatagacccaatttatccctggttttactgacgtggtgtacggtgggccccacatgttagcgctcacttggtgtcagcgtcgtcagctcctctgtcgagccggaacatcagcccggtgtgggtgcaggccactgttgcacctgctgcgagttgccgtcggcggtcaccgccgaggccacctcactttggatcggctgcaccatggaggggccttcatcatcgcctcctactgctgaggccgctcctcttgcgcgcttcgtgccgccctcctcatcgtcccccatgactgtctacgacacggttagtccataaggatcagacacctatatcccaggaccatacaaacccgttacatgaaatgcgccaaagccaaagcaagccccgtcaacatgcttaaacttgaaaagcttcaatgcagaaaaagtgacgcttgtggtgattgttgtggtggtgatggtggtggtggacacggtgaccgccacagatccagcggaaaatgtggcatgtcacagatgatccacgactcgctagtgttcgacgatggtcaccgtgtagtgggtggcaaggtgcggtcatggagcaccattcaccaccctcgacaagcctgtggtggtgatgggaccaggggcagccggagccacgccgtggaggcgcagcaggcgtcgccgctatcgatgcccgtctaaacactgaagccgcaaggcgagtcgtcctctagtgtgggctacagagacggcagcgagccacgggcgatgtgcccgtgcaagatctcataggatacgcctaggggtggcggcgacggtggccatgaaaaggtggtggaaccaggcggtgacctcggtgaccgcgggtcacaccaccgctccacctcgagcagcgggtcgccacccacgaagaccgttggttcatgatgctcgcccgcctgtcccacaccctattccccgtcaccaagccgctcgccttgccgtccccatcgccacggctcccccgtgaaggaggcactgagttgccatcacaacgcctgcctgccctgcgctccgtcccccatcgcctcgtagtccctgtcatcatgcacgcgccccccgtcccctatcacctcgccgtccccatcaccgtgcctctcccctcccatctcataccggccgcctcccctctaccctgttccctcctcccatcgcgaggcgctcaaggcgacggagcttggccgggctcaccagtcaccagctgcctctcccctctctcacgccaccggcctcccaagattgctaaagagaagataagaaagaaaagaaaacgaggagagaagaaaagaaagaaagaagagataagggccccacatttttttactcacttacatgtggatctcgtaattttattattttttattttgctgactaggatgccacgttaaaaaaaccaaagaccatacttgccctgggtcttgtataatttaaaggtgaagatggcgttgccccctggtggcatgctcgttacaacgcagggtttgcacgcgccgtggctctagaagtggtagaacggcccaggtagtatacatatggcccaacaaagcaaagctatcagcagccgaagtgccgaacaaagccatcttctgttccacttcaccgcgaggttgcaaccctgcaggagcggcggtgcacgttggcgccgggcggaagactcgccgacctcgcgcggcggcgtcttcctcttcttcaccttaggagaatcgacggcctcagtca

SEQ ID NO: 86481 - DNA, 2506 bp, Oryza sativa
tacccccactatatattgcagtacagaagagtagtttctcacacacacatccagtgtatgctgatggccaatttatcatgttttatgcacgttgcattcaaaatcaacagacaacacaattacacaagttccatggtacattgtaactcccttcttcgaagcttatcgtctcgcttggttgcttcagcataggatgttctgattgcttgcagcttaatagctatttctctaatgtccattcgttctcttgggatcggatgagtgcaagaaagagcaacctgcactacagacaacaagcatttatagaacctattttcttgctcgatcctttcttgattgaagcctttgcattcttcttggagttgagcatcaattatatgtggtatctgctctgggaagctcttctccacaaagttgacaatgttgagctcattctcaaacataggatctgttggtcttttacctgtcagcatctctagaagtactattccaaaaccgtaaacatccccataggtcgatgcattgccacactgtgcatactctaaaagaaaagataaaatcacactaattagtacaatgcaacgtctaagtattacttcagaaaacaaattgcctttcatgaattgaagatgtggcaataaccatatatacctggagctatataccctatggttcctttcaatccaattaagctattcggacaggaatgtccaagtgaggcaaatttagactcaagaatgaggcttgaaattccgaagtctcccaaatatgcattcatatcactgtcaagaaggatattcgttggcttcaaatcacaatggataatagatctttcacattcgtggtgtaaataggacagtgcattagcaatgtcaacagctatatttactctctgagataagctcaaacattttgaagcaacactggtattttttttatgcaaccacatatccaagttcccattaggcatgtattcataaatcagagctttgaaatcatttccactatagtctattgttgaacacgccgttaggataggaagaaggtttcgatgtcgaatgcttcttaagatctcacattctgatatgaagctttcgtctgcgcatctcgtctctaggtcaaaaactttaatagcaacttgtattttaaccggacttaacttagctctatatactgaactgtagcttcctcttccaattaagtttaaccgtgagaagttccctgtagcttgggctatatccttgtaagaaaccctagggaactgctttccaaaagaaagcaacgatagatatgttcttcttggtgtcttcttcacaaggtatataaggcatatcagcaccgtgagtgacaagaaaccaactattggaatcaacaatctggtcaaattgctcttcctttctattctgtgagaaacttgggggcacgatggcatatggagatccataactcctccgcatagtcccctattgccttcaagataaacagatgtagcatttctgaataatccattccttggtatttctccttggagattgttataagcaaggtccagattgctgagtagaggtagatcccccagtactgctgggatggtgcccgataagatgttatgggaaaggtccagattgctgagtagaggtagatcccccagtactgctgggatggtgcccgataagatgttatgggaaagatttagtacgctcaagccttttaggttgtaaagagtaattggaatggttcctgtgagaaagttttggtccatttggatgatcactaagttgtggcacatccccagagaatcaggtattttcccagtaagcttgtttgatgtaagttgtaggtagatgagttgtctaagattactgatctctggaggtatggtaccttgaagactgttgtagctaagatccagctttaacattagcgaagggtttcccaaggagggtggtatgtgaccttcgaatgcattgttttccatatagagctctgtcagctgtgtaagattgccaatggagtatggaataggcccagtgaacatgttcttttgaagatataaagattgcaagtttttaagattaccaatccattggtcgatggcacctgctaaactgttttcatcaagtgccagtagaatcaacccagagaggttccctatgctaggtggaattataccagataatttgtttccacccaaaatgagatattgaagagtgctaggtaggcaaccaattgaattcggtataactccctgtagttgatttgcatttagtgcgagcatttttagcgccgtgcagtttgtcaacacatccaggaatttccatccttctgtatcttttgcttcaagcatgtttagctgaaggtctagtttagacagtcgtaaaagcttaaccaaggaagtagggatccggcctgtgaaattgttggattgtagaacaatatcttctagcattgaggcattgcttaaggaagctggaatgtgaccctcgagtatgttgtgacccatgta

SEQ ID NO: 86482 - DNA, 9633 bp, Oryza sativa
  unsure (1)..(9633): unsure at all n locations
atgtgcccaaggattgccaacttagtgtgttgttgaccaagaccgcagaaatccaacgaacaactctacgattgtctcatcagctagtcagctccaacaacaacatcgatgatatcatccaccgcaccaatgctcctcttgctccacctaactttgcaataaatcatggcaataataccttcagcaccaaccactctctgcatcgacagcctcagcaaagaattgtcgtagatggaagaagttgtgtctctccccgacctactccaggccaagcaaagggcaatcaacctcaggagggcgataccaagcagaaaaccgtcatccgcttcaaacagcaatcagaaggaagcttctcctgtgaatgatagcaatatgcagtcctaacacatcatcacggaaccaatcaaggatgatgcagtcactagaacaacgccagctatatctctccagaatcaaaatgagcagccacgcttgtggttttcagttcgctacttatcattgtgtaatcgaaagtttgcagcaatcatgtaataaataaatatattcatgtctataaacagtgagcttgctatgtttatggatgattcatgttgaggatacaatgtaccgatgataagcaccttccctttttgtttaaggcagtgccttgtattcgggtaataagggagaaatcaatatttgagaacataatagtcgatggttggtaattagtctatcaggtatcagaaaagggtcaaaggtgatatggcagaagaacaatatggatgctccccatctcgaggaagcactaaagatgaccatcggcaaataaaccctagtggcatagatacaaatagcaagcaatgtatttcccggaaggtagtcagtgcagctttttgacgaaccacatcaaggtttcaccgaaaggcagcaagccaaaggacctcatcgtccccagaagcgtccgcaatccacattaaagaataccacctgttagagataagccgaaagatgattgataaaagagattggcaaagatgttctctagcatgaaagaagtaggccgaaaggtgattgataaacagaaacatgctctgcatcgctcaaggaagacccctgatagtaattgcccccccacaacagtcaccttgtcattaagtaagcaagatgacctaggtaaaagtgtttctattaaggcaaggagtgaaatcttcaactcggtatcagatgctacacggagtgaaaagtgcaagccccggttaccaggcaacgccatgtcttgggagatgatccaatgggaaagaacacatcaaggctgaaggtgcacaggaatacgttgaatgctaaatgatgacaacatgaagagaatagcggaaagtaaactgaacataaagaaagtgaatctgagttgcttgttcgtgggagctattcccagttatgaaccaagtgatatcttcgaagatagtctacagaggtcagagtaaaatcacatctaacaacgaagcttcaaatttggccggataacgatcagacaataagaagtccagcagtaaaactatttgggaagacgtcaaagtatatccagtgggataagttggttctcttgggaagcataattcaaaggcaaagttatcgacccttgcatcaaatagcagaagtagctatcacccggagaccaggaaagctaatatgaggcagttggtggcgagttagaagcaaatgacaagctcaacttagaagtaaatgacaagcatgatattctcatgatgacaagcatgatattctcatgatgacaagcatggtatcctagtaatgacgagctgatctcgacgcataacgtgaaatgggtaacttgtatgaggttgactccaaagatatgaactatacgaagttctggaactgaagccccatcttcaagtgccgcaacccagacgaagtcagctaaaggttcaaccagggacaagtcaggtgaagagaagattccacctgcaacaggagatcgagacaagcagtacagagtggagaagctttgctaggcaagtttgttatagaaaacgcgacggaagaagtcagataagaagagaagaccgcccaacctatcttcctgctagcctcctcgaatctcggggacgagattcttgtaaggggggtggatttgtcacgtcctgataaattcatcccgaaataaaaatcattccctaaaaggaataatagaattaattaaaattcgaaaagaaattggcaaacactaaaatacgtacaagaaaaattcaaatgtggcccggagaatttttgttaaattctccttggtctaaaaggagccctcaaattttagtggaattttcagagcacaaataataattgagaagaaataaacaaagttgaaaaggttttatagttttactctgatcagaggtgtacaactgtacccacaagacacagccccacgacacatttccgtgcgccgacatgccaccacgacatatcggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcagctaaaggaaagctacactacaagccctgccgttgcccacgctggcttgtggtaagtacgataagttcttccagggcatcccgcgaaccggtccttaattgccatgggtgcgactagcaaaactgtcacgtcctgataaattcatcccgaaataaaaatcattccctaaaaggaataatagaattaattaaaattcgaaaagaaattggcaaacactaaaatacgtacaagaaaaattcaaatgtggcccggagaatttttgttaaattctccttggtctaaaaggagccctcaaattttagtggaattttcagagcacaaataataattgagaagaaataaacaaagttgaaaaggttttataaaaagaaaaatccctaaaagtcttcttttcccccctttttccctcttgggccggctcagcccaattccctccctctctctcctctcccccgcggcccaccggcctcctcccccgcgcgcgcgccgctgacaggcgggcccgcccgccaccctcgctaacgggtggggcccacctgtcatccctatcctcgcgccgcgcccgccgcccgcccgtgccctagcgccgccgccgccgccgattccgccgcatcccgccgtccccgcgcgcaataaagtggggggaatcattccccgtgattccctctccgttttcccccgcttttccctctctctctccctcggattcgttcggatttaatcccgcaagtttcaccggcgtcattgatggagccgagatctccgcggccgattcctccctctccggccgctctctccctctcccgacgctatataattgttccccgtgcctccctcctccgtttccgccactcgccgctcgctctccccgtcggattcgtgctcgcgccgtcctcctctctctccgccgtcgccgccgagctccggttcgccgccgccgtcgctccggacttcctcccgactcggcgtcacctccatcggcttcgccgcgtcgtcgtcgacctcgtccgctcctccgtttcgcccgccgaccgccggagcaccgtcgtcctcgccgtcccgaaccgcgccgccgctttcctccactccggtcgtcgtttccgccgtcctcgtcgtcccggggtgagccgtggaccgcccctttcgcttccctctcttctccgctctctcgggcgccgctccgccgcgccggtggtcgccggcggtgaccatcggggcgcgggtgcgccgcctcccgtcggccgtgccggcgaggccgccttcgggcgcgccccgcggctgccaagtggggcccggccgtcagccgcccgcgctcgcgggtgcggctgacgcgtgggacccacggcgccggccagcgccagccgcgtgcacccggtccaccgtggaccgaggggctgccgcgtgggccccactcccgtggacccggtccgcgcgccctctctctcggctgacgcaataaacccgatttttaattaaaatttaaatgaagaaattcgcaaatatccatttaaagagcatataaacttcaaatggccatatcttggccatttgaactcggaattggaccgttcaagtctctaatttttccttaagaagtaaagaacccatttttgtgctttgtttctgctgttatatggagtttattagagtaaaagccttttcttttccgttggtcgtgtagacgctgcagcttcggaagattcgctcttcgtggaagttgaagccgacgtctgggaaagcgagcaaggcaagtcacatcatccttgagcatattgaagcccagtttacaaaattatttttttaatttaaattaatgcattatcgctttatttaaattcccgcgttatcactgttttatttagccatgcctatttacctttgttatgaccttattattattgctatggttattattaccttgttcaccctagaataaacaaaaccccaactagtggacactctatttatggttccactagtatgaatttaggtagatgcttcgctgattaataggacaacattaggtggttttataattttagactttgggaatattcatatcatttggacactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggattggagatggatgaagtcgggggtcgatggacattctccagggcaaatgaaggctacacgagctgcggcccggtagtcgagatgtcatggcagagggttggtgccctgctgctagggggctcagtcctgcctgcctgtcccgggtgtcccggccgtaggtgggattgggtcggtactcttgtctatggctaggaggggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggatcgtctttataaaatggctttgggcaactaagtgacttttaaatgctgtttactgcaaaacttaacccctatattattatccccttgtactcctttgcattaattgtgcatctccggtgtggcttgctgagtactgtggttgtactcattcttgctctatctttctccccccttcagtaagagaagctttggagaagaagtcttaggtggagtcctggcttataccccagttgagcgcctgtgaagatggagccgcaggcccgctagtccgctgctgtttatttttgattgtcaggcctgaagcgcctctgtaataatgtaaatattatcgatataataaagatgtgtcttttatatcatgtttgtgtggtgtaccccggcttttcctgggacggggattgatacactagcgttcgggaaaaggcaattttcccggtcgcgacaagatggtatcagagccatctcgactgtaggataagccgagtggataaaacctaaggacatattttataaataaaactatttgcgaaagttcctttttctcctttcccctgcgctatttgcaaaaggtttactcccttcttccttcttcggatttcaactagtactagatggtcaggtcagtgaagaagaagacatcgtcagttgtttgccgaagctccggaagactgcaggatccgctagtgaaatgaaggaaacagtgaagccagctgtgaagcaggagtgaagatcttggagaacccgtcgcaaaacctaagccaccctatagggtagtgttgttagtcgtgtgttccttgcttgtgtgtgtagcgcgtggtttgcatcggtgggttgtgatgtaaccatgctaggttgtttgcttaatcaacttgcagaataagtgaaacaaacaacacatcagcaagaagaattagttcctttaaggtcctgtctctagttctggtctattctttcctggcttgtttcctctctcacctcaacccctgtaacagatgtttaacagagaaaaaggaaagaatgtcagcgggtatgcctcaagtaactcaagttttcaactcaatccaccactggcctcaagagagttaaccagggcacacccttggtccattccaagcatgctgcttagttcacagctaccattagttggaagtcaagaccaaaatcagtatgtgtttgatcgagcgtttgccacccaggtcaatgagcttccaatgccagaagaggatgtccccttttgtcacgattgtagagagcaaggacactatgccctgaattgtccatgggtatatgtcaaagaagccccttcctttggtttagcagggcagacatcgctaaaccagcctcctcgcaccaagtcaagtttgcagcctagtgtgcaaagtgaagagcccaatggagacaatccattgaatcctagaaaatgctttcctcctagcctttcgcaccacgtggggtcacgtactaagcaagccaaaggcaggaagagtaagaatcagaagagaaaggcaccgatgcgaactgaagaagaagtacgtaagatgactattaccagcacagaatggcctccaccaggaatgacaaaacgtcagagaagaaataccttccgaggtgcgccacagttgacagagcaacttttagctaatggaggtagagtgtctgatagtgaagattcagatcaagtctcctcagatgatgaagatgagaagtctccccaaggtttcaaccagaataaaatggaacataaggcatgctctcgttgtagagaaatcggtcatgttgccagctcgtgtgccactacatgcgttcattgtgaggaagaccatccacccgacaggtgtccaacgagcaggatcacttgtttcttttgtgaaggaactgatcatgtaccaaaagattgtcaattcagttttctgctgacgaagaagatggccaaccaacccgccagttccaacggagagaagcatcaaggcaacacaaatcctcgccaagattacagtttcagcctgactccagtgccaggacagaggaatcaaaatgagaaaagaaaatgccgagtccgggaagatatctgttgcttcaattgtcaaggaatgggtcatttcgccgacaagtgcccaaaaccgagaaacatagctgccggcacgtcagtccacgtaactccctgcactcagaagcttgctcctcagcgaattgtcatccatgcatcccgaagcagtcctatagcccgcgttgcaacagctccaactccagcgagagcattaccacaaggtgtcaatgctcaatttcagccccagccatcagttgacaagacagaggccagtatcggcattgtacctttggatgttccagcacagcagccaaggaatcaagtacaagatgaagaacctgagcgtgagaaagttattgtctgttacaactgtagtacctgttaagggagcagacatgccaatcgccaagtggtcactggagcaaatgcagtacctgttaagcctagcgctagtcagaagcaaccataatactcttatatcagtgttcaaatacttttgttttatagttgatccccgtcaatcatgtaatgacagagaaacatgagattatgaaggagtttgataagtttatgaaggatccatgttaagattgcaagtgctgtgagttgtgtacattttgttgttgattagggagacctagggtctcatttccgtaaactcataatctattatgaatcaaataacctagcgattgatggcgaagaaaatcaagtgattaacccaagagacatttgtttggactaagagtttcagatgtgtcttcttcggatcaaaggcatgcacccgttgtggagaaattggacacgttgctagcatgtgtctcacactctgcactcattgtgaagaagaccatccaccaggggagtgtctcacccgcaggtgacatgttttctgtgtgaaggaacaaaccatgtgcccaaggattgccaacttagtgtgttgttgaccaagaccgcagaaatccaacgaacaactctacgattgtctcatcagctagtcagctccaacaacaacatcgatgatatcatccaccgcaccaatgctcctcttgctccacctaactttgcaataaatcatggcaataataccttcagcaccaaccactctctgcatcgacagcctcagcaaagaattgtcgtagatggaagaagttgtgtctctccccgacctactccaggccaagcaaagggcaatcaacctcaggagggcgataccaagcagaaaaccgtcatccgcttcaaacagcaatcagaaggaagcttctcctgtgaatgatagcaatatgcagtcctaacacatcatcacggaaccaatcaaggatgatgcagtcactagaacaacgccagctatatctctccagaatcaaaatgagcagccacgcttgtggttttcagttcgctacttatcattgtgtaatcgaaagtttgcagcattcatgtaataaatanatatattcatgtctataaacagtgagcttgctatgtttatggatgattcatgttgaggatacaatgtaccgatgataagcaccttccctttttgtttaaggcagtgccttgtattcgggtaataagggagaaatcaatatttgagaacataatgtcgatggttggtaattagtctatcaggtatcagaaaagggtcaaaggtgatatggcagaagaacaatatggatgctccccatctcgaggaagcactaaagatgaccatcggcaaataaaccctagtggcatagatacaaatagcaagcaatgtatttcccggaaggtagtcagtgcagctttttgacgaaccacatcaaggtttcaccgaaaggcagcaagccaaaggacctcatcgtccccagaagcgtccgcaatccacattaaagaataccacctgttagagataagccgaaagatgattgataaaagagattggcaaagatgttctctagcatgaaagaagtaggccgaaaggtgattgataaacagaaacatgctctgcatcgctcaaggaagacccctgatagtaattgcccccccacaacagtcaccttgtcattaagtaagcaagatgacctagggctgcagga

SEQ ID NO: 86483 - DNA, 1075 bp, Oryza sativa
tctagatactccacgaatttaaagcgaataataagcacgaaggagaagaagttcacaaacctaaagtctcatgactgtcacgtgttgatgacacagctgctaccagttgtaataaggggtatcctcccagacaatgtccgggcaacaataacaaagctatgtgctttcatgaacgcaatttcacagaaggtcatcgatccggatagattagaagccctgcagaatgatgtggtgcaatgtcttgtcagctttgagttgatatttccaccttcattttcaatataatgacgcatctgctttgtcaccttgtcaaagagatcggtattctcggtcctgtgtacctacacaacatgtttcctttcgagaggtacatgggcgttctgaagaagtatgttagtaaccgtgctcatccagaggcaagcatcaccaaggggtatggaatagaggaggtcattgaattttgcgtagaatttatcgaagaccttcgcccaatcggggtacctgaatcacgccatgaagggagactacggggaaagggaactctcggaaggaaagcaataacgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattgcggtgccatcgaggacatatgggaacttgactatggtcctctcaaggttcctctgttccggtgccaatgggttaggttgactggtggaggcgtaatgattgatgacagtgggatgacaactgttgaccttaacaaggt

SEQ ID NO: 86484 - DNA, 3501 bp, Oryza sativa
tgagatcatcatcttctttggcacaatgtcttctatccagcatatctcttttattaagtctatcacaaaacattagccaggcaaagactttgatcttcatgacacattttgttttccatagccaaatcatgggtctggggggttgcaatgcagaataatttagcttatagaatttcttagctgtgtacttatctgagccccagataaaattccaagcatcccccatccctgattgtaaattcaaactgtccagaaccccctgaagttgcaagaattccgagtaagcctcatccgagaggggtagagcaaaagaatcttctaggggtcttgaacacatggccttgactgaatcagacttatacatagtcacaaaaaagagattggggtagctggtgcatttaaaatcatcattccatagatcattccagaaaagggcagttcttcctgtcctgatttcacattttgctatcccctgaatatgtctacaagagttgtgatgtccctccaccaaaaagaacccttattcatcgtcaggtgtggaactttagagacatagtatgattgtgagattaatttcacccatggtaaatcagcaccattatagaacttgatcatatgctttagaagaagggctgtgttttgaactctcagattgatcactcctaagcctcctttctccttaggcatgcacaccctatcccaggaagctagagatttccttgtcgaagaagggttattacctctccacaggcaattcttacgagctgtgtcaatggccttgatgactgtaactggtagctgcaatgaggacatgtaataggttgcaatgaggatctaccaagttgacctttcaacctttgacctgactggtaccacatccaattcagttctcttagatttatggtgcaatccatgggagtaaaaggctttttctgggggcctatgcgtctaactcttgtgtttttattattagttaatactgtttctgattcttctctttttgcagcacgggtcagaggtatatatatacaggatccagtgaccaatgtgtatatatttatgatgtggtatggaccttagatgtttcccttaaactgtgatattgtactgtgattctactatttgcatactatggcagtttttctgcacacagggtgtgtatcccatctgtgaaaactgaaaagtcaaaagctcatgctgcatctatgcaaaaagaaaaatcatagatgtacacatgaatttttttttcaatattaaatatgtccatgctttcaagaaaccaaaaggcattccctgtgtaacctttgtgaaatctattttgtaataggggtccaaatgccagggaattttgcataattttgggcttgttattatcattgtggtatttttggctatctcctctatgtcctccaatttctctaatacacaaggattatattatgataatcaagttttttattcataggggattacaatctactgtaggtaactttggctagacaatttcatgggttataatcatttctgtgtagagagatcataattggaagttttagtaaaaactgtgagaaattaagccattaagattaaattatgtttttggatcaagaaagacattttacaaacctgaaaccgcaccattgattctgtagatcatattatagatgttataaactgtatttttttatgcattggtgtaaaccttgtttcaccctgagaaacaatggtagcaacgtctccatgaagcacggccttcccgtttattcggtgttgtgtattcgtattctccagcttaaagttggcccctatgtaactccttgtgactgaagtgaatcaactctctctttcttgcaggctactggaaaaattgttgaaaaactcagatggcatggatcaataatcagagattgttcctggcacccatactttccaacgcttgttagctcttcttgggatggctatctagtccggtgggaagcaacagaggacgacaaggacccctccatgctcaagaccggaaagcaaagaatgcatccagagggatacacattttcgtttgtgttttagaaattcagcagacggcagggtcctcaatgcttggaagatgtattcacgtcgatgctactgtgtcggattagtcattttctctgctttctggttcaagtagcaacgtattcagccgtatagaaattcaccgaatcaaagtacaacattacaagttacaaaggtagagtagttcaatcagtcatttacaaatgtatgtctttgcttctctttttctcccatttgggatttcgacggccttgactagatagatattggtgacgggcaccttgctcgctagtcaggcttggagaatgctccaaaatttgggtacaaatatgtacagttcaaaagatgaataaagtgaggaatcttcaatgcattgtgtttttgttcactcgaccccgaattccaaaatagcttttggcctcctagtccctacggtaaaacatacatgattttaactttatttatttattttcaacagtctttgagctacgattgtgatcatgatttaatactagaacaggttaataatttaatatgtttatgagattatgaaagtactctacatacacattcaatttttatattttcaaactatgtatagtcactaatagtcaaagtgtcaaaagtttgattggattttgtcccaaattcatggtcaaaggaagtatatatgtatctcttgtaacatataagttaagcgtcatgccaaatggtatatcttaaaaactacaaagtatttgttagtatatggctagaattgtaaaaaaaacatgggtgtgattggacgcaccacgaggcataaggagaaaggaggtcatacaagttgaggattctctataatatatttgtatatacagtaaccgtactaacatatgagccaatgctatatatagtgtcattatcctgttgtacatgatgtggggacaaatatggtgagccaaaaagaataaggttatttgtaggccttggtgatcatgagagtcaagtgatcattttgatgggtgtcctaggtagcacacatgttccatggctgataaaaatatatgcctatggggatgaggccgggtaatacacccattttaaggaaaaaaaactccattatatcgtatgcatgtcatgtatttatactatgacttaaactcaattggcatagcgtctatcaagtgatctatatatacaatgtggataatgtgaagtaatttggtactatctccgtcctaaaatattgcaacctaggatgggatgttgcaacattttgggacagaggtagtagatcagttagtgatcaggtagaggtagaggtagagatatgattgtggtcatgtgtagcgatagtgacgacaagggctgtacaatgagatgatgatgaacttgaggtggcaaagcaaacaaaatagagagggaggtgatgaggtagggaaattatgtagtgcaaaccacatatgtagt

SEQ ID NO: 86485 - DNA, 765 bp, Oryza sativa
caagaaattgtcttggtcaatttttttattttaagacaactgaagggtgctgatcatgttaacaagccaaaatttgtgaagttacttaagatttaacgattgtctgtttttgtaggtattggtgtcttaaagaagcatttgtcaaagctacaggtgctggcgttggatttgggttgcaacgtttggaattccaccatatgaattggactaatatttctctccgtattgatggagaagaggataggaaatggaggttttggcttttcaagattgatgaaaagcatttggtatgtctgaattttttcacaacatctacagtgcctaaactttggctcttgtacttctagttttggtcttgtgataggttatttgcttacgattatcaacaccattgcaggcatccattgcgaaagggcatccagaggatgctattgacagcttcaggagaacattatctgatgtggttattcaggagggagaattgcatacggcaatagaaattccagaagaagctttcactctattgacagtggaacaacttatacagttacatgattaaatggtcttcttgaattttgcggtgacatattaatgcaggactaaaatcaacaaattgtgagtgtatcctgaaagttaaaatatatacatagcacaccaaaattaggaaaagtatccttgtatttgctctcggtgcttctgcagaaatgagagcttaggggttagggcctgtttttttttttcataacagagaagacacttgatatt

SEQ ID NO: 86486 - DNA, 2028 bp, Oryza sativa
ctgtttctattgttaaggactttttttttcttttgtttaattgctgtgtgattgcatgtcatttgtttttagttaaaagcaagctgcaaaaagaagaaatcctacatgtcaaagaggaaatcttgagttcttctcattgaatacatgtcattctattatgacctccccccaccacacacacacactcacatgtaaaaaaaaaaaaaagaaatcttgtatcaatgcttgtcttgattgctagtgttgctactttattcaatattttcttctgtgtgtggtgatggtggcaaaggtacttgcaatgtctttgagaaagatcttttgaaaggaattgataatgctgtacctcatgagcatgcaattgattaaagtttgttttttttatggtagaagcagacatcgatttcttttgaaaaatagagaagtgattacttgtgatcacattgttgttaacttagtactaactatgtagcaataagcatgcaaatgggtcataccgtcatactcggtgatttttaaaactgtaattttttgaggtaccattatcaacttggtggtctttataaatttgttcccaccatttcattggtgctttatgcatattttttcccctgtaatgatattggaggcttgctgcattgacctaacttttgtttccacttaggcaaataccttatttaagagaatatgcttgaagttggatgcactatctcatttccactttgctccaaagccggtatggaatagtgacaagatattttacttacatttgtaatttctttcagcgaagttaactaacaaggtaaatattcacttttcaggtcattgaagatatgtctatacaagcaaatgtaccagctctagcaatggaggaggtaaataaaatccttcatttctccatgatgtttatacggtgagcatttcatgtcatgatttctctctctttttgcagattgcacctgtagctgtttcagatgctgcaatgcttgctcctgaagaaatttttgaaggaaaaggtgatgttaaagaagaagcagaacttacacaagctgagcgcagaagaagaagagctaacaagaaaaggagatatgcaggtaaatgtccttatgttttttaagatacattccttctagcttttagtataaatattctgacctgacatggataatgctcctacttcctcattcaaaacatttcattgttcattcaaacatggaagtagtttgagcaacccaaattcaattatagctagcaatatttccaattgcaaagttgggtacgagaatagattgaggcctgctagtttttcatacttttgtaccatacaggatcgcataaggagaggccagccaagatgcagaaagattaactcaatactggggaaacgcttacattatgaacaagtagtcagccatttttactgttcagcattacctcctgacccaaggatccattcatgatgagtattgtgcaaatggcaacgcagcattgacagacatggaggcagagagcaggctaggaaaggtagggtgaagggttgggctccaatgcttttgatcacaggatctgtactctggtggcacaacagacagacagctgttccaggtcaaagaccctgacgtaacccatctcccgtcccacaagaaaaggcgagcgaacgtattggaatgtgggatgggtaaaagaaatcttttgtttcttgttacactagtcgtagtagtagtgtagtaatgcaattttacaatatcattttttacactatagagtatcaatggagtgcatgtattcagaggcatatgttctgtttttgatacgttagggcattggtttgcagatgtctgaaatttgcgtgcggtgtattagtatcattttgatcctttgctttttttgccacattgagggattagattgatctaataaaggtgatgcagctatagactatagcatggcaagaaagcaaaataaacatgggttatgggggattgtactatcagctacagtagcaggtagagatgcctgtacgcaggt

SEQ ID NO: 86487 - DNA, 876 bp, Oryza sativa
aacattgtagctacatttaatacgatttcttttatggcagcctgcagagaaatttcccaatgtcttttcccctgactcactgtttgcaaggtattctttcttgtgtgccaacgcccaacaaaatgttttttatgattcatctacagaatacttacttttgttggaaaattttcaggttcccatatttcttaccctgcttgtgcatatcagtctttgctgctgttgttctcataggctgcatatggatgccagtaagtcagattccattattgctagcttcacaaaatatgcaatcagtgtaatttgtcatatatttagttgtatttgatatatttgcactgtggaagatcttatgacatggatctgaaaaaagaaatcaaaagttttgctgcatgcttagcaaccaaaatcagttactggtaattataacggagataatctgcattttatcctaatgtggttgttccacttcatcaggaattaatagtctcttttgttactttttgaagtcaaatttatatttcctctcttaaaaacttgtgcattagcagaagtatcaatatttagcatgactcatagtgagaaaggataattcttcggtaccttgtattaattctttttgtatagttgtaaagtaacttgaaatgtattttaggagacattacacaagcataaagctgatgcaagtagatcccaaactgttgaagctttggagagccatttgattgatccaaaagaaaaggctgaccaaaatggtagtttggactgcaagaagagcttattgagaaattggcccttgatgtcctccataattctctattgtgtcttctcctttcatgatatggcttatacagaggtatattgttcttgctatta

SEQ ID NO: 86488 - DNA, 4840 bp, Oryza sativa
ccaagcctcccggcgacgggccttcactccactacggcgggagttggcctttattaagtacaaatgaatttggatcacaactcaacagcgcggcggcttcgagggcggcggcacgtggcacaactcgcagcgccgccgcgtcatcgagggctacggcgaccgtcaggcgttcgagtaccgcgcccccgggaacaagaagacggactggctcatggaggagatcgccagcaacctgccggcggcgatcaccgacgagggcatcatggtcatctgtaaggtctacctctcgccgagggccaaggaggcgacggccaacgaggaggaacgccaagaaaccaacgtggttcccgggcccaagaggctccgagaggcggaagccaccggctacgacgcgccggcgccgccacagcccgacgtcggatactcgtactccggcggcggcgagacgtctcaagcgaccgcctcgatggactactgctgctcgacgacgacacacacggcggacgacacggccaatgccgcctactaccacggcgacgctgatgccatcaagccagatgcttacgacggcggcgactacggcatcggcttcaacgcagacggggagctggttctctgcggcaacggccacggtggcatcgggacgcagggacagacgccattggcaatgcagaacaccaacggggagatgaccttgttctcaccaatgaacggctatggtgttggcttcaatgaggaggtgagacaagaaccacaagtagaaggtgaggtggagatggataatttcttcaacgatttgttcgtcgacttcgacggcgccggtgatctcaatcccaatcctaacgggggtggagacagccacggccacatactatgtgaatgaattgaatcgctggggtagagtagtcgatgattctttatttatttatttttctttgagacgatggaagaacatgtatctgatgattctttgtcaacgtagttactgatttgtagacagatcttaggagattgttctgttcagttcatgaatgatacttctagttctttatttactctgttttatgaatttaactcctgttcaggaccttaagggtgctaatatatatcagtttcaaatggcatatatggcatcaaaagattatttcagtgtgaatccaaaccacaataacttgttgcactaacaaccgtctatcatatgaattcactgatacaataaagtctgaagttgaaagcagagtggtaaaggtgcacatcagtaacgtgtgatgtagtaacaattacatgacaggatatagtgcagtttggcaaaatttgaacaaaatcagtggatggttagtgtattccaaaacaactgaactgagctgggcagctggatgccgtattgcaccctggattctactttcccttattagtgattattcttcagctatatgtcatcagggccattggcaagtggcctgtatccatttggagttgcagaggtttcacctgaaccaactggtatacacttcaagatgacaccaacaatcaggctgatggagccaaggccgacgctgagcagccaatgttgccagttgagcggaacagtactggcgaaagtgccaagaaactctatgatcaccacttgaaatgctacggttgcagctatgactgcaatgaagatccaattgctgatgataccacggaaaacattgatcttctgcatttctctgctgtttatttcattgaatacctggtacaacgtttgccagaacatcatcattagaacaagaaattcccttgccaaatcatgattatttttttttaaaaaaaagatatatctatcagttcaggattcttaagcatgatattggaaatataagctgtgaccaaccaaacacatattgtggcagacttcggaaagacctcagtttcaccataggtcttaaggccaaaaaagaaacaccattttatgtgagtggtttgtggaaatactagcatggttacagtgttccataatgcactaacctgacaaaacacgaaggagttgaagatcagtgtatttatgatggatttggaatctgcacccttgatgttcagaaggctttctccaccaaacatgagagctccaagtacaaatagctgatacaaactttggcccatgatatttctccacatgaccttggtaatgaaactttccccttttcggacaggtggcctcttcatcatttcatcatttggaggctctgttgctagtgctaaagctcccagtgtatccatgatcatattgacccacaatagctgcacagcagtgagaggagcgctccctgtgacggaagagagaaacattagtactgtgttggagatcatggggaaccacttaatggaaatacatggtatcagatgaatactataatgttgccctcacctgtgatgcatgctgagacaaaattgataactaaagcaacaatattgacagtcaattgaaactgcacaaacttttggatgttaatataaactgcacgaccccatcttgcaacatttattatagtagtgaaattgtcgtcaagtactatgacatctgcactctccttggcaacctgcacaaataaaagacaaaattactccatttcagaagatgaaaaagaaaatacaaagtatccaaaatgggttatcagggtcaacttatttcagtaagaatgaatactgacatatttgtcctaaatatctgacttttttaatgtctattgatgctacatccataagttttgaactgcataggaaacagtacctctgttcctgcaatgcccatagcaagcccgatatctgcttcgtgtaatgcaggagcatcatttgtaccatcacctgtcacagaaaccacctcatcaaacatacctcgcaagtttgtcacgagtgtatgtttatccaatggtaaagaacgggccataacctgcaaaatatttccagatattaagtttggtcaatatttgagtaaacatatagactgaggaaaacattatgaacctgaatattcggtatcaggtccctcatctcttctgggctcttgctatggaattctggtccttctattgctacaccatcttcagtcaatattccacactctttagctatagctttagctgtatttatattatcaccagttaccattcttactgtgataccagcagacatacaggtcttaacagcatccttaactccagggcgcacaggatccttgataccgaaaatggctattagagtaaaaccacttgttggactatctgcattgtcatcaatatcatcatccacttccttatatgccaggcacaacgtccttaaagcatctgaagcaaatgagttgatagtatctaagatgttctttctctgagcttccgataagggaatagcatttccatcgccatcaaccatcatgtcgcacatctgcaaaataatttctgatgcacctttgcaaaaccatctggacgtgccactgggtaatgaaatcagcactgccatcttcttcttgactgaattgaaaggctcaaccttaaccttggtgcaggcactatactcagcatcatgaactccttccaagcccaagccaaattctaatattgctctttctgttggagttcctaagacagtttgcttgccatccttttccttgaccacctcagcgctagtattctcaaaaattccctgcaaaagcagactcaatgttctagaagaaaccacagaattaagttctcctgaaatggtgttactggtaactgactttgaaacctcagatatccatattttgtcaacaaccatatagttagtagtcaaagttcctgttttgtccgtgcagatggtaccagcagatcccattgtttcgcacgctgaaagatgtctaacaagtgctttatcattcattaactttttcattgcaaatgcaagactcaaagtaacagccaagggtaatccttcaggtacagcaacaactataatggttaccgctgttgcaaagtagtttactatagtcaatgcatcggtagaataccatttgagcagaccaaccgtcatgcctttgtcaatgaggaatctaaccagcagaactaaaaatgttaatatggcaaataccagtccaatctttcctataacggtcgcaactccatttagcttaacctgcagtggtgtctcatcctctcctccctcactcaatgtgctcatcaattttccccattcagtgcgcataccgacagcagttactatcatcttagcagatccatcttgcactttagttcctgccaagatgaatggtttgtcttgagaaacatacactgggtcactctcaccagataagctggactcatcaatcaaaagggagtacccatgtatatatagtccatcagcaggtacttgatctccaattgacagatgaactatatcaccaactaccaagtcatatatagagatcttttgtcgacgcccatctctggttacatggataaatatctttttcttttcattgtctagctccttaaattggagtgactgcttataatcactaacagcagtaaccataacaactaagaaaatgctgagtattatacccaagccatcatacatgccctttggccatccttctgttgccaaaccaactgcaacagatagcaatgcacataccataagaattataagggtcatgtcctggaatgcatcccaaacaaacatccagaaacttcttgaaggcttttctgcataacggttgacgccatatatgttctgtcttgtatctaagtcactagcacatatgccatgatcaaacgatgaacggacttttttagatatcccatctaccccaccatgcatcttt

SEQ ID NO: 86489 - DNA, 5506 bp, Oryza sativa
atcttatgtaagtttatgcttctttcatgatactattttttttgcagtttgtttatgtcatttctttgctacatgtgctttacatgaaagtttagtgcattcgctgttcgcttgacaccattaaacctatcttgaatataatttaatggtgttatatcagaacgactaagttggcctcccattggtaataccatccatgagaatcctttttgttattctctagtactaagaatatgaaatggactagtgtaagacggttcttgtttggagtgtcatgtgagggacagaattgcaggcagggaaagaatgagagtagtacttctctttccataagttaaatgtgttttgagattggggattctaagaaagaaagggatgaattacattataatttacctatgccatacaatgttcagttgtcacaaaactataggacaacccaagaaactatgttgattttatctttattctttctctctgttttttcctaatataaatctttagttaattttagggtattcccgtgctggtttcttgggcggttaatgtgccaaagtggctggggtgccccagggaagaaggcacaagggacagtctgtagctaggcagttaagaattctaatccactgggttaagtttggcttgcattcctaactagagatgaactgacaaaggcgatctaccatgctggcaaaataagtccatagctcagtaaaccaacgcattacctattttgttgtgtccttcctcgtgtttagatggtggcaagaatggtgctttttcatcagtcttcgataatcctttgcactgtaaaaatatatgtaatgaatgcaactgagggctactgtgctgttattttttatgaatatgtacagataactgaagaaatagtgcagaaatcaattgatgttcttgtaaaagttgtcgagtctgagggttcagcattggcatccactgcgatggaagctcttggtcatattggtctccattgtttattgccttctattaatcgaaattcctctcaaggtaaaatgtgtttcctcgcacttctgatagacgtgaactgtgctactcaccagcttcctctactatgtatttgtttaagctaatttcgtttgtcttgcagctgcacttttaacaatcctgaatgagaagctggctaagctgctttcagaaaatgatactaaagctatacaaaagattttgatatcgctgggacacctatcttggaacgagttgtcatttgcacacctgaataatgcattggacttaatttttagtctttcacgctctaaggtagttcttttgataaattcaaaatttgtggttgaaaatattctgtatttgacaatattctattcctaaatatcattattcaggtggaagaagttctttttgcagccggggaggccctatcttttatatggggggaagttcctgtgaccacagatgtaatactagaaacgaactttgtctccctttcccaggccacaaactatcttactggtgatgcacccgtacttgtctcgagtaactctaataaaggaagtgattgtgaagaagcacacgcaatggctcgagaagaaattataaaacggttatttgatacattaatttatagcagtagaaaagaggaaaggtgcgcaggtactgtctggttggtctcacttacaatgtactgtggtcagcatccaaagatcctggaactacttccacaaattcaggtctgccaatcaataataacatatatttatcattgtagaagtactatatcttaggacaaacaagagtggtgcactccaaagtttacattagaattgatacaccataggttgttgtgtgaattattaatctgtcctaaaattaaaacaatgccagtatgctggacagggcacagaagccaacaactgttaataattgtgtacctttcatctaaaacatgtgcttgcttatagtataattcagagttcctcagaggtttcagctgtcaagctgtcactgaaaaatattaatttcagtactgatacaatcacctatatttagacttgatccatgtgcaagtgcacttctttttaggttttatcctctatggtgtttacgcatttcagttgaagaaaaccagaaactttgagtatttgattctacaaatcgtgcatgcatatactgatgtagtgtagtgttttcagttagtggagtccttgtcttggggtgaaagagtgtcctttaatgttgagctattctcatattcaaactttgtctttttctgtcattatatgtttctcttctaaatgtcttctatcttgtatcattatgttcattccagcgtataacagtttgctctaggtttctgcttaccttttgaagttcattccttttataggaagcccttacccaccttcttggtgatcagaatgatcttacacaagatctggcatcccaaggcatgagtattgtatatgagcttggtgatgcatctatgaaggagcagctggttcatgctcttgtgaatacactgtctggcgcagcaaaaaagaaaagggccatcaaggtgcacactatgtttccagtttccattttgagagaacctggaatacccccgaacccgtacccaaaaaaaaactgttaatgattaatgttttctctgtctgcattagctgatggaggattcagaggtttttcaagaaggaactattggcaataatcctactggaggaaagcttagcacatacaaggaactttgtagccttgccaacgagatgggccaacctgacttaatatacaagtttatggatctagctaactatcaggctgctatcaattccaagaggggtgctgcttttgggttttccaagatagccaagcaagctggtgaggcacttcagcctcatctgcataccttaattcccaggcttgtccgttaccaatatgatcctgataagaacatccaggtattgaactatacgcttacattatcacatatgccatgttttgttttctgatttttgtgttgggtttaagttcttaaagtgtttgtatgctataaccttatgatccttcattgcaccaaagtgagtatgaatcttgttagctatggcctgcaaaatttcagcaactccacagctgaggtcgtatgcatgtttgtaatcttacctagagaattattggtttgttttttccaatagtgtgtagatataaaagtataatgcggtcttcttgttcatatagaatccaaggcagtcaggaagtactacagtgcatcagacagctcagattatctgattttgatcacttaactatttcaaaaatggttcttcctagctaactgacactttgtatttcattctaggattctatggcacacatatggaaattaattgttgcagatccaaaaaaaacaatagatgaacattatgatctaatagtagaagatttattggttcaatctggatcgaggctttggcgttcacgtgaagcttcatgtcttgcacttgcagacattattcaaggtcgaagatatggtcaggtagataatttgttttgctaattttgattttttttaaaaaaaatcatgtaactattttgttttgcataagctatgaataactggtttaggatttattttgagaataaaatattgcttatctttccctttgttaaggtttctaagcatttgagaaaaatatggattaccaccttccgagcaatggatgatattaaggaaactgtgcgaaatgctggtgacagtttgtgccgagctgtaagcttgttgacagttaggctctgtgatgtgtcacttactacttcatctgatgcaaatgaaacaatgaacattgtactgccatacttgctttctgaaggcatactcagtaaagtttcaagtgttcaaaaggcatctataagtttggttatgaagcttgctaaggtatactcattgtcaaattcaaaaaaagttatctgcattaacattttagtggcaattttttgctccactgtaattttctttatgtatgctgctgtcatgaattgaattacacgaactaactgcccgatgttcacagggggctggccctgcacttaagccacatctgtcagaacttgtcagctgtatgctcgaatgcttatcaagtctggaggatcaaagattgaactatgttgaggtatgctacttttcttggtttttgttaagcacggatgggtagtgattttccaagacaattaacagtttctatacctcactcatttctgaatttggaccaaagatgcatgcaggaaatgctggcatccaaactgaaaagcttgagagcttgcgtatagctgtggctaaagattctccgatgtgggaaacccttgatatctgtttaaaagttgttgacaaagaatcactggatcttttagttcctcgtctggctcaaatggttaaatctgctgttggtcttaatacaaggttagttttgatgctactatgaaccttgtagtataattgaaataataaattgttgcttttcatgtacttcaatcttgttgtcattcattttatgtttgtcttatttcagggttggtgttgctagcttcatcaccttgttagtacagaaggtcatggttgaaatcaagccatatgcggcagcattgctgaggttactgtatagtgctgttctggaggaaaagagttctgcagctaaaagggcctttgcatcatcttgtgctgcagtcttaaaatatgccagcccttctcaggctcagaaacttattgaagataccacttctctgcatttaggtgaaaaaaatgctcagttgtctgctgcaattcttattaaatcttatttaagcaatgcagcagatattcttagtggatacaatgcagttgttctcccagtaatttttgcttcaaggtatgtgaacgcatgtagtcttatcttagccttttatcttctctaccattgctaatggtattacagatattaatgtgttttgaagttcactttcagtctatcacagtaacttgaaatgcacatgttctttgaactgtacattgcaataacaaaacttattttcagatttgatgatgacaaagacatcggtgcattgtatggagaactttgggaggatattcctagtagcgaaagagtaaccctacagttatacttaccagaaattatctctcttttgtgtgattccatgtcctcgtcgtcatgggctgggaagagaaaggtgaagcctttatttcattatcttactgtccatacacataaaagtatcatagcttggaatacacttacagtactgtgtgctacttgcagtcagccaaggctataaaaaaactatgtgatgctctaggagaatccctgtctgtgcaccacaataatattcttgaatcacttttgaaagaactacctggtcgattttgggaggtaattagtactatgatttttctatctgtggcttatcagtgaatctttccttttattcatggaataaaacaggatggattgcttagagattttcaaga

SEQ ID NO: 86490 - DNA, 3767 bp, Oryza sativa
gcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatataaaccatggctaaggaactcgaactccttaagtgtgtcttacccgacaaatttgtggccgggtgcattattgcaaaacttcctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacaacgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcactactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatctgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagcttttttccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctaacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggtttaatcattcttgtctcaaaattttgatatgaaagatttgggagtagctgatgttatcttaaacattaagctaattagaggtgagaatgggattactctcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctgactagtgcaactaggcctgatatctcctttgctgtgagcaagttgagccgatttacttctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagaactaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctatcaggaaattaagaaactccggagttataacgttggattacatccaaacagcgagaaacctggcagatccctttacgaagggactatcacgaaatgtgatagacaatgcatcgaaggagatgggtttgagacccatgtgagttatactatggtggtaacccagtctatgtgatcggagatcccgtgaa

SEQ ID NO: 86491 - DNA, 1396 bp, Oryza sativa
gggcgaattcgagctcggtaccctaattcagatcagaacaattgcagttttaattcctttgtaataaagcttagttcttgagcatctgtttttcttcttttcccccatctgctcttccctccagatggtctacaccaggactggcaaccgcacgacaggcgagggcagcaacggcgaagaacgcgctgatggtgtgcaccccaacagtgattctggcaatggtccgccaccacttcccgagaatccgacccttgcccaagttatggcacatcaaactcagatgatggcagccatgatgcagcagatgcagcagcagcaccagcagatgcaccagaggatgatgcagcacgccgaacagcagcaccagcagtttggtccccctccccctcagtccaagttgccagaatttctacgcgtcaggccacccaccttctccagcaccaccaaccccatggaggcgaatgactggctccatgcaatagagaagaagctgaatctcctgcagtgcaatgatcaggagaaggtcgcttttgccacacaccagcttcagggtcctgcgtcagcttggtgggacaaccacatggccacccgcccaccgggtactgaagtcacatgggcagagttctgccgtagcttcaggaaggcacaggtgccagacggggtcgtggcacaaaagaaaagggaattccgggcgctccatcagggcaacaggactgtgacagagtacctccacgagttcaatcgcctcgcgcgatatgcaccagagaatgtccgcaccgacgccgagaagcagaaaaagttcatggcgggtttggatgatgagctgaccaaccaactgatatctggggactacgctgactttgagaggctggtcgacaaggcaatccgtcaggaggaccaacgcaacaagatggacaggaagaggaaggccgctcagttcagggcacatcagggaagtcaccagaggccgcgcttcactcccgggcagcagggtggacctaccaccatgatcgtccgccagcaccgcccgttcaaccctagcaacttccaccagggcaccagtggcagtcaaaactaccatggaagtcagcccaaccgcggtacagctccacgcccaccaatggcaccggcacagtcaggccagcccgcgcaagccaagaaggagacgggagcaaaaccagtgtcacgtcctgataaattcatcccgaaataaaaatcatcttctaaaaggaataatagaattaattaaaattcgaaaagaaattggcaaacactaaaatacgtacaagaaaaattcaaatgtgacccggagaatttttgttaaattctccttggtctaaaaggagccctcaaattttagtggaattttcagagcacaaataataattaggaagaa

SEQ ID NO: 86492 - DNA, 4011 bp, Oryza sativa
ggggggggcgcaagccagtttggggggctccccctagccacctcaacatcgccttgccacgtcggtagggggtcgacgccagagaggctggcgccgtccagttggaccaaaatgtgaaaaatccagtccaaagtaacacgcatgataagtttctgaaagcggcacatcatgacagttccgtgtccgatgatttctgggattatccccaaaaaaaaaaaagcctaaggcccatgtatataaagaaaaggaaaaaaatcttggtaagagataagaaagtgaaaaactctcctattaatatatcatgatatatatttgatcaattctacacttctactccctccgtttcagattataagtcgttttgactttgatcaaaataaaactgattaaaatttgatcaagtttatagaaaaatagtaacatattcaacacaagacaaatatactataaaagtaaattcaattagaaatttaatgaaactaatttagcgttatagatattgatatatttatctataatcttagtcaaacttaaagcagtttgattttgacccaagtcaaaacgacttgtaatctaaaatgaagatagtactattatatatattgtttcatatatttgtggtattttagaaaaatattaagttcaatcacccatacctaaaattctagataagtcactaggtggtttgcagaattttgccatggttcatcttatttgagtctatcttgttcttgaaaaccatctcaggctttcagcaggttcagtgcatcaccaagaaaactcatgcaaggtggtctgcagagttattttccatggattattatatttcagtttcctgttcttgaaaaattgcctcatgttttcagcattttcagcaggttcagtgcatcgagaaaactcttgacgaagaacgaatttatctttatctccggcggcagatgccgcatttactgaagaaaatgcaatcagcgatggggacacgtgtgcctcatgtgcaaataatgtgtaagctaaccaaaaagaaaaacttaaaatggacagcaaattctctgataatctggccagctcggaacaaaatctaggagatgatctcaaattctcaataccacttacgccgaaaaaaaaaagtctttattttgaacgcgtaaaaactttgcacgcgaaaacaatataatattctcaataccagtataccacaatctagcttcacagcacacgactaatcagtatataacttaaacttgctttgagcttttaatctggatgccgtcgttcttacggtggagaatttggctgatatctccccatcgtttgtcaggggattatgcagtcaaaaggacgggttttgcgtatttaaagccgcttgatagccaagcttcaattcagtaaaatagtcaatccacccatcctgtcgtaataatgctggtaattagcttgaaccgttcaattacattggtctagcattgattcagttctccaattgatgatgcttgcgtttctatcttttgctagctttgtggctgttgaaccatgaacagtatctttgtacaggaggaagtagtctctgctgtagtgaactggttctgtcaaaatattctcctttttgctcaggtttttcaaagttctgaatttttttgtcggcatttctaagttaagttcacatgttgtaaatgatatgcttcggagattttaggaatcggagggaagagaatcgaagtaacaatgtactgaactagcattagtcctgatcaccatgacagggcactataaaaagatgggttaattaattaattagtggtgcaaattgatgcagctgccatgcattgaattttgcatttgtcttctcttctgaattcaactgctatggtgttttcaggtcttctcttctgaaacaacattcgcctgagctgcttccttagtcatacagttagttgcaattctctgtctgaacctgacatgcatttcttccacagattaaaattaacaggacgtgtctagtgcttcccggaagtttcagatttcgcatcaaatgtcgatgcatggtgaatttgaatttgtttcattcgatgatcgagacgtatcgctggagatgaagactgataataattaataaatctccacgtgccactaaaatctcaacaatcatagctttgcatgacaatgtcatcagtacactaagagaacagataggatcagtgttagtccggctgctgccgcgagagaggaaaagaagaacatgatgaactaatcagtgattcgatcaggccgtaattatgaacgctgccggagtcgtttctttttctagggacagttcagagaatgagagtgctgatcgatcgatttgacaatttgacaatctgacaatgacaccagtggagaatgaatcgaaaaaaactgaaaagatcgatgaacaaacagtgtatcgacgaacaggtcgcttgatcgctgggaatggacagtttcttgcgcgaggggatcgatgcttacgtgagtgcttccgaatggttggtgccccgtccttgtctcggtggcaatgatcttggactgccatgaaagatttcgcagaaagatgaggaaaatcggtaggagaacccacacacacgagcgtctctgagattcttggtttgactgtctaaagctcgtaggaagctgaagaagcacacagtttcaaaggttacagtactttttatcgtcttgccggtcatcttagttgcctgatgtgacgaacaattcaactggaacaattgtaaacgttgcaagtacaatttgtggagtggagatatatatgctcctcatcatctgagaaatctggagcagaatcgatcaaacttgacatcagccgttcaggtatcgccaaagtaagtacagcatccggttcagtttcagtgatgtcagtagccaattctgctttctgcactgcaaaagagaaaagtccactttatttttctttttgagcgggaaaaaatatctactttacgtcgtttaaatgggggtccagtttcaattacatatccctcaaccgtaaagccgaatatagtgtatccctcaactaccaaaccaatccaaatcaagtccccaaatagtactatgagcggtttcgattcatataacatcttattgacctagtcttcatcccatataatatcgtgatgatattaacatggcactaaaaaataaaaataaataaacaccgatgaacaagatattacatgggatgaagatcctgtagttcggttaacgtttaagtggaactacaaaaagttgctgtggtctagtagttgaccacagacggtcttcctgtaaggcgtactccagaaccgctaaaatgttaaccgacgagatagaggaattgaatactctggagctcctctcctttcacagctgccaataaatgagttctgctccttccatagttgccaagaaaccaagaggactaggaagtcgaagcccttacgaagatgcttcagcaggcaattcctagaagtcggccaccaaacctaaagcgtgcaaccgcgggaaggagcgaggtcaggccagccaagtgaagacagcacatggtgccaaacctgtcgaacgaacacacagtcgatgaggatgtgactcgttgtttcaaggagcgaacacaacgcgggaagaagggaatgtcagtgacatggggtttcatttttttcccctaattgtaagtacaagataggcgccacgtaggacacaactggatcaacacgccacatcagccgtcatcaaaaactaccgaggaacgtaggttctagaggttgaatgtgcttcatagttgagggatgtgactgaaactcgatacttaaggacctaaactgaacttttccactgcaaaatgcaagcgaactgggccgagagtggcgaggttgggctgggccggaggcctatgtaggatggcatgtacagtaataaaccctacatctaggggcttttccggaagggtcgctctataagtttgcaacaccccagctagggtttccatccacattccacctg

SEQ ID NO: 86493 - DNA, 6470 bp, Oryza sativa
aaacagtggagaaaagttccaggaagttggaggatattcctatagtacaagagtatcctgaggtgttcccagaagacctcactacaatgccaccgaagagagaaatcgagttccggatcgatttggcacccgggactgctccaatttacaagaggccgtacagaatggcagctaatgagctagcagaggtcaagaagcaggttgacgaacagctgcagaaagggtacatccgaccgagtacttcaccttggggtgctccggttatctttgtggagaagaaagacaagaccaagaggatgtgcgtggattatcgcgcccttaatgaggtcacaatcaagaacaaatatccgttgccaagaattgatgacctgtttgatcagctaaaaggagctaaggtgttttccaagatagacctacgatcaggctatcatcagttgagaattcgggaagaggatattcccaagacagccttcaccactcggtatgggttgtttgagtgcacggttatgtcctttggactcaccaatgcaccggctttcttcatgaacttgatgaacaaagtgtttatggagtttcttgacaagtttgtcgtggtattcattgacgacatacttatttattcaaaatcagaagaggaacatgagcaacatcttcgtctggtacttgagaaattgaaggagcaccagttatatgccaagtttagcaagtgtgacttctggttatcggaggtcaaatttctgggtcacgtcatttctgctcaaggcgtggtagtggacccatcaaatgtggaatcagttacaaagtggaccccaccaaagacagtttctcagatccggagttttcttggacttgcgggctattaccgtcggttcatcgaaaatttctctaagattgccaggcccatgacacagttgctaaagaaagatgaaaaattcaaatggtcagctgagtgcaaccaaagttttgaagaactcaagaagaagttagtctctgcaccagttctaattctgccagatcagacaaaagacttccaggtctactgtgatgcatctcgccaaggattgggatgtgtgttgatgcaagaaggcagagtggttgcatatgcttcgcgacagttgcgtccacatgaggccaattatcccactcatgaccttgagttggcagcagtggttcatgctctgaaaatctggcggcactatcttattggcaaccgctgtgaagtttacactgatcataagagcctgaagtacatcttcacccagcccgacttaaatctccggcaacgaagatggctggagctgattaaagattatgacatggggatacactatcatccaggcaaagcaaatgtggtagcagatgctctgagcagaaagagctattgcaatgcagtatgtaccgaaggcatgtgtgacaaattgcagcaagatcttgagcacctaaatttgggcatcgtagaacacgggtacgtagctgccctagaggcccggcctacgtgtcacgtcctgataaattcatcccgaaataaaaatcattctctaaaaggaataatagaattaattaaaattcgaaaagaaattagcaaacactaaaatacgtacaagaaaaattcaaatgtagcccggagaatttttgttaaattctccttggtctaaaaagagccctcaaattttagtggaattttcagagcacaaataataattgagaagaaataaacaaagttgaaaaggtttataaaaagaaaaatctctaaaagtcttcttttccccccccttcctctcttgggccggctcggcccaactctccctccctctctctcctctccccgcggcccatcggcctcctccccgcgcgcgcgccgctgacaggcgggcccgcccgccgccctcgctgacgggtggggcccacctgtcatcgccttcctcccgccgctcccgccgctcgcccgtgccctagcgccgccgccgccacggattccgccgcatcccgccgtccccgcgcgacataatgaggggggaatcattccccgcgatcccctctcccgtttccccctcttttccctctctctctccctcggattcgtccgatttgaattccgcaatcgtcgccggcgtcttcaatggagccgagatctccgcgcccgtttcctccctctccggccgcgctctccccctctcggcgctatatatttgctccccgtgcctccctcctccgtttccgccgttcgccgcttgctctcgccgtcggattcgtgctcgcgacgtccacctctctctccgccgtcgccgccgacctccggtacgccgccgacgtcgctccgggctccctcccgactcggcgtcacctccgtcggcttcgccgcgtcgtcgtcgaccccgtccgctccttcgtttcgcccgccgaccgccggagcaccgtcgccctcgtcatcccgaaccgcgccgccgcgttcctccgctccgttcgtcgtctccgccgtcctcgtgtctcggggtgagccgtggaccgtccctttcgcttccctctcctctccgctctctcgggcgccgctccgccgcgccggtggtcgccggcggtgaccatcggggcgcggtcgtgccgcctcccgtcggccgtgccggcgaggccgccttcgggcgcgccctcgcggctgccaagtgggcccggccgtcagccgcccgcgcccgcgggtgcggctgacgcgtgggacccacggcgccgaccgccgccagccgcgtgctcccggtccaccgtggaccgagaggctgacgcgtgggccccactcccgtggacccggtccgcgcgccctctccctcggctgacgcaataaacccggtttttaattgaaatttaaatgaagaaattcgtaaatatccatttaaagagcatataaacttcaaatggccatatcttggccatttgaactcggaattggaccgttcaagtctctaatttttccttaagaagtcaagaacccatttttgtgctttgttcctgcctgttgtatggagtttattagagtaaaagccttttcttttccgttggtcgtgtagacgctgcagcttcggaagatccgctcttcgtggaagttgaagccggcgtttgggaaagcgagcaaggcaagtcacatcatccttgagcatattgaatcccagtttataaaattattttgatttaaattattgcattatcgctttgtttaaattcccgcgttatcactgttttatttagccatgcctatttacctttgttatgacattattattgctattgttattattaccttgttcaccctagaataaacaaaaccccaactagtgggtactctattcatggttccactagtataaatttaggtggatgctttgctgaataattaggcaacattaggtggtttcataactttagactttgggaattctcatatcatttggacactatggaattgttggattatggtggaattggacatacacctctctttctctttcaaaacccctaaaacctgttttcggtggggtttgggtgcatgccagttatgggaagtagcaccccggccactataaggattaagctcgggcctctgttgcaaagcactaccgtactaaccacatgtctaatgggtaaggcttaactcggtgctcagtctagtcctgaacaaaaggacacggatagagatggatgaagtcgttgcgacgatggatatctctgaggcaaatgaaggctacgcgagctgcggctcggtagtcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgaggggtcacggccttgtttaataatactgtgtagctctaggatcgtctttacaaaatggctttgggcaactaagtgacttttaaatgctgtttactgcaaaacctaacccctattattatccccttgtacccccccttgcattaatcatgcatccccggcgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacactacgctcgtggatcaagtcagagcagctcaagtaaatgatcctgaaatagctgagctgaaaaagaatatgagggttggaaaagctcgagatttccatgaggatgagaatggcacaatctggttgggagaaagattgtgtgtgcctgacgacaaagaactgaaggatctcatactcacagaagctcatcaaactcagtattcaattcatcccggcagtactaaaatgtaccaggacctcaaagagaaattctggtgggtcagcatgagaagagagatagccgaattcgtcgcactctgcgatgtttgtcagcaagtcaaagcagaacatcagaggcccgcaggactgctacaaccccttcagatcccggaatggaaatgggaagaaatcggaatggatttcataacaggtttgcccagaacatcgtcggggcacgattcaatctgggtggtcgtggatcgactcaccaaagttgctcattttattccagtacacactacctatactgggaaaaggttggcagagctttatctttcaagaatcatgtgtttgcatggggtacctaagaagattgtatctgatcgaggaagccaattcacttcaaaattctggcagaaactgcaagaagaattggggactcgtttgaatttcagcacggcttatcatccgcaaacagatggtcagaccgagcgagtaaatcaaatcttggaagatatgttgagagcctgtgcgcttgactttggcggagcctgggataaaagtctgtcttatgcggaattctcttacaacaacagttatcaggccagtttgcaaatggcaccgtttgaagcattgtatggccggaagtgtcgtacgccactcttctgggatcaaacaggtgagcgccaactgtttgggacagaagtgttaactgaagcagaggagaaagttaggaccgtcagggaaagactgcgaatcgcccagtctcggcaaaagagttatgctgataaccgccgaagagagcttacttttgaagcaggggattatgtgtaccttcgtgtcactccgcttcggggagtacaccgcttccaaaccaaaggcaagttggcaccacgctttgtgggaccatacaggatcttggaacgcagaggtgaagtcgcttaccagctagagctcccatctaatatggttggtatccacgatgtgtttcatgtatctcaattgaagaagtgtttgagggtacctgaggaacaagctagctcagagcacattgacatccaagaagatttgacctacgtggagaagccagttcgtatccttgagaccagtgagagaaggaccagaagcaaggtgatcaggttttgcaaagttcaatggagccaccactcagaggaagaggccacctgggaaagagaagatgaattgaaggccgcccatccgcacctcttcgccagctcttccgaatctcggggtcgagattccgtttaaggggggtaggtttgtcacgccctgaagtacccctcccttgctctaaattcataaaataaatcgtccgaagaaattgtttaatttaacctagagagaaaccctaaagtaataaatgcaaataataatcggaatcggcatgtggaatttttcttggattctgcatgtcaaaatacgctaacaggatttttagtggaattttcagagccttggaaataattttaaccaattaaaataagcaaagtgcaatattaaatccctggaaaa

SEQ ID NO: 86494 - DNA, 1685 bp, Oryza sativa
cagcccggggtgcagttctacaccggcaacttcctcacggccgacgtgaaggggaagggcgggaaggcgtacgggcagtacggcgcgctgtgcctggagacgcaggggttccccgacgccgtgaaccaccccaacttcccgtcggtgatcgtgaggcccggacaggtgtacaagcacgagatggtgtacaagttctcgttctagtttaggtgactatacatggatcatatgtggtcattggtcgatcgcttcatctgctgtaagttgtgacattgtcggtgtcggtcggtgcaataatatgatatgcgttgatttgcaataagacgcatgggggaagaaaagacgagaatttttcactagccagttcagtctcatagagaagttgcggcaagagaaaagcccgggattcttccggcttgcaccataatgtggtgggttagttgcggacttataaaagtttttccatacgagagccacttctctcatacccaaagttttacggaagagggctagctacttaccattccaacgtaataggttatgtgtgctgacttcaacacaatgttagtatggtatcgtagataacagatatggtattattggtatcagatatgaaccgttataccagacacaatacttatagatatcagactttgatacttacatatcataatgacatcgatgttttagcatggtaacgtaggtaccagatttttttttgggagggtacaaatcaggacacacacgaacacacaccacaacacacgcatacacacgtgtgcgcgtccctaacacatactaggattgagattgaaggcactaggcctcagtgcacgggaaatatgcaaccactgaatgcgcacgcgcgtgtgtaccattatacctaaccgggaccaaccaaagtcagtcccgggaaaagagggggaaaaaacccgggtgagcacgagcgtcgaacttggggttcgaacgctcgtgggcaatgtgcccaccggcgtcgctaaccatccaaacaaatgctcgatctcacgtaggtaccagatttggaaccgtagataccagtgttaacaaccaaatttggtaacatctgtgtcaggaaagaagattggatcaaagcaaagtcagaggcggagatcgattcgagaacagagcaagaatcggctggagcccagatcggctacgattagtatcggttaagtccaagtcagactgggttaagtgatgcagccgattccgacaatacgacttgtattcgatatcgggtttgagttgacgtacttcaagatgattgccatacatggataaagtcctgggaaggcaattgtatctattaattatgatattttatataaattttttacagataaatatgggcaaaagtttgccgcaaagacttatggtatcttagagtttgttagagataatagtcgtgtccggtatggacatatcttgtaattctcgggtataaatagaccccgagccctatgtaatttttaacacacacgttcaatacaatttcggcgcatcgccaccctttttgctttagttttatttcgatgatttcttgctttcgggttgagttgcatcggtttcgatcttccacaagaggtaaaacttgttatgacggcctgtgttctcgggattagggcctccatctttatgataccctaatcttgtttatgtaattc

SEQ ID NO: 86495 - DNA, 676 bp, Oryza sativa
cttcaactgcttcgagcccgggcactttgcggataaatgcccgaagccaaggcgtcagcaaggccaagcgcctccccgccccaacaacggtggtaaggatgtcattcagggtcgtgtgaaccatgtgacggccgaggacgtgctgacaactccagacgtcatcgttggtacgttcctcattcattccatccctgctaccattttgttcgactctggagcttcccactcgtttatatctgtgccattcgtggggagaaatcagttgggggtagaaaggcttagaaaccctctgctcatcaccacccctggagaggttatgacagcaaagtattatagccctgccgtccctatagaaattcaggggattccttttccctcggatctgattctgctagacaccaggaacttggatgtgatccttgggatgaattggttggctcaattccaaggagtagtggattgcgcgagacgcactgtcactctgtaccgagggccggagcaaccggttgttttctttgcacccccaacctctgtcaatagatcagaactgcatcagataggctgtcagaaatccccatcgtcagagagtttggagacgtgttcccggaagaactacccggtatgccgcccaagcgagagattgagttccggatagatcttgctccaggaaccaccc

SEQ ID NO: 86496 - DNA, 2415 bp, Oryza sativa
tagtgatgtcaaagccgaagaagtttccagtcagagcaatgtggcttttgctgaagatgcagttcaagataaggtaataccaagtgagccaccagaagatatacgaccagtgaagaagttggaacaagaagaaactaaggaagctgatgaagcttccaacgaaacgaactctgctatcttcagcgacttaaatcaagaagatagtatcgtggcaagtaaacaacttgagacagaactagcagaagaggctgctgcctttagtaacttagatcaagaaggtggtatagcagacagtgaatcacaagtggcagacctagaagaggcaaaggaaattgaagccactgaaactgaagaaatcacccaccaaccccctgctgctgtttccacagaactgccaaaagaagataattcaacaagaagtgagccacataatgatgatattcagcattcgctggaacaagattcaattgaagtgaaggatactgaagctgctgagattcaagagatctcccaagaaagaactattgctacttctaaggaggatgctgtggaagatgatggtacagcagaaggaccaacctgtgtttctcaagaagtacaagatgtagaatcagaagaagtcaaggacaccgaacctgataatgttgtagaagcatccgatgtggtaactgtcgatgacgaaggacaagaaaacaatgtgctgacaagtgagaatattgcggaattgcaactgcagggtcttgaatcagaagaaatcaagagccctgaacctattgaaacagaggcaggtttccatacaagccatgctgctccctctaatgatccagttgaagtgaatacaacagcatgtgagacacaggacacggagtcagcagaagaaataaaggaaaccgaaggcactaaaactgaatcaattccccaggaaagcaacatttctgtttctgaggaatctaatccagaagatagtataacagcaagtgaaacaatttccaacactcaagaactaactattgcaggatcaatagaggccagtgaggacaacatagatacaaaaactggagaaatcactgatcaaagtaatgaggtttttgctggggaggcagctcaaggagataacatacctgaaagtgtgtcaactgctgatacacaatcaatgcaggagctggaatcagaagaaatgaagaaacctgaacttgttgatttgagtggaacatttcatcaaaaggatgatgccatctctcagaagcaaaaccaagaagataatccaaccacatgtgagacgaatgagattggatcaaccgaagtgagcagtgttgaagcctctgaagatcaagcaattgcccaccaaagtaatattactcaatgtgaggagcaagcaacagaagaaagtattacagaaagtgaaccacaaattttggaaatggaatcagtccaggatatggaagacactgaagctactgaatctgaactcgtttcagagcaaaacattgtttctacttctgaggagtctgttccagaagaaaatgctacaacagaagaacctgcttttcatgacagagaaatacaaaatgatggagcagaattaacagagcaacatgatagtgtgaaggccgaagaattacccaaccaaagcagtggggctattgttgaggagacagctcaagaagccgatttagtagcaggtgagccaatcgatgatgtgcaagaaaaggatcttgaaccagaagaaataagtaacactgtagatggtgaaacaggagaagcttcccatcaaacacatgctgctgttgaagataattggacaggtgaggtagagagcagtgttgaagcctctgaagatcaagcaattgcccaccaaagtaatattactcaatgtgaggagcaagcaacagaggaaagtctaacagaaagtgaaccacaaattttggaaatggaatcagtccaggatattaaagacactgaagctactgaatctgaaaccattttccagaaaaacattgttcctacttccgaggagtctgtcccagaagaaaatgctacagcaaaagaacctgcttttgatgacagagaaatacaaaatgatggagcagaattaacaaaggaacatgatggtgtgaaggacgaagaaatacctgatcaaagcagtggggctattgttgaggagacagctcaagaagccaatttactagcaagtgagccaactgatgatgtgcaagtaaaggagcttgaaccagaagaaataagtaacactgtggatggtgaaacagaagaagcttcctgtcaaacacacgaggtagagatgacagaatcatcagaacagatgaaggacactgaacctcctgtacctgaaccagaatcatcagaagagatgagggacactgcaccaactgtacctgaaccaacactccaagatag

SEQ ID NO: 86497 - DNA, 765 bp, Oryza sativa
ttgtttgaagttgtcatattttcaaattcaaatttaaacggttcaaaaaatattatatagaaaaatgaccaaaataaaagttatagatcttgatgagttatacaactttgttattgatgacattttcagttgaagtcgttcactaacaaaaaattctgtttgaatttctcaaactttgaatttcaaatttcaaattgtttaaatagagtcggatggagaaatgaccaaaataaaaattttgcatctcgatgagctctacaactttggttttggtgacttttccatttgaaattatttattaaccctaatttttgttccaagttgtcaaattttgaaaattcaaaatctgaattattcaaatgaacttatttgtacaaaggaccgatacaatagttgtagatctcggtgagttatacaattttgttgtttaggatttttgatggttgtgtatgtgaatgaatgtatatgaatgagggatgttggggtgtgacgtcctagcctagggcttaataggattaatagaatactcataccgacaagttacaacttctcttccggaagctgatctccaaagaactttgatgttaagcgtgcttggcggcctgagagaggctagacggcatgcctaaaaataaaatttattttttttgggattatactcatctgtgactggcattaacttaggcccgattgagatgactcatctgtgacgggcattaacttaggcccgattgagatgactcatctgtgacgggcattaactta

SEQ ID NO: 86498 - DNA, 8051 bp, Oryza sativa
cctcccagagtgtgatcaggcaggcaactatggatggctgttacgagttcaatggcttcttccacgagtacatgatctcgcggccagtggaagaaagaattttgttgccactagaagtctctgtactggagggctattgctggagactaaccacaaaaggcgacataggacaacacaggggcgaagccactttgggcggcctgggtgcccaggcaccccccggattcctaaaatttcttagagatgaacaaattttggccctttaggcacccctacagcccaataggaggcacccccaccagaccttgaatcccacgatgccacttattcagcccacgacgcatcagctgcccaactctttttctcctcacgacgacttcgcgagacgtgccgtatacaccgacgcagcgacgcatcgactgcctgcccttcctcccgactcccgagtcgcgacgccgacgcccggagcgagccgctgcccacgaagacaggactgcacgaagacgaagccgctgcccactaagacgcatcagctgcgcgtgcgacgatcgtggctgcctgcctgcctcgccggcgttcgacttcgacgatcgacgttcatctgatcatctcgccgatctcgtcctcgtcagcgtcaaagactcaaagagccgctgcctgctgctcgaccaactagagtgagtgttcgtcctctgtcctcaaggatcatctcgccgattatgtgttagctatactatttgcttgaacatcacaaaagacattatagtcttgataaagttaggcaccccccacccatttgctctagcttcgccactgggacaacacctagccatttggaacagctgggacaggaacaagactctgttcgacagcctggacttgttgaggctacggtctttaacggtgtttggtccatgggagtcattcttcatctccaacaagatgggagtgcttcgtgtgctcgacctggaggatgcatgcgatgtaactgatgttgatgtcgagaatattgggaaggtgctacatcgcctcaagttcctatccctaagaggacacaaaatcacttatctgccggattccttcggtgggctgaggcacctccagactcttgatatcagatgcacctccattatcaatcttccaacaagcatcaccaagctaaagaagctgcagtatgttcgtgcaggtaaccctgtacctgtaccactggatgatgataccagtactgatggaatcctacgattacgaccaccgccaccagaagcagcatcagcaacagcttccccatcattatcagaaccgtcgacgtcaatgagcaggccacatgctgcgcttttgtagaggcattttgcaaattgcctctaagatcaggagttttatagcgtagagacactttatagaggcactttcaaaattgtctagaaaatttttactctagagacactttagaaatattttcagcgcattttattatattttatcttgtagaggcattctttcggcactttaaaatgtgtctaacatgtaaagacatttgcttgagacactttaaactctgtagagacacttcttacaaaaaaaaatatactaaatggctaaatataagtagcttaaggcataaacatatacaacgaatgacatgaggttgagttggttagtgccttgaagataagaatgatttgatcaagaaatcacgagttcaaggattggcaaaaacaagggaaaatattttattctcatttttacattggtttcatatggttgtggtacaatttaatgtctctagaaaatgcctctaccaccttatagacattttataaaatgcctcttcgtttatagagacaattcaccataagacacttattagacatttttaaaaatgcctctatagtattgtaaaggcatttgaaaagtgtctctatagtactagaaaaatgtctctacaaagcatttttgttgtagtgatgcaactgcggtgtcccgtttattcgagttgcgggagacgtggacaagccggcaccgcggccagcagcctgctgttgctggcacctgcaatggtggaattgtggtgcccagagggattcgaaaaatgacgaccttacacactctgggtgtcatcgacgtcagtgttgcaaagaagggccgagctattctggaagagctcaagaaccttacccaattgcgcaagcttggagtatctggcatcagccggagaaactgtcgggagttttgttctgccatctctggtcacgcccacttggaatccttgtcggtgcatctcaataaggagaacaatcgaggctgtttggatgctatctccaagcctcagagaacctaaagagccttaagctgtacgggtatgcagacgacaagctgccagagtggatcacgctgctgcggaagctcagtaaattgaatctacagatggccatgttgccgtcaggtgatgggctccagttccactcaggcttcgacagtctcgtgatactcaagatttcctgcagccccagtttacaggccgtaacgtttcactctggagtaatgcctagtcttgagtgtctgaagctccgttgctgtaatgtctcatcgttgaggctctctggattagaagcactaaccggtctcaaggaagtctggttcggtggatcctatagagaagcattcaagcgagagctgaagagacagattggccagcttcccagggaaatgaaacctgtcttgaaggaggagcaacgcttgccctgaatcctgattggggtgcactgcacgcagctatgcgtgatagtcgtcgcctctactgtcccaggagcacccacaggattacacgagtgctgttgttcacttccttttcactacgactctgtccagcctagcttctcgaccactggaatagggatagttgtgtatccagcgcacatctctagctgtaattgttgttagttgatctgttgatgtcactgaacactgaaatgctatgttccatgcatgccccttttcatttcattgtatggatgaaatggactgcatattgcctggattagcaggtggattgattatacaccgtagtatgtacagcacagcacattcattctacagtctgaacttactgcgcacctggaaatggcacattgctatggcaattctatgatcgaccttagtacttctctatcgagggcattgctgataaccaaatgattgtggacaaatcctgtctggggagctcatctcttgcttcatcagtgggacttcacaggatttgtgcaggagagacgtcgtggctaatgtcatcactacttgtgagaccccttgatttttgcaaacggagcataactagcggcgtctttgcatgcgtccccttaagtggcccgtacggaaaaatcgattttcccatacgggtcttttaagaggaccgcatgtaaaaatgacacttaagcgcccgtatggaaaaattatttttttttatactggccacttaagaagccgtatgcaaaaataaaatttcaaaaatttaaaactatgaactccaaattagatgattcttttttctaaatatttctaaaatcatgctctatcatgttattgtgttcttgctgctattattttggttattttttcttgtgactttgttttatcaattaaaattttaaatttcaaaactttaaataatattttgaaccagtaattgatttcaactgaaaaagtcatcaccaacaaagttgtataactcatcaagatctataacttctattttagtcatttcttcatccgacaaggttatttataagattgttaataaaatgtacatctctcttgtagttttataaactttataagagatatgtgcatttttgtgaacaattttataaatcactttatcggatgaagaaatgaccaaaataaaagttatagatcttgatgagttctacaactttgttattgatgactttttcagatgaaatcatttagtatttgaaaatgttgtttgaagttgtcataatttgaaattcaaattcaaactgttcaaacaaagtcatatagaaaaatgaccaaaacaaaagttgtagatcttggtaagttatacaactttgttgtttaaaacttttccatttgaaatcatttattgctttaaaatattatttgactttcttatattttaaaatttaaattttatatagctcaatcaacctcggatggaaaaatgaccaaaagaaaattggtagatctccacgagttgtacaactttgtttttgataactttttcatatgagttcatttaatatgataaattttgattcgaagttttgatattttaaaattaattgtttttccctcctcatcccttcaaattttttcatcaccccttctcactcccctgtctagatacttttaccaccacacactctctctctctctctttctatcctttcccctcactctctctttctttccaactctctttctctcctctccactcctcctcgagcacggcggtggctagggcggcttggcccggagctagcggcggtggcgacctcgggcggcggcgccaccgccatctcctcctcaccgccgccgccgccgacgaggaggaggtgacgggccagatccggcggcaggcgacctcgggcgacttgaggcagcgacctcgggcggcgacgccaccgccatctcctcctcaccgccgccgccaacgacgacgaggaggcgatgggccagatccggccgcgccggtcctcgtctcgcccggatccggaggcagcgggcctcgtcctgcccggatccgacggcgaccttgggcgaagagtgccgcggcgacctcgggaggcgggagcggctggcagtggaagcggcagagggcggcggcggcagcgaggcgagcagcggcgggagcggggtgggcggcggcagcgagagcggggacgggcggcgggggcgggaacgggggtgggcggcggcggcgggagtgggggcgagcggtggagccgggagtggggacgggcggcggtgggagcgggaacaggtggcggcaggagcagccagcgagctcgggtggcggctagggtttcgttttttcttatttttcgcatgcgggtgccctggccgcatgcaaagatggcgatctttgccgcatgcgaaaatcgttgccggccgtatgtaaaaacgtattctgtagtagtgcatgctcctcacactgaaacattttattttaataaaaaaactattctttcttgaaagtagtgaaaaaactaatcccagccgtgataattacactggtgtaacctcctttggctaatatacatctaaagtatgtagtgaaataactaatctttctcaatacggtaatatgcctgccatgtcatcaaagaaatacagaccatattcaatttatattttcagcaagaatcctagagctgaagccattacagacacggcctaaggatagacaaacgcggccttgaatgattaataatttttgttttgtttgtagaacacaaagatatataatggactaaaatgcatttttgttctcttcaatgaaagggatgtatggcctggcatgtaaaacaatgagaaagtgcggtaacttctaagtaaaagggagccaaaatttattatagccaagtccatgcaagcacaccaagtcatggccctcaatttgtaacctattattgacaatattgagtatttccatataacggaataatttgttcaggaggggttcaatttagaaggaggatcgaattacagaattcgaatcctgagggatttaacatttggcaagatttgggattcacccggatggatttagtcaagatctttggtaaaaaaaaaaacctaaatgtactcaaagaaacacatgttctattgtgcgggctgggctaggcccttcaaggacgaaaaccagacttttccgtgaattcttttaaaataaactctttttacgattttagtttgtaatagggtttagatggcaaattcccactagcctttatttgtagaacaaatacaaaagattatttcttaaaaaggattttcatatattaattaatattagattttgtttataaaataacttcctccaggaattatccctgaagggggttttctttaaagattcagtaattgtagacattcgtaaaacaaatacccaaaaggggttctaaattatagaaaaagagtttttaggaagataatttatatttacaaatattttattattttataatcatggttcctttagtaaataatattttaatccaaattagattttaatttccgtccttgtggtcaagcacaacagaaaaaagaaagtaagatacaataaagaaatttggaaaaagatttttgactattccgaatttttttcatatttcaaattcaaaattttcaggtgttacaggtccccacgcgccttgtgagttgcgaatggctgaggccaatcaccggtcggacacacgctgcccgtgccacaagaaaactcggtgctagacctcaaatctttagaaacagatctcctgaaataactgtacatgcagttatgtcacttataaattgatctcactttactataattcacatgtaaatatctcaactgcgtagtagttaagttaaagtatcctgttcctaaaatgttgtatttcgttcatagtacaaactcaacacttttgaaacccaggtcaagggtgaagacatcactattagaaaaatcgttttttcaggcggcccaaaacagttttcacagacagagagaaggaccgtcggttcactgtcgcctgtcctccatcgccttcagccgcgcctcctctggctccggttgaccatccagcaggtcggaccggccgctgggaacacagtgacggaggaggaggaagacgagggatgtaatggctagcagcacgaaggcggcgagcatgaggaagtacccgaggacgacgtaggacgccgcgagcaccgcgcaggcaagcaagcagagcgagagggcgctggttatcctgatcgcggcgactaggaagaaccaccggttggctgtggcggcgacgttcacggccctcttcgacaacgtcatcgccgacatgccgacgatggcggtggagaacatgaagaagatggagacgtagatggccgtgaacctggtggttgcgctcactagaacagataccatcatctcaatcgggcggcaacccccatctcaatcgggcatggcgtccgttacaggctagaagtcactgatgtgaaaagttatctcaatagggtaaacggccgtcacagatgaacctatctcaattgggccataattaaagcccgtcaccgatagttttgacccagacgatcagtcaaactatagcccgtcacggatgacctatctcaatcgggtctaaactatagcccatcacagatgacccttatctgtgacgggcattaactatagcccgtcacaaatgagtcatctcaatcgggcctaagttaatgcccgtcacaaatgagtcgtctcaatcgggcctaagttaatgcccgtcacagatgagtataatcctaaaaaaaataaattttatttttaggcatgccgtctagcctctctcaggccagtcttttttgtccttactcgtgtgcacctgggaagaacttccccctatctcaatcgggccataattaaagcccgtcaccgatagctttgacccagacgatcagtcaaactatagcctgtcacggatgacctatctcaatcaggcctaaactatagcccgtcacagatgacccttatctgtgacgggctatagcttaggcctgattgagataggtcatccgtgacaggctatagttagactgatcgtctgggtcaaagctatcggtgacgggctttaattatggcccgattgagatagggggaagttcttcccaggtgcacacgagtaaggacaaaaaagactggcctgagagaggctagacggcatgcctaaaaataaaatttattttttttaggatcatactcatctgtgacgggcattaacttaggcccgattgagacgactcatttgtgacgggcattaact

SEQ ID NO: 86499 - DNA, 1994 bp, Oryza sativa
tgttgcaagttgcatgctcaccgttaattttctctcctttttcctccatctttcaattatgtacttatcaggaatcttgctcattttcagatacaacatcactttcaaaacatggctgcataggattccatctttggagaactttgcacatatgcacacgaagttttcttgtggtaagtctgtcatcacaacatatcttcttggtctgaattcttgttgtttcagatttggcgctgcatatacttcatatgcttttccttgttgtatagctgccacttctagatttagtgttcccttcaattcatcttgaaacttatcaaatatcccatggttgtataggtctgctgcttgttcttctatcatgtaatttgaccaaaaagactttggcttcttgtttctggattcataatctttcccatactcagtgtcgaagatgatgtcattgattgtttcatattccagtagaaaagtcatgacactatgtgttgggccaactccccttttaaaccttgcatttgtgccctcactaagtgctgtgctatgtataaatgggcaaaaatctgttttggaatacaccggtataaaattcttccttgttctccacattatttccagatatttgatatttttcaagttgtactgtgcaatcatttgcaaccataggctttcaaattcagctcttgtcaagctattgtgcacaatgtcattaaattctgcatagagatctttccttctcttgtctgaaaatgtatttcctgacctttctctacatttcttcaaaatgtggaacaaacaatttctatgtttgctgtttggaaatacttgacgtatagctgccctcattgccaagtcttgatctgttataattgtttctggatgttttcctcccatggctgttaggaacgtttcaaaaacccatttgaaagtttctgtagtttcatctcctaaaaatgcacatgcaaaaatgcatatgtttccatggcctgtaacaccaactattggagcaaatggcatattatatctgttagttttgtaagttgtgtcgaaactcacaaattcaccatattgctcatagagttgtgttgacctcccatcagtccagaacatgctcttaactttgttattctcatctagagtcagcttgtaatagtagccaggatcttttgcttctttttgccttagatattccatcacttgattcatgtcagtatttcttgtctctgagttaattgctgttccaacattgctgacgtcttttccggtatatggcagtgctgctatgcctcctctgagaaatgacaatattgaaatcatatttctcgtgggtatgttgcattgtttcaaagtccttatcaactttttctcttcatccgtcatatgtttgtgtgatctgaggaactttgcttctctattgggtgtgagtgtatggttatggttgagattcatgcttagtattctccaaacatcaccatcaagcctcactgttagcatgcatttgcaatcagttctgtcaatcacctgtgtattcctctgctgctgagttttcttttttttcttcttctgaccatcatcattcttaccatacctgtagcactggtatgtgtacttggtgatctgaccaaatctttttttgcttgtagatttgtagtggtgtgtgatgactacagaaaatcccacttgatatgcatagaagttgaagaaactacgcgcttcttcatgagttctgaatttcttgccaatgcaaggtatgtgtttcttgtcaattactacaggagtgttatcttggctatcttcttcattagccaagtagttgttaatgtcttcttcattgatagtgtcattgtcctctgctgaggtagcttttgtctcacttgttgtttctgcttgcccaacatgttgctctacttgttcaattgctgtgattgtattgatttgggaatcttgctgaagcatgtttgaagtcccttcctgaaaattttgttcaagtaatatgt

SEQ ID NO: 86500 - DNA, 973 bp, Oryza sativa
ttatgccgccgttgttgggcgtatacgtcttcaccgacggctttgccttcgccgccgccgactggtgtttccgcctgcacggctggcttttatgccgccgttgttgggcgtatacatcttcactgaccggcctgccttgtccgccgccgactggtgcttccgcctgcacggctggcctttatgccgccgttgttgggcgtctacgtcttcaccgaccggccgcctcgaccgccgccgactggtgtttccgcctgcacgtctggcctattatgccgccgttgttgggcgtctacatcttcaccgaccggcttgccttcgccgccgccgactggtgtttccgcctgcacggctggcctttatgccgccgttgttgggcgtctacgtcttcaccgaccggccgcctcgaccgccgccgactggtgtttccgcctgcacggctggcctattatgtcgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcactgaccggccgccttgtccgccgccgactggtgcttccgcctgcacggctgacttattatgccgccgttgttgggcgtctacgtcttcaccgaccggccgcctcgaccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggccgccttctccgtcgccgactggtgtttccgcctgcacggctg

SEQ ID NO: 86501 - DNA, 5550 bp, Oryza sativa
gcaggcatctaggttatgagtaggtatttaaagggtcatttaagaaattattatcagatcagaaccagggttccaaatcctagtggtaactggtaactgttcatttaccagaattaggcatgtcaaagttcctgtggaagcaggcttgcacgtgagaaatcctcaaattcctatggaggtggtcagcaggtcagggatgaactctccacatgggaacccgctgatatggttttaagatttctctaagcgttggtgttagcatacactatgtcggtttatctattccttgtcccgttaccacgcctgaatagaattcaactatgactggctttagttaatttatgtggtgtttcagaagaattcaagaagcagagttttttctctctagtgtgtgtagatctatggtacttgaaaaataaagggaaaacacacacacacacacacacagaaaaaaagaggaaattggaagcattgcactagaatccagagggaataatcaggtagtggcttcctggtgtgttccaggatttgtctgcattctgagatttgggactctggttatatccatagcctttggtctcataatagttatatgttctctctttagaaaacaaaagttttctgtcattgtagtgtcagatggcatacatcttgggttcataacccacttttaatgggtttttgtttgtttgttagtgctagttgagatttatttgaggtgtgcataatgttagcaggagcagagtatatattacagtgctgtttgggagagcttcttccagcataccacaatccctgtcatttaattaacaaaaaccacatatcttttttaagattacgcaattttactggcagtcatagatgcttccttttttttctttgaatagctacaggtataaatctgccttgttcattaatgtactgtctatacaatgttgaaggaacttaaggacgttttaagaactgtgcctgaagttgaagaccttgttggacctgaagatgctgccaagcttttgtctgtgaaagagtaccatggtgtcaatgaagtaaaatcctgtctgcggtcagcttttactaagctaatgacagctagtaaagaagcggtttctgaagcaattacaaaattgatttttcgcctgaatgctgagagcaaggtaaaaatatgaaatcaactagaatggttgtggatatctgcattttcacatgacatcaaatattagaaccttcccatattttatggaaatacaggcttttcattctttggatcttcattttctatgcatttacattatcttacactcttaccagtaaaatgtgccatgaacatttctcttcattatctttccaaatgaaagttaggttctgttctctcctgcttgaaagttatgcggtggttctttcgtatacgatgctaaacctatcagtggttaatgagatgttaaagtgcacagatgatgtttaaatggctttaatgctttgttttaccaatgctatgccatatgcaatgctcttgttaacgaggtcatatctagtactctgacatgcattctccttgtttgagacctctgataaatgtgggactgaacatggggtctaaccccgcagcacatagtgttaaagacgtaacttgcaaaatgacattgttcattgttttccaagttaaaatttattttgtttcaaccgcatggacttgactcttcgagacatggaaacatagtattgattactaggcagtgtcaaagcactgaacagtagaaaatatatatcatgacatttacttttcttacattcatgtgctgtgattgcgttgctatgctacttaattgagttattagttacatgggttgtaattgggaggaaaacaacaaagggggaaggtaaatataattgcacccatgagcagcaattcatgctattgtttttgtttaaatcgtccattttattgaacattgcataaaacaattcctgttttgttatccccattatacaaaacgttcccttaggagttatcatcttccaagtaaccctttctttacagcaatatgaagcataactaactagagtacctttttttaaagagaatttaatgaatacaggtcaagcctgagattctatctgtactgataatgatgtcatgatctattcaggtaaggaccttaaccgagaaagaaaatctagttttgtcgctggagaaacaatacccagaagatgttggtgttctatcagcatttttcttcaattatatcaagctcagtcctggtgaagcactttacattggtgccaatgaaccacatgcatatctatccggggaatgcattgaatgtatggccacttcagataatgttgttcgtgctggtttgacacccaagtacagagatgtgcaaactctttgctctatgctaacatacaaacaggtgagttacagaagtgaaaccatgacaatttctaattttgatcacatgccgagacctaggaaggatgctttcccaaggtctgcagaagttctgagaattcgtcgtcccaggacccaggctacaagccagcactgacatatgtattgtgctatgatgcctatgcatctttgatctttattaaacagtgaataccatagtgaactccacaaagttgtcgcaatgatcatcaaaaatatccttttgcaggtctttccagaaatcttgcggggggttcctgtacagccgtatgtaagaaggtacacccctccgtttgatgagttcgaagttgactgctgctcactaccaccaggcgaactggttgtgatatccccagtgtcaggtccatccgtctacctagtgatggccggggaaggcgagatccaggtagattccatgccaaatggtgaaaagtctaaacaaggtgatgttttcttcgtgccagcatacaccgaggttaagttctctgcctctggtcctgagtgcatgcagctgtacagggctggggtcaatagcagattcttcaattaatttagtgactgctgaaagagttccacacacaattgctgtaggtaaaaggtcagtgcttacaaaatacaagtgaaatgatatgactagttagcaaaagttaccatatgtactgtataggtcaacaaaagaataagtcaggttccttcatatcttgattatttgttcttccaaagaggtctataccatagcgttcctcacgcatccagatccatctgaatggagaggattacagagaataactttcagccattctattctattacattgtagttcagaactaaaatgtgaactggtctcaagctttgacaccgaatatagttggaaatacttacagacatgctccatgtcttttcattgtttgctctgccttctaggctggatgacctgagtcgttttccttttgttttgtctgtggtgatcattggcattgtcgttcacttggacatgccgttgatattggcatcgatccattgcttagtgcatgtcaatttgcactgccagtttgtttgttgtttcctactgctacttgaagtacctggtgttgctttcattcagtgaaagccggttggtccttgcgtagtgcgagaaggcccagtgggcttttggtgtttgtttccaagaagaaaagaaacaaacagcattggattggacgccggagttgcatggcatttgcagaattgcaggtcgttttcctctgcttctcgtggcccgatttggttaagccaaaacggtgtctttgatagcgtggacacgtatgtagtacgtgcagtacaggttggttgggtggatcacggcatatatatagcgtgtggctgtcatctgtgcatgcacgagcttgtagtaacctgttggctgcaggtggccatccatgcatccttccttggcttggatacatccacttcgatcagtcatcagtggcacagccaaacaaacctgcaaaataaaggtctctctccttatcacgtcaattcctagaaccagcgatcattttgtcctgcctgctttcactggcacaatttgcttcctctatcctcatatcccatcttggacatcatcttgtttccttcagaattttcagattatcgctgcattattcatctgtaatgtaatctcgtacggagtattattctcgtttgtcctttgtcgtcatcgtcttcgagagcttagacttgcaaccaaactgccctgctggttggtctctgtaccctgtatggtttagtaattacttggagagtgcagtgctgatgctacactttgaccaagtataatatctggtgctttatcgattcattttttttgtacgtgttgttaaagcaaacgtggggcaattcggccgtcaatcccgtgcggcacgtcaaaggaacacagagagagtttcgcaggcttaagcaacaccagctaagccatctacttacctgtctaatctgtgcaagtgtgcatgcttttcctccctgtcaactctacttaatagttactgacactagtagtaccattgggatcatatcaacggttggtggtgaaggccgcatcaaggaaagaaaagactccaacttttgatccaaactatccaagtatgcattgtcatttcacattggagaagtagtggacttccagtgtgtggttggtattccgtgttggttttttggttgatggctgatgtacatatatgttgtgttgatgttcacttgacaggaaagttcaggtgattcggcctgttgttttccagcatgtgtggaagacggatggatgtcttctttgatcatctctgtggactgtgtggaagatgttaattagtgggtcaccacaagttgctagctgcagaaatggactccatattctggatcatatatacagagtagttgtacatgacaaatcagcatcatatcattgctagtttgccacctgctcaaatttatatgatcagagcttgaagatggttgctaagctagagctttggtaataattaccatggcctagtggaaatcatgcttgtcatggatgtgtagcaatatagcatatgatgggctggagagcatgcacaaagccgagagcttggcatacaagcttgcatgcatcttgggtagcttaaaaaaaacaaaatcttgcatcttttaattgaaggttttgttaagcacaataagtaatccaccctagctacaaattactttaattaattaagttgtgtaaagcatgcaatctggacaacgtagtacgttgaaagttaggccagcagtcaacagccactgtaaagctaatgccggaccaaacgtgcaaaaatatcatacatatgcaagctgattaacaagttaattagtagcatgttttcgcgtaaccggtatggcagcatcatatatatactacgaagtggcatcttgccgggttaattagctcagttcatcaggttcagtgaacgatcaccaagtcgtttgatttgactaggccgcgactatctctgcacagtaggacggatgacttcctttttaactctagcattgacttgcattatccttaggacctttaagcaagtgaaaactaaaagacaagctatcacagatcaaatttgtttgtt

SEQ ID NO: 86502 - DNA, 22352 bp, Oryza sativa
aaggcaatacctccactgttttcacgtaatatggttttgtgtttcttctataatttttcaattctaagtgaaaactaaaagacaggcttgataattaactaagcagtctacactatttaaatatatatatttttggtgagatacccctttttattttttagacggcctaaaataaaatcctcctacaaaaatgcacgtgtcccgattacttgaatggagttatttttacatatggtcctactatgaaaatcataaattttacaagtgcttgttaagagggcggcttgatgtcatccatggcggatttgattgtgcaagcgcttgggagtgccaaatctggtggtggtgacagctgcggagatgactacggtaggttgcggagatgactgtggtgaggaccgtgacccagcggtagtaaagatgacggcaacaacgggcgaataaaggcgaggtcccccacggcggcggcgagcagatgcatacgagttcatccatagaaccgatgggtagatccaagtgtgctcatccaccaggctagaggtagatgaaggcgaggttgtccatgacgccaattggcggatccaggggtcgaggttgtccacaacgccgacaagtagatctaggcgaggtcgtccgtgatgatgaggagctagggttcctaggtagcaacggatctggtgacgatggcgtcggctttgggagcggcgatgattgcgacgacctaattgctccctcttctatgcgtatgcgatcttgtcgccctcaccctcttctcttgcatcaatgggtgaaattgttttgatcggcacatggagcaatgatttttgaattgttggatattttttttggatgaattggataccatagacgagtgacttattagctagccacatgtgaaaagcccttcttcatagacgaataacttagctggcctcctggaaaggggcatttcacatgcggttgtctatgaaaatggacttctacaggaaaccacatcctacatgtagaaatacaatatttccacgggcgtttttgttacaagcaattgggccaaccacctctggaaatcgaatttatctgcccaaaaaaagattttcataatagtactatgaagttgggaaggtcatgtgatgaaatggcttgagctacgcattttctcatgctccatctatttccaaattaatatgtcagcgacaataattactgcttcacattaactaccaccaatactaacttcctatggttaaattataataaacaaaagttgtattgtcttgttaatcccttctttatataaagttaaggccaaaagctcaaacctcgtgcttccacgtcatcatcaaattgtgaaccgttggatgaatgcattagatcgcttctcagacgtatagagcccaacccattagtcaccgggtgagtctcttcgccctcagtgccaaatgtagctcacatgaacacattgacccatctccatacacatctacatgtatccagcccgttaatccgtataaaagagttttatggctgaacgccccttcagttgacatgcgctacctaaattatctacaatttttggatagggctgctaaaaagaatttctccaagaaagctatttgtttcttctgtttcttcttgaaattatacctcctatctaacaaattgatgttaaccaaatcctgcagcaacacgcggagcatcctctagttaacaaaggcagaagactctaaatttgaacactgaaaattctggaagcagctgcaaccgccaaaagactcctcaaacatgaccttaactagtctgctgaaaatctatgcaatgctatcatggatgctgtcacacatttcccccttacacaattcctagtagtcccaactagctaatctacgtccaatactttctccatcccaaaatgaatttatttttcacccatctcacatgccaataaaaaatttagaatacctctactttatcaaatctcaatgcaactatttctcacttcatatatttctaacacaattatttcatactgtcataaactccgatgcaatgattactttaaaattaaatttattttgagacaaatggaaatgataaaaataaacgggacggagaaaatgtatgtcttggttgtcagaacatgggatgtggcccggccatgattgttgatttttttatgcacattagttgagtcgtttcaaatcaagggtacgatcgatctcaacaacatgacaaggaatggtcgattttggatatggtcctgacttgaccagatgggatgtttcactgttgataagaagcatgcattatgttcaccgatttggcatttcaatgtaaccccgttttgtcacacagtcggtgcagggaggttctccaacacattcacaaatactacttgtctctcttcaccaaagcttcgagagttcatttttattatatgctagtatatatttctaaggcttggttcttaatagaagatgtacgaaactgagtttatgataaaatggtacaaacgagtagaaagttaaaaggttgaaatagctttcttaaagacaagctaataaacaagtttttttaataaaaaaaaagtagtgtaggaagcgtgtctatgttaatcaaatccataatataatctgttagcttaaaaaaatcatgaaccaataaaattcatgccattaagaactaattaatcaaatccaaatttgtctcgccaaatttatgacggtcagggaggagggaaatttaaagaaaccggcgaggacaaattaaaatgtgaatacatacacaacaaaatggtgaccttgatatacatgtactttttttaaaagattacatggaagacgtagacacacacagaacacgcattcacacaccatgaattaatgcaccctagaatcctaatgaaagcacaccataattgattaatcggatccccaaagtttatttttttgttaattttttggagatgataaaataggacatatattccttggttggaattaatgttacatctctgcaaaatatcaaaaataaatctcaattgcatttacctttaccaaaaatacaaatgtgttccccgcacacggaattaacattgagtacaattttaggcatgtaagcatgtttatcaaaattaagaagaaaatgatcttcaaagcttttgaggtactacctccgtcctctcatacatccaaaatttcttatattttaggacggagggagtatagtactatcagatagaccagatatgataatcggagcattgactactgttgtatgtgggaaaaaaatgcatctttttttttcagttcattttactagggttgaattggcttatattattgtttctaaatttagcaactccccagcaacaacatcagtgtaagtacactagcaagctacttttgcctttgcttacaggcaagtgctactaggaataagtggaaaatttgactttattgagctagaagatggatttgatatgacaaggactcagagcaagtctcatccactgcacacaaagaaacaaaagaaacctaggttgcttataattgcaaacattaatgagttaattagctgccttttctatttcgttcttgagtgtcatttttcttcagtaatgttacgttaatgctgcaaaacatgcatgctagctaggtgtactgtatatgtagactatggtacaatatatagctatagctccctattttagctttgatgaagcattgttaatcattttgcagaatgaattattcctgaaaattattgtatatgtttgatccgaatttcgttttgcattcacacatgcatgtgaatggatattaaagtttgcatggttggcttatagtatatctatgtggccttctttttaagattaaatattcaccgaattattaaaataaattaattgttttacgctttaaaaataggtgtatgagaaaaatgcgtcctctatattttattacttagaccactttgttttaagcttaatttttaaaatattaatttttatctttataaacaagaagattttctcaaaaaagaagtgtattaatataatcattaacgataatctactcaataatctaaatcaaacgttacataccatatactcctactaaagcaaaagcaaaacggtgtagttatgaaatactccctccgtctcaaaatataagcaattttagcatagtgacaaatcaaacatttttaactttaaccattaatagcaacaaaattaaaaaaaaatcaatcatgtaaaattaatgttactagatttatcgttaaacaaattatcataatatgcaactctttttatttaaaatatattatttttatagatattattggtcaaaataacatttcggagggagtaaatgaacaggtaggtactccaggacgcatagcggtaccctgcaaaaaaattggacatgtgtgtttgtccgtgtcggtcaacatgaacaagcaaggagacatggcctgccccttgaagaacccccctccctctagctctgtccattctgcaaacagtcgccgaacgaaagttatacgtgcatggagacttgatgcatggccggaatatttctgtgtttgtcagatcaggtctgattgatcaccagctgcttctctctctctagccttactactccctcctcccaaaaataactgcagccatggttttccgcgcccaactttgaccactcgtcttatttgaaattttttattaaaaacataagtcacgagtaaagtagtactcatgttttattatcttataacaacaaaattgctaattataaaaaaatttcaaataagatagataatcaaggttgggcgctgaaactcatgactgcacttattttgggacgaagtcagtactcgtatacttcatccgtcttataaaaagaccaacctaatatcgaatgtaataatctatctgttcagatttataatactaaaatacgttacatatctagtactagtaaattagtttttatgagaagaagaaagtatatcatagatgaaccatatatttgtgttttggatgtatgcttgcatgcacacattacatcctacggttgtagcgccatatatcagcactgtttgcagaacaaaatcctgtcagtgatcgagcgtctctagctacgtacagatatgcatgggggcctttgttggaatccgatggacaatatataacgttaaagagaagataacatgtgtcaagcaagctttaatttgacggacggggcctctctagctacatggtgagcattcactggataattactatatttcttctaaaatatatatagtagtaatctaggattaaattaacgagtactacgaattcgaatctagacaaactcttatttggtcctaaattactaaattttgagacggggagagagtatatgttagaaaagtatcattagttgtggtgaatgatgatggagttgtgagtgcaatttgtccatcaagtatcgaattctattgctcacaatatgtactctgtgtaaatttaattactacactgaaaatttatattcattacctttaattaatacactatattcttaaatcaatctgaagtgaagctcagaaaagattatacataattaattaattcgatgtatatatgattattgttgttagttttcaaggtttaaattcaacaaaaagtaatgttttcagcagcagcaattaatatataaatgtattttaatgatatgggaaatattaatgttagtcaaatatacatcaatattgtttaggactgtatcacatatatatatttgttacaaagttttaacgaaatattattaaatatttccttaaaactatctgatccccacgtaattaattagattaacttaatttctatatcacgtgttctgattcatgtagtcaagtcctggagaggaaaaaagaatctcccttaaattagtatgcacctatcaacgctcttcctttcccattctatcaaaacgcttttaatttttttttctcgccggccattctctatcaaatgccatgtcccacatcctttaagaggaagtctactagcacagtgcccttgaaagctccaggagtcttatcaaagcaaaaatttcaagttggaatcatctctagctatagcactttctttctccacctttctccatccatataaatatatacaacatatatttaggagaaatggatgagatatccatatgattgtaaaattgttccctctctggcccgttagatttgatgtgacgatatgttacatccatcgtcgttttccatctagagtacgactggcaatttttctcagaaagaagcatgattggaaaagatatatttaataactacatcctaggttatatagagcaacaaacttaaattctaagtcaaatcattaattatctaacatggtagtattatctcaataatgtacgcatcaaaagaaaacaagttttactccttccatgtcataaaaacatgtttcaagtcaaacttaatgtgaacatcaatattttaaaaatatttagttagatgtatgaaaactatatttgtagacatgtacatatatagcatgataattttatcagggtttataggtcaaatttgtacgtgggacaccatgcatgttcatgtgtaaaatgacatgttttcatgactgaagggaataactgatcgaactcatgtatattcatttgtttaaaaaacatatatggacaaaatgtacctgaaattgtatcactagcctagctatatatacttcagaatgtctatctagtgtggcaacttgtgatagcaaaccacacatatataacaataacaaccctctagctcattgttgagttcttctggaaagtagcgtggcgacgcgtttgtgtgctctacttgttaaatttcccaaatttgcacaactcaatttgagttttattggtaaccctcttctcttcttctaatatattgacgtgcaattcttttgcgcgtttgcagaaaaaagttttattggcaaccacacatatatgtagatcgagatcgagatagccatctcaaagcgacatgtcattgccgactttccctagcaagagaaagctagcaagccagagagaggcatctcactctcacacacacatctatagcttgattctgacccatattgttcccatctccagatgcaattacagcacacaaccccaccaacataaacgagatcacttggagacaacgacctctccttcgatgatcaatgcatataacaacaagatctctttcacaaacccaacaaatcaaagctaattgaatcgccttttaacaagaacaaacaaagagagaacacacatacgtacgtacacaattacattaacaaagtactactactaacaatagttacatgcaccatcgatcgatcaaccactacaagaagctagctagctctagctaatatgtttaaacacatctcaataatattctctccatcgatcggaatcatcacgctattgatcatcttctacttttgatttttgcttgatcgatcactagtacttctatcttgatcgatatgatggaacaactcatccattagctaatgtgacagcatcatcaacatcatcatcatgatcatcatctcatctcgctttaatggagagacatcacaagaagcaacttaccatctcatctatccatgatccatccatccacttagcctttagctacagctaagctcagctggatacgtagctacctagctagctagctagattcctcctccccactcgccgagctttctcgccgccgcttggcacacctcgtcggacctccacgtgtcgccgccgtccatggcgccgccgcagtagttgtagctgccggcgttgccggaggcggtcatcatcgtcatcatggcgctgccggtgcagctggagttgaggtagtcgaggagcgtcgagtcggagtagtactcggccggaccaaggtccagcccgtcgaggctgaggcttcccagcgccgacgccgagtcgacgaacacgccggcggcgccgtcgtcgagctcgccggaggactgcatctgctggtcccatctcagctcggagaagcagggcagcggctggaacgccgccgcggccgccgtcgagccggccgacgtcgacgtgctcgggctcgggtcgatgtggtggtggtacacgttgttcgggacgacgcacgccgttgctgcttctgcttgctgcaggtgggtgtcgaagtcgaacggcgaggaggaggcggtggccatggcggcgtggtggtggagtggcggtggcggcggcggagtggggtcggtggctgctccggccatcttctcgaggaggcgaggcatccaatagcagcggacggcgtcgcggaagacggtgctgttggcgtcgaccttgagctgcctggcctgcttctgcaccctcgtcctccagtagttcttgatctcgttgtccgtcctccccggcagatgctgcgctatcctcgaccacctgatcaatcaaattaaccaatcgatcttgatcagagataattgattttgattgatatatatgtgcagattgatcaaatcaatatgtatacctacctgtttccccacctggaatggagctcaagaatgagcagctgctcctccggcgtcagattcccgcgctttatgtcaggcttgaggtagttgagccatcttagcctgcagctcttgcccgtcctcttcaaccctaatcgattaattaacccaaatttgttcaagattgattgtacttgacctagatgccatggttagatcgatgatgattgcagagtgacggaggactcaccggagcagcgggcgaggagattccagcggccttcgccatggcaggcaatgtagttcatgaggaggttgtcttcctcgagggtccatggtcctcgcctcagctccatcatctcctctgccatggcctcctgctgctgcttgctcatcactcccatgggccctgcaactctcctctgcgacattgctgtctactacctttgcagcagctgggatatatagctatctagagcttcttcttctactactagtagtataaatgttgttggtcagttggtggattggatgatgaggtcgatgtatgatccccttggagggtgcaactcatacaaccatatatatagccatgtacctccactagctctcactagcttaattagcttgccccttaactactctctcaactctcaactctctaggagatcaattagggaagaaaagaatggaagagagcaagcacaagtaagtacaagagaagagggaggagagatgcatatggcctagctgcagagagagagagagagctaaattaagttattattggtggctgcttgagatcaatatatatatatatatatatatatatatatatatatatatatatatatatatatcccttttataatgacttgtggcaatcatatgaagggaatttttgagggggcatgcatgcaactgcccctaatcaagactgaaaagtactactacttgtaggaagaagaggggtacattttaatttggtgggttaattagcttcttgggggagaagagaaggaagaggagaggagaaagccaagtgcgttgttacacaccaaaaggtcagggcaatctgtcaaagcttccatctttttctatggaatgagagagagagagagagagtgagagaagaaatagtgcccagtactgatctttagattctctcctacatgaagcgtgtttgactgaacaatttgtcatccctcttgcagcactgtgttaggattagacgagagagggagagtgggatggagagatgaccaaattgttggatgcacacattggtgaaccacacacctctccacgatctccttttgcactgcaaaaaaaaaacagtaatgcaaaacgttattctttttgtttcttttggaatatatattatccttttgtgataagctcaaatcccaaatagagacatgtacatatacatatgcatgcatgggtttttatttattgatattacaccaaatcattggtatgttttcgaaagctaccacactttatggtatagtgaaatgcaaatgtgtctccacgcatgcaactacctgcctatgggcctatggcacttaaccatgcgttcaatcagaataattatctgtttcataattaattatttactaccagtttgaactagaattatttgccagatgaggtacggtctacttcaagcaaagaataagcaatcaatcagcgagacttgtgcttgcaaagcaaatagctttgtagttctttctcccgaaaagccaatgaaacactaaactttggagacagcaccctggtaagtaagcaaagattaggtaggaatgcctgtataagttcctaggataatcatataaaatattcgtaggacctaatgattcttgacctaactgtctgcatgccgaccggttaaaatgttcaattcaaatgtttagcttaaatagtttgtgcgtgatgttggcacagttgcatgcataccatggtgtgtagtcaaatacttgcaattaatcttaatatttgccgcatctaaagtgtcagttttgcggcttcccttgaccgaattttcagaagtacagtcactgttaagttggaaaagaatcaattcaaacatgcatgtccttgaaacatataatcaattgaaaggtcattgaattatactatatgaataccccgttgtgttgctgccggaaattaagttacataatatgtataaataagatgcaatataattattaaaactaaaacaaattgatacttatgaattttgagcctaaaaatgattgagattgcatggtgttatgagagaagaaagaagagataatttgaactatggatctatcagccaaaggctagaaataattagggtgatgtggcttaatgagagaagagagaaatagcattaactatacttagtggggatgaactatataagtatataggatttgagcacacatgtcaaaaagatgacaagtgaataatttacaatagacttgttgcatgatatatttaacatgtataggaaatagatgaagtgtaggcattcttgttatcttgctattaatggtgcaaacaaaaaaaatcgaataaagcctaagccatgcatatttttcatgaaaaatacaattttattggaatttgtaaatatattaagatataaataagtggtccgataatgtttgtgtgagaccagaccaatgtctaaatcaatacgtatttgtgatcggatcgagtaattctagcactagtacgtgtaagttctcatatgagccatactacggtgctctctgttggtagtaaaaagcaatatgaaccgttgttctcatttggttgaagggtttagatttatttgtactaccacttcagttagcggtattagaaatgtggaggtgcattattataaaaaaaagtgtggagggatataatcaacatttagcaatgacgactagacctttttttcaactttttttttggctttttcgatggaatataggtgtgagcaatgccagcggaatggatgaccaaataatagatctagaaaaaacataaataacaaagttacctctaatcattgtattggtaaattactaatttattcttaataatgaacgattatgatcatttggtaatttctcttttagagcacgggaacattgctctttttcatatatgttagttaattattagagaaaataattgtaaatgaggaagaaattaacatacactagctcgcataatagttttagcgtatctgcaattggttacgctaagttataacctttggtccattaaacatcatcatatcgttactcacaaagttctcttttatatgcttccttgcaaaaaaaaaagggagttctcaaaaaaaaaagggagttctctcttttatttgcggcctttttttcaacagaagcacgataaagctaacaataattcataaacatgtaactttgaaagaaacctacacaagtacaataaactatactagtacaccactagctagccatgagttagctagccatgagttagcgatcactcatatgtacacaaatataaaggattctagtatttgaaatatgttagcaattatatgggtttctaatactatttctcttacccaaccgtccctctcatttaagtttcacctaatgttacccctaaccatccttccatgcatccccatccaccccttatttagtaaggagcatcataggccttgttaagttagggaaaaattttgtgtgtggttgtcacatcggatatatggacacacattgaaagtattaaacgtagtctcataacaacacaaattacagattccgccaggaaactgtgaggcgaatttattaagcctaattaatccgtcattagaaaatgtttactgtagcaccacattgtcaaatcatggtgcaattagacttaaaagattcgtctcgcaatttacactcaaactgtgtaattggttttttttcacattttatactccatacatgtgtccaaacattcgatgtgatgggtgaaaagtttttgttttgggaataaaaaaggccatagtatgtataaaaagaaattttacaatccttaaatgataccgaaatttttagaacaaatacccgtagctcctagttttgaagatatcgagaggcaccaaattttacactggaaatatggtacctcccagtacctactcaagaactgtaaaatcagtcatgttctaaaaatctccgttcgttacctcccgttcccaactttcctccctcattttccgtgtgcacgttttttaaactgctaaacggtgcgttttcttaaaaaaaaatttctatacgaaagttgcttaaaaatcatattaatccatttttgaaaaaaaagtaaatacttaattaatcatccgctaatcgctgctccgtttttcgtgccatggagtgagggttcccaaccctcgctcccgaaggcagccttatttgatgactcaacttttcctttagaaacttggttgtttgagatcacaatgaatggtgtttcgacttctccgcactataagtctagctatctacgcaccccatttgagacatcgactttaatcttttcaaatacatattttctccattagtgcttaattaaccatcagttctatatagtataatttatctttattgtgatgtctatgattgttgtaacatcatatatatatttcgggtcctttttgtcattgacaatattttcaaatacatattttcaccattcgtgcttaattaatcatcagctgtacatataattaatctttattgtgatgtctatgattgttgtaacatcatagatatttcgggtcctttttgtcattgacagtggctatatatgctcatcagctaggatataaaagtatataaatatgattttagatctgtccagtcgtgttactcatgcataaacttgattaattattgcctataaatggaccaacctatatatctagggtgctgattgatcaagaactcgagataattctacttgaaagtaacaaacaacaactaggaggatacgctcaaaagaagagaaaaaattacattggtggtccaaattttaacacttgcaaatattgtaccagctggtaagcttttcctatggaccacgcactaataccatggcaaacaagtgattatccatatggaccacataatgatcgttgcattagctcacaaactactagaaagaacaaaattattgtaaatttagttacacatgcatgagccagttaacggcatgattagcctttctagaaaaacaacatatgtagcacaccgttttatcttccttgtcattttggagaacgatgtagtcaagaaaacttgtattttccattattgtttctaatcattatatgatataaaaactattaaatattttatatgtgatgaatccaaacatttctctagatatttgtcatcgaagtttgcagggttgaataacattttctagtatgtcctaaattctatttgagacagatcaaagtagatcatttttttttcagtagtgcatatatatagtaaattcctcatatatatgctaaaccaaatgttactcttgtatgatagtattaattatttcatttacaattttatatactcaatctatctgaaactaccagctaacttttatgcacccttcttgtttcgccttcatatctcatcctttaatttcatccttcccattctaaaaccaagcttcaaatattggcaagaaagggaacagtaaaattttggatgccatattaagaaaaataaatgtccgtacgtacgccacatgatgaatttgtccttgtttttttttcctttggcatgtacttgcaagtttcatctaactcatggtccttaaatagtccacaagtcctaaccattcatcgtcacttgcggttaaattaattacgtacccaacttgcaacagaattcatgtgcaagatctatgaacatagtatagccatgctctatatagttttgtgtatatatagtagtccttaattagttttctgttatcctatcatatatattatattgcatcatatcatattataataattattaagttaaggtaaaagagaaactctctgcctatgctctctaggacataagctagttaccatgcatgtttagtaagggaaagaaaaatatacagttgactgtgatgtgggtccatacgacataatgcatgcactatatttaataaagagtacacatcaaatttgtaggaatcttaattttggattaaaattgttcaaaaaaaagagagagtccatgcatgtcaaatgacagtaaaagagcgagtgaaataaattaacctgcaatctcatttccatatatataaattccaaagtaaattctctagctaaaataatgtgagtatattttggaactacaattactataactagtccttgcaattgtgaaagaaattcgacaagttttgtgtgcgattacgcgggtgatgtatgtgtgcgtgcacacacaccgccgccaccaccacgcactcacaccacactcacaccacactcacacaccacaatccctaagcaacgctcaaatagatgaagaccaatggtatatccctagcaacactaatttctatgtaaagtttactagcgtgtgtaatattcgtgaggttttaacaaatcataagaatgatcgtatagacataagtcttaatttgcatggtccaatcaccttgtattgttaactagtctgtgcatatttacttctaattttgtaggtcctaatgggagtttatcagctactaaactcaaactgtttcttagggaaaaaaaacaggtcaatgttgttgctagacaaatttaaagtgtttgtatctataattagtgttgtaggaaaaagttgattagatgtatacatatatgtaccctctataacttaactaattgctcctcactaatgacatttttttctcttctctcaccaaacttattttcttgtagtgactagtcaaatgtgcaaattataaaaaacatgtgatgtcatactatttaactataaagcaaatttatctcgcaccacctcatgtttaccattgtgatgcagctttaacctaatgttgcaacgcacggggtttacatgtagtcatatgggcgattatgtaaattgactaatcaattatcggcaaaccggagatgcaaactaagtggtagcttgactaagtaattaactgcgaggaaaggtgaaattatcgcaatcaaatatctttgtatgggaattcaaaattaaaaatattgtcacacagaacagatagttaaggataccctagcttgtgcttaataggattgagtaagtgaaggtggggggagggacagtaggtctggtttatgagaaaaatttgggcgtccccttaatatgattcactcaagagcatatatatattgggaaagaaaatggggaagagaaaatccatagtcgtagttaagagcagttaggtatagcagggcatgtacaatggccactgatagagttgtagaaagttcttagccttgctaattagaaatgttgcttatattgaagaaagagaaagaggagagataaaatatcgttgctataattaataatggctaagcaataactcttagcctcaatctataaaatggaaactcgattgcattcggatgacaaaaaggaaatactagtaatgaagaattattttctaggttaatggttagaacccttcatgtctcaattgttataggggtaaagtgagactattatatattccttaagaatattcctttggcgctctatactattatgaagccctgaagatgaaagggttgcttaattgtatcctccaacaaacaacttggtgagtatatcccagttggtattaagaaagcaattgttgtgcgttgtatgtatagatatgtcacggcgtcatgtacgcatgcaatgcaactctcatcaataaattaattaccatatgtatgtatgcatgcatggcgatctttttcgcagtatacacacatgtcgttagcatgcatgggaagtcaagccctgaacatcgatcgcctcatgcatagcaatgctgaacagtgtacaagaaaaatgatctagggaaataattaatagaaacaatgcagagtagtcatgaaatgtactacctccatcttaaaatacttgtcgctttaagttcttgtttgtaacttttgattattcgtcttattcaaaacaatataatttttttatttattttgtttgtgacttgttttattataaaaataattgaagtatgacttatttttttttaattagtagtgtggaactttttcgcgaacaaacaaaaaggattacatttcaatatattcattaatgtggaattgtggatgcgcgataattacacaatgctagtttgcaatgatatagtttgctccaaactacagtaaaaccaacagtatgaccactcagctaaaccatctgaattaaacactgaattttatatgaaacatatacagtgactccaataaaaattttccgtatttccaaacgatcgaagcctcagcaaccaataaattaaaggagatcaaaagcggtttaccactactgtaacacatgcttagctggttgggttctacggtcgacacatgtcaaagtttcagcttcgatcaatcccctccgaaagcgatcgccattattggccacacagaagcttattagcttagctacctagtaatcacatcgatctcgatctatctcttttcagtggtggatgcaacatgatcatgataaagccattagctagctagcgatcgatggaaaggaggtgagatcgagatcgaccattaattccttctcctacctacaactcgcccctgatcaatatgatcatcttcccttaattaatcaacggatcgatgatcgaaatgatgcgtgaaaacaacacgtcgtctccacttaataacttgcctggctgcttttaatctcactcactcagtcgatcagtgtgtgtgtgtggtggtttgttgatctcatcatctatcgatcgccagagtctaagcctactcgttttagggtaggttacctaggcgcctctccagcgacgacgccgccaccgacgacgacgaccgcgacgacggcgacggcgaagatgcagagatcaagctagatgcatatatcgatcatgcacacacttgccttggcatgtgattatattgtttacatcgtggcatgcaaaaaatatggatgaaatgacaactccaagaatcgcaaacctgaacacgctacttaattcgattatcgatcgttaactgctcttgcagtcagcttgaattggttgcttattctcatctagctagcaatcttgactactgttacgtacgtatatcgatcgatcgatctagttggccatcgaatatatgtcgataattatgacaatggatgtgagcttagatatatctggccttaatcatgcccatctcctttacatcgatcttgactagctatagctctttgcttcgatacccatctctctctcagagacacacacacacacatacacgttccaattctgcacgtttccacattattcccgtgagaatcgtatcagaatatattaattcacactgaacttttgattaggattaatccaagttagctagctctagaataggtgcagagagataaagagctttttcacagcacataatcttaactaggaccaaattaagagagaattagctagcttcgtactagtatgtacatatattgtgtgcatatgctggaaactaagagatgatgcatctgcctagtgctagctagccagctattataattaggagattcatattcctttcacataatataccactctagctaggtaatagctatgccttaggtcgacctttcatccgaacaatttttaatcaacgtgtttagttatatatagttattagtggtgttaatctagcaaggctagcaacttgttgcgtacgtaaatcaccaaggaaaacaactaatcttttgcattaatttaccaatcgatgcgtcgacgggttaaacatatatactaaattattgcacacttacgacaacctcccatgagagggaaaacaagtggtttcttgatggatcaatcatgatttatataaagtatagaatactaatatatcatcaatcgcatacactagcaacagaatgaattcgatcatcagttgctaattaatagctccgcctatctcgccgtgttcttgaggtattccagaatctggtagtgtgtgaaacaggaaagcaatctagcgagcacacatgatgcttagacgattctaattaattaattaatagttaattaattaaggcagacgtgttacgtctgattttaacggaatgcacgcacattaatcagttgtttaatttgacaccccacaacatacagaggcttgggcgcacctggccggttttgatgattaattctcttccaattaacctccaatccatgccagagacttgacaaattattaatctaatttgtttgtacgtgtgagctggatggtattgtgtaaataggttaattaattgctagttgggactgaaaccagccaggttcatgcatgagtacatattgttcatgcaagttacgagttttgtagggagggaggagacatcaaactgtacaattcgactacctgttgcaacgaagaaagattaactaatgctcctacggatatatagtttggtgagtagactaagccatatgttttaagtataatgccatattgccatccattccatggcattgggtcatcatgtgtgtgcacatgaagctgacggcaccaaccgtctactagttgctaagctagctactagtaggaattaataggagatagagcaacatcatgtgtctaagttgctgtaaaacaattgtaattaatattgagttcctgcggtaagctaatgcaaacttcttgtttatgttaattattaactaccagtacacctagagtttttctacgattcttcctaccataattcattgtacattccaagttattgtagtttaacagtacttctggcacaatgttgacacctcctccattttttttacctttttgactttcatgcatggtatattggtatgagagatagactttgaacattatttttatatctttaattaatatttaattaaaatattacaatattgcagaaacgtttccaatggcaaatttaatgatatatttttcgtataataaatttggacagttttaaacatataattctaaaaaaatagagttatgttagtcgtatggattttgaggtatcaaaagagaaaaaggaaaccaccacatataacgaagccaaacatgatatcacaccatatgagattaaaacttaatgataacagggagccacaatattgattgacgagagattagatctgctaaacctttacctttacgagatattttttacgtacactctcccctaaactagtataattacaatgtatcaagatattaatgtcccccggccgacctacctagagcgattattctattctacaattgtcatatactagttataagagatggtgtctctctctatttaagagagacatatagagtcctactctatttttaacaactccaaatcttattttacagctacatttgtacatatattcgtattcatcacacactttaatgtttttctacatagtcttccaaagagtgcagaaaattggccgctgctctcaacgtgccactgcacttgaagtttgtttcgccgctgtacgtacatggctacaacagagttcaatgagagagtttaatcaagcataaatatctagcgagcttaataaaaaatgattaccatattttaattcaccgtgctgcttgtcgtttaacgcagatatctacttgtgtaaacattcgagtccaaggtttcaatttttctgccaacaattattttagagcaaagtccgaagtttcggatgctttgccggcctgcacagataaccatcagggctgcaatgaaaaggccttttaaccacgtattgagatgtttgggccgtatactctacgtcgtgaatctaatgggcttagctcacatgaactttgggccgtaggcgtatgtttctgctcatcttcttttttcccgataatatagagctatggaagatgcgcatgtacactcacatattttggaataagtcccatttcacacatgctcaagaatatatttcgatttatcatgacaaggaaatagtaaaattgatctctcgagattttggcacacagcaaaacagagaaaataaaaatcttccttcgagagagaactgtctgatgtatgcagttcgtcttcctttaactgaatattctgttcagagtggcagctaatctgacgccgccttgcgctagcctgagattcacaaccggcaatctgctcccgaaatatgcatctgcaacagcagcaatcaagagcaataaacccgtggtcaggacattttctgaagtgtttaactctgcatcaaacgtaaatggcactgctaatggtagtattaccttccaggagtgaatcttctgtcacgtccttgtacgcccagtcgcatgctgcagcgatgctctcagatgcataccttgcatatatagttgtaatcagttacagccagaaatcaatcaagttaagtggaaattcagaaatgaacttttggatgtgaaagcatacgtgtctgggcatgtggtctggttcttgctgcattcttcccatcctggcactcgttgtgaccattctccctgaaacatcaagcagtaagtagatcgagctgctagttgcctcaagcacaccagaaaaccatttttcataccgttatattctgcatcagtgcatcgacaaattcagccacgccttccccatagtagtcgttttctgccgttttgatgatgttgtcatcccaaacctgaacgacaataccaaagacaaaggattcctaattgattttgtcacagtcatatccatgctttatctgatttttttttcttttgggaagtgggatgctagtctgaatgctttttgcagtgggatgcttagtctgaacattggacttacatggtggagaacagtcttccttgtataccagtgcacatcaatggtgtttcctcctttatcggaggtaaaccccacatgaagcggctgtcatctccaaatgattaaacactaattactacactagtctactatacaagtacttacagagcgtactaatcacatttttttgggtgtacctggtggatgtcccccacaaagtgtgcaaggaacagaagtgcttgtgtcaggttatctgaagaactcaagatcagaaacttatcatcagcctgagactaacaaggcaaaaaaaattgcagaactgaattaaatggagcagtattacattgagtagaaggggatgttgcatcataggtgaggagctgggaggtgtagttgttgatggcgccggcgacgcacctccccctgaagctatcctcgtccttgcagtctcctgacaatgcaacacaagaaaccaacatgatgcatgctgctacaatgtgacagcatgtccatgcaaatttcagtcgaatttgaggacaaaatcaacaaactgtcgtaggtgtagctgcagaggtggtccggggtgtcgatgtagtggagcggcgccgaccaggggtacctgagcttgacgccgtcggcccaggagcagaggctgctcaggttgcccccggcgtacgacggcagcaggcccctcaccgccgcggcggccgcgtcgctcagccggccctgcacgagacgagacgatcaga

SEQ ID NO: 86503 - DNA, 2517 bp, Oryza sativa
aaatgaaaaagtggttaactcaaagttgtagtctcagttgagctctacaattttaatataaagttttatttcatctgactttatataatataattttaaattgtaaaatcatagagctaacaagttgtgttggaaaatttgcatttagatcccttgccgccctttggccctcccagagggcggcacgcgattagatttgtaaatttttgaaatataaaaattatttttgtaaatattttaataaaaaaaatgtataaataaaaaaatttcgtgaagtgtgtacctgcactacatgggttgacaaattcgtacgagggtgtgagattgtattctagtggggaagaaagattaacatgtgaaatagattctgtttagttatctaccagcataaggacgatgtttagttatccaccagcataaggacgaccattggtagcggttcctaaacggttactgatgacttattagccgtttagggaagtccctcccttcgtcgaatacatgcaagaaatgaatggcaaagcctcttgttccaaaagaaaagatgaacatagaattggtatgtatggttgtctgagctactgacgttcttcaatccaaaagaaaagatgatgaaagaattatgcccgtctcaactagatcaacggactcctcgtcagtcctaaagagaaaattaaacaattacctatgcaatatctaaaaaattgcacttaacacttttcaactaagtgattttttccgacagcgtcttgacaagtgacaactcgtgtgaattcataaacaaaataacgcaaatactgaaatagataaagcacctatcatttgcatcgaataccattagcaattacttcatcacattatttgaagctgcagccacctctatgtaccaaaataccggacatcgcaccatacctcgacagtagatttaactcatagttaggcagcacagaaggccaacaatcacacacatcataggtaatcatcattttgtgctttcatgtgacaatgagtgtgcagcaggacggatcatttcccaggaagtttgaaaaagtactcgattttccacaactgaatgtgatataatagcatcagatgcagtggagcaagtacaaaactaacggaagcaattcaaaagaacaatcagttattctttgtttgcatcatttgaaccctcctccataggcactgcttctgctgcatctcctttcttacctgtagatgacaaaatggtagttaggtgagttgaaggttccatccaggtgaggcaacttaaatacaaaaaaaccagtaaaattgtgttacaaagaacaggacaaacctttcttcttttttgcaccacttttcttctttgtttttgtccccaaagcaagccatgccttgatctcagcgttgtcttcaatggatttagtgggctgcaactcctgaagtgaatgcgatgttaccctctgtgaaccagatggcagcagaagcacagtaaacttgatgtgtgcaacaaggtcgcctgcacaaacaaccaactattaatacaaccactagaaacgagaaatatggcatgtagcagtaatcaacagaagcggtttgtacaaataaacacaaataatctcaaaaggaggatacagatttgtactcgccccaaggcttatctcataaaaacaaggcagaacaattgccaaaattctacagtattcaacacctagagcgatgatatgtgtacctggcttctcgtgaaggacagggtacggctgcaataattcatgattcatgcattccaccaaacctaagcgtgcacgcttctcttccaatgccctgtgacaattcaaaatgcatgttacaatatagtaaacaaaaaggtgcgtctgaagtaagcgttattgtagcaacctagcagtgaagggcatgataggaaacttctggcttatctcactgaaaatgaacctagatgctttcatcttcaagtgataattcttgtctacagctctcttgtagatggtggtctgcttctcatccaataacttgggctgtgcgtcgtaattaaaaaaaaatgtaaaaaaaaaaagcaaacagaagacaatccttcaaataaaagcagctattctcaccttcccttctccagtgctggtgacaatatcaattgcatacacttcattttcctcaaattcagcatcatccaccttcgtatcagcattggacacactaagtacaactttgttaccgtcaatgacaaactgtttcagctgatggctgagaactccttccacaattttgcagtcataagcagcagcaactttctgaatcgcttcggtgacatccttgttctgcaaaagaaaaattgttactggcaagatcagcattctaatacaaaccaaaggcatgcaactgaattaattcattgcagagaagacatacaggttagctcactaccaaacagtttttgtgtgtctagcaaaacataatagcatagtaagagaaacaagcacaacatttgtgtgcacagttgacctagacactaaatgtgaa

SEQ ID NO: 86504 - DNA, 7252 bp, Oryza sativa
tgctgaaagtaaaatagaggaggacatgaagaagcaacatgctatgtttttgtcttctattactaaccatttgcaggaagtgcataatcatgaaaaggaggagagagacatgaaagagccgccagtcccattgatcacactcaaagtcgaggcacctccattatctgaagagggcatcaaaggtaaacttaatggtgctgaaattaataaaggtgagtgtgttgttaatgaattgaatttgtccacttttcatgctatagcagagcaaccattagtggaaccaactgctgagattcctttgtcacaaattgatttgtttgctgttccttgtgataaagaagagttatgcgataatgcttcacttatatccatgccacaacttgtgaatgaacatgctattcctactgttaattcatactgcactgattttaagcatgttgttcacattgctaatgaagtagaggagcgtgaattgagatcttctttaaatactttgggctatgttcagtttgatgatttttgtgagctcgataatttcaaggagaaattatttgctaagtctgatttgccatatccaaccaatgttatatttcacatctttggtgaatataatgatcttggaatatattttgtgcatagagtttacatctgctcggatttagaacctcctgtacatgtggataaaatatgcaagctagagaaaaatgttattgctaaccaaattgtctcgagtttgccttgttttgattggaagaaacaggttgttgtaaatggactacgcaaagagcaccatatggaaaaaccgaggacggttttccgtgaagaaggggaggatgatgtgaccatggctaccacggatgcaaccattgctcacatcatggatgaacaagaagatatcgagatcaagtactccaagtgctggaatccgattcggccacctactacaccgctgacttcaaacggccaccgaatctgcatacgacctccgttttcggcccgtgagtacttgatggaaagctctcggagccctctttctaacagatccagcctcttctctgaattctatctcgtgtggccagaatcacaggaacaaggtgttgcatcacctataatgggcctatgggcttgtaacttcatttgggaccccggcccaggtgaggcccatgtggggtgcgccccaagctggtggagcacgaccctaggcacccctaggtcgtcctcccacccctatatatagctagtctggcccaggtggggcccatgtggggtgcgccccaagctggtggagcacgaccctaggcacccctaggtcgtcctcccacccctatatatagctagttaccccttcagggtttctcgggttttgttagattaaagtttagccattgctacttgcttgcagcgcgcgtgtcggctagaccgtccgtctgcttgttcttcggaaccccaacttatcatttgtattaaattcctatttgcaatatcagattgctttttatcttgttcttgcttgtttcttcgatttgcttgcaggaatagggttgatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatcagtcactgtagctcgattgcgcccgaaaagcaaaaatgtttagggttcatcgtagaactcacactaagggtgtgtttggcatgcacacttttcaaactgctaaacggtatgtttttttttaaaaaaagtttctatataaaagttgctttaaaaatatcaaattaatctatttttgaaaaaaattagctaatacttaattaattgatcgctctgttttccatgcgggagagatcagttccctccaggaatctgaacacaggctaacggagactgggaagtttccgtgtgtttttttacacacgggagcttttttcaagtcttttagtactgtcatggattaattttacgagattttcagaggagtacagtttgttttcgtcatttcttttagaaaaaatatactagttctcgaaaatgccttatatatccaggtccatcacccaccaccgtgtgcatgtacttgccgtcacgttgtatttaagcacgattagtgacaatctacacaaactcgagcgtgacgggtcatgactatgccgtgtcgagcgacggccgacggtgataatcacgatgagcctacatacttagtatatgctacttatacatactctatacaggacactagtacgtacgttacatatttatatacataatacttctatgctatttatacatactctatacatagtaggatattgtcccaaatcctctatttatttagccattgattcaggggataggcgagccatcctttttgcgagtaatgcagaggagaacggtaaagccggtcacaatcttatccctgtttccatcgtacgtagagccacatccacagccacacggcccgcgtcggaacagggaatccccccggcgtgcagctcttcttttccccgagcaagtttaatagcaaagcccactactagcttcaaatcatttatagccaatgtaatatctaattcatacactagttacttactatactagtaatatctggtcttacctgtcatacacacattatgtcttttaaatccgtgttgtagctggctacagatctgtagcccgctgcttttctctctcttcctttatctctttaaaatatgtttatagctggcttatagcctgctatttgtacctgctctaaaaccgaatacatatttcctccctcccaaaatatagctatttttaaggttagtgtgggtattaagaaaaagtaggtgagaatgatcggactggatgaagtgtgtcattggttgaaaagagaaagtaggtgaataagaatgattgtgattggttaagaggaggtaagtagagaaatagcttcattttagaacattgtgctagaaatagttaaattttgagatggaggcagtatctatctatttattgcgtataaactaaataattagaaaaaaaataattaataagataaattaatttgtaatatattcatttacaagcattcaacttcaaattcaacttatatttttatataagttgtaaaaaataacaaattaactctaatcagtatacatatatttacaactaaatttattttttacaacttgcaaaagttaaatttaatctcaaatgcttctagtgtgatatatttcatattaatctatcttaacatttaccagttgatttgtgataaacggttagcaacaattatccaggtgattagaatccttctctcccctttgcagcactgttccccccactccccctttccttatcaggaagccacacgcactctccgtctccgtagactgcacgcttcgtcgtcacatttttcacggcctcctcaccgccctcccccctcgggccccacgtgtcagccgccccgtgcggattctttctttctcttctttttttaacctttttttttttctttttggtataaacaaggaccagtgtagttgcgcccaatcggaggggagagaagaggagacacacgcaccgcacggtggtggtggctctcggctcggccagatttgtttaattattcgccccgggtttaccgcggccgccaatcggaggcgccgcgcgcggccacatccctttctttctctttcctcgcctcgcctcgcctcgccattggcgagccgcggctatatactaggcgcaccccgccgctgcggcgcgcgtttctctctctccttgtctctctgtgctgttgttgttgcgggtgaatctgcttggatttcgtcggagttttctgtcgcggaggaggagggggtggtggttgatcggaggggaggggggagggagatggcgagggagaggagggagatacggaggatagagagcgcggcggcgcggcaggtgacgttctcgaagcggcggcgggggctgttcaagaaggcggaggagctggcggtgctgtgcgacgccgacgtcgcgctcgtcgtcttctcctccaccggcaagctctcccagttcgccagctccaagtaagcgcgttctctgatcccctctctctctctactgttgatgctgctactgctcacccgatgatctcaccctttttttagttttcgatccgctcgagatttttttggggggtttagatctagctacctgctgctgtgttcctctctcgtttgaaagggctccagatcctcccggtcgctagggcttcctccctcttctacagttttacttcttcggttttagggtttgtgtttggttgatgcgatgcttctcgcgaaacgccacttcgggatcgagccttcttttctacttccagaacaatcatccttgcggtttttggggctgattcctgggtcgattccggtggattctaccacccgggatggtcctccgaaaatggggaatttttctactgtagtttcaatcacaatctccacagctaagtacggggaaaattcgatcgcttgctttttgcagatgagagatatgcatatttctcgtgtattccatttgctttcatgtggagaggaacactctaaaatccggttaattttgcttacgtacgctgctcgataaaaaataaatcccaaaaccgatcggcgcggcgcgcggccttgggcgcctccgctaatcgcggcgccgccgtacctgtgattttatgtgtggtgtggcatggcatgccgtatgcatgagccgtcaaccaaccaaccaacgaaccagctgccgatcagttcatcctctcctactgcctctctctctctcgtggtctgcgcaggtggccggctggtactttgctgtagctatagctatatatgggatcactcttgtagcctttgggtatttgggcttgctagcttaccattattggtgttctccaagagagaaaaataaacatttcaagtaccaagagggtacgtggcctttgcatgttccatatataagtatgtcgtccaagaaaaaaaagggttaatttagtatagtaggactatacgcatataagcatgcccaaagagaagggggttaattaattaatataatgatgagtagtacggtactccattttaagagtgtgatcgatcttgatcagtttctttttggcagtcgaagctatttaagaatataattgcatcatttagggattgagcgcatgcatcagagaacataattgtatgcacgttttctgaagctcctttgtttaatttctgtgtgatttttttatgtgcctatatagttgactgcatatgggtgcttctttcccaaaaataatggaactgtgcgttcttcttttggaacgtactgtccttgggtgtaacttaatatttgatgcttgtaatttacaacttgatatatagttcatgataacttgtttcgttcttataattagaaccatgccatgaactttataatagaataatctcgtgtcatttatgtgttttgtgtaactaacaatgaaggtgagaagatcaaggtcgtagtacctcataaactttacactattcctccactattccttttttagggtcctcattttatatacttttttctacttatcatttggaacatctacacagttctacaatacacctaagacgctaagaccattatctttcacaatcttatgtcccaagccgctaagtataattgtttatctattatatgcccaatatcatgctctctagtttttcttccctacaatttgtcatctcgttatttctccatcaacgtacaactccattatgtacgaggaaaagatcattccgctatgatactatttgagtgaacaattatcagacaacaattaaataggagtaacatagcatttattgaggtgaagttaattttcagaagggcaaatgttaacgaagacctggtaattaaactggtcttttcgatctccatgcccaattgcactgatcgagaacgtaaagaccttggcatagttttttttatggcacctatatattcagtatgtatttcagtaggaattattgtacaagagggacaattcatatcatcaaaacctactggtggcatttctaattttcttactgactgaactttacacttttgtgcacatattactagattagtgccatagtttttgtaagttcaagtgcgtgctgctaaactgtatcctagttgagaacggtgggagttatattatataacttaatttttttctacaaaacgttgaacagaaatcactggacaaccttaagtcagataagaaactatgcacactgttataatttaagatcagtgattctgctgacattattactaagagcatatatgatgaagacatcaaaatgtactttaaacatgggcatgcgtattacgagtagcacataactctagcagaaatgtatgaattctacacaagctcagcatatccttggctggctggctacatcttcttggagaacatccaaagctatctttttccacccctttgaaaggatataaaatattgtgcaagtgttagtccaacgcagtttatattatgattacacaacaatcccaattcccagggtttcaaattgaagtttacttctagaattaggttccaaccattaagcaatacgtacgtagtatattctttatatatgcttatgtttttttcctgagaaaaatatgcattgtagtttagaccaatgggccagaattcatctgacaacaataaacaatatgtacttgagtggtgtctgactggtttccttcatgttaccctcttttgaatatgggattcctatagacaataacagaagaaacaaaaaaaatgcattatattagattaaattcagagtgctttagacaatcatatatagagtttaattttccattgatatatatgaacatgatatgatatgataattgaatatatatatatatatatatatatatatatatatatatatatatatatatatatatatatgatgctcgcagaatctcttaccaattttcagcgtaactagtaacaaataattaagatttattctcttattaaagaggctgtcttgaaggtgttagactatagatggttttgtatattagatatacattattattatatctccagagagcacacccctttgaagt

SEQ ID NO: 86505 - DNA, 2243 bp, Oryza sativa
cctgcgaaagaggcgatcccgctgctgacgccgtacaagatggggcagctggagctgtcccaccgggtggtgctcgcgccgctgacgcggtgccgctcctacggccacgtgccgcagccgcacgccgcggtgtactactcgcagcgcgccaccaacggcggactcctcatcgcggaggccactgtcatctcccccaccgcgcagggctacccggacacccccggcatctacacgcagcagcagatcgaagcgtggaaacccatcgtcgacgccgtccaccgcaagggcgccctcttcttcctacagatatggcacgtcggcagggtctccaccacaggttcgtccacttgctggtggttggttgattttttttcaaaggtcattgcaaattgtgctcgttggttgattaattaaatttcgaaatgaaatcgacagatttccagccaaatggacaggcgccgatctcaagcaccgacatgcagatcacaccggacgattcagggatggtgtactccaagccccggcggctgcgggccgacgagatccctcagatcgtcgacgacttcaggctcgccgcgcggaacgccatcgaggccgggttcgacggcgtggagatccacggcgccaacggctacctcctcgagcagttcatgaaggacagctccaacgaccgcaccgacgagtacggcggcagcctcgagaaccggtgccgcttcgccgtcgaggtgatcgacgccgtcgtcggcgagatcggcgcccaccgcgtcggcatcaggctgtcgccgttcctggacttcatggactgcgtcgactccgacccggaggctctcggctcgtacatggtggagcagctcaacaagcacgagggtttcctctactgccacatggtggagcctcgcatggccatcgtcgacggccgccggcagattcagcacggcctgctgccattcaggaaagctttcaagggcacgttcatcgccgccggtgggtatgaccgggaggaaggcaacaaggtgatcgaaaatggctacactgatcttgtctcctttggaaggcttttcttggcgaaccctgacttgcctaagaggttcgagcttgatgcgccattgaacaagtatgatcgcaacaccttctacactcaagacccaattgttggatacacggactaccctttcctcgatgaggatcagaacaactcggttgctgatgcttagattttgtgctattttagttgttggttctatatatccacaataataatgtgcacgattcatgtaaacagtgttagtatatgcctgcgtgcaagatgtcattttcttctctcttttttgatggtttatgtctgcaactaattcattttgatatttgattagttatgcatccaaatatattgggattaataaacgcagatgtattcacaccacatgagaaatatatgtgttcttttgtaattttataagttgatgtgctgtccttttttttacatcccagcatgggtcccttttgaattatcttgttaaaaaaaacttttctctctttgaatttacttagcatataaatccaaattaattccaaacaatggtttccatcacttgtgcaaatttttttttgtcacaattccaaattaaataccttaacttttatttttgataatggctagaaatccatcctctaaaacctaaactgacaatgccgatcgtacgaattatttttgggcaagcccttaagacactttagcatacatgcacacaaaaaaattatacaattatgggcctctttatagatgatattatgggcttctgttgaaatattttagagggtgtatgtgctctctggtcgagatgaaaagaagacatgctcatgattaaatcatttgagaagttcttatcatttaacatcagattgccttttatggttttattaatgttgtccatcatatatgtatattttttagagcttctatgttttcttcttgccccagcaattgtatcatatatttttgcttaggaaaaagtacgaatccctccccaactatcaggtgagtacgaattatccccctaaacccgaaaccagatatttttcacccctcaactatcgataccatataaaaaaaaccccgaccagctttgtaagcggttttggtctatgtagcagtctagtcagtaatttttttattaaagaaacaatgggccctacctgtcggatatctctccactccatgtcttcccctctcacccacctct

SEQ ID NO: 86506 - DNA, 3047 bp, Oryza sativa
tcgaggttggaattgcggcgggatcaagcgaagcctcgtcaggccatgccctcgtctcattcctcagtttatagagtccattccaagcaggtacaatatacatcctcggaacaaataaatgtatttggttttataagaaaaattagtttgcagtgcatcagtgatcctatattcctgcttattggagtacatacatatatgattattggcgttcatctgtgatcagttccctaggtttagatccattgtgttatttagaattagaatggtcatttattcagggggctttgacctgttagtaacccgagtcaagtcatggcctaattaactgaatgaatgatttcagactcaagaaaattgaaaataatctacgcatcttatcttatgaaaatagtatgggaaagagcacaggaaaataatctatctgaactataccagtttgtagcgtgggaatatgttatactcagttttgagggtgtaccacggtaactaatgattcacagctgctttcctccagggtgaaccctcactttgctggttggctttcagccgtggattagcaactggttcatgttctgaaatttttatactaaccatcctcagtctgtagtatttgaaatcaatctttcagtttgttctgaaatttttatactaaccatcctcagtctgtagtatttgaaatcaatctttcagtttgttctgaaattttatgcagaatataaccaatgccagtattttggaatgagcgcagaattgatccgtcacttctgaagaaactccgttacttagcagaagcagaggccacaacctggcagcggctggtcacttcagcggtctccaattgcctttgaatacgccaatggtaatttcaaaaatctccaagtagtccactaattttattacttacattttttttcatctaaagcaaaattgaaaacatatgtttccttgtaattctaaatttgactgcacatattttgatttttgatgagtactgctcgatagattcaaagcggcccatgagtttttttttttgagttgaagtggcaagagcattgccgaatatattagacgaatagagttcaccctgtttataaggaaaaccgggcccaaaaaacatacaactgcccggtttgctaaagtgaaaccggcgaaaaccttacacagaagacacaaaaagcctgagacaagacaactacgaactgtcggaggccgagggatgagcaagaccgtaagatgaaatctccaaggaggtgaataacgacataagccgctgtcgacgtccgtccaaaaactgggctggttttcacccaggggggagggagtccacaaggcaacacctccagggaggaaacggcacccgtgggcgtcgatattgccaatcctagaacaggcagggcatgaggtttttgggaactagcaattattgattttgattgttgatgatgaagagttctgactatctacatgggttagtttcttgttcaacaaattcaggaaatagtttcagctcatcagaagtttgcatcgatgtcatcccttctagccatcttctgtgcatttgcttggaacatttggttctgcactaccgttgactataaaatacagctcaacagagctttattttctcacatttctcataacaagttggatatggaaaaccatcgactctgaataggagatagcgagctttggaatgattctgagatagctccattttttatcttgtctgaactttggctgtgagctcaaatgattaaatcagtatctttttcatttttttcagccactgaatactttttaatagttttctattattctatggataatgcttgtgtgcatgcttatgatggattgctaattgttttacacgtgcataataactgtaattaactgggggagtgcttcttgaggtagatggaaagctttgctacttttgaagaaaacgagtggataatagagaaattgggtgagacatcatttattctgcgcaactttgagaactggctgagatgtaaacctgggaaatatagtcatcccgtgtgaataacacaaatgagcttcgaaggacaaacatcatgccattgggtcagttctgcagttaaagatagttgtctgaaattgatgaagttcttgactgcaggttgtcttttaagcagtttgtagcttaataaacggttgtgcaggtgccatggtcatactattgatcctgttagaacaaacaagataaaatggatgtgcccaacaactagacaataccacataacttatgatattaccgatagtgatgcgaaaatcagggaatagacagtattgtttcttcttgattcagaaggcgttctccagctttcagcaagcctcatcttctattgattttggcatgattgagcgaacgaagttaacctcgctaaatgaaggtacccaccgctatagactgtaatgatactccctccgtacttataaaggaagtcgtttaggacaatgtttaagtcaaactttaggaatataaatcataaataactcttaagttgttgaatttgaaaataaaaaaattatatgaatagatttgtcttggaaaatactttcataaaagtgtgtgtgtgtgtatatgtatatatatatatatatatatatatatatcacttttcaataaatatttttatagaaacaagaagtcaaagttatgttttggagaccgtgtcactgtcataaacgacttcctttgtgagtatggagggaatacacattagttactaaattttcagaggcttttgccttaactttgttcaaaatataatggagaactctgttaacaggactcgtaatggggcaatgttgacgtcactcaatgaagctacatgggtcttgcataaagggattgatcagcttttcttttatgcttgctcattgatgaaatgacaggcattaggcctttttattttcaaacatttaatttgctaacattgatgccgtgtacccttagtagtattattatatagtagaacattttttatatcatgttctttggggacaaatttacaccgagt

SEQ ID NO: 86507 - DNA, 12249 bp, Oryza sativa
acacattcttggtctcctttcttacaaaaaaaaaaaaagcttacttgtgtcccccagaaaaacgtgagtacagccacttggtgcacaagaatttttccttttcttaaaaaaaactaggaatatagcccgcgcacatgcgcgggcatctttaatgtgtttgaaattttattacgaatgcttacgcgtagttggctttttttttattgaaataccctttgtactttcaaacttatttgggatttctattaatgttggttatgattttattctagttacgcttgcaacataaaaatttgttaactaaaattgtgtgaaagcatgccgttttgaatttataagaaaatattgtgtcatcaccatgaagtttctatgaaactatatattgtactatgggtatttctatactttaagtaataattgcttttatactatctatttctttttggattttaggataaagtaatttaagatttctattaaacatatagctaatagaactatgtcatataattaaagatagatttatacttcgtcgcataaatccgagaaagttaaattttgtttcaaaatataagggattttagagtagtattacttgtcctatccaaaaaactataatttataatttattgtttacccaatcttaccctaaccaccttcccaccctccacgtctcttttaattaataaggggtatcatggtctttttttttcttcctcattagctataaccctaaggcaaattttgttataggacactgcgatttcgtggttttagctgtaggataccgtccgaactcacttttagaggaagacactccataaacgtggtaatttaccaatgtacaccgcgccgattagaataataatttccggttgaagaggagagagaaatcacgtgaaatgtcaaaaatgcccttaggcccacatgtcagctctcctatctgtcctctctctatcccctccttccagcgtctgatgcgcggcgtcgggtagtcgtggtggcggagaacgatgctgactccgcgatggcgacggcggacactacgggctttcatgcttcctcctcctacaggacctcgagcgccgctaggatgtcgagcccgaccccgcccgcatcacggtggcgccacccgccgctgcgcggcgacgacgccgcgtgaagtgccgcgtggtcgaacgggcttgtcggcgacggaagatcgccgctgtcatactattgctgttgcggctaccacggcgagcagcgggcgacggagacgtcgagcttgccttctccaccatgggtgagacacgtagagagagaggaggagatcccattgaccggccgcttggtgaactccgcggcgttgaggatgatggtagggacggggtcggtggcagcggaggcgggaaggcgagggccggcggcagtaacggacggtggtcatggcatcccaccgccggatttccgccgcatcccggagttccgcagccagaactcacccgtgctgtctcgccatcgctgtcgctccgaccctcgcccccgtgtcgccgcaaccgctccactccgcgcatcagacgttggaatgaggggatagagagagagagagacatgagagaaatgagagctgacatgtgggctcaagacatttttgatattttacgtgatttctctcttctcttcaaccggaaattattattctaatcgacacggtgtccattggcaaattaccacgtttatagagtgtcttcctccaaaagtgagttcgggtggtgtcctaccgctaaaaccacgaaatcacagtgtcatgagcaaaatttgcctaaccctaaataccttaagatggttctttactacctgtgaaatacatcttgatgtttttttctaatttattaacacacttggatgattgttttttaatctaaatgcttatctataatgtagatagctacgaataacgtgaccacttgtataacgataaattacacgttgaatgttgtgccttcgtaaataaaattttcaataatttctcttattgattatatgctttaatatatcaataaatacgtaggttatatgctacatagattagtcatattttttaaattatatgtagggtgtgtattattgatgttttttaatttatgttttttcatattgcagtatacatatatattttttgatttaaagaaaagtcatgaggatgtagttttcaattattttgttccatgagattgtacacctaatttacttatttgtgtttatgaataacttattatattgccatgtggaaacataggaatgtctataggagttccacgtgactgtttgagagcgttttaggaagtttaatggacttttattgtataataatagatagatatatagatttttaagatttgtccgatttttaagagcgtcacgcgtgatggtgtaggagtgttttactttttgtatataatataatatatagattataatcaggttgttatctaatgtttgattttattctcatattaaattttgctaggtataaaattaaaaactaaaaagaatgagaagatatgagatggagggaggggtggacggacaaatgtacgtatgtacactacgtacatgagggggatcagaggatgcctgggagggtaggggtggatatttttaaatctaacagtgaaaaataatgggtctaccgtattaagtgaaaatcaagggtatgatgttttgctttttttttctcagaatttttttgatttctctaatttattagaacgccaagtggaggcttaggagcgtttgtaggaagttttatggacttttagtatataatagatgaagtactacgtaagagataaatgttgcgcaacaaactatagtgatctaatttatgtatatgatagaaacaaccataacatcacatgaatacactcgtaaatgtgtcttgtgtctcttaaagtttaaaagacgaagaccagcgatacatcatttgcctccctaaaaccctatttataaccggagatagtacaattacataggagggatgcaatttagctagccctaattagccaccccaagtacaagtgctcaccacctcctttctactccctccgtcctataatataagggattttaagtttttacttacaatgtttaatcactcgtcttattaaaaaaatttgtgcaaatataaaaaaaaagttgtacttaaagtactttagataataaagtaagtcagaaataaaataaataataattctaatttttttgaataagacaaatagttaaacaatacaagaaaaaattaaaatcccttatattatgggacggaggggagtactactatcaaacatgaccatgaccatttactaatagtctagccctaaggccctgtgagtctgtgatgtgttgggcaccaccaaccattgccatgatttattcctcttctttctttctctaactttaattttatttattcttcttgtgaggcccaagcggccaagccgggagcccgggagtgtgcagcagtagactagttagtagctgttccacggtcccgaccgccgcacgcttagtttgaccggagccgtccacccgtgaatgtgatccatccggttccacggccaactttcccggtcaaacacgacgtgacgttccccgtaatcccccacacgatccacgggagaaacgcccaccaaacaaccacaaattcttccagaaaaaaaataaacgaggagcagtgacgttctcgcgaccatcatccgaacgtgccaagcatcttctctcaaacaaaatcgtgtcttaaaaagttaaattaaactacttttatactgagccgtttatttactgtgcgacaatgcgatattatattatcgtaatcctagtcgtgatcgcgatcctgacacgaacaaaaaaacgggccgtgtctaggattgtgacgctgacgacgttttgccaagggcgacaccagtaacagcactgtactagcagcggctatcagctcacatgggcatggccgctcgctccgttcaacgccggggaccgttcgtttcaactgcttctgccttgccgaccgccagtgacgaagcggaggtccgctgaaacaggttggcagttggtggcaactctgctgcagaattatttgcagcatgacaggtgaagttctaggcatctagctgcaagtcgtattccctttgtctaaaaaaaaaaatctagaacttaatatgacaacgaatctgaatagaattatatccagattcataatattacgatgtgatttttcatggaacagagggtgtatcacataaaagagcagttaatcatagctcgatatctgcagtactaggggtagttgctattggtgatcatcttgattaccacttcggagctttcgaggcttcaaacataggaggcatggtaaagatattctttttcctgtaaagttgatcgcaaaggtcgtcatttctacagtgtatccagtgtgaaagagcaaaagaaatgctgacgaatgtatagtactttacatgtttcacagataacagtttcaggaaagggaatttatccaattcaggatattgttggtaccagagatattgtacactacagacatgcttccctgatgcagaagacgctcttgaagacacccaacgctaataatctcgcaaatcttcttttacagaacaatccatccattagcatttcttatggggaggccccttagtacgatctgtatagtcccattaagggcttctccctatcctccattctttttcttgctgcttcacgcgctttaagggcggcttcctcctcctttgagatcactttgggcttgccgtcctctctttttctcttgttaacagcaatggcggatggagcaccctttacagttctcatcggattcagtggtttcttgacgaccaaacctggagcttggccccctttaattgtggggacagtcgcaactgaagcagttggttttgtttgtgaacttgaggattgcccagcattagcttgggaggtttttgcccatgcgtatgcctcttcctgagtgacccatttacctgctcattaagaaagcataaatattagtgagaaatagcagctccctcaaaggcatgacataaccacttaaagatccagatacacatgttaagagaagtacctaaaccgtcagaatagtagaaaccagaatttgagtcaaaatagagtccagtagatttgtcataatagtatcctgaatagagtcgaattcccatcctgcacaaacaggatgttatctaacagattgaacaaatattgttaaatagcgaaaattgtaatagtgctggcggacagaatgatcagcgcacatatgcaaacagtgcatcatggttcatgctactcagtgtgccagggaaaggtaggaactggtctgttcatctgttctcctgtctttaatgacatataatcatcagtaaagacttaagagtattaagcatactaaccagaataattctgctagggcacagttcatgaaaatctaacatcatttcattaacattaatgcaattgttagcaaaatttatcgtcaacatagtagcagagcaagtattactcacggctcaatttggtagtaaaagttttactcatgatgacatggacaaatctcaaacattcatttctacatcctatagtagtttccaggttacatattttcccatacatttgagccaagagaaagatatgtttgaaggacggatttaagataaaacaattttaggctttgaaaattgacagtagttagacatttctgctaaccaaggtattgtattacatgagctaggttggaatatatttcaagcatgtcaaaaactagaatcagcaggagaaaaaattaagaagataagactaatacaacaagttaatacaagctcaaaatagtgaacaaaaagagaaaacagaaatcatgaccaactaaaccctctcaagattggtgaattaacctaaccatcaactaaaaaaatcctacaaaagcataacagagaagtaggatgttcccaaaattcctaaaataaaaggaaaaaatatttttcactatcctaaacaaaggacgggaaggaagatagcaagcatatatcctctaaaaattagtcatccttcaaaacggctcttcctagggtgaggtattatctgtccccataaatagaaaattccaggagtaataaataggattaaagtattgatataattggaattgcagaaagaaatactccatactaatttactaaaaaaagaaagtacctcatccaaaggactcattttatattttaggattaaacaaaagggttcgcaaataaaagcgcttagggatagcttcatcagatatggaggcctattttttttttatacaaagcagagataactaatggcacaaaagaaaacaggctatgcagtggatcaggcattgaagaacactattgatagacaacggtgagccatacacaccatctccaggtgccgcagaagtgtcaccgtccacattcctttgactgttctctaaatctttttggtagctctttttagctttctgcagtgaacagtaagttacaaataacaaggcatggtagttcataaatcaaccaattgcaagataaattgaaacaacacagcaataagggaaaggataaattcaaaaagaaaaagcctacatggttttatcaatgcagaagtgtttacccttcacaagctctgtagtttgtgacataacaatatgtacattaggtgattaggataccaacatactggggaaaaaaacagcattacaaacttacagcttctatttgcttgagggcccgggctgcttgctgctgctccttttctttggcagcaccctccttttgcatggttgccaatcttttagtgacattgtccttgtggcgcttaccgatttcatgtgttctgatgcttagcgggttattagctatgtaaatcttacagaagtcacaccatttgtttccttggctcacccagtactggaaaaagataggggaaaaagttatttataacaaaaacacttgcaaagttggatgcttgtgatgacagtgtacaacaacttaaatgtcaaagaagatgatcgcagataactttcaaagggctaatagggaccctgtattcctaccagaaggaaactacagttgcttcttgtactgtcaccttttcagatagtgactaaataatctctttctcgcaatggtaaaaaatattgatgccaaaaagtcaattagcaggattggatgcttgcaacaacagagtttaagagcataacatagatcatatgaatgattggacacgaattttttcgaaaggaaaaaacaactaactattctcctataaacgaacacaataggcatttgtatcctgatttattcagaaagagaattgataatattgccatgatacatcacattgggactttcagtctctaatctccacttagcatttcaaattcaattacagttgaatacaaacaagtactaaaaaataccattaacctaccaaaagaatcaaagccctatttggttaactatctcaatctacaaaaacataagatgactgaagcacccatatgaagatggaatcactccagtccagaggcaaaatcttcctcagtccagcctcaccaagccgcatattctatctactctcccatagcatccgaacacacagggacatgcacaagcagcatacgaattacgaaactaaccctaattcatcgaaatccacgagaccaagtgactaacagaggcaaaatccctaaacatcagctaatcctgtataaactcgcactcggaagacgccgaccatcaccgagaaaccccccaaaggagaaaaaagcaccggggtttcgttcagatcgatgcgcgaatccccacagcgggcggcggagggcaacagggcaacgcgcgatgccggaaaattgcggaggaagaagggagagcgtacctccgtcatggcgggcaagggctccgctcagctgcgccgattgcgacagtgagcttcgcctccgctgccgggggaggggatcgccggagcggccaagcgagcgggggatttttggtcgcagtcggagacgggacgggggagagggtgctggggtgaggagtatttctcgggatgtgggcccgccggagagggggagaagcgcggattccagacgttcataattcaaattcatgccttgtttgaagtttaaacacgtgatttttcttccgagtaaatttcgaaaacaaaaagaaacacaacaactatttttttatcgaaactcaattttaatcgagcatttcggatagttgcaacaataacatatgatttattagaaagctgcaactttatatcctactccatccattttatatataagttattttgatttttttaattagtcaaacttttttaagtttgataaattttataacaccaattagttttattaaaactaatatttaatatattttgataataggtttgttttatgtaaaaaatattattttatttttctacaaatgtaatcaactaggaaaaaaaattcaaaatgtttcgatccacctatcatacatatatgaatactcatatatgaatactcatgttgttgtatattgggttcacgtgttacatacactaaaacgatataattttatagttttctaataaaatcattcactattattgtagctttgtagatagcaaaataataattttgaccaaataattacaatactatgaaatttatttttaaaaaaaaaaaatcggatttctgtccgcttcgtacacgaactgcattttggacaaaggcgatgatagtttagtagcaacagctaataagccttagattaataaacggagcaactaaaattgtttcaaataattagagtttggttaaaacttttatatctattctcggcaacttaaaagctaaggctagataatagaatacgatgaaagaactccaaaaccaagtatcaaaattaaaattttggctaaggcttatatttaagctaacatgcagacttcagtttaattagaaattttcctgcattccgaacttgtctcaagtccatcccaggctattatttctcaaaaaaaaaaaaaaaaaaaaaaaacccggccgaatgtttgtgttatagatgactcttgtctcagaagaaataatggtctattaaaataaagttaggtatggatgtgtctcctgttgcctaatatgggcgatttctggagtttccgaaactcaaatatgcgattccattgccccagactccaacattgattgattttaatgaacatttagtcggagtacatggacaattcaaacagatgcaaactgtaagaggtcatgttccacgaaatgtaagctactgctacactttcttcgagcgatcagtcaaagttttcgatcttgattggagttatatcatctgccaccttaaaattcccgactaatcgagcaaagaacaccatctgctgctccaaagtaaacttgatgttctcagcctgttcaaatggaagagcatactccatcacaaccttatcgcagggtttagggtgtaaagagacttgagactatagagagacaagtgatacagtttggtaccttgcggaaaccatgctgctctccttcgtattccaccaaggcaacaggcaaacctttctcttttaaggccttgtatattttgcgtgcctgatctggtgggactacctggaatgaaaatgaattgaagcagatgaaattgtttgcactttacagttgcaattatgcaccattaatttctcggttatcatgattatgagctcataggaaatgtttcacaaggaaatattgcaggaatgatgagaggcaattatgcatcagtaattcctcagttatcatgactatgcatgagaccaacatagaaacttccggtttatgaactcataggaaatgtttcacaaggaaatattgcaggaatgatgagaaaaaggctcaactacacaatatagaagtatttttttttaaaaaaaaaaatctttaactctaagttataagtacctagaaagtgacccttgcttctccaggtgagttatgaaaattaataaaaaaaaaaagcaaataacatgtgaacatgaaacttattacttgtcttagatctaatactcctgtaataaatctgtaagactaatgagtaccagaggatggtttaggaaaaaccattagttaactataggaggaactaaaatatgatgaattgatgatctgacagaagcggataatctaataaacagaaaataaaagctcgattcaagagtcccacattagcttgtctgctgttctgctagatattgatctctattcaagggtgcaagtgtaacagcggagcatacctcatacagtaaattttcaccgcatgtaacactttgacatgttatacaactatacactgacaaacatgacttgtctaaaatagttgatcctccgcaatcatcacataccttatcatccaagccttgaaacaaaataactggacatgtaaatttgtcaacaaagttgatcggtgatctctcatagtaagcattttcatttcctgaagagcaatgtagcaaaaggtgactattacattggacatacgggttggattgaatacttttaccaaagcagaaatagtgagactcttatggtcttacctacaagattgtcagtatagtgagactcgaatttgtgtgtctctgctctcaacaaagataagtcaccaatctgctcattaatatggtaataaaaatgacaagtcaacaatctgctcaatagttcttatgtctatgtagagacaaaaatgattgacgttacaaaggtggaccactctgtgaactgcactttaatctttttatcagttttccatatcaaattacctatcatacaaatgcaagtagtgatttaatacctcaatttcacgttataaatcaagtttgttaaattcttagttatatctgtgaaaaacagatcctacaacgttgtgcactgggctgaaaaatattcttgaatattcccatcttggatatggactaagaaaaggatcatatcgccaattattttctaaaagataatgcaattgatgtgtaaaaagtaactattacttaaaaacaatcacaagaaatctagaacctgcagcccccattgttctttgttatgtacatttataggaaagccaaaaaagcagaatcctagaaagatatataacttacaccatacaaagaagctccagccttgaatgtgtccctgaatgcgagtgaagctaacgtagtgtacccacctgctgatcgcccagtaatacaaaggcgtcgctcatctactttcccactctccacctaaaaaatgcattaaggtgttttgttagcattactataatgaaatgctattatataattacaaccattactactaggatgtaccaggactcttgcacagctgcaacaatcatcaacatcgacgataccccatttccccaatagcctctctcgatactccctcccaaaaccttcagttatattatactacagttaaattcagtgataaaactaaagatttaaataacctagagcctttattaaatcaactacgacatgaattagcagaaaaagaaaacaagctcccaacattgtacataaaggtgcaaccaaaagtccaaacagtggaagctaaaaggacaaaccagtgcttcccccatagttaacatcaagatatgcccatcctcgacttgtccaatactgaacactcaggtccagaattccacgtgtttctgctgttggtcctcctgaaagatgtggggaatatcaaatatgcgattgccatgattgtgatcatggaaaagaaggatgcaataacctaacgaaccaaattagacagaaaccacatagtaaaaattgtaaatacaaaacagaacacataacagttgggcctaaataactgaataattattttctgggatcaaactacaaagatattctgaggcatcacaaggcttcaataatttacttaccatgtgttttgacaagcaatggaggtttttcgtctggcaaaccttgaaaatttgggtttgaaggtgggtagaaatatgcataagctttctggccggtgctggatgttgaaaactcaacaaattctggtgcactgaagaaagaactatattgtacaacatctgatgaggatgaccaaattattgagaaactaactacttttgttctgtcctcatttaaagctacctgaaa

SEQ ID NO: 86508 - DNA, 714 bp, Oryza sativa
acggaagattttttaaataactttttggagggttttcttttatagaactgtctataatatatcttttagagtcagttcaaaaatggctcatgggacgtactgaaattcaataggcgacgcaacatggacatatcgagtatatacattcccttttcccagccagtgtgattttaactgagtatatatctttacataaacgatgttgcaagagaaaacagcatgttacgaagctcaacaagcaataaaaataatctaatctatcctgttgttgggcagtgaggggaatagcagcatttcatcagtgtccaggagagtagcatttcatcactgtccaggagagcttcaagatgacgcgttcttcctagctgcgtaaacccggtaagcagctacgcccacaactgcaacagccgctcctactgcaaattattggcacaccatcagttgtgttagaactcaaccaacttaagataaaaccactattcagtttcaactcaaaatcataaataactattacttttagattttattgtcttactaaacctgtgctcttactattctgtagtaattggcatgatcgatttgtgccagagcataaaggcaaatacagaaacacactttagaggcagaagcttgacactaacttacctgagacaaccgtgagggaacggttcagaagttgacggtattgcctgtgtgttttcccagcttcagtct

SEQ ID NO: 86509 - DNA, 1527 bp, Oryza sativa
ctcgctccctctcattctccctcgtcatcccggtgtacgccccgtcgcccctcatcgtcgcaaggcgtcccggagaaaccgccgccgcccgccgtccattcgcggccggcgccttcgtcttcctcccgccagcccgcgtaggcgccacgtaggcgccacgtcggcgccagctcggccgagatcgggtcgggccgaccccggtcagcccctcccgtgcgcgcgttccaccgcgagccgtgaggctgcgcgtgggcccgccgcatccattccaccgcgaaccgcgcgcgtgcaccgcgtcccagccccggccgcgcgcgtgcgccgcgtgctcgctccgcacggtgaaccgagtcaccgacaagcgggtcccacccgggaccacgcgtggtgagcccggtccaccggctctctctctcctcccttcccgcgcgcgcgtgcttgggccgccttgggccggccggcccatttagctcggccgagccgccccttttctctcgggccgcgccctagccgccgaggaaaagtctatattccctccctcttttcttttcttttcttttccaaaaaggatttaattaaatccttttcctttagaccaaaaatccaataatcttagaaattcaatatcttcccaaccgtaaatccgtttgactccgttcaacttccaaaattcctcaaatctcgagatctatctaatggcacgcttagaggtcattaatagagctttattttcgccgtttgttgagttgtcccgttttgcgtgtagtttcggagaccgaagacccgcagtgcgaggatttcgaggatcaagctcaagatctcgagcaaggcaagccacctttgaacatcttgagcctatatttgaaattaattatgttgcttgaaaaatattatgcattgataggatcacacttaatctgcttgtcccgtctgcaaggcagattggcggacctacctatttgttgcatttgatccttcctctgttaattgttataccatgtttccttgtaaccacctagtcgcgcctcggaaatcgtgcactctgcactagtatcaacggtcgccttcaaacttaaaatctgagtaacttcttgggtaaaacttgggttttacaaaagacttggaaaacccgacacctgggttggtgcttgtgaactaaatgaatttccaaaaccgcggaccggggaacgtaccaggtgtacggtttcccgctcttgcacttaaggaccgtttccttggaatttcatccgaacataagacaagtacgaccacatgggtggaatgggacacccctggctgagtaactagcttatcaggggagccttgatgccgagagacatgtggattcaccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtg

SEQ ID NO: 86510 - DNA, 1088 bp, Oryza sativa
cctttaggaaacgtcttcctgtcacgtctctcttcactcttccagcgacatctaggtagacgtttgaaaccagatttcttggcgagccttcggctaaaacgattcctgtagcgtgcagttaacttatgtatgacagctgtcaccagaagatcattgtcgtcaaacttgcatttatgccgcgatgatgccttttgccgtttgacatcttttttggtagttttttctggcacaatcttttctgctgacccaatgcgtactctggcttgatcattgtcactattttttatgggaacttgctgattcatgtcattgctatttccaggcaacaagtttaatgaaacctgctcagtgcttgctgaacctatctgttctttatcattgctaattaaacagccagcaggattctcagttgtatggtccatatattgaccaattgcgcagtaacttacaggaacatcatttaccttctgtttcttttgactgcctttgtcttcaatatttgcagctttcttggaccttttccgattgtttttgctcgagtctaattttgacgtttgcttcggtccagaagttaacatcccacactccatgttcatttcaccatgaagttcagatgcctttgagattggttcagaacagatcaactgcctaggaggttctgggtttaggaccgtccaacaaattggagaaccctcattgtcaaggtataggaatccccgaatcaaacttgcttcatatactgaggattggatgcctagctgcacgttagtccccatggtgccatttgaagcattgaggcaactccgcatctcttggctgcacatactatcattcatgaaagaaagggttccatcatgaggggacacaaacaataactgtggctccgatatcaccatcgcattgttggtgccttcacatgataactgccctccttttgtcatctcttctgagctcatctcattaccttccaaaactgtatccatcgttggtagaaatgacagtgcaccagcaggtctatccatcacatctgtatttgccaattgggactcagcgacaactccatcatcatgctgttcgggctgcaggaa

SEQ ID NO: 86511 - DNA, 1922 bp, Oryza sativa
acactccttagtcaatttcataagcatacgcatctcttgatgcagactactggaaggaggatgtccgtagtgaaatggattccattatcgctaacgggacttgggaggtgacagagcgaccctatgggtgtaaacctgtggggtgcaagtgggtgttcaagaagaagctcaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcattcatcaaatggacgttaagacaacttttcttaatgaagagctggatgaggagatctatatggatcaacctgatgggtttgtagttgaaggtcaagaagacaaagtgtgtaaattgttgaagtctttgtatggtctgaaacaagctcctaagcaatggcatgagaaatttgacaaaacattgacatctgcaggctttgcagtcaatgaggcagataaatatgtgtactatcgccatggtgggggtgagggagttattctgtgcttgtatgttgatgacatactgatatttaggacaaaccttgaggtgataaatgaggttaaatcattcttgtctcaaaattttgatatgaaggatttgggagtagctgatgttatcttaaacattaagctaattagaggtgagaatgggattacactcttgcagtcccattatgtggagaagatcttgaatcgctttgactacattgatagtaagcattctccaacaccttatgatcctagcttgttgcttcgcaagaacaagagaattgcaaggaatcaactggaatactcctaaatcattggctcactgatgtacctggctagtgcaactaggcctgatatctcctttgttgtgagcaagttgagccggtttacctctaatccgggagatgatcactggcgtgcgcttgagcgagtaatgcgctatctgaaaggtactatggaattggggcttcactattctgggtatcctgcggtactggaggaatatagtggttctaactggatctctgatgtggatgagatcaaagccactagtggatatgtcttcacactgggtggtggtgctgtttcgtggaggtcttgcaaacagactattttgatgaggtcaatcatggaagcagaactgacggcactggatactgctactgttgaggcagaatggctgcgtgatctattaatggatctgcctattgttgaaaaaccggtgccggctatccttatgaactgtgacaatcaaacgataattgtcaaaatgaatagttctaaggataatatgaaatcgtctagacatgtgaaaagacgattgaagtttgtcaggaaattgagaaactccggagttataacgttggattatatccaaacagctagaaacctggcaaatcccttcacgaagggactatcacgaaatgtgatagataatgcatcgaaggagatgggtttgagacccatgtgagttatactatggtggtaaacttatctatgtgatcggagatcccgtgaattagaacctgggaagaacaaaccattagtaaactagaggagagtaccaatctataccctttctaagtgaagatgtatgtactctcgtgagctgcaaggcaggttggctatgccttaatgagttctgttggctttaattagcgaagatgatgtcctacagagcattcttgaaagaacttacctttgtaagcttgactgttggtcgcagtctatgaagattttgggtgaatcttctaggaagcttacgaaagacctaggagtatgacttatacgctccacccgaggagtagtctacaaacagtctagtaccagataagactctgagtgaaac

SEQ ID NO: 86512 - DNA, 17303 bp, Oryza sativa
ttcctgcagccctttatgacttctgtaagctcctaaatatccaacaacctacatgatcgtctgtcattcctgtatcgtttgctaggctctcaatatattgaagaaaattcctgaagaaacgaagaggaaactagctgctcgtggttacattgctcaatctggatatgtgatgaaatacctccccgtgccaccaaattgtttatacattccagaatttacagatgggcagagcatcatgtcctatgtgagttcttcctcacgtttgttcttcataattttcctgactggttcaattctatgtcatggcttattatacttgcttctcatatcaggacatatcaatatctctgctgaagaaggtgcttcagaaaatagagcagataaaaaagtcaagagctggatccccaaactttgaatcacatgaagttgaatcatgtgatctacagctctctattgcccagtacatacatctaaggggcactacaagggtatgttgcatgatcttaatgtgatagtttatttaccatatttacatgagagcatgttcaggagagtcctgtctcagctagagaattgctccagagagtagctcatctgctcacacacaaattggtcacttgttttgtaatcgtaattgtcaccaagccatgaattaggatcgactagttgtcaactgcatttgcacaggctgtcgacttaagctcatttttacaacaatttcaatactccttatagtaaccaaactaaaaatatgaatttacatttgacttcatattaatataattataatgactgagcacatgcatacaagggattttgattcataaatctctcagaagatagcaacaaatgaccaagcatatccatatgggttgggttgatcttgtgtcgggttgatcctgtgcatgagtatacactgtggatggttatcattgaggatgaacggtctgctattgtgcgtctatgtgcaccctttattagagaaaacagccatgcaaaccatgcatgcattgtcagtgaattcataatttcatattgcataggacgtccgtcatgatcatagacacactaagcaaaactgctcatttccctacattaactatattatcgaactcccttatagctattaaacccgaaactacaacatttctatagtagttggacctgaaaaggttcatgaaattcatcaactattagttcatgttaaagctttcttccataggtttatgttttacaaccgttctctcccagtagttgtgtgcaatcacttatttagtcttgtttcttttgtcccacggtaatgttgtcttgcagggtcctcaagacaacaccaagagatttgcaatcagtactgatccttctgcgttatcaacaaaacaatggctggagaagatgagaacattatttatcagcaaagggtcagggttttcatcacgcagtgtacttactggagatccatatattggagtagatgtgattggactgccttctgaagtggcaaaaagaatcactttcgaagagcaggtaacagacatcaaccttaacaggttgcaagagattgtggataagggattgtgtttgacctacagagatggccaggcaacctatgccatcaccgttggatccaaaggtcacactaccctgaaagtcggacagactatcagtaggagaattgttgatggggatgttgttttccttaaccgtccacccagtacccacaagcattccctccaggcatttcgcgtgtatgtccatgaagaccatacggtcaagatcaatccgctcatatgcgcaccttttgcagcggactttgacggtgattgtgtgcacatctattatccacagtcccttgctgcaaaagctgaagcactggagcttttcagtgtggagaagcagcttaccagttcgcacagtggcaaggtcaatctccagctagttagtgacagtttgcttgctctgaagcatatgtcttccagaacaatgttgagcaaagaagcagctaaccagctggcaatgcttgttacatgttctcttccagatcctgctgtgatcaagtcaaagccgtactggacaatctcgcaaatagtgcaaggtgctctgccaaaagccttaacttctcaaggggacaaacacgtagtcagggacagcactattataaaactggatcttgacaaagaatctgttcagacatcattctcagatttagtgtattccactctttctgttaagggtccaggagaagcactacaatttttgaatgtgctgcagccattattgatggaattgattcttttggatggctttagtgtaagcctccaggacttcaatgttcccaaggttctattggaagaagcacagaagaacattgaaaaacagtctcttatccttgaacaatcaagatttgcagaaaatcaggttgttgaaatgcgtgttgataataatttgaaggacatcaaacagcaaatttcagattttgttgtgaaacgctctcatcttggacttctgattgatccaaagagtgactcttcagtgtctaaagttgtccagcagcttggttttgtgggtttacaactttaccgtgaggggaagttctactcacgtcgtctggtggaggattgctactacacttttgtgaacaagcacccagctgtcagagaagaacattctccagaggcatatggtcttgtacggagttcatattttcatggccttaatccgtatgaggagctggtgcatgctatttcgacaagagaagctattgttcgctcctctagggggttgacggagcctggaacactatttaagaatctaatggcgttactgcgggatgtcgtcatatgctatgatgggacagtaagaaatgtctgcagcaagtctatcatacaacttaactacacggaggatgatgccttggacttccctagtgcaataggtcctggcgaaccagttggtgtcttggctgcgactgctatctccaaccctgcatacaaggctgtcttggatgcatctcagagtaacaatacttcatgggagcggatgaaggtaataacattaaattattttatgcattggtaaaaggtaatattgtatgcatgcatgataagtttggtatattcctttaacctaacaggaaatacttcagacaacaagtcgctacaaaaacgatatgaaagaccgaaaagttatcctatttctgaatgatgctcttgtgccaagaagttttgcaaggaaaaggctgctattgcagttcagggctgcctaaggagaattacgttagaagattgtgctactgacatctgcattgagtaagtatccataattaatgctgtcaattatattggtatataaattaatgctgtcaattactggggtatgtagttatattcgcttgctttgcttttagtgaaatcaatgaaggactttatttcttttgtggttgttttattgtagttccctggatttcttataccaaagtctaaaactcaagtttccttttcctttttggtccttcagaatactttccatttttgaaatgtgaaagttttgcggatatagaatgtagatagttggcaaatgttcaatatctgtccaatgaactgaaaattatgtggatctagaaagtaacttagtgttaacttatctgtttgcacaaacagtgtgtttgactgggttaggtcttatcatatttagggatggaaactgggctgcacccgctgggtttcagcaccccgtaccacccccgcaatgcaagatattgcccgtccccatccccatccccgcacacgggtcagtcaagtttccccctgtccccatccctgcaccaggtatgggtcacccggtgggtccccacactcggtaacaggaacaagagagtagcaagctacaagccagcaacatgacagcacaacagcaacaaagccaggaacgaaccaacaaaactagttagccaaacacaaatgcctgaacaaccaaacatcaaacagatcatatccaactatccatacttaaacaccaacagcgtcaaagtatgaggtcatagattggcagtggcagcggcgcgttagtcgcgacagtgacgtggtgtgtccttgaagcttcacagtggcgcagcctagaggttgcccttctggttgcccaggtggcttcgtgcagtcgctctcgctccttctggttgccctgccgattggatctgagagagtggaggggaggagtggaaggaagagtggatgtggactgtgctaaggtttcagtactttatatatgcacctctgatttgggccttctaaatgcttttttttttttactttttgggctgtggtcttaaagggatttgcaccttcctgattgacttggggccccatggggattcgggggccgggggcctgcagaacgtccccgctcccagcccacccgatgggtgaacaatttggcctaaaacagccccatggagggtgatttcctcccatttacagcccataatagagttattccccgccggttatcatgtccgggtccccattgccatccctaatagattcatattttatctgtttaatgctgagaacccggtatctcttttccatggatctgcacatcagtgttcattgtccactaactagtcatggacttggttcattgatgttaaacttcaatcatttatatactcttgaaattgtccatcattatgcaactggaactgccataaaacaacttagaaattggtcacgacagtacccagataaatgcaagttttgatcattctcaaaaatggaaattgagataaaagtctccttgtcgcatattgttggcttttagtattcattatcatttgagcagaacaccttaaatataacattcacgttgtcaggtaccagaagcaaataggtttagatggaacttcagaagcagccccagcacttgttggccatattcatcttgacagggtattatgatatattcttatgttggtgaatacttgcatgcaaacagttgtttttattatgccctgataatatatgtacatctttctttcaggcacatttagaaaggatcaacattagcactgaagatattcttcagaaatgccaagaagtttctgggaaatatgggaagaagaaaggacatctcagtaacctgtttaaaaatattacattctctacttggtaactatctattctctactatattgcttgagatctcacgtttgaagaataaattgcacgcactgctgttttgtttatgtggttgtgtcctgccattagttgctatggttgttggcggttttatagttttggtagaagagggttgtcatcttgtagattgctagggttattcaagtgctgcattgctctttaatcagatgttcaatatctaatatttcaacatcatgatgatgtgaaatcctacttatgatatgtgattgtcgctcgctgtatcaaatgataagttagttaacctcaactacaaccatatgctgtacctggcttgcaagtttcatctccattgaagtagtagaaatgagccataagaaagaggtaaggggatctttatttgcttcctagttccaagattgttcagttttgattttctttttcatgttgtttatagcaaagtattggtagcttggcatagcaatggagccatcgtctaggcagagaatattgatgcattgtttatttcaaatcacaattcctggcaatattctacttaagttcattttcagttaatcatttttagcattaattattatctgtttactgtgagacgatattatattatttaatcgtactcaagttttcacccttactcttggcagcgattgtttattcacacagaagctggttgatggaaagctacctaagcttccgtgtttgcaattctttgtttctgataacatgatagtatctgaatcagtggagagagcagtcagtgtgttagctgattctctatgtggagtgcttttgaatacaatcataaaaggtactgtaagttgtacataatatgcttctgttggaatttcattttcaatacaatttattatttaggttcagttgaaaatcctttattcacatcttgccatgttttttaaggggtggggggggggggtccaaaaagccaaagaattatgattgatccatttttagcccttaaaaaacaattatcttccttcacgctcatgtctttcataatacttttctttttttcccccaaaaaagttaccactattttcagaaccataactgttattgtgttgcaaacctagttcatgatggggtaaaccattcattggaggggttcaaacaatgatggcttgtggttgaatggcactaggtggagtgcactgactgagggatggatttagagtagctggttaagggaaagatcatctgattgtatagagagatgtggctctgtttgaggcaataggatgtcatggcctggcataactaaaggataacctgctaacaaaggatgggactataatgaacaaattggtaccctttagtgctaaagctgctgcctgctggctccacagctgtaacagattaagacattctctgttaatgtttggtagttaactgattctattggttaaattattgttataaaattaatgttctcctgtcctgtcacaaaaaaaaaagtgttgatgtgttaaccaaataagggtagtacttttagctcaacaatttccttgaattgagaatgttgctctgcaggtgatcctcgaattcaagaggctaaaattgtttgggttggatcggatgcaacatcttgggttaaaaacacacagaaggcatcaaagggtgagccagcagtagaaattattgttgaagaagaggaagctttacatattggtgatgcctggagaacaacaatggatgcctgcataccggttctgaacctcattgatatacggagatcaatcccttatggtattcaacaagtgcgagaacttcttggcatctcatgtgcttttgatcaagttgtgcaggtttgtcaccttaccctttttgtttgtaagtttgggaggtatttcatttcaaatctgctgtttgcaggtcacgctgcagatctttccaatctttttaatggattatttgaccacttgcatttacaagaacttactaaggaaaatttataaatatatgaacttagtatttcatgatagctctatggctacctctgcttcacaaactactgtgtttccgtggaaatagctgtttgacaatgttgatctaggtgtgttggggaactatctatggtttacgcgtgaatgcgataattgcatttttttttccatgtctgaccaagattttaatgttaatagagaatgttgactggtggaacattcggttttgtttttaatgggcaagtttggtccatttcaattgagttgtatttgatttctacgatgaactcttttgtacatcatgtttgtgcttatggatttgtccaatgcattttataaatttttatcttgcatctcatttcaatagattattttatatgtgctgaattgtgcagcggctttcaacaactgtaaggatggtcgctaaagatgttctcaaagatcatctggtacttgtggcaaatagcatgacatttactggaaacctgaatggatttaacaatgctggttacaaggccaccttccgttccttaaaagttcaagtacctttcacagagtccacattgattgtaagcttatctctgagatcaattggtttgttttttatcatcacatacattttattgatttggcccttttattttgtagacccctatgaaatgctttgagaaggctgcagagaaatgtcattcggattcattgggatgtgttgtttcatcatgttcttggggcaagcatgctgcaagtggtactggatcatcttttcagattctgtggaatgaaagtcaggtaagctggttttttctgcccactggagcttattgattatataagaagtggggcttcactctatttaattggggctaatctgcttaaagatctttgcacggtgtgaccaatcaaatgaattagcgttttagtgaaaaagtagctctgcttattgttgtaattgatttttttcagctgaaaagcaataaggagtatggtgatggcctgtatgattacttggcattggtgcgtactgacgaggaaaaggcaagatacacattctttgatgatgtggactaccttgcagaagagaacgaggcagatgtgtgcttatctcctgaattggatgggaccattggtcaaccgatcttcgatgataatttggaagagcaagatgttcagaataacagctcgtgggataatggcacaacaacaaatgcaagctgggaacagaatggtagtgctggaaatgattctgataaatggggaggttggaatgatgcagctgcaggagctgacacgggagtcacaaaaccagcaaaccaagggaattcgtgttgggatgtgcctgcgacagtggaaaagagttcctctgattggggaggctggggcactgaaaaggcgaaggagaaggagaaaatatctgaagagccagctcaacatgatgcttggtctgtccagggccctaaaagggcaacagatggaggagccagctggaagaagcagtctagcactcagaatgatgggaactcctggaaagagaacaagggaagaggatcaaatggaggttcctgggagaaagataatgcgcaaaagggatcatggggcaggggcaatgatgaagctgaaaataataatgatgtgcaaaacaaatcttgggagactgtggctgcagatgctcatgcttctacagagaagtcctggggcaatgttactgcatctccatcggataatgcatggagtgctgctccggtttcccaagggaatggaagttcagatacaaagcaatctgattcttgggatggctggaagtctgctggagttgacaaagcaattaacaaagacaaggaatccttgggcaatgtgcctgcatctccatcatttagtgcgtggaatgcttctccagtttcccaagggaatgaacgttcagatgcaaagcaatctgattcttgggatggctggaagtctgctggagttgacaaagcaattaacaaagacaaggaatccttgggcaatgtgcctgcatctccatcatttagtgcgtggaatgctgctccagtttcccaagggaatgaacgtttagatgcaaagcaatctgattcttgggatggctggaagtctgctggagttgatgattcagttaaagacaaggaatcctggggtaatgtgcctgcatccccatcagatagtgcgtggaatgctgctccagtttcccaagggaatgaaagttcagatgcaaagcaatctgattcttgggatggttggaagtctgctggagttgatgcttcaactaacaaagacaaggaatcctggggcaatgtgcctgcatctccatcagatagtgcatggaatgctgctccagtttcccaaggggatgatgtctggaattctgctgaagccaatgagtcacgtaataaggactggaaatcagatggatggggtgccagaggtggcaattggaggggccaaagaaacaatcctggtaggcccccaaggaaacctgatggcaggggtctgcctaggagacctgatgagagggggccaccaaggcgacactttgacctaacagctgaggaggaaaagattctaggagaaattgaacccactgtgctgagcatcagaaagattttccgtgaatcaatgtaagttacttcatgattatttgttaattttgtgtgattcatgatttacagttatatgcttttaagtttctgaatagaggaggcttggcttttatatgaaagtatgctaggtccgacatttaattgatttgtactgtcttaagctttttaactttattgttgacttaaaattttgcagtgatagcataaaactttctccggaagacgaaaaattcatcaaagagaatgttcttgaacaccaccctgagaaacaatcaaaggtgtctggtgaaatcgatcacataatggtatggttctcttgttacttttgggttgacctgttgtgcaattgcccgatacgctataatgaaatatagcattcgtttggcttatggtgtgcaatggcctcatttaatttgacaggttgacaagcaccaagtgttccaggatagtcggtgcttgtttgtggtgtcttcagatggaactcggtcagatttctcctatttaaaatgcatggagaattttgtgaggaagacctaccctgagcatggggactcattctgcaagaagtatttcaagaggcgccgtgaccaaccaccagcagctgatggaggcacagcaccaggcactccagctggggctacacagtctactgcagttgatacccaggagggcacttcacagcagacccaaccagatatcgcaaccgctccagctgcaactcaacaagagactcttcaagacactccagctcctccagcagacgatggattgctcgggaagggacctagcccgtctgactgatgctcagggtgcgcttagagctgccaacatcctgcttgtgctctaatcctgccactctttttttcctacttggcctgacattgcctagtgactagacagatggtgactttgtgtagtagagaagggttagcagtctttaggtctcactcttccagacgaactctgtaaattctggatgttagtgagctgcatcccgtagcttaaactcgtttttaccctctcttttttttttatcttttttgtctttccagtatggttatttggttagtccaatgcaagccgattctgcgaggccgtgccgaatctgatgattttgttgttctgcaaggcacagagctctcgctggtgctgtttcattttggatgctgttacagggttttgtaaagacactgaaactaccatgcgaatcagcaaaagatggattccctgctgtgaacaagcaggtggccttgcatgaattcattcatcaaacatgaggtcttgctggtgacgccacaaatttggtttgatgtgtttgcactgagctggaccaatctgttcttgaaatttcttcaggttggtacagaaaataggtaatattgtattctgtcatttcattaccaagaccagtggtgtgaacaagctggaggcattgcttaaatgcatccgtcaaccgtatgattgtttcagcaaaaatcacaaattttgtttgatgtatttgcacagcaatctgttcttgagattacttcaaactggtataaagcaaataggcaatgctgtactgtcattttgggttttttcacttatcattttcgacctttcaaattgtggtaatactaccaaaattttgtaaggtacttcctccgttcaaaaatgtagctacctagtacgggcatcactaggtagctacattttgggacagaggtagcagtgaactacacgtaccttgtcaactcaacccaaccaatttttgggtaattatattacttttcactcgtaaaaatccttccaaaagttagtaaggtattaacccaaacacaaccactcttaccttatcaaaatttggtaacgtcgaaaattgacattagcgaaaaaatgatttttatttatttttcattaccaggatgcatttcatccatcaacattcattaaccatatgattattttcagcaaagaccacaaaaaattgtttgatatattttgcactgaactggagcgcgccctgttcttcggatcacttcaatccggtaataacaaagcaatgctgttttctgtcatttcgttacaaaggatcagtagtatactcctaaataataggcacatccaaccgtcagatccgcatccaacggctgagatccccgccgccgcggcgtgggagtcatcacactagactagtacactaggctagccgcctcgaccgaacccctccactctcttccgcctccgcctccgcctcgccgccgccgccgccgacgacgacctccacctctccacgccgccgtctgcgatgcaggcccgcgtcgtcgtcttccccgtcaagggaagggcctggtgcttcgccagcccgcgcgccaccgcgcccgccgccgcttgcgggggcggcgatgggggcgccctactacccccaccgccgccaaccgtcaaggacctctggcgcggcatcgccggcgggggccgcacggcgtcggagaacgcggaggccgtcgtcgacttcgtcgcggacaaggtgctcgactcgacggggagcgccttctcgtctctcgccttaactgcattctcgcatgccgcccgcatttggggggtttctgatggtggggttttggctgccgcagatgaaccgggcgtggatcgggttcgggagcgcgccggaggggtcgatgaagaaccggatccacaggtcgggagtgtaagggtttggggattgcttagtggcgggtggcgcctgtggagtcggaaatggcgagatgctgagtcgttgggtgtgctcccctttttttttgctttgttgtggtgtagcttcgggctgaagctgctctcgcgggtgcggccgtcggaggtgctgctcaagtcggtgaccaaggacgtctccctactcgagatcgtgcatccggcaaggtgagctctgcttatgagtttggtgtttgtgtttgataaaatgtgcgtgcaatttgtgtcgtttcacctttgttgttattcttagtttgattgtcgaatcgattgggatattcaactatttgggtccttgttgtgatgaatatttcctaaggctctgagcctctgtgcaggaaatcatacagtatctgtcgttagtggcttagcttacttgcaatagcaatttatcattaacggatacacattgtcgccaatgaatggaactattagaatgtctgagcagatactaatttagatatacaagtttcagtatgcttcatgtagcgatacatgggttatatctgatcaagtttgagcattgactctgacatctctatcattccgttccaatacacaattcacaccagctttctctgttcatagctgttattcaagaactttgttgggacaaagtagttgaaagtccttctattctaagggcctgtttggcacagctccagctccacctctcctggagctggagctcagccaaacagtttcagctccacctgaaatgggagcggagctgggtggagcgctctcacaaaatgaactagagaggtggagctgggtccattccagacccaactcctggagctaaatttaagagttggagctctaccaaacagggcctaagaaattgcatgatttgcgtattgtaagtctgctgtaaaaatgtatgtcttaattcttcacagcttgtagctgcttgttttttgaacctctgtgcgtgctccgtaactgtaaaatggtagattctgtgtcagtgcctgttgttgcacagaagaagctctaaaagacttgttcacacgaactattcttttactggcttcgtaagttacttggaaagcctcatgcatatgcttgtttttgtatagaagttagctattgagctttatgaatcgctctggcactatcaagcatcaccagacagagttggtcggcaattttcttactcatgtcttattttatgtctattcaagattatttctgaatcctagctttaattgcagtataaatcctcgtcttgtgcgtcgacggttgcggcatattgctgtcaggtgagtgtttgatggacctgctccaacaatttgttactgtatagctcaatttatatctttcctcacccttctgtttctgcaatgtttctgagaaccaggggtgcatcagttcacaggaaatttctttatggctcagtttgtttgcttccagttacaagtgttttcatggtaagtctatattcatttgctttggaaaaaatggtgttggctagcaatttgcaacagtgatttcagtgggatcagtttgttgtactttgaagggattttttttttcattttgcgatgctatcaattattgaccaaactaaaaagattattagatctttatttttgcttgctgcctttgctagattgcgcacaatattagttgaggcttgtgtttggtctacttttcaacttagtacatcaaattaagaaaaatatgatgagctcatttacacattaaagataagggatttttacatatgtgggaggtataatttacacttctgattcagttaatgagccatacaatataattataattttgtgagattgtgctccagtgatgtctagtttataacctagcacacattacttgaatcctgatgacccggtaggttcttatgttttaatcattaaccagagtatcataatctacttgatcaaaggatgtgattgtatgttgccttcttgtgttgttgtactttaccccataggattcatagcagaaaaaagattgtgaaatagagtatacatgttggtatgaaaacttctaatgcgtgcaatccgtacttaactcactatgctatggtgagatgacattcattcttatacacctacttattcatttgcaggtactgcctttgccaaacataccatttttctgggtgctgtttcgtgcttattctcattggagagctctgcaggtttgttagatggcccagttattatagagttttcagctcttggatttttttttgttcaaactcctctctgtcgtggtgtggcgtttgctaaggtatgtttgatacttactttgacatagggaagtgagaggctccagttgttagtttctgacagctcagatcaatggaaaatccttcttgagaagcagaaagagatgagttccagaaaggatggcaacccttgtgaaaacactcaatatgctccttgggtaagttgtctcaattcaaaatgagttaaaccttcagattgttgtattttgagggaagttttggaccgagacatttatggacctccggagtcatcatcttgattattttctgttaattcaactagagttgtagatcggacatactacatcagttctagatcagatacttgaagagttgaggtagttaatctgtgttactatcacatacctactgcctctagtatgcaaatgtacccgaaggcaatgaacaaccttttctgacatgtggccgcatgggataatgcacaaacaagttaagccaggatatgccaattaaaagaatttatctacttgcacagttgcatatatgctggcttgttttacccgctaggcacagtttgtttgaccttgaggtttatgacatgtcagtgtacccttgcataactgcatgcattgtatgcccaacctgcacatacacatgggtggccacgactatggatggatttatttgtagttattgattatttaatagttactccatttgcatacaactggtgagcactttctggaatgcctgacttcatgttgcaatcattaagcaatcattgaagccagctattataatatatctttatatggtttttatataatataactttttatacatctgatgaatgatgggcacattgaagcttgcctgacttatatacaacaatgattaggctgtctgtgcagccagttatgcatctatgtgtaatctcaattcggaggatctgtacattgtggctcacagaaaaaggttgccagttacttcacaactccaactagtcaccttaacaatttttgccacaacatgttgtaatttgctgttggaatctgaatctgatattgtttttactgcaacataacttgagatcctctacctcacgggatttatatatgtccacaacattttatgaaggagctactatggaggaaatgggggaggggagttccattatttgtatcatataagatgatcttgtttgtaatatgtgttcctctcatacatggtcctttcattagttaggtgaaaatagtggttgttgggggtgttaggcaatagtggcttgtgactctagcctactgataattccttctagattgttaggctttgacagtatatatatcatatcatatttactgtatgtgcagtttgttttttttttgaaaaaagaaatacttattgtgttatttcttcaatagaatttgcagccttcgaagaagcttgatgggttccttgagagcagaaaattgaatgaaggattggattgtgataccatttcgaggatttgtcaggcatatgatttggacaagattgatgttctgaagtacagggatttggagtaaccacatccagtttcttggctgccgtggtgatttttttgccagctaatgtttgtgtggtagaaatgaattccgtcgtggagaactagctgaactgctgaagggtacacgagtgacacgagacttccaaaattagtgactaatgcagattttttttttttgcaagggatttggagtagtagcattacaattcacaagttttgttgttcctcagtctgctgctggtttacaaggcagaaaaacagacaggacctaaaactgtagtgcccatggtgacatctaattctgtacccaccatgtaaatagaggtggaggcatcctttccccactagcattttctttggtttcagcaccactcagtagtcagtactctgtaaggagatttgcttcaatggattttgcagctgctataacttctgaagtcaaaagttgtgactggattttgcagctaactatgaggccaaaagttgtgattggctaatattttttttttgggttgtttagggtgcaatcagaatcaatcattgggtagatctgcatccaattttggttccaaagcagaatctcctctctgcaaagtaccaccggtaaagatttggtctttctgaggtgcttccagtgaaagttcatagtttctggattaggactaacctttgtatgttttgactgatccactcatctacctctttgattgccattggattatcttgatagccggcggtcaaattaacttttagaaaaacttgagaggatggcatgaaagcaccacaaatccatggcattctgcatgattgaaaaccatctcctaattaggtgtggttatgctgctaggattggagcgaaataataaatatcagaactgggtccaataagccgttttccttcaagcttatccatagtagtagtagaagtactagttgtacctctcgatagtgacgttgctgtggcaatgtttaaacaacgcaaaaatgtgaccgattgggcgattgggattgcccacaaagtgacatgccaacttgttgctctcttaactcttttaccggtcg

SEQ ID NO: 86513 - DNA, 1622 bp, Oryza sativa
ctttgataacggattatatgaaaaatttagttgcaaatataaaagtacctcaaaactgtatggaattcttgtgttccaagcatttcgatttgctcctctcttctcttccgagctgctcgactttactagagctaatgaaggcatgccaaatttgacatcatggtgacatttagaacataaaatagattttacaaaaagtccaatttgaatttagatggtactccattagttacaaaatagtataagaatttttcatcacatccaaccaaaatcctttatattttgggacgggtagaaggagtgtaaagcatttctggaaggagggagtataagcatttctagaaattacaactggagtataaacatttcatgaaacttcgagtactactccctctatcctataatataaaggattttgaaacgatgtgatatattataatactataatgtgttatatttatctaaaattctttatattatggaacggaggcaagagggagtaccatctaggagtacaggtcatatcgggtaaattgcatctgcaagggctggatggccggagacccgatagcccattccccatttcccttatccggaaacagcctttgctttccccctccctaaaaccccccgcagcggcgcagcgccacctctcctcctcagccgaagcgtcggggccatggccatggcgatggcgtcgccgcccgcttgcccattcctcctctcgctctcggccggcgccaccgccatttccaccgtgtccgccgcctacggttccgtttccgccccgcgcgcgcctctcttcctcctcgcctccccgcgtcccgtcccgcctcgccgacccctcgccgcgggctcctcatctcccaaggccgcggcacccgccgccgtcgagatccccgaggagtacgtggacgatgttgatgcggtgaacattgcgcaggacgtcacccaggtgcatggccgcttccccatccacgcatatgctccatttttttgctttaacatgggaatgggtttccatctaaaacagtacagtgaaattggttaaggtcactaggatcatctcgtttagcttccagtattgtggtggttgagtctgtgaggtactggaattccatggtaaattttggtatttttctgtaagctcgcaatgggcatgggggataaatgataattggcttagatctcattttttgttctggctaggacaaactcacaatgggcatgaagtataattggttagatctcattttgttattctacccatgagcatgaccactcccacttctgatcaaacatttacttgttaatcagctgattgggaaaaccccaatggtgtatctgaataatgttgtcgacggatgtgttgctaatatcgctgcaaaacttgagtacatgggaccttgcaggagcgtcaaagacaggtatgtttttgtcatttgtgtattcttttctgccagtgccacctctcattcatgtcttttcaggattggattaagcatgattaatgatgctgaagagaaaggattaatttttccaaacaaggttagattatcctgatagtatttgcaatactaccatcatgaagattctaacttgtgcatatacttctacctatg

SEQ ID NO: 86514 - DNA, 1528 bp, Oryza sativa
attttcttccccctgatgatcattcagatatttatgttttggggtgggtcttttattgcccttttcttaatatactagacgtggaaaatattttttttgtcaattttactaaattttctgttcatgttatccgactttctccatgtatgttaatttcttgaatgttggctttgacatataagactatactagtatttgatacatagctgaacgaggtaaagaaaggaagttccatgattcctctgtggtaaaaactgtcattgattttgtattcagatcagtgaatcatattttgctttgtagcttcaagttcacatctaatcaattctgtaacatttaaactttaaacagttttcaggaaattgttcctctcaatgctggcaatgtgcttgtaatagaagacaacgaaccagctgccagatggcttgttcttataaaccaagcattaaaccggccagctgaaaccaatgccaatgtctttcagaatgagccatctccctctgttgattctagtgtctctcgagcttcttcaagcctcgatacttcgttctctgacctagcaaaaacatcaagtagttccacaatcttccagaagtctaatctaaaatccattagaaaatccttcatgccagtccatcgaaaacggcttaaggcctgcaactgccctgtagagatggccaaatcatcctacagggatgcttgctttggttgccccaaagcatatgcttacgaaatagattcgtcagaagaggatgaacgggaagaaaagaaagggcaatcaagggattctaatggatctgtgcgcagtgaagtaatttctcctcccaccgcaagggatgaactaaaatataatcttatagcatgtaaacaaatggttggcatttttgtaatggtatgggtgaagaaggaactagtgcagcacattggtcatctaagaacgtcttgcatagggcgaggaattctgggttgtcttggaaacaaggtcagaagcaaagcataatatcagtttgaagtgcttttgtaagtactttttctgagtacacttcttctgcagggatgcatatcagtgagcatgacactgcaccagacaagcttttgtttcatctgcagccatttggcttcaggtcagaaagaaggtgatgaattccggaggaactctgatgttcttgagatactgaggcttacactgttttcaaggatttgcaggagaggtgtgcgaaaaatcccagagaaaattcttgagcatgagtaagaatgtgcttttagtgtgcttgtaattagtaaatatatgtatcttgtcaagcgtatatttctaagctatacgctgtttgtttcagtaaggtgatatggttcggagatctgaactatcgtatcgcactgagctatgcagataccaaaaattttttgatggaaaataattgggatgttctctttgaaagggatcaggtaacttccatttcttgttgcaggaaaatgatccattttttctggaatagcaatatcatgtacctgagaaacaattactatt

SEQ ID NO: 86515 - DNA, 2446 bp, Oryza sativa
ttcctgcagcccccatgtgtggtatactccatgagtttttggcctggaaagcatattaccaatgtaaaagatatttctcttttccaataataaagctatatgttctgaatcaagtaacagcatggacaaaatctaatgatgaacatgtattgatattcattttaccaagaaaaaaacaggatattcgttgaaagaaactggaggaggccaaatgactcaagaagaggtctacttacatatacatattttggggatcaatttcattaaatagattgatgtagaagcgcaacccatctggactgacatccctgcaaaggatacctgacaaagaagttggtattagtttatctttttatatatagtgttcatggcttgaattttttttgaatgggtaaccatctaataccaatgctttctgcatttagaagatgctccttcgctaaagcaggtgcaatcccaagtgtaaatgcagcatcgctggggcttattcccttctgaagggcatcctccttttgtgcaagtgatgagattctcgcaaatacctatgcatatcggcaaataatcagcatgtgcttctgcttaaaacgataatagtagcgttcaatctgaaggtaacagtgggcaggtgcccaccaacaaattaaatgaaatggaagataactaaacaattggaaggtccagagatatttagccacactctttgtgtgactgctaacttgggattgttatgtcgtgtgatgtgtggactgtttgacttgaatttatgatgaaatttaggcctattcttgccagtgcttacctcatcatcactatgcgtcttggtctggatcaccttcactccactgtcaaatttcctgagcatgactgggctgctcattacaaatcaacatctataagcaaaacatagaaccataattaatggctggcaacaaaccagctgaaaatactaaaaaacacattacaacatggggtacatacacgtcaaatttctcccaaagggaacaggcttgcagaagatcctctggtgagatcaactctacacaaaatataaggaaaaaaaacaatatcagaacatgtaacaaaggaattccatacagatacttagcagaaaagcacagacctgtccctcttgcacggttgtagagacaatagacatcaactagtgccatcataccacctgctttctctagtggtgttctaatatagtcagccaactgataatgaatacaaaaggttgaaaatagccttagtaagactgctctaaccgggaggactcagaagaagataaaaactcttcaaaacagtgacgagttatagaggcaaggacatttttggtgttcctgtcaattgtgtatgaaacagaacttgagtgtaaaatctgtggtctgtagttgaaataaaagaaaaccctctgaatgattcccaaatttgacccaactaatgtgtaagcactaagcagcgtgaaacaattcaggcatgaggcaaagaaatgaacagaaagtactgttcaatagaagtagaggctcttggttgatggaggaaaaggacacacaatttatcctgaagatcctatggcgataaaacctctcaagttgaagatttggtctagctggcatgatattatacaaagttcatgcattgccatcagcatcacaattgagcttcacagacagtgaaaactacttcacaatgaatgcagcaagaacacgagcaaagcatgtattacctggcgtgacagctgctggtggtacagagcaccagcggtttctttcgtcacaggggacacgattccaacactcaatagccaatcctgcatgtcttgcttagatcccatctcttcatcattggaattggattgggctgatgagttcgtcaatagcttttgcctcattttctccgctaactccatcatttccttagctttgctctaattacaagattgcagcaaaacacacacaaaaaaaaaaagctgcgttgtaaaaacatatttgttccaataccatatgactgcgttacaagaactaaatgtggaaattttacattttagctgcgttgtggagcatggtgttccagtaatccagtcaattacgattgcatcacaagaactaaatgtggacatggtatcaagtactacttggcaagagcagcagagaggaacgaaccatgagggcgttgagatcctggaaggcatcctgcagattctgccccgcgctctcccacgcctcctgctccatccgcaggatcccggacaccccaaccacgggcatcctgatggcgagatcctcctccgcgggggccccctgcgccgccgaggagccgcccgcgggggcagccgccacggcggcgaccacctcccacgccctcgcgcggacggcctcgagcagcctcccgtagaacacgtcggcctcccccttgctgacgacgacggcgacgacctccgatcgcg

SEQ ID NO: 86516 - DNA, 3799 bp, Oryza sativa
gttggctttgctgctgcactgaaaccgcatgcctttgatggttcaaactataagagatggaaagcacgtgcactattgtggttgacagcgatgcagtgcttctatgtttcacggggcaaacgaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcacttgaggccaagttcggagtttctgatgccggcagtgagctgtatgttatggagcagttctatgactacaagatggtcgatgaccgttctgtagttgaacaagctcatgagattcagatgctggctaaggaacttgagaacaacaactgtgagttgccggacaagtttgtggcaggtggcattattgccaaactaccaccttcttggtcggactttgccacttctctaaagcacaagagacaagagttcagtgttcctgatctcattggctctttgggtgttgaggagaaggcgagggcaaaggacgtccggggcaaaaaggttgagggaggttctagtgccaatatggtacagaagaagaaccctcatgcatcccacaacaacaagaaagtcaagcctgatgtcaaacccaaggctgcaaccaattttaagaagaaaagcaagggaaaggcaaagggagactgctttgtgtgtggcaagtctaggcattgggccaaggactgtcctgagcgcaaagacaggaagtctgccaacatgatcattagcgagggcggaggaacatcggggtacggtaaaatattacctacagttctctctgtttttcattcacttgattggtgggtggacactggtgctaatattcatgtatgtgctgacatttctctattttcttcttatcaggtcgggagaggttcctccttgttgatgggaaacgggtcgcttgcggctgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtatctaaatatgggacttttgttggaaaagattatgacagcggaggcttgttccgcttttctttgaatgacatgtgtaataatcataatgctgtgaaccatattagcgagaatgatgagtctaatgtgtggcattcgcgactctgtcatgtgaatttcggttgtatgacgcgcttagctaacatgagtttaattccaaaattcactttggtaaaaggttccaagtgccatacttgtgttcaatcgaaacaacctcgcaagcctcacaaggcatctgaggcgaggaatttggcacctctagaacttgttcattccgatttgtgcgaaatgaacggcgtgttgactaaagggggaaagaaatatttcatgacactgatagatgattgcactagattttgctatgtgtatctattgaaaacaaaggatgaggcattgcatttctttaaaatctataaagctgaggtagaaaaccaacttgaaaggaaaatcaaacggttgaggtctgatagaggtggggagtatttttccaatgagtttgcatccttttgcgaagagtttggaattattcatgagatgacgcctccctattcaccccaatcaaatggggtggccgaaagaaagaaccgtactctaactgagatggtgaatgccatgttagacactgcggggctttccaaggaatggtggggtgaggcagttttgactgcgtgtcatgtcctgaataaaattccaatgaagcataaggaaataacaccattcgaggaatgggaaaggaagaaattaaatctctcatacctacgaacatggggctgtttggccaaggtaaatgtacctatagccaaaaagcggaaacttggaccaaaaactgttgattgtgtgtttcttggttatgctatccacagtgtgggttatagattcttaatagtaaactctggagtacccgacatgcatgttggtacaattcttgagtccagagatgctacattctttgagaatgaatttcctatgaaatatacacctagcacttctagtaaagaaactgtcatgccccatgagcactttgcaccgatagaacacaatgatcaaacgcctgaggaaaatcctgaggaggacaacattgtagatactcgcaagagtaagagacaaagggttgcaaaatcctttggagatgactacattgtatacctcgtggatgacaccccaagaaccatagaagaggcatattcatctcctaacgctgactactggaaggaagcagtacgcagtgaaatggactcgattatgtctaatggtacttgggaagtcgttgagcgtccatatgggtgcaagcccgtaggatgcaaatgggttttcaagaaaaagcttaggcttgatggtacaatcgaaaagtacaaggcaaggcttgtggccaagggttatacccaaaaggaaggcgaggacttcttcgacacatactcactagttgctcgcttgaccacgattcgagtactactcgctctggcagcctctcatggtcttctcgtccatcagatggacgttaagacagctttcctaaacggagagctggaggaggagatctatatggatcaaccagacgggtatgtactagaaggtcaggagggaatggtgtgtaaactattgaaatccttgtatggcctcaagcaagcacctaagcaatgtcatgagaagtttgacaccacgcttacatctgcaggctttgttgtgaacgaagctgacaaatgtgtatgctatcgctatggtgggggagaaggggtgatcttgtgcttatatgtcgatgacatactgatctttgggaccagccttaatgtgattgaggaggtcaaagactatctgtccaagagttttgaaatgaaagatttgggagaggctgatgttattcttaacatcaaactacaaagaggagatgagggtgggattacacttgtgcaatcccactatgtggacaaggttttgagtcgctttggatatagtgactgcaagccagctcctactccttatgatcccagcgtgctattaaggaaaaaccgaagaatagcaagggatcagctgagatactctcaaatcattggttcattgatgtacttggctagcgcaacgaggcctgacatctcatttgctgtaagcaagctgagccggtttgtctcaaatccgggagatgatcattggtaggctctggaaagagtaatgcgctatctaaagggtactatgagctatggaattcacaataccgggtatccaaaagtactagaagggtatagtgactcaaactggatatctgatgctgatgagataaaagccacaagtggatatgtgttcacacttggaggtggcgctgtttcctggaagtcttgcaagcagaccatcttaacgaggtcaacaatggaagcagaacttacagcattagatactgcgacagttgaggccgagtggcttcgtgaactcctgatggatttgccagtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatg

SEQ ID NO: 86517 - DNA, 1125 bp, Oryza sativa
  unsure (1)..(1125): unsure at all n locations
aaaatggccatggagatggtgcttcaggagaagcagctgaaacgcaaactagtgctcagacttcacaatgattacaagatcagccgctgctgttgttgctggtagttgtaggtttgctttgttgtgcttgtagaacaaaattactttagagattgtgttacttgtaaaatacaacaaaacatgatcatgttgtaaagttacctgctcaggtttatacacgtccatgtaaatcaaagttcatactgtaataacttgtaagtatgtaaacatgactacacgagaggtttgagggtaccattttctcatgttttcggtggcaaagataatttttcggatgaaatattggcaaagcagtgaaacatctatctatctattatattattaaaacagctttgaaaagaagcaccacgttcgctgtgggggctagaaattcccacattaatcagagaaaaagaaaaaaaaagaaaaggagagtccaagtaaaaatacaatttaaaataaggaatattgaaagaagaatccatataggaactcaatacaagattaattaaaattcggaataaaaataaaataaaatctgaattagcaaaaaaaaaaagagtccaagtaggaatacaatttaaaaataactgaaattcggaattagaaataaggaatattgaaagaatagtctatataagaatctaatacgagattaattaaaattcggaataaaaaataaaaaaatcgaaattagaaaaaagaaaagaaaagaagagttcaagtaggaatataatttaaaattaactaaaattcggaattaaatataagaaatattgaaataagagtaaatataagaacccaatagtagattaactaaaatttggaataaaaaataaaatataatctgaaattaggcaaattaaaaagagagttaaagtaggaatacaattttaaaacaactgaaattgaaaataaaaaataaaaatatcaaaagaacacaatacgaaaaataaaatacattctgaaattagaaaaagaaaaataagatatcatctaggaatacaatntataaataactaaaattggtgataaaaaataaagattactaaaataaaaaaccatctgaaacataggacgggatta

SEQ ID NO: 86518 - DNA, 2470 bp, Oryza sativa
atagagagagagagagatacaattccccatttttttaattatttttcttatatattttttgtttccgtcttaatgaaatgaagcacaattctcctgggctttagagaagagagagagagagagagatctacaattcaccaaaatttgtcctctgtgtttatcctagcacatcatggattttaagctgaaatttcgtacatgcctgattatatcatgaattgcaaagccagtgttttccttgtttgcagtttttcatggccatttgcgttgcctaaaagaggatgcactggaaatactcaaaaaaaactaacagcgaccgtaggcaaaactaacatctcaaagtttctggcttcaaccacacttacgaaagatgacacgtgatgcgtgacgtataactaaaaaaacgaaagggatgaaaataatgctacttgatagcataattatactctgcagaggatctaaaaagatgtaggcatgcaatacaaagcattaatatgtgttaagccattattcaccatacctaacatagcaatgcaactcagatatttggcataccttgtagagactatttcaaaagaattcacggactgaaccccagatagacttttcttggcatttcgtgcagagactatgtccaatgagttgacagattggacaccagataattctggataagtttttatttttaacattgatggtcggatatgtatagtcctaggaggaagctgcaacaggagactttattatttcttataaagtacactcaagatataaggtcagtcaagataagatagaaaaaggacatgatctgtacacttcaaaattatgtaaacaatgcatatattggtgaagacagtgaaggccactcggccagtgcaactatgacaataagaggatatcagcaaagattatgtcaacatgaacaaacaaagaaatgatcaggcggtcttaggaaatgatgagatgcaagaaatagcacacctatcctgaatgaagcacggataaatacggctcttcttgtatactacttttacataatcatatattatgaaattctcctgcgtgttctaaaaaataaataaaaaattatgaaattaaattgcaagacccgtactagacaatctccgattgtacggcacaaacatatggaaggcgctaatatatagatgttcaagcaactatgaaccaagattggaataaagaggtaatcctgaagaaattattttgataccaaacctgcttacaaactaattgtcttagaaaacagtgcatacccgcttgtcaactaggactgttccctttacagcagatccattgtagaacaggcggagttgaataagaagaggctagaaaaataaaatagataagaataacaaacatagaaaaaacagaaaaggggtaaatcagaacatcttatagttaatacaatacatattcagtggtgttgttagaccccatcaatttgcttgcagcacaatccacaatgtcctgaaataatgggaaaaattctcagatagcttaaagcgtggaacaaaacattgccattaaggttgaatgaagcacagtaaaataagttaatggcagctgatatttatatctggatttttgaattataagtcagtggcaataacatttgagcccaccctgaagctgaatgcaaaagctgtgcaatagatatgacagcaggaaaattttaggattggcacattcctacctaataatgaaatgaatcaacacaaataaaagttaacataagaggtacttcaattaggaacgagaaataatgtcacaaaacagtatattggtaatgcaaaaacaatgtaccaacagtcatttgcttcccatatgaggggcaacaagaacgaaaatggtatcaatttaattaagcggacaagttagagccaaagatgacccgaactaaggtggtgaggatgtagtggtgtacatccacacttcccaccaactgagctagggttcagttccttctttctgtaactttatcacaaagtcgtaatgatgtttcaggcatgtgtacatatgtatgagcaacaccatgattgttcctttctcttactagtatgctgcactttgatgaattgtgtttgtcaaactttttcactggtgtgcatgtgctcaccttataccttataaacaatcagataatccacaaatgcttctgatttagtaaaaatgcttcacaaaaccataaccctcagagtaaccaaaaaatgtctgacaggttaaaatatactacctccgttttttaatagatgacgccgttgactttttctcacatatttgaccattcgtcttattcaaaaattttatgcaaatgtataagatataaatcacacttaaagtactatgactgataaaacaactcataacaaaataaattataattacataaattttttaaataaaacaaatggtcaaacatgtgagaaaaaggcaatagcgttatctatta

SEQ ID NO: 86519 - DNA, 3053 bp, Oryza sativa
aataacaaaaaaaaaaactacgcgtattgcgatgagctaccaaactagttggggctagaaagtgccacactagtagcaatacccaaccgtatgcgatggagacggcacgacaacgaggcttaattttttagcgtgtaggcgagggaatgagcgagcgagaatgcgtccatgaccatggatgatcgatcgatctgaatcggatgaatgaatgaatgaatgcaagagctgaaagggagtgaagaataaataagagcaaagcaaagggaaaagggggagcggccacacaaccaggcttcccgtgacagctctaaacccaaacccatttttttttgacctcctcccttgccaaagaggtgattaattccagcgcccgtactgtgtgcttgctgtcatctacgcagccgcagccaccaatcaccgccggccgacgcgccgcccgacgccgggtgccctactctccatgcaaccggcctgtccctgacaaatattacaacagaaacagagcacaggttttcagccatatatagtagtaacataattatcaactactactacctccgttttatattataagactttctagcattgctcacattcgtatagatgttaatgaatctagacactcattaacatttatataaatgtggacaatgctagaaggtcttataacctgaaacggaggaaatattattaaggaggagaccatgagataccaaaatttttagcgtaaaatttgatacctgagatactttctcatagtaccttttgaaggaccgtacaatcactctaagattgcagcaatcctttttgaatatttgttatgaaatcggaggaaaaatattattatggttttcttgcatgtggtgtccgtgcaggacaaatttgatttagggttttgtctgctgttgcgacctggaaactggaatgcatgtgacgagcgaaaaggatggagactggagaggaccagagttttggttacctgccttgatcgatgtggtagacaaccaagggcagaagccagacaagtcgcattcccgtctgaagctaccctctgaccctgcaacaaacggagcagaaagtcagaaaaccatgtatgaatatgagcacaaaaaatatcgcgtaatagagagccacttacgtacggtagaataaaaaggttaatgagtaaagcaacctgtaactccagataaccaagtaggaacaagacagcaaatccgcaatgaagacttgtaagttgtaacatcttagagtgaagcaaaaaaacagttacttcctccgtttcatattataagactttctagcattacccacattcatatatatgtttaatgaatctagacatatatgtgtgcctagattcactaatatctatatgaatatggacaatgctagaaagtattataacctgaaatggagggagtacaagtttcaatcccaattgcaccaaacataagagtggcagactaccagaaagaatcatcacttatgatttgctcatttgtcgcaggaagcatagcttcctctctgtatattttactgaataacaggcagtacacatgtggtgtaatcacaaattcacaaattggatgaagtgagatcaccatcatattgccaggacaaaacaattacacatttcacaaaaatatttcgacaaaagataaatggctcgcacatgcactacacaatatctctggacaagcccataatatcgctcaacacccgaagactgcccattgctcaacacccgaagattgcagcaccattcagggatccaatgatggcaatggcccaagaccagccgcgaaaaagcatttccattctccaaaattggaataatcatgtaccataaacaaccttgagatgtgcctagtgattctcaattgccgatgaatcttcatcgatatctgcacgtgatccttcccacagttgctgctctatgcccagtttcctgagctctgttagacctcgctccactgcagataacaaaactaacagtgctcagtaaagcaaaaaactgaaaatgatggcattcttggataggagaaaaaatggatgaggtgtgtaaatctaggtaaaaacaattggaaaaacaaaacagattataggcacaccgcaacatgtaatatatatgagggcatactcaaaatgccttctgtatacccccaatatcccataactgtttagacaaaaaaaaacacatcaatcacattaatagtggttcatgtaagtatctcacatataggtggtgtttgaatctcctgaagatgaagatgaagataaagattaagtgtttcacgcaaaacgatgtggtaataacgtgtgattaaatgagttttaattattacaaacttgaaaaatggattaatctgatattttaaaacaacttccatatagaaagttttcgcacgaaacgcaccgtttagcggtttcaaaagtgtgccacgaaaatctaaatcttcatccaactcttgttggagaaacgaacgggaccataatgttcgtaccactataccgtactttggattacagatgggaaagaggacagtaaagggcaaagagataaaatacaacagtgaagaaataataaaaggaggaaatagaaagttggtttgatccctacaaaagcatcacatgatcaactgttggggcatgctgtcaaaaaagagctgcacaaataaaagacatcccagggacgttggatggttaaatagtacgataaatcattaactaacaggtggataactcccaatgctaggttattttttcaacaaggaaagttgcttattaccatctatagcatcatgagaagttggggctactgcattgcgaccaatccagaactgaagccgttcttcagcaatgtcttcctcaatgccatgagttttagctcttctccagaagtatataagccatgcctgcattcaatatatattccataaatcacacgtaataaatggatgaatttgatagttcacatcgctgaaaggtttacctgcttaaagctaacatcttctgcctcttcatggctaagatctgcaataggtcaaaaagtt

SEQ ID NO: 86520 - DNA, 1707 bp, Oryza sativa
ttttagtgtctacttattgaatgtgtgtcactaccttgttttgccagatgaactttgatatcagttttatgctctgggttgacgtttagtcaggaacctattggagtgtgttcttcatcagttgtacggtgtgcccactcagtcagtcagattagtttccattttgttattgcctagctgatatactgtaatgtaccactgttgatttttttcacgaatagccactgcatgttttatggtgtttgtagatttacttatatcctcttctacaagactggctcgcctactgcggagatttgttttggttacttgcaataggtctcaatattcggatcaatctatccttatttcttatgtgaaatagggaactcagggtagacttcattatacttgctggttacgtgaaacttataccggttgagctagttcaggaatatccaaaatccattttgaatattcacccttcactactcccagcatttggaggcaaaggttattatggtttgaaggtgcataaagcagccatctcatcaggggccaggtacttcgcaatttctctatcacccatcacaagcaactgctgtgcagtttgcgtatctactcaatgctatttccatggaaagcaatatcttggcagttaatttaagctgatatctcacattgtagaacaaaactaaagctcaactatacataggtactcgggtccaactgtgcactttgtggatgagcactatggcacaggaagtactctagcccaaagggttgtgcctgtgctagccaatgatactccagagcaattggctgcaagagtccttcatgaggcaacatatcttatgctcggctaatatttctttgatggaaatggctatgacaattcacttagctgcaaatgcaattgatgatatacgttcttttgctcatttattaaccttacttttcaggaacatcaggggccagaagctggcttttattaagtgcaaatgaatttggatcacaactcaacacatataagtagaaaacgacgacatataccacctaattggacaaaaggattgttggtaacggtgacgccaaaaacacaatatcaacgaggatacctttcagacaacaacatctcctcttccatgctgtattgtctgctcatttccttgcttccctggcctgtaactaacatgtaatgctttgtaatttcagatgcattacatctacttgattttacactatgtgaagcaagcttcttcttgactcgcaagttttcaagtgtcatttccacatctctcatagtaggccggtcttgtccattcaatttagtgcatgttgcagctagtgatgctacttcttggatttggtctccatctccctccgtcatgacttgtggatctattatttcaaccacctgaccttgtctatgaagcgaggcaaaatataacacaagactttcaccgtgatcagtcctatacatgggcctttttcgagtgagcaattctataagaagaacaccaaaactaaaaacatcacttttatctgttagatgacctgtatagtagtacatgggatctaaatggccaattgttccctgaactgctgtagtcacttcagtttgttcaatcggaatataccttgaagctccaaagtctgatacctttgatattaaattttcatcgagaagtatgttgcatgccttaatatccctatggaatattggta

SEQ ID NO: 86521 - DNA, 2580 bp, Oryza sativa
cacatctggtaacgcccatatacaaaatggatgtgtttcaagcaaacttaaattttcaggtaacagaaagaaagttcagtcaatgtctgagggtactgttcattactatgtttcttgttgagatcaatttaacggagtaaacgatttaaaatttacattttcttacaaatccaggactcatcattggaataggacttggtggcagtctaatcatcgtggtactaattcttactggaattgtcgtaaggcgaaagttcaagtctcgaagggccaaaaaactgaaggaattcttcttcaagcaaaaccgaggattgttgcttcatcaacttgtagacaaggatatcgctgaaaggatgatcttcagcttagaagagcttgagaaggcgacaaacaattttgacgagtctcgaaagcttggtggtggtggccatggaaccgtctataaagggattttgtctgaccaacgtgttgttgctatcaagaagtcaagatatgctattaagagagaaattgatggatttattaacgaggttgccatactttcccaagtaaatcacaggaatgtagtgaagctttttggatgttgtcttgagacagaagttccattgttagtctatgagttcattccaaatggaacacttcatgaatatcttcatgtcaactctgcacaatcagtcccatggaaggaacggctgaggatagcacttgaaatagctaggtctcttgcttatctacattcagctgcttcggtatcaatcatccacagagatatcaagaccaccaacattctacttgatgataggttcatagcaaaagtatccgacttcggagcttctcgaggtatcccaattgatcaaaatattgtaactactactatccagggaacttttggatacttagatccagagtactaccgtaaaagccgacttacggagaaaagtgatgtatacagctttggtgtcatacttgcggagctaataacacgaagaaggccaacttcctacatatcaccagaaggcttcaatctaaccgaacaatttatcttgctagttagtgaggacaggctcttggaaatagtagacagtcaaatcactaaggagcagggagaagaagaagccagagaagtggcagaaattgctgttatgtgcttaaacttaaagggtgaagacaggccgacaatgcggcaggttgaggtgaaacttgaagggttgcagggtgctgtaaacactatcagaggtcgacgtgcagttcagttgaattctccattgactgaagagagcgattccaacatcgttgctgttggtgacgctggttatcacaactcaagcaggcggctcagtatggaggaggaattctggtcatctatgagctttcctcgttgaccatcttgtttctcatccagctcataagattttttgttttgttggtctttttttaagtttctcttggaacatctgcaattgcaaggaacttccaagctgtatcagtaggatcctccacaactcgtgcgatttcaacaaaacttgagaacttggcacttccctgcagtcctgtactgttcgtgtaataacttatacttcctccgtcccaaaaaaataaatctaatacggaatgtggcacattctagcactacgaagaaaaagattactagctttttaggagtagttcaaacgaaacaacatgtttgcctccctttgatccttgcagttatcaccatagatctgccaaactgatatgttctatgccgaacagttaactgaacttacaatggatattcagttatacattgtcagtgcaccaacacaaggtgactgaatagtaattcattagtaactaagttcagatcgccttatgagtccgatgtgtttatcattcctacaaggacagattcagacgatgattctagtggcagtgaaacatgcaggatatgaagagtggaactggtgcagattgtagagagaactgatcaagctaggtacgctcctgttaatcatgatatattatgaaaagaaacagaagagatcagaagggaactttttcttgtagagtatgcaatcttgctgatcaatttacagggatcactgatgtatctactgttgtaaagaacatgtgcaacaatggaaattcagaactattgctttcttagcgaaaaaagataagaaagatatgtctgacatgcaagaattctgatttctggaggtgttgcactgctctgaaaagtgcagaataccagtatatgactataagaattttgtagctgtctttgcctcaacaatatcaagtgctttgttgaggtaaacagtttcagaatagctttgttccttctagaaaaaaaaaatcccatgaaatgtttttcatgtctgctcaaggaaatgacagggaaaggtggaaaagaaaatgaatcactcctgcattttctaaacctgaatctcagccagataatttccatccaacggatgagacgagcaaaccaggggttcggagaacaattcaccgaccccaaccaaagataccccctacccatcagcacagccgccggtgaagttgccggcacttgtgtccatcttgaaatccaaaatt

SEQ ID NO: 86522 - DNA, 2657 bp, Oryza sativa
gaagccagctgttgaagtaaaaaatgccagtccaaagaaaaggaaacactgtaactgtaaaaactcacgatgtttgaagctgtgagtatcttcttttttcttttgggtgtaaaactgtaaatgcagtgtcatgtttacagcaagggaaaatatagtgttttgaaatagagtactggataacttttacatgttatttgcaaaaggtaggcttccaagcaactattatcaatatgtattctcaggtaaatgtttagtaccatcttaagaatctcgaaacaggtcagttatgatggtcaataccggtaggagttacgtttgattttccttcatacaacatcattaacggtacctaaatagcttcctaaatggtatgccatgtacattagtgtgtgtagtcagtggaaagataagagtataactgttgcgttgtgttcatagtaggggattaatgtttcctttttctcttgtggtaatcttatttcctttgcagtttgagtttgatgcacttgtctgctattctaattataattgtcccgtctctgtgttttataatattcaattcttcctgattgctttttttaaggcacattctccctaggcagactgctagcaaacaataagtgcaacgtactgatgtttgttgtcagctgactttatgatgatgaaacaccatcatgcccattatgcttataacaagctcactagcttgatatttgtttgttaggtattgtgagtgttttgcagcacgtgtatattgtgatggatgccattgttcaccatgtggaaacaagattgagaatgaaaacataaggaaggaagctattgaaacaattctcctccgtaatccacttgcatttcagcccaaaattgaaaatagtccaaatactgtaactgttcgaaaggtactactattcgccaatataactctttaatatgacatactatctacatctataccatgttgtaaccttaaaccagtgctcgttttccccttcagtagttatcctgatcaaatccagaaatataattccaaaacatgcatgagctgaatgaattttatatagatgaaatgaaacaaattcaccaacagctctgctttatttttttggtacacacctttcattatcttgcttcggttgtgacaaggacttaaaaatggccatgatagtgtccctctattccatttttattttgataaatgagtttgcaatgtaagtttcaatgtggtttactggtatggttttatgcataatctcatacacctacccctgattgctcaatacagtcagcatccagagctttcatgtcatattgacattattccctgctttttatagtttttcatttttattttgaattcacgcactttattttgtccttgaattgaatgtacatttctacgcaggcacaatgtaattatgctcttcatttcatttacactgcaatactaaaatatttgtttacatggtttaagtaaaatataaaataccaaagtgatcttggatttgtgggtaatgttttataattcttaatgttccattagtactaattaatccattcattttttttaatgtcctcttgtcccatcttttagcaggattctggaaattaaacactaaaaatgattctaactccaatgtttaggaataatttgttatttccccattaaaatgccaagtccattttttttttaccttgagctacatgtgtttatacagtcttatgtgactttcaggataattctgaagcaatacctccgataccaaagcacaataagggctgtcactgcaggaagtcagagtgcttaaaaaagtactgtgaatgcttccaagcaaacatcctatgctctaagaactgtagatgtcaggactgtaagaattttgaaggaagcgaagagcgaaaagctttagttcaaatgaaaaatgcatctgatagaaatcacattcaagaagcagctaactttgctctgaatggtgccactggatctttaggatacaaaaattctccagtgcgtaggaagaaatatcaagaaaattcccttggagaacaaattttgtcagaagcacaatttcaaccggtatgttctaattggtatggccagctgcaagtttttgtggactagaatttgttgttactgttatgtgctagactgaccatgcagatgtttcacagcttgcatcctcttgcacaggatttggaggggatattgctatcaattaccaaagcaaatcatctgaaatgatctataggtaagcggaactatatttatattttctcaaagggaataactcaagaacagaaaaaaaaaggtctatgtactcagataagccattttgaggttcttaattctttagttaacataggttacaagtgtcccttctggccttttagatagttctactatgccaatgtgtaatctagtttcagtgtgtcatgagcttcctgtaactagtgccatttcagatggctcagcctagtactttaatatttttgaaagtcttcatgggtttatctcaaaggttatatggcagcatcatttagttatactaaaatatgttatataagaggtatactctaccgcttactgtctcttcttttgatgaaatataatattttctcaggtctccactagcaaacactatccctcttattgaagt

SEQ ID NO: 86523 - DNA, 1190 bp, Oryza sativa
ctttgacttacttccttcaccttcactctttgctcgtttgtatcttgatgccccacagataggacagacatccaagtcagcgtattccttgtaatacaaaatgcagtcgttcggacatgcatgaattcttctgacctccaggcccaacggacataatacttgcttcgcttcatatgtcgtttgcggtaaattgttcccctctggcaacagatcctttaacagttcaagaagttctgtaaaactcttgtctgaccagccattactagccttaagcttcatgaattccaacacgcatgacaacttgctgtgcttcgacttgcatccatcatacaacggcatctgacaatcttccaccaacttactaaacttctcaaaatctttgtcgttgtcctctgcgtcttcaatgtcatgcaacattgtagatagacattgagtatccaaatctatggtctctccacctaaaggagaaggtacgaacatgccttctcgagctgcggcggtgttctctacatcctgatccaacacttcttcagctgcgacatcaggtgcctcttgctctccatgcttggtccagcaggtatatttcttcatgaatccattcattatcaaatgagcatgcacttcatccttgtcttcgatcatctgttcattcttacagtccctacatgggaacaacatgtgcatgctcatcctactttttctgtcattatccgcaaatgtgacaaattcagtgaccccctctctatactcggtagacgaacgatgcgcatagtacatccatctacgatccatctgaaatcaacaacatacgaagaaaaatatatgatgatcgatatattgagaataaatggagaataatgtgttttttcccttgaattttagcaaaaaatcgccccccttgccctcccaaccgatttgtgaatagtaaaatggtcgggatggaaagcagttggcggtttggaaggtatttatagacccaacacacctcaaacgggttagataaaaaaagcccgtcaaaggtattggtcatacctttgacgggcttcaattcagtggcccgtcactggtatacctgtgacggggactgctttcagcccatcgcaggagaggggatacgtcctcagtgtgagggctggaaatgccttggcccgccacaggtgaggggataccagcgacgggggggaagcaaa

SEQ ID NO: 86524 - DNA, 4645 bp, Oryza sativa
acgccccgcgccccgccccaggcggccgtccccggaggaggggccggtgccaccgccggtggggtcaccatgcggatgttccacggcgacgtgttcctcggcgaggcggaggtgttcccgatgaagcagggggccgaggggagcctgccgttcccgagcaacgagatccgcatcagccacctctcgccgacgagcgagcggtgcccgccgctcgccatcctgcagaccatcgcgcccttctccgtgcgatgcaagctccaggccaagctgatgcctccccacccgagcctacaccgcctctacctcacttgcttcaacgagtacaaggtttgcccccacgcaatttctcaacaatcgctcatgtccatcgctttgtattagtatagctggtactcccattcgaaatcgaagcgaaataagttgtttacagcgactacttgggaaatggtattagcgccacttctaaattttggggcaatcaccagtaatcaaagcgttttacacattctattatggatcttcgatgggttgtgtgtttgatgtggtttgattcgttcggatgatgtttcccattgatgatatttccatcaggggcacgaaataataggatttataaaattttttgtctccttgggtttgtgtagagcgcagtggtagtagttggagatgaggagctacacctagtggcaatgccgagcaaggtggagaaggtgccatgcttttggtgctgttcagtacgctctgggatctatgcagcatctgttgggatgctgaacttgcggtgccttgctatcgtatttgatctcgatgaaacccttattgtcgctaacacaatgaagtcctttgaggaccggatcgagatgctttcccgtaggatggatattgaagacgaccccgtcaggatagcagggatgtctgcagaaatcaagcggtatattgaggacagggagctgctcaaggagttcattgacacagatacagttacagataatggcagaatcgttgggacccaaaaggaggaagttctgcctatctctggtgggcaggagcgtgttctccggcctgttatcaggctgccagaaaggaatgcgattctaactcgcataaatccagaggtacaattcagatagatcatgtataaatatatttcatttaaatgaaatgttgttatcgtttgcctgtgtgcatgtttttggcctggggttatctagaattacactttgaaatcagttggacctattcctgggttggaaaaatagaactgggctccaatttgctgcccacaaaaggcatgctgtatgtctatttggttattagcgatggtacaaaaataagttctataaatgacttgtaattgctgcagttttgatcctcggataagacatatttgttcaggctcattgtttctacctacaggtctgtatgatctgcatagttacataatttgctttgtacatgtgatgtttatgaataaaacagatgcagaaatgaacttgtagcctgatggtttgggaaatgatgaaataacaattaacacaaagtttgacaacctacacacaatgtgttattatcagctcatatgtttgctgccaatagaaaaaagagattctattttagtaattatttttgtaatgcttatctgagacgattaatcaagctgattaagtcattctggactgaaaatgggctcagtataattctcatatgtctagttattcaaaattttgagataactagagtttttaattattgtagaattctgtaattagttcccttttttgaggtgattaccttatcccctgtctgattttaatactctgctcaggttcgcgatactagtgtttttgtaaagctaaggcctgcttgggaggatttgagaagtcctgactgtaagggacgcaaacgatttgaggtctatgtatgtacaatggctgagagagattatgctcttgagatgtggaggcttcttgatccagaagccaacttgataagctctcataaccttgcagagcgtgtagtatgtgtaaagtcaggtaaattttcaagaaattggaggttcttttttttctgctatctttcattgctttcttgtctcaacatgttttgttatattgacatcgttactaaacacagagtagctactttaaaacactgaacacgaatattctgtgttatctatcttttcatgtacaatgaaattatgttgtgtttccaagttattgagaaggaatgggttcggtattgcagattagtgtcccagagagaaaacccatagtttttctagcatgtatcgttcattcccttagtattgtatttcattcttatccttacaacttcaaatatagtgcataagtagtactaaatattgtttaaatttgtataaaacttattcttagtttaaacaatataatatttgtgtagaatgcttaagtgaatgagaaattgcgctttgccattgcccattatatggataatacataacatagatcttcgctttactatctctattgtctcagctctggactatgttcctgccataatttcatggacataaccaccaatattattcattattctatttcatggcaggttcgaaaaagtgtctgcagaatgtttttaaagacaaaggatgccatccgaagatggccatggtaattgatgaccgactgcaggtttgggatgagaaggatcaacctcgagttcatgttgtcccagcatatactccatattatgccccacaagctgaggtatttatttgtattttattgcttacactttttttggtcaacaatatctcattctggaccctgtttgcatattttagatggcaaatgctgtgcctgtgctttgtgttgcaagaaatgttgcttgcaatgttcgtggtggtttcttcaggttggtaaaaaatataagataccgtatgtgcattctgatgatatcatgcttactgttgtaatgttattctttgcgttcatcaatgcattgcagagagttcgatgaaaatctattgagaaaagtgtttgaactaatgtatgaaaatgagttgctagatcttccatatgctcctgatgttggtgactacttagtctgtgaggtaacattattgaatcgttgttattttgtgtgtgtttattttctaaatggttatccaactgctaattttgttccaggacactaattttgcaccaaacaataaggatgttgcccctatacctgagggtatgagtggagctgaagtagggaagaggttgaatgggctggtgagtgctgatcttcgtttctgctttgctttgatttttagggacttgattttttttttcacctagatcaaatcagctaatgatgcctatttctatggtaagcgctgttatacagcataatataaatgctgtcatgtagcttgatttcaattatttataaccatctactttgtgttatttcattttagaagaaatgtaggtgtatcaaattgatccttctttggcttacaattggatttgtccttgtatcaaaattaagtccacagttctatcacttagctagcaaaatcatcactagtttctttatcagtttgtaatagactagtatataatgatcatgctagtgtgttccttatttcaggcatatcctagagaccagaaacaaataccatcatcaacccgtttgtcaggtacttacctcatgtccattatctttattggctttcttttggttcttcttcctgggctttcttgaacccttgcatttataaatcactttagtcattttttattattaccttgcggacattaaaagagggaatggttttctctgtaccattttttccctgtaaaggaaagagtactctactatgaaatgcagcagcatcaacattatgcttgaaaatcctaattgtacctcactattattaaagaagtacaattcatatattgttttggatctgtaatttgatgcttcgagtaacataaaccaatctttgtagatgacgacggagtggcactccgtggcattccaggtggtacaaatatccaatctaacgggggatcattggcaacaaccccctcattatttgtcacggtgttgcaagaaattggacggctgtgcgaatccagggtatttggatctttaagattatatttgttttctgccattgcccttatgagctgagagtaatctcctgttctttcttcattaggtggagttcaggtctactgtaagcagtggaaaaaacatgcaattttctgttgaggttggcattttgaatttttacatattatacttcgtttccatgtggtcttggcaacagcttgggctgaaattctaattgagaaaaatatatatttagaatgttgagacacatttcctttggcgtctcaactctcaacttcagcatcagtccagtgcttttgctctgaagctgtttgcttgcgggtgcattaccagatttgtatagcaatgctgtgatatctctacttaatcatgtgatcctcatgttacctatacatatgatgttccaggttctatttagtaatgaaaaaatcgggatcggcattggaaaaacaagagatgaagcccaagtactagctgctgaaaaagctctccagaatttggaaagtgagtataatcctttacatcttgattattg

SEQ ID NO: 86525 - DNA, 12579 bp, Oryza sativa
ctatcaacatggccatatgaaatatcaactaaaaatccaggcagttcatcttgtgagtttcaaatgtgcatcgcaactcgcaaaccacctttaaataaaaaattgccacgttaaagacaagattagataagacagattaacagatccaaattgtgttgtcagattcagaataagattagcacctttattgtgtttgtagaagcgaaacttctatctcttgcaaagtctttccctttgtttcaaccacatggcgccgcacaaatattgctgctaccacacaagctgaggaaaacattgtgtacagaacttgtggaccaagttgctccagaagccgcaagaacaacaaactgacaaaaaaatttaccacctgcagcatttaagcatagcatgtcaagacgtcgatacgaatcatggtagaactacaatgaaccatggcaagtaaatagtgcgccctaccaaattattgttgcaaccctacacttatcatttaccattacataatcaaccatatcgaaatgtctaagttttttattatctaatttaaaaatctggccccattattcatttattattaacagcatacagtaccttttatcttatggcgattgggggaaacgattttgttacacagagaaagctgcagcttacagagtcaaatatacttctgaaattctgatcttcattaccataaccagggttggtaaaacagtgtggaaatgctattgaggacttagcagcttgaatattttgaattgatctaatatacctgttctagctcagcctgactaaacaacagctcaaattcttcaccaggtatttagcactaggctccttttatcattgaacaatgtgaacagctatggttacatactagcagtaacatatttttaaacatcctaatggaacaggaaacatgcatagacacataataccaaatattaacatattaaaccaaaaagtgaaaatcagcaacgaaatttccacgttgaatttcactgtttgatctaactgccagcattttgacatgcagtgtctattttttgaggatgaaaaatgaactcctatccaatgcacagacatgcagtgtctttttttttttgtgatggaaacataactccttacccaatgcacggacatgcacagagccatagccttggcccgtattttgtttgggaaaatctcaggcaaaagaagtcctggcactggacctgctcctaacgaaaatgtcaagacaaacctgaaaaagaagcactcaactataagaaactggtagacttaccataacatttgtacttaatgagccagtaaagtataattgtcaggaacaattaaagagttctgctaagagcagcataaaggtaaactgtctcataatttaactagttacaaattaaaccaaatggaaagccctattgttcatataaagaataactaaggatgcacaacaacgctgagggtgaagtcaggggaatcaaaatgaaacaactgcaaagcagaacaatatcatgtatgcaactgatatccccagtgccatttacatgtcagatcgatatattgacacagaattgttccaccatatgcaaccaaaaggttgcctgaacaagttcttggaagaatttatacgcaacaatgttttgtatcaggttgaataatttgtttccatccttcttataatctattacctctaatgaggtataagagaaatgatatcctttgggttgatgtgaaatggatggtctgaacaaatttagagcaccataaaaaaaatcctatttgtagatacaataagtagagaattttgcatatttttaagcctgatattggcacatttggcacaaaaatgtagcataaattggcttaaccaataggagcataaaacctcctgcttaaggtattcaactagtagtcacagctatttagtttagcctcctagacattaataactaaattcagataacttgaaagatagtagaatcaaagtaacggaagacataaaattctaaaacttacaatagcatgccaccaactgaaagatatacgcttgcagaaccaaggtggtgacgatttgctccaacagcctgaagtcccattgcaaaggcctatagcagtaaagatgtgcagtgagtaatgttcaacattatcttccaagttccaatcacagtgatagcttaccatgccaaggaagctccctgaaagaagtactttccttcctagtttgtccattagaagcatagctacaattgagcctggaagcaaacacatcaaacaaaatccatcaaccatcaatataacagaacagtagaacaacagaaaaaaagagaagatgctccaatgagcccacctgataaatttgctatccccatgcatatgttcgcaaggttagggggcacacccacacttctgaacacagttgatgagaaatagaacacagaatttatgccggataactgttgtaaagcaaagagcgttgtgccaataaaaacaactgtagcaaaaagggacttgtaatgaacaaacttcaaggccaaacataaataaggttatagtttagcgcaaatacacaacagaatggaaaacacataacagcttgtaccattaaagttgcgaccataaaacaattccgaatacttcacattttctccatcatcgcctctttcagatcgggagagttctgccatagcagacttaacatgaagaggacctagaagtttttcaaattgtatctctgcttcagtcgttcttccacactgaataaaagataagactcgtcaataattttcaatgtatgtgctacaagttaaatataaatatgtcaatacaaattgccaatataaagaagtatgggagttgtataagtctgtgttgagaattggttttctcagaaaaaaaactaataaaatgttttgctcatatcagagctgtatttgcatggtgcacaatcagaaaacaggcacagtattgaggaaactaaagatcaacgatatttatccgaaaatctaatgtgtgctttctgaagcaaataccaatatgtgccaatggactactcttctatagatatcattcgtgttaccatctaagtaacaataggcaataagtttgtgtcaacccattattaattgtaagcacaaaaaacctcaggatgatggtagattgcaagttctaaccaacagattaattgtttgatttaatacgacagtgaccttcaaacattcatggaaaaatcagcatgtggtatttgcatatagtttaagagatcaaatgtcgtttccgacaaagtgactccaagatggtcctcaaatatgagtatctcattttacgactagcaaaggcacttaagatcaaatttgccgaagcacaattatagagaatcagacacctgaagggtgatttaagttggaagatcatagatagaaaataagcagcttcccccaagataaacacaccttatacagccactgggggctctcagcacagaactccattccaagagcttgtaaagttgctggaacagctgcaacccagaaacacaccctccacctgttaatagcaaaggataaagttagatgcatcagatttactaactacacaaaacatgtagagagctacagaagaaagcatctaaccatctatcaatatccttcacaggtgtaccaattaggagagatactacgattccaaggcaggttgcaatctgaacaaagctcccatatgtgcccctcactgaaggaggagaaacctggatccaagggattataagaaaaaggtacaaatgaataagattaatatttgatacagacaatcagagattgaggcataggtgcataacaccaattacatacctctgttatgtacagtgaagctactggtggacctaatcccatccctgttccaaccaaaaatcttccaagaagcataccctccagactattggtgagagcgctgcaaaatgtttcttcttcaggaaggttcaatgaaacagaatcataggaataactaagttcaggcatagttccttccggcagctctcaagtattaggtgctcatagatgtaagtattacacaattgcattttcggaaataacagtcttggtgcaactaccaaaacggatcctattaaataacatgcagaagataaaagtgctaaagattcaaaaaaaggttagcatcttaaatattatcattcaatgcacttaagtgaactttagtttgtggatgccatgtagcaatggcaatgtaaaagcacctcaaggtaatcagagcacatatggtttatgttgttattattcaacttatcagcaactctacagcaccaataaataaaccaagacttaacacccataagtgacttggtatgctatatccaaaacgtacactagctatcaattaataagagtgttgaattattgaaaggctagaacttttccctttttaaggataatcaatctaagtacatcatgagcgcaattaagaaaagaatatttactattgagccatggttttctagaagatgcgtgtaattaattttcagtactcttcagtctattgtggctagtgaaagtcaatttatcgtaaagttcgattgctttcatgtttgcatgtgaagttacactagctccacagtcagtcgaagaaaccatataaatttacctaatggcgggatggcaaacctagtattctcaatatactactctctgcactgtgttaagaggaccacacattttattcatctcctacataactcggagattcaaaatcccatggaaggacgaatccatcaagctactacttgtcacaccaccaatatatcaatatgatacataagaaagagtaagtttgttgttcccaacattcaactttccaaataaagtatacaataccaacaagaaaccaggctaccagtggccactgaccttatttgtttaacaccaagaaaccaacaactccagctagaaaataagaaatgctagcaagtggcaattaaatacattccaaactgaccaaactgcacatggactaggatttagtggaagtgaccatcaacagaagtgtgatgccatggattaccacacatggactaaggattcagaggaagtagccatcaacagaagtgtgacaccacaaattaccacgcatggactaaggattgagaggaagtagccgtcaacagaagtgggacaccacgaattaccttacggcagcgccgatgatcatgggcagcgcactgagctgaaacgcgcgacgcctgccgattccgtcagcgatggatccactgaacaggcacccaacaaacgcaccacccaggcagatgctcaccacaaggcctgaaacacaggacacccaattgctcccatgcccaataacatcaaatttcacccgaatcgtggctgcttacttaccttcggcgagggtgttcccggcgaagccgaggtcggtggagatgctctcgagcggctcgttcacgaccctgcaccaaaccaaccaatcacacgcacgcgctccacaccgtgagttgggaaaacaaccacaaccagaagaagaaatgagaaaatggatggcacgcacccggagtggtagccgaagaggaaggaggtgagcgtggcgacgcacacgtgcggcagcgacatgcgccacgacggggccccgccgtccgccattttcgctgcagaaaccgccaccgagcacagaaaaaaaaaacctcaaaatctcaccacccaaaaaaaaatcgcagggaaaaaaaaagagaaaaaaccgtgcacggacctggcgtctcgacgtcgagatccatggcggcgtccctggacggcacgcgcttgtacgccgacgacttaagcttccaccgcatcggcgctgatcggagaaagagacaacgcaacgcaacgcaacgcaagcagcagcaggaggaggtcagtctagggatttgggaaagcggaaggcgagatcgatctggtggtaaatgcctcgacactcgcctcggggatgtattaatagcggtggtggcgtggcgtggttagcacatgagaagaaaaaaaaatcaaaaaatcgaggaggaggcggcctacaaagttacctgaccaccaccgccgcgtgcgcgggcatcagatcggccggagggggcgacggcgacggcgagggggtggtggcggcggcttggatctgggagaaaggggaggtgatttgatgctgtgaggctgtggatctctctctctctctctctctatctcggggggagtgggtttggtggcgtagcacggagaggagaggagaggagcggagcggagatggcgggggatgagctcgtgtcgtgaggctgtggtgctctcgtgcgacgaacgaatgccacctttgcttctgttggttccttttttgcttggagcaaagcttgttggtacacttcatttaagagaacggggttttgcacaatagcccttgagggtatagggtttttcagacaacttcagcggctacttcctcattttctgtaaacacgcttataaaagaagaaatctatataaaagttttcagaaacaaaacaaattaatatttataggtttgtaataaataatactcaatttataattctctaataacatgtatcattccgcgtatcgcaaaaatctcgaccgaacagcaaaccttgtttttggtttctttactggattatttgctccatgctttgagaaaaaaagttctcttctcttaaaccacttattttatattatttgttaagtttatttatcaaactatttaatttatccttagaatcaagtaaataatcctacaataacaatttgctcaacgatttgtttgaaactgtgccaaggttctatttggggtgcgtgatacgtcttgatagtattacattatataaaacaaatggtcaaacgtgtgttgaaaaatcaaagtaatcatccattttaaaaaggaggtagtattatccatttgcatagtattatcgaacatagtatttaaaagtcttagcacattggatgaatcgttttttaggtaatggaataaccggaattcaacgagctacaatcaattattacaaagtccacacatgaacaaactcagcacacactgacataatataaagaaaacatagactaagaaacaccaacacacgataaaagaacccttaattacttaattctatttgagaatctccatctgaagttgacaaaaaggtgcataatcgtcgactcaagtttacaaaatgcttcatttattatcttgatatcatcattatgcctttatagttgggtctaaccccgaaaccaatatattgccctgaaaagtacctgcaaataagattttgatgatgttttatcaaaaatcatatcattctactatgccaaagagcccaacattataacggaagcctctacaagaataagtttcttaactttttttattaacactcaccagccaattcccaaacatataagaaacactatgtggtgtgtataatccaaatgagaattgaattgatctccaaagaaatctagaaaaatgacaatccaggaaaagatggtaaaattgtttatttttcatataaaaacaatatctcaaactaccattccaattcctcttagccaaattatcttttgttaacacattcgatgaatcatggtgttgaaaaaagttaatttacaaaagttttaagttaggaaaagctcgtatacatataaaaaaattccttggaaaggatttgagttgggaaaagatttgagttcgggctggtttaatatagccagccaaatttaatcctttgaggcagaatgcgaaaatacaacaaagatagtggacgcccatgcaaagtctccaaaccagaaatcccagtacgcaacgtgtggaggttaggctgtgcgcgcgctgcggccaccgtgacgcgtgttcgctaacaccccgggtccaccgccaccacgcccgaccttttggtggtggtgggtcggcgcgggtcgtaatcgcaacgaagaagaagatgcccacccccggtgaacggatcccgcacgcagcacgctcctcctcgcgacagtgttactctgtgctacagacatgtggggcctacggtatcagggtcccacgtcccagcgactgttagagtgtcggccggttctggtgcccggtcgttttctcctccgattttcgagcggctcacgttttttcgcggacgtcggggaagggtctggattttgtcattggaggtggtgggcccctattgacggcacggacgcgaccgaatgatgagtggggtgattgacttgatgacagaagcatgattactaatccccgtttcgtatcataagtcattttgattttctttttgcaaaattagttaggttagttaagtttatagaaaaaattaataatacgactacacctcatcaaattcaaattaaatgtattttgataatatgtttgttttgtattgaaaatattatatattttttctacaaacttattaaacttaaataagtttaactaataaaaagtcaaacaacttaccatataaaacggatagagtaatttccgagcggtctcacctactagaccattgctaatcaaataacgtgcggccttacaaaagagatcatgagccatcgtatggagcccataattgtggattaacatggggggaaactgttttaatcactcgggtggacgtccacccgtttgttgtatgtcatctaaatagttatgaaaaaatttgaaaaaaataacaagatatattaatatttaatatttcactccacaaacatgcaagttaaaattcgacttttacaaattataacaaaaataacaaacaaaactcaaattactatacgtatgtttgcagttaaatttgttatttttgttacaacttgtagaagttgaatttggacttgcacgtttgtggagtgatgtattacatattgatctatcttttcaaattttttcaatttttttcataatcatttagttgacatgaaataaacgggtggacgtccacccgagtgattagaatccatctccttgacatgggaaatattcgttccgaatcgtcattaaaccaaaaaaattttctcaagttttctatttgtttccaaatcgtgtttccaaattttctcacatacgactttgtgcacatcctcacctagaaggaagcaaaacgctcttagggttccatgccatggcaaaagaaaggcagagcggtagtggcggcttgagaacaaggagaaaaagcatggaagccaaaagatactcctaccgacatcgatgacctcctatagtgcgtcctcctccgcttcatcacctcgtcaccttcgcctgcacgcgcttctgctgcctcatcgctaatgcctgtccgcccgccgtccttggccactactacatcctcgactggctggaaagacactcacatgttgataacaatccggcctaggtggggttgaccgaggcccaacaaattaaggtaatccggactccaacagttcttaggcacacccactcgaggaaaggcccaatctccctaaaaagaccagtccaataagtgaagggtggctctcccttttaaggtagcttcctcctcctaagctaagcagggtggggttattcataagctcacacggtcgccgcccgacttttgcatctttgccagcgggtaatagtggaggatgtcctcatcattcccacccccttaacaagggcccagctctgataccacttgatgaaccctgagctccacttgagacactcaaggctgttgttggcccgatctttcggtgagttgatgataactacgatttgggagaaacattgacgacccgactacaaccgtactagacgttgttgtgttgcgccttagcgatcgatacacctctccgtgggttgttgatcttgccggtatagatcaaccttattcctgcaagcaaatcgaagaaacaagcaagaacaagataaaagcaatctgaattgaaaataggaatgaatacacacgataagttggggtttctaatacaagcagatggacggtctagccgacacgcgtgctgcaaggaagtagcaatggctaaactttcatctaaacaaaacccaaaaaactctaaaggggtacctagctaattataatggtgggaggatgaccaaagggaccctagggtcatgatctacctgattggggcgcatcccacatgggccccacttgggccggggtcccatacgaagttacatgcccataggcccatgacaggtgacgcaacaccttgtttctttgattgtggccaactgagatggagtttggcgatgaggctagatccgttggaaagaggactccgagacctttccatcaagtattcacgggcccaaaacggagctcgtatgcaaatttggcagccgtttgaagtcagcagtgtagcaagtggccgaatcggattccagcacttggaggacttgatcttgatatcatcttgttcattcatgatgtgagcaatggttgtatctgtagtagccatggtcacatcacatgtggtcaatcctccgttcatccccgtgccttcgtcggatggctccaacagtggcagcagttgtttatccctcgactacctcttgttcacggacatttgaggcacgtaacgatcactggcggtcaagctccccattccccatcccacttcgcttcgtccctgtcgtgtgaagctcgtccccgcattccaccggtggtgatagagggcagcagggccccaaatcagacgagtgacgagactcccatcaccgagttaggctgcttcttcatctgcagcttcctcctgctttctcagcctacgcactgcgatccctaagccttgcaaccatgggagagggaggcgtgaggcagggccgcgaggggaagaagcttggcgacagagtccatctcggtgtgatgggcgagttggagctagcgacgataaagaatgacactaacaggaggtcaccgcagaaagagatggggtgcatatgagggaggagcggggaggtcaacaagctccttccacctcctctggacgatgacgctaccatcttgatcctccgtccactaggcccatcgacgactgtgaccccgacgcctcctacccttcttcgactaagcgccgatggcaacatcagcctagcaacagttgtgtcacgcgcgacagagctagcgccctgtccccatccctccccgcagtcgtttgcctatctctctctctctctttgtcgagatagagggagttggagctataccaaacaggacctaaaagacaagagaggatgggatgtggacacattgatttttttttctcttgagatatatatgggtcctacctttttaaatttcgctttttttccttgactgaaatgtcatttaagtgccacttacatgacaggtcaacgtaaaagaccgggttaaatgtcacgtaggcaccatgtagggcaaaaccatttagggaggcaaattaatctagttttaacagttgagggagctgtacctttttaagggcaagtacaaaggtagagaccggtatggtctctatgttaattagaggctatcacgttacgatagttaagacaatacggtctctaaccattaatgtgccaaattactttcttactagccatatttcctttattagactcaatgcaacaaaaattttcctaataaatgcgaagagtcgactctatgccgttgtcatgcgtagcaaccatctttctctttccttcttcctctctcttccacgtcaccaaatatgcttacataacaataaagagagatcgctaataaagaccattgtacatgccctaagttttgcggtttgaggacgcgaataaaactcggtccataggtgagggatgtcgaagaacatttcccaagctgttatggtgacgctattgcaatctgggccgggctggcacagcccacatatatctataactaatataaatatttatatttttccggtcgtcacatctaattttcatccatacacgatccgattcggttagcaatagccatggaaaaaaattgcaaaaaaaaaaaaaaatcggccgccgccgacgcctccaccaccgccggagggagaagagaggcggcggagggagcgccgctgccggatccgcccgcggtggccgccaccgccgacggatccaccctcggacgaagccgacgccgtcgacgccgccattgagagggcgacggggagagggagggagagggggagggagggacgaccatctccgtcgtctccgccgcacccgaccgtcgccgcgccgcccgcaccccgcaccccgccgtcgccgtcgcccacgccataccccacacctcgccgtcgcccgcgccgtgccgacgggagggagagggagcggtccaccgtcgccgctgcaccccgtcgtcgcccgcgccgtgccggtgggacgggagggatagggggagagggagcggcgccaccggaggggaggggagaggaagcggtgccagtggaaagagggggagggggagaggcggcgtccgggacgggggaggcggccggcttggttgggggggagggggcccccggagggagcgggaaaagcggcgtcgggggcggg

SEQ ID NO: 86526 - DNA, 2737 bp, Oryza sativa
cgtcgagtttcgtcaccggaattcgcatcccctcgcgctccggtgagttcaaccgctgccgccgccttcggccatgaatgccggtcgccgtggttcatcttcccccctctaatctctctcttctccttccttagggcaccccgaagctcgtccgccggttgccgtcgtcctcccgtggcttgccgtcgccgttcgccatcgtcttcctccgcgccggccaccctcggtgaggcatccctcccctcttttccctttcctctcctcctagtgccgcgccgccgcttcaagtcgcgcgccgtcgccttcggccgccgccaccgcctcccatgccgccggtcgccgccgtcgtcggccgcgtgccgtcaccgctagccctggccggccggtcggctttgatgccgagccgagcccggcggccgcctccatcgccgcccgtccgatcggccccgagggcgatctgggccgtcggttccgtggaccggcggtggaccacccgcgtggtcctggtccacggtgaaccgccctcccccttgagtcgctgaccggtgggccccgcgtgccggcgccccttcctccctctcccgagccgctgaccggtgggccccgcatgtcggcgccgctttcccccgtgctgacgtcagccctggaaaatattgcgcaataaattatttaaggattttgttatagtaataaacacagtgaatcttctaaaattcataactaattcatccgagctccgtttcagcccattcaagtctcagtaaatcaagaaaaatgtgtagaatccattaaaaatggttttgttccctgtttcagtagtcttatagcctgtttgcaatgtttgctttgtatgtcgctagattccggttcctccgacgctccggtgtacttcgaaatagtcgccgaggttcctccagcagcagagcaaggcaagtcatgcttgtcacttgaacatgttgatcctatattgcaaatgctctattgttttctttcaaatactgcattgttttataatgtttctaggggatgtttacctattgtcatagccatgctattgttgtaccttgtccctttgtcagcttggggttataacatgattagagtttggactagggattgcttagccatgcttagttcaactagttcaatggggaagatcttattaatgtttagactgttggttctaatggttttgttggattagtgccaccgctttggtgctggttaattaaaataaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaaaggtcctgtcatggcctctttccggtatgtcgtggtggcatgtcggcgcacggaaacgtgtcgtggggctgtgtcttgtgggtacagttgtacacctctgatcagagtaaaactattcgaatagtcgtgcccgcggttatgggcggtcaaccagattcaccgtgattagtctcaccctagtgtaatcttttgaatttggatagtttgggtggatggttgggcctgttgcaacgtgggatggcgttggacagtggatagtcaatactaattaattattacaactgtttaaatctttcaacttctgtttataaatgctcgttttatgcaaatgaaccactctagctcttctttgataattccctgcatcatacccctattccggtatgacttgctgagtacagtgggtagtactcagtcttgctctatttttcccaaccccagagcacgagtatgtgtcagatgaaggtttctccgaggagtaggcttcgtccgtgccgtcgaggatgcctgtggagtggtgttcccgctacagttctagtcaaggcttagctcctgttgtctttcgtttttccgctgcatttatgtaagacttttatgatgtttgtaagacgtggatctgaatgtcaacattgtcgtttgtgtaccccggccggtcctggacggggattttaatgcacattctgcttgaattctattcaggaatttctgggcgtgacaggtaccgaacgaattgaggtcgacattgcccatcgaacagcagtacacgacgcaagtttaagtagacatctgtcgacccaatttgtcattacgacttcagaaaatgtgactcttcttttgaccatccaacaagatattacttccaaacaaaaacatgctcatgacaaatacagttatttttgcacaagtcggaacaattgcttcaggtacaaccttttcaagaagaaccaaaacttgtaatcacatcattttttgcattcaacaagtcaaataattttgaggttccaagaacagtggtcaaaacagtaaagaatcaaaatacttacaactcacaactcaaactgcgccattatgctacaaatatatactactagtaggcttcctctaaaactgctgcactttctaaattcagaccaactacttacaacaaaaacaccacggccatctaactaccaacgtgagtgggct

SEQ ID NO: 86527 - DNA, 1381 bp, Oryza sativa
acaatctgtgaattgatcgaattccttctgctgccattgttgattttgtgcagtccggcttcgtcgcggcgtgcttcccaccgctgctgcgagtgatcgagttcgtgggcgaagacgacctcgacaacatcggcgagggagaaatctggactacggttgagaccagagggaggtcggtgaggctcctgaaagagaagatcgcgaagcttgtgggctacgaagacttcacgatgtgcgtcagcgccggccgccatgggcagttcacccctctgctcatggatgccaacttcgagggcgaagatacgttgctgtgggaggtggtgcgcgtccccccgagtggagacatgccggggctcccgatcgccactcaggtgagcttctccgatccttctccgctctcttcttgcgattcctgtttttttgttttgtgtcttgatgctgatttcgtcggaaattaatcttgatttcttgcaagaattaaccgtgcagtacaatttgtggattgatcgaatttctttctgctaccgttgttgattttgcgcagcccgggttcttcgtcagggtgtgcttcccccagccgctgcgggagatccagttcgtggacgaagccgacctcgacaacaccagcgagggagaaaactgggctacggttcagatcagagggaggtcggtgaggctcctgagagagaagatcgcggagcttgtgggctacgacgacttcacgatgtgcgtcagcgccggccgccatgggcagttcacccctctgctcatcgacctgcctcgccgccgggagaccctgcagatcgtccttgtcaggcccaacaccgaatgtaagcagcctagttaaatatgaatgttgctgaattttctgaacaatgtttatgtggttctgaattttgctgtgaattctagtaacggatggcatggagtgggcagtgtctctgtttttttgatttttttttgtgtcagatcagcactgtagattttctagctttcagtagtttgtgcctgtttggaatttcctgaaaatgcagtgatgatgtatttgcagaacttatctttcagtagagttaggatttgtctgaagaatactgtagaacagcagaactgcagaagtgaaatatatctgcacttatctgatgaatattcattccagtcatcatcagacaattgtgtgcaccttgggtttaactgaatgctgtaggattcatctgaatgttgtagatttttcggtgtgaaattcagcattcgagtagcattttaacatgtgaattactggcactgtttttacttacaagagctgtaattcttgtgtattactctttctaactgcgtgatttgtttgctatggctgcagcgtatgatcagttgatattcccga

SEQ ID NO: 86528 - DNA, 2535 bp, Oryza sativa
catcggcgagggagaaatctggactacggttaagaccagagggaggtcggtgaggctcctgaaagagaagatcgcgaagcttgtgggctacgaagacttcacgatgtgcgtcagcgccggccgccatgggcagttcacccctctgctcatggatgccaacttcgagggcgaagatacgttgctgtgggaggtggtgcgcgtccccccgagtggagacatgccggggctcccgatcgccactcaggtgagcttctccgatccttctccgctctcttcttgcgattcctgtttttttgttttgtgtcttgatgctgatttcgtcggaaattaatcttgatttcttgcaagaattaaccgtgcagtacaatttgtggattgatcgaatttccttctgctaccgttgttgattttgtgcagcccgggttcttcgtcagggcgtgcttcccccagccgctgcgggagatccagttcgtggacgaagccgacctcgacaacaccagcgagggagaaatctggactacggttgagatcagagggaggtcggtgaggctcctgagagagaagatcgcggagcttgtgggctacgacgacttcacgatgtgcgtcagcgccggccgccatgggcagttcacccctctgctcatcgacctgcctcgcagccgggagaccctgaacatcgtcctcctcaggaccaacagcgaaggtaaaaatcccagttcgagtatgaatgttgctgaattttctgaacaatgtttatgtgattctgaattttgctttgtctctgtttctctgattttgttacgtcagtccagcactgtagattttcctgttttcagtagtttgtgcctgttgtggaatttgctgaaaatgtagtcatgatgtgtttgcttgtagagttaggatttgtctgaagaatatactgtagaacagcagaagtgaaattcatctgccgaattttaatctcggccaccaccagacaattctatgcactttgggcttatctgaatgttgtagggtttatctgagctttgtagactttttcacacaatggtctgaatactgtagctgaatgcttgattggtatgtaaatatggtgtgcatctgggttattactattgttgtgactcagaactaaagtggatggattgaaacaagttcaagcctgcattgtctattcaacttgtttcacaatgatcatatcggtagtttagtgtgaaattcgacatccaatatgcatgttgctggattttctgaacattacttatgtaattcttaattttgctctgaaaggaatgcatggcatgacgtgggcagtgcttctgtttttctgggcctttttagctagttcagctcatctttttttgtctgttaggacttgtctgaagaatactttagaacgacagaactatacaagtgaaatatatctgcacttatctgatgaatattcatttcaggcatcatcagacaattgtgtgcaccttgggtttaactgaatgctgtaggattcatctgaatgttgtagatttttcagtgtgaaattcagcatccgagtagcattttaacatgtgaattactggcactgtttttacttgcaagagctgtaattcttgtgtattactctttctaactgcgtgatttgtttgctatggctgcagcgaatgatcagatgatattcccgaatccgaatgcattgccgtcagcagaggccacagatgaagacaatgccacgattgagtgaatccttttgtgctgaagttctgacaggctcagggaactcgacagaagattagtgtgttggtatagggtggaattttcagttcagccgatgctgcaatgcagttttatgtttgctatcagctgtagaatggctgaaaactctgaaattttcagtgtgttcaatgggtgtttttcgacggtttcacatacttcggaaacaggtaaaacaggaccttctaaggaaaatattggttttggtgacaattagtattcatgcctagtatggattgacgccaaaaatgtgcttattcctgaagtatattagtgttcatgctaaacttggtagaaatatgcatgatgtgtctgaattctgatgaatgaacacagtaactgaatgtctgaatctcctgaggcattcaggcttgcccctgcctatctatttgagaattttgatgggttccagtttgctgatgctacatgctatctactatctagttagttagtagttctgtctatacttagctgggtggaccataaaccaattgttagatcaaaaagtaaagtacagaggagagttcttgaaaacataaaactactccaatgctattttctgaagccctaaaacattcaggggttgtccctgtccttctaagagtagtatttgggaattttttttgaaggttagtatttaggaattttgacggtgccggtttgcaaatgctacatcctacatgctaactcctaactctgtgagttcacctatttgacagaactggacagccatattcctgttgtttgcagcaggaactagaacaagtt

SEQ ID NO: 86529 - DNA, 10637 bp, Oryza sativa
gcatatgtacctactggttctattggtcgtgtgactcagtgttggattccaaaatttcttatttctaaccccaacacagaggcctcgacatcttctcgttcgtaggtattttggcggcatactccccatgtgcattcaacgttgagatggcgattgctttttatggtaacatcaatttatttttggattgacatatttttggttctactctctcgattattagctttttatatgctagtgtttgaggtagtaatttttgttaatacaagtggatatatgtcgattcatgagaaccttggtgatatcattggcaattggatgtcttttttaaaatctttgatttcttcttgatttttctttggggagaattggaggttaatttgagggggagtttgtgctttttcatgcattcatgtttattttatgcatttgctctaattttgaaaataaataaaaataagaaaaataagagctttgttttatacctctagtatattcttgtgcatgctagcaaaataattgaggtctatttgttgctatgttagcttgtatgcattttagtctttatatgaagcttagatattgcttttaagtgagatgatgcatgacactaattcttttacttgaattaagaaaatatgcaatattaatgctagcatatggtttgatttttaaatgcttatatatagctttattgaattgttattcctcaaatagctttgtaattgctcattgtgaaaagagaataaaaaatacgaaaaaataaataccgaatccttggaagcagtcttgacgataaggacgtattcgatgtgagcaaaaataatgggtgccgaatccttggaaacagtcttgacgacaaggacgtacccggaataattgagagaaaaaaatatgagcaaaaaagtctcaaggaaagaaaaagttaaaaattctcttggttgttttgtactaaagctaatttgataaacagtaataaatgcaataggtatatatgtatagtgtttatttttcaacctatgtgcttgtgaatatattgcattataaatcatttgaagtcatgagtccttattgatgatttgagcttaattgtaatatctttgattcatgtttatactatgatgcatgcttgttaactagttgatgaatttatctcccttatcttgcaaaacatgatcattaattgcttttggtacatttcaaagctctcgaaaaaaatagaaaatggaaaataaaaatttgttattacaagtggcaagcatgacatcatttcatttgtgctttattgtcattatttctcttttgaattcttgatgaaatcattgtcaaagggggagaaatatacaaaatgcatgcttcttggaaaggggagaattgaactgaaactgtttcgatttacaaaatgcatgcttctcgaaaaggggagaattgaactgatgaactgtttcgatttttaaaaatagtcgattttgtgctttgattgcaaattgatgggagaaattctttcttttaaaaagggggagagtttttctttttctgctttgattgcaaattgatgggagaaattctttcttttaaaaagggggagagtttttctttttcacttttgtgatttttgtttttatttttcaaaaacacaaatttgcattttggagatgttgccaatgtattcatcaagggggagattgtgaaatcattgtcatgattaataattgtgatgaacaattggctatgcaaatgatttaatcaaagaattggtttgaaaagatgtgcgaatgttagtgtgagtgcgtgtgactaatgtgagtcaggttgtgatatctgtgcccagaaacggttgttttgtctgattgtgtgcaggtgacttgaggtcagccttagtcaatggtgaggaccgggactatgctcaagaggagcagaggtctattgcggtcgggataccatgtaagaaggtgactagagctagtattcttggaggtcaacttcggtcaacagtggggatcgggactaaactcagggaggagttgaggtccagacggtcgaggatatcgggtgacgaagttggatacgagatgtcacacggtggatggacaccgtgtgggagagatcttcgcaacaggcttcacgaggtgtgcgtgcaagtgctggtgttcgcgaaggagattggagtgagaaattgagaaaagggtatatggtgctacagtacacgtggtactgtagcatgcgtatggatggtatctatgcatgtatgttgatcatgcatgtgtggctcggtgcgttcttcatgcatgtgtgatggttcggtgggcttcggtggcagctggctggaggccgaaccggtccaggagcagcagcacgttggcccacgtgcgataggcccaagcaggagcaagcgcaggagatcgagtccgatgcggttgattgcggctgtgcgagttttgggaaattgtaaaaggtttggaaattgagggtttgagtcctactgtgaaaaggagttctacacctattttgagtagggggtttttcatgtataaatagagggggagcgtgaggcttcccggtatcgcttttttatcgcttttcagagcgtggagctgatagtttagttagggtttcgagtttagtcgagatttttgtaaggagtgttgttagtgcactttgtaaacacagagagaagcaataaagttgtcatctactttgagagttcttcgatttgtgtttcatcgggttcggcggttcgaccggcggcgtgcaagcggttcgactggcggcgtgcgagcggtccgaccggcggcggcgacaggactacgtcgagatttccatcgatttgagggtaacttttatttccgctaaaagtttttgggttttagttttctctaccattcacccccctctggtaggcttggtttcttgtgttcgatcctacactcttgagggaaaaaaattacatctccatttttattatggtcatctttattgtcaactgctaccttttgaggtcttttggcagttgaaagttgaaacaagaaaacatattactctaataaggtgcaagctagcaggagatctatgcaacaaatagtatctccaaaaccaagctattaaaatcttgcaatactagtaggaaataacatgatttttcagcaggacaactgcaacctaactatgcctttgttacaccatgccattggaaagtatgaaagacagaaagagcagattgttcagcgggactgtacctttgctgtggctgcggtgccattatccgtcaaaggaagggtataagcattgtgaggcgtcgagctctgcggagcagtttcattgggcctcagtgtgatcaatggcaatctgagaccattggagcctgaaactgcatatcctctgtcggaagaagagctgccggagatgtgagaggtaaccgaggcaagtaacaacaatgcattcagatttgggaatagcaactgatcgtcagctgcagcaatagcaaagaaatcatgcagttaggcacaagtaataacagaggcaagtttaaatagtgctgaacaagttggatataggcttgaactggtttcagaccatccattttaaggtgtcgtagaacagagacaagcagtattaacataccattcagctactactggttttccctatctacaatattcagatcatcatctccgaatttccacaacattcagataaaactatcatcaagaaacacaaaataccaaagtactgaacaatttacagtactgaaaactacaaaatccacattattgaacggacaaaagggacctgaaaaacataaacattgcccacaggaaactcagtcaatctagcaagcttggcaatgaaaaaatgccaggcaatctgcaattagtgaactatactagacttactgatgcagttttaacatttcaagaacttgtgcttcaggaaattcagtcactgtcatcacttgtcagaattcagtccctgtcatctacggaatcatcaataatctcaagttatgcagaccattcagaactacataaacaatgttcagagaattcagacacatgcatatcgagctagtctgcttaccttcactgttgggcctgacaaggacgatgtgcagggtctcccggctgcgaggcaggtcgatgagcagaggagttagccgcccatggatgccggcgcggacgcagagtgtaaactcgtcgtagcccagaatgcctgcgagcttctctctcaggagctggaccgacttcccggtgaacacgtcgatgttgccggcggcgcctgcgccggccgtcacgaactggatctgccgcctcagcgggggaaagcacgccgcgacgagattcttggtcaagttgcactgcacaaaatcaacaacagcagcacaacgaatttgataaaaaaaattcacagattgttacatggttcaagattaatctccgacccaatcaatcatcatcaagacttcttcaactagaaccagaacaatcctcttgttgtagaattgcataaaggacacaacacaaacacaagaattgaaggaagagaggggatcaggagagaggaggagtaggaggatctcacctcagtggcgatcgggagctcaggtctgacttgactcggggtgacacgcaccacctcccacctcagcgacgtttcgttgtcgacgtcgctgtggacggagacgccagggcggcgagccaggaaggtctggttgccgcgcaggtagcgcccggacttgtcgtgcagaaggacgacgcagccgcgggcaaggtccgggccggagcacccgacggcgcgccacatgatggcaccgacatccagcacgtcgcggtcgcgctgcgctgcctcgagcgagcagcagccctcgcgctcgcggtcgggggcgtcgggggacccgaggtagcggccgtaggctccgcggaggagcacataccgcgtgggaggcaccccggcgaccacctcctctacggcccacaccgcgttgtgcagcgagccgccgccgctgccgccgcgcaggttgccgtggtagacggaccgcccgttctcgtcggcgtggaggtaggagttgcagcaccacacccgcagcgccacgaactccactccctggaaaacctccatcgacggccgccgcgcgtggatggagtggtacgaggactccatgatctggtcggagagtcgaacgcgcggtggcgagacggtgcgtcgcgtcgcgtcgcgcggccgcgcggggaggaagaggatcgagcgatcgcgacggcgatggccgccgcacaagaggtggcggcgtgcgcgcggtggcgaggcgtggcgtggcgtggcgtggggaggaagacgagagaggcaactagccgtggaggaatttggtggtggtggatttgaaagcgtcgcgaggaggaggacggaggcgcacgtcgcggtctgacaggtgggccctctggtcaatggtcaacctcgtcaatgacgggtgggcccgtgggcaccgtggccacgtaaaacttgggggcgacctgcaaaattcatgcaaacgagtttctgaacctgttcagatcgctgctgcaatcaagatgaatctctccagtttcaaaagagtctgaactctgaagtcacactgtgtctgcatgctgcaatgtttcaaaaaaaaaattgaccaccatcatacaaatcgctcaagataaaacgcaatatactctctttaataatgtcaatctatcggtctgcatgtcaatagtgaactatcctagactcgctgagtcatgtgttcttcactttttgatgtaacaattggtttagggtagataatcaccgtaacaagtaaaagcagctactacctaactagattccacacttgacattaccaaacttcacgagattaagttactgtcatgacttcagaattcagaacatctgaccttaatcaatatttttgtcagaagtgaatttacagaatgaaattagaatctgtccagttattttcaaagaagtgaatttacagagttatgaaggttccatggactcagattcttaacttttggaactaacagattcagcataggacgcagcatctgcaaactggcaccgtcaaagttcctagatattttcgttaagcacactggacaggggcatgccattactcatcagaattcagaacgatggtcatatttctaactagtttagcatgaactgtaatacatattgcaggagagttaagcacacattcttgtcatcaatccgtactaggcatgaagactaattgtcaccaaaaccaatattttcgttaaaaaaccctgtttcacttttaccgggttttcgaagtatgtaaactgcgtaaaaacacccattgtacaccctgacaatttcagttttttcctgtcattctacaactgagagcaacataaaactgcatttccggcatcgactgaaaattctactctatgcctctaaaaccaacacactgatcttcgctcgatttccctgagcctgtcagaaattcagcatgaaaggattcactgaatcaatccctcctccgatgcctatatctcctacgtcacgatgcatccggatctgggaatgtcaaccgatgatccgctgcagtcatagcagagaaatatgcagttagacagtgcccaaacagtactactcctgcaagtaaaaaaaacagtgcaagcaattctgcaaatgaagatactactcggagttcccgtctttcgcactaagcactggacgatcattttcacaacaaattgaaactaccatccttcatatatgcaaaccatctgctgttgcatgataataatcagaacaaagtgaaattagcatccattctatatgcagataataagaactcgaaatggtttcagacaatccattttaggtgacagacccaccacaacaatagttctaggccagatcacacagtattaacataccatttagctactactaattcttcttatctacatattcagataaaatcctattcccaagaaagcatagtacaccaattgcatacaattttcttgtgacgcctgacttgcattccatcaacagaaaattcctcacatttgtcagcaagtaaaaacaattcctactgcaatgttcacttctgctgttctactacaatgttcttcagaaaactcctaactcagcaagtaaaaacatgactgcattttccacaaacagtgcactgagaactggaaaaatctacggtgctgagataaccaaaaggaccagaaaaggagatatatgccattcagaacaacataaactatgttcagaaaattcaggaacatgcatatcgaaatcgaagctaggctgcttaccttcgctgttgcgcctgagagcgacgatgtgcagggtctcccggctgtgaggcaggttgatgagcagcggggtgagccgcccatggcggccggcgcggacgcacatcgtgatggcgtagcccacacggttctcgagctcgtttctcaggagctgcaccgacctcccttggtactgaaacgaatcccagacgatgttgccgtcgccgtcgggcgccacgaactggatctcccgccgccgcggggggaagcatatcttgacgaagagctcagccaagtcggcctgcacaaaatcaagatagcacaaggaatttgatcaattcacggatgatctcccacccaatcagcataacagattgtagcagaacgaagaacgatgacgcaaacaagttgtagaatcgctagaagagaggggagaggatcggaggagctcacctcagtggcgatcgggagctccggcctgcctggactcgggaggacgggacgcacctcccaccgcaactccttctcgtcgtcgctgaggcggccatcgccgacggtgaggctggggcggccaccgcaaaccagggtactcatcagtttgccgcgcaggtagcggccggacttgtcgtgcaggcagacgacgtggccggtcctcctgacggcacgccacatgatggcgtcgaccaccggctggtcgaagtcgcgctggccgacgacgggggcgggacagcagcaggagagcggccagcggcgctcgacggcgtccggggcaccgaggtagcggccgtaggcgccgcggaggagcacgtactgcgtcgggggctccccggcgacggccaactgcaccgcccagatcgcctcgtgcgaggggcggcggcctgggtcgtagtggtagaccgacctcccgtcctcgtcggcggtgatgtacgtctcctcccacaagttccgcagccgcacgaactgcgcaccatggaaaacctgcatcgcggcccgccgcggatggtgcgccggtgatgcgcgcgcggcggcgagtggcttgctactcctcggcttctcggcgtggcgtggcgtggcgcggcgcggcgtggcgtggcgtggcgaggaaggcgagactgcgagagaggcgaggcggtggtgcatttgaaagcgtcgcgaggagaggagggagacgcaggccgctctctgacagatgggtcccctggtcaaatgtggtcaaccgtagtcagtgacggatgtgcccgtgcaaaatgttgaatttgctcaaacgagggagcgcagattcaggattgagtagactctgcaaaatttttaagaaaaaaacgagtttctgaacttgttctgatcgctgctgcaatcaaaacgactctgttcggtttcaaaaatgtatgaactctgaagtcacactgcctctgcattcagctgcagtgtttcaaagaaaaaaaatggtcaccaccatacaaatcgctcaagataaaacgcaatatagcaaacttggcccttaaaaaaaatgcatcaatctgttttgaaaggaggaagtaatcagtctgttgttcgcttctagagaactctcttgtcatatttttttttactttttgatctaaaatttggtctagggtagacaatcaccgactcaccgtaacaagaaatgtagcatctccaaacttcaggagattcagttactgtcatgactcttcagaattcaaaacatttggcattactaactgtcaacttaatcaatatttttgtcatgactgaatttacagagtgaaattagaatctgtccagttcttttcaaagaagtgaatttacagagttattaggaagattccatggatgatcgatccatcagtccttcagccggttgttcttaacttttggaactaatagttggtttagggtaatcacaggaacaggtaaagaactactctactagattctgcatagcaaagcagcatctgcaaaccggcaccgtgaaagttcccaaatagatggagagggacacgctattactcatcagaattcagaacgacgtgcataattctacctagtttagcatgaactgtaatacatgttgcaggagttaagcgaacattcttgtcataaatccatactaggcatcatgactaaattgtcaccaaaaccaatattttcgtcagaaaaccctgtttcacttataccgggttttcgaagcatgtaaactgtgtaaaaacacccattgcacaccctgacaatttcagtttttttctgtcattctacagctgagagcaacataaaactgcatttccggcatcgactgaaaattctactctatgcctctaaaaccaacacactgatcttccctcgatttccctgagcctgtcagaaattcagcacgaaaggattcactgaattatggccctcctccgatgcctatatctccgacgtgatgatgctttgggatctgggaatgtcaactgattatccgctgcagccatagcagagaaatatgcagttagacagtgcccaagcagtactactcttgaaagtaataaacagtgcaagcaattatgcaaactaagaacttgaacaggtttcagacttgaaaccccacaattaaggtactacgaggatgccgaatctcacactaaacactgatttgacaataatcaaaacaaattgaaattagcatccattctatatgcagataataagaacttgaaatggtttcagacaatctattttaaatgacagacccaccacaacaatattaccataccattctgatactaccaattgatgttatccacaatattgagataaaatcctatcaattgcaaacaattttcttgtgatgcctgactagcattccatcaacagaaaattcctcacatttgtcagcaagtaaaaacaattcctactgcaatgttcacttctgccgttctactacaatgttgttcagacaagtcctaactcaacaagtaaaaacatgactgaattttccacaaattccacaaaacttactgaaaactggaaagatctacagtgttgaactaacaaaaaggacaagaaaaagatatgcatgccattcagaaacatcgcccacagcattgccaacaatttcagaacagcataaactatgttcagaaaaattcagaagcatgcatgcatatcgagatcgaaccttcgctgttgcgcctgagaacgacgatgtgcagggtctcccggctgtgaggcaggttgatgagcagagggctgtgctgcccatggcggccggcgcggacgcacaccgtgatggcgtagcccacacggtcctcgagctcgtttctcaggagctgcaccgacctcccctcgtactgaaacgaa

SEQ ID NO: 86530 - DNA, 2389 bp, Oryza sativa
ccagtggatcgggccagacaggccggccggggcccgttgtgccacgtgaactgaacagtggcgccgcgcgagcgggtcaaaaggcggagccgagtagccgactggcgacggccactggctcggggagcaagcgcatgacacgtcggcacaagtggggtgggcgtgtatcggtggatgatttggggctgagacttttcaaaaatgttggaactacggggtaacggagtagaatttagatcactcacgtcggccctacaagggagagcgatgcagcgttggatctgaattagatcaccaggccaccagggtccgcacaagacagcagggggaaatgggggcccaagcaatttcatgatcttctttttttttttttttggagatcttctatggacattaacagtgatagaaatcatactaggattacattgtacattaacagtgttacgtaaaatattactccctccgtcccaaaatataagtatttataagtatttttagactctgacagtctccaagatgctactttaactaacaatatctaaaaataagatattttaaatagaaagaattatatattatgatagtttgtttaataataaatctagtaacatcaattgtacatgattgatatttgttacttttttttgctattaatagttaaagttaaaaatgtttgactcgtcacaatgctaaaaatgtttatattttgggacggatggagcactacttagggaggatatctgatgctctaccggataactccagatccctccaggttaataatacttgtcgtgttggataagtatacacggttttaaaaaaatatcaatcattttattaagtattttgtagactaatccatacatataatctttagatttaagacaaatattttataaattatttgtgattgaaagattttaaaatttagccttagtcttgtccaaaacaataagtattattaacttggaaagagtagtacccaagcacctaaaactcactcttgagacatggaaaattttgaataaaagttaataacatgcatctacaatagcacgaaatttccaatccaagttttatttgcatgtcgagaacgcctgaattgattcacttgaagatttaacatcgaaaagcattgccgatttatctaggcttagactgtctccaacaagtgacccataagggcacctaaacccaaaatgggtctccgatagtactattttagcctccaacagagtacctatacagaagacccattttgcgtgctataagaggcataacctaaatctgagtatcctctctcctgaaaatctatttgcagtaatggttctcttttaggtcttattgttagagaagaccaaaaataggtattgaactctttaactgtagcgctatgcaaacgtgaaatgggtcttgtattttgggtttcattgttggagatagccttataagttcctgctgttacactaccataccatattgcacatgtttgacaacggataaataatatatttcatggaaacaagaaaggctacataatgacggagtgaccataactgataagtttaccaaaatggttagattattttgtattataatttaactttgataaaacaacaagctggcagcatcagagcttattacaattttaatgcacaaaatttgatagatgctgcacaacaggaattacaatttggtgattaatcatctaatttactgacctcatggggtttgtctccctgaagagagcgaaacaatgcactcttggaccatttcctggactcttctcttcaaaagcttatccttcacaccagaaagcatgctgcggtagaagatctccaggcgattgagttcatcagtacctgctgtatccaagatgttctcaaattcctttctaatatcaaagacaggagattcttgaagggaacgtggaagtgttcgttcatctagaggtttacgaaatattgaaatgtgaagtatgttggcatatctctccataagtgtcagttttgaccgaagaaactccagctcttctgaggcagcagatagcttttgttccaactcagcgctattccggtcattcactcccgatgttgatgcctgtgctctatcctcatgaatttcttggaagttctcatcaagaggaggccacatcacaacacatggtatgtaactgtcagcagtctggtttctcccaagcacaccactgcggcctctgccccaagcccacatcctatacccatcaccagcaacaagaacagtgtgagcagctccacaagtgacctgcactgcaccaagaaatttgaacccatttgtctcaggagactgaactcttatcgggcgtagagcatcccctgaatcaactcctgaaaagctggcatcagggcac

SEQ ID NO: 86531 - DNA, 1331 bp, Oryza sativa
aaaaagaagaagggctttttatggttttcataattaacctaccagtccacaacttaactaaatgttgtcgcgttcttaaaacaaatcctaacttaaattcagcaaaagaaagggagtatcaagaaacatgacatattgacatgaatggcaattggcaattagtggcacttcttttgttacttcagaaaattagtggtgtcgtgtgcaaaaaaaaaaaatccaaacaaatgaatacattgcatatataaaaagagggacagaaccatgcaggcacatacttcaattgtaacaaagctaatttcttttatgtaattaaaaatgaagtacaagtacccatgaagctatgattcttgagtatttaaaattggattaacatgttcagatcgtgcaatcgcatgcgtgcttggctagttattttatccttttctattattacataagttttcacatgcattaccaatctagacttgatctaatgacagtgctagtgaatattacagagcattgcatctgctgagatatatacttagtcatttacagataaccttccctagctccttgccagcagtaatggcctaatccttattccctttttatcagaccaaaatatcataatagttttatcatgcagtgtacgatcttaagctatcttcactagtaggaaacaaatgcagtgccaacttgtcggagaagtatactagtaggaataataaagtactacttcctgctgcccaaaacgagaaacatacagcttctagttctagtgttaattttatcgcgcatatgggcagatgacacacgcacctcatcttcggtcgggtctccggcacagggtgcatcaacaactgacagaatgatgcttccttgggccacttgagcagcagctgtggaggcaagacgcggtgccgtaggttcgccattgctcgcatcttctcctccatcgtctcgaacgtacagaacaactgaaacaacagccgtagacataaaatcagcgatgagctgagccgatgacaagcagtgcatgcggagaactaacagcgcatttgatctcaagcacccgcacctcgaacaagagcactcctaacctatacacgtcggaggcgaaagtagcgccgccgcggtcgtcggcctcctcggggctggtgtaccaggtgagctccatcgccagcacgctcctcagcgggaacgtcttcccgccgcggtcctccccaccgctggcgccgtcccgtcgccgccgaggaggcgagggttccggtcggcctcctccgagccgtcggagccggagcaggagcccgagacgtcggagccggaggcggactcgatgaacgcga

SEQ ID NO: 86532 - DNA, 4056 bp, Oryza sativa
aggcaatttcatacacctcccaagaagatccttcgctaaaagctgagataagcacaggacgggatctactttccttgtcacctagacccaactggccatggttgttattgccccaggcataacaaacaaggtcacctcctgtataggtctctccagcactgactgcagctacgacatgctcattaccacaggcaaccttaacaacagtgtgaccatggaaatcccacacaggtagtgggacacagctaggtgctatacaaaactctccagcatcagtctgctgcgggcaatttccccacatccacatagctcccagagtgtctatggcaaatgacatcatgcccccagctttaacagaagacaactgcaacaaaacatacagcaggattggttaagcacaaagatgaacttttaagtagtattacaagtttgcagctttggttgttcttataagaaagggtgatctatttgtaccttcaatgaagactgtgtgctactgttctgtgcttcagactgcagcgtttcaggtgaacccaaatcttgaaaacgctcaaccaaacatgggaaaagagaattctcttccccgtagccaagctgaccatccgttaaatagtcaagaaagaacataacaggcgctgacttggatattagtagaatggtttcaagtcgccaaagctcaaattacataaactttgtgaaggatacagatgttgtaaccccatgaccagagcgaaccttcatctgcaatgttggacaatattcagaacaaagcttatatgtattaattacatataggtaacgcatttgattaacattttggctaagaaaccatttacagttaaaactagtaacctgaaggaaaattatgtattattttttcttactgaactcttagtaacactgatgtctagattttctttaacttccatctagttaaatcaaacagttgagatcattgtttgtaagagttttgctttgatctaaactgaactattcatttgcccattatttgccattgatgtcacaacgacatgtgagctatatgttagtttgttttagataaggccataagggaagtgacaagctcccagcctttgcatcatctaaggatgcacacagccattacatcaccaaatgctaagcaattatataagttagtgaaataatgagtctcgaagggattgggcaaattcaatgctatacagtatgggaaagcgtaataaaatacagtgttctttgcaatgaacaatttgtcgatttcacttattaagcagttcaaccattccaagcaaattcaggggaaaactcataccatatcaaaaaggcccgtagtaacagcacaaaaattcaagggaacggaaatgttcgcatggtctgtgcatattgtacaggaataaccccacataccaaatgctcgtcagggatcaggaccataggagccgcaaagtacagcaccggtgaatctaatctactctctccgtttcaggttataagacgttttgactttggtcaaagtcaaattgttttaagtttgactaagcttgtagaaaaaaataatagcatttttaacccaaaacaaatttattatgaaaatatattcaaatattgatttaataaaactaatttggtattgtaaacattactatatttgtctataaacctagtcaaacttaaattaatttgactttgaccaaaatcaaaacgttttataacctaatttcagagagagtaactaccagtagattgcactagaaaattatgcacgcattgggcatttgggccacagcaactcagtaaactaaaattcaagttaccagtggctagtcggttactcgggtgggcgctctccacaaaccgcaaatcataattctgcaactacttcagtactttcaaactacagttgcctacacagccgcacagaatgctatcacgaagcgaatgaaagcaaaagcactaaccgtccagcgcaaggctgtggtaggcgccggatgcgacggccacgaacctgggccgcggcctcccgccggcggcgaccacggtgggcacgtgctcgtcggcctcgcgcccggtcccgaggcggccgaacatgccccgtccccacgagtacacctcaccgtcacctgcaacgcacgcacgcccagcaaaacccacaaaagccacgctctcagatcccgaatcccgccgatgcctcgataattcgccccgggagcaaagcgagcgccgttaccggtgagggcgagcgtgtgggcctcgccggcggccacggcgaccaccttgggcggcatctgcggcggcagcggggagcagcggtggagtggacgagagggcagatgaggaggagtgggaggaagaggagggcacgagtacaactggaggcattaccgcgagagcaaggcagtaaaatgagcagcggaagcgaaggcgataaggactcgagcgagtcggtgtgcagcacggcaagtcaccgcttgcggaggagctcgtcgacgtcgacattgacttcatcccgcttttcccccaagaatgatccgggagatggctttgggacgcgtgtcgcggcgctgcatcaccggaaaaagaggtggttggaacttagaattggcaggtgtgctgctgatggtgcgagtcgctagtgagatttggacaagtttggggagtacattactcctgtggatgtagagttgtagacactggcaaccaattcagatatctgatgaactactacacattctgcatctaggaaatgttgtgcattgcagcgagaggggattcctttgtacaagcagcaaacgtcatatgttctactaagttctaacacattttgggttcagttgattatctcacatacccacggtgcaagtacatacagcaccctgcaccctgatggttccacaaaggaaaaggaattacgaccttctcaaactctcacatatttgacagccagatgacatcgatcacagcagatgccgcaaggaagatgcaactgagaaaggcacacgcgatggaggccgctgacaagtcgcagaaacgtggcagtggcttgcagaagttggggagcgccgtgtgccggatgccggtgcggttcagattcgcgactgccgccgctgctgatccagcactcatcattgcatatgcgaagatctgcacgcgaatgaaaaacagcagaagttagatgttaatcttgcattccacgggaaatgtcaggccaaagccaaatgttcagctgctatttgttgaactaaagaaagttgtggggttgcaatgggaatggaaagtaaagcagcttaatgacaaagagtttttaatcaactttccatcggatgatgtgagaagtaaaatatccacttgcaagagctttgattttgagacctctctaatcaaggctagtgtggtggagacaggtatgacagaagaggctgttgatgagctagttgctgtttgggtcaaagtatatggcataccaaagattgctaggaatgaggatgctattaagtccattgctgagttggtgggggaatttgaagctctagatggtgctagtatcagaagagatggtccaatcagagtgagagttgcttgtaaggaccctagggaattacacttcgggatgcatgtctatatcaacaaagtgggatacttaatcagatgggagccagaagggtattcgtctattgagaatagaccaattcaccctgatgacgatgacaaagatgacaaagacgagaatgacggcaatgaagacatgaatgttgatgaggattacaagatgcaaagccctactagaggtagacagaaccagaatacaggtgcttcatcaaggggtggacactctgcgccacctgcttacaaaggcaaggaatataagagtggttatgtcaagaagattgcctctaagaaaacctctactatctcatcctcagaactggttttggagaaagaaaaaaagaaagagttagtgtcactacagcaggaaccaaagcacacagagtcacctgagctggtgttgtgggagaaaaagatggagatagtccctatggaacaagaatcccaggaaat

SEQ ID NO: 86533 - DNA, 3919 bp, Oryza sativa
ctttcgactgcagctgcctgtgcgacgctggcaatcagccggagtggtgtggcaatgggcgagagggtgggcgttggagcggcagcggtgggaaaaccatggacggcatcatggccgtgccaagtatatacggtagggaaaaccactgtccaggagctgtactggcaatctggagctcaccggcgaggagaaggaaaccgtgcggaagctgatggacgaacacagcggaaaggttgatctcggaacgtatctctgggagaacaacctcaccatgacattctcctccaacctcgccagcgcatcgccacagccaccgcttctgcggaggccacctacttcgacaggagcaccacactgcgggtgctctgtagccatggccagctggcgcaggcgcgctctggctcctcgagtcctcctcggagccgcccgacgaggatgcctacgtcgcgctgttccggctccgcgaatggcaccgcgcggtcgacggtgggatgcagggtgtgcgcatgtggatgccgagcacccgagcttggttctctgcctcaggaacaccatgctgagcacgctcgtcaggttcggggccatatggtacgcgtggagggtgttcaccgaatgcctgagagggacgtctcaaagagccagaaagaaatagcagtggagtctaagcaaactatatagagttacagtccatgctgatcacggacaagaacgacgcgctgatgagcacggagtaggaggccatgctgagcacgggccgcatgccagggtgccgagctgggggctcgtcggactccacgtgcttgtccaggtacggggtgagcatcgacgcgtcgaggtccgactacagtggtggtcggaagctcgaggccggcgccggaggtgatgagaggaagaaggagcagatgaagaatattatgcgaacactcaaggggatcatcctggcggcagcaagatggacgcgcccaccgtcctccacaaggccgtcaggtacctcaagttgctcaaggtggaggtcaagaagctcggtgtgcgtagctcaagcagctaagtgtgctaccgacagacccgacatcgacaatgaccttgctcaacggctgacggggacgcggatggagtcaagatggagagggcggcgggtagaggcaccagagagaaggccgcaagccaccacacacttctccatgccatctttctctctatcgagtgacgtccttctcctctcccgttgaccgttgggcgccgccccttttccccgccactcgtgatgccgtccttcccgacagttgtcaccttacagggcaaaggggagagagagaagagaggggaaagggaagagaggggagaagagagtgttagccactgacatgtgggccccgcatgggtcccacgttgactcggcttgccacgtcagctaaaagccgagcatgatactgtctacgatatcggatgatcagattttataaattaagggatccattatatctggtatttcgattaaggacaaattccaggctcgacgacaaaatgagggacctagagtgaacttatccttcctatatggacccaagaggcccagactgggtcaatcctaagagcaggtacaatagcagactattagccagctacaaacatattttaatgagataaaagataagagagaagagcagcaagctacatatctgtagccagttgcagcacggactccaagatgcaatgtgtgtataacaggtgggaccatatactaatagtatagtaagcaattattgtatgaattggctatagatgaattggagctagtagtgggctatattattaaacttgctctaacagtgacagtcaaaaggggccagcaccggcgtcggtggtggcaagggaagagcgagcgcggtggacacaatggtggtgttgacgggagctcgacagcgttggaagatcggaagagcgagcgcggtgttggcctgttgggaagatttcggctccgactccggcgagggcattggtggaatgcggcggcggggacacgtgaggaggagcgaggaggcgcggaggcggagtcttcggacgggcgaaaatcgcggtcgtggtggaggagggggtaaaatcgtgggtggacggtacggattagggattagacgatgcggaggcgatgcaaatgaggatggatggtagggattaatgcagatgatttggcatgtaggattagagggtgcaactcctccttttttatattagtatagatttgtgtagaaattatcattgcaagagagatggctcattcacgagtgcagatcctctacagtactactggtgcagtagcagtggctgacgtgtggacaccagcattactacaggcaatccccgttgctcattcactatttcatcccttttctcttccgagctgttggccacttggcccaatagctgggcgtgtatcagtgcatgcatactgaagtagtactccagtacggagtaccagtgtaccacagctcttctgttcgctcgccctgccacgattttggcgccgtgtgctgtgcctgtgcgctgtactgtgatgatcaggttcacctcgtcatacggcgacagcgtcatgtcaggtgtcttcatctctgtcgccatcatttggcccgttttcggtgctttcatctggttgcagcttggtgggctggtccagtaggtaggttacgggctggcctggttcttccatactcaggtccactaattcaacccacatatgaaaaactggaaatggagtaaagctgcgtgaactgtactattattaaagaggacatatccggtgaaaatgagctaagtgttgaaaactcgtgaaaatcatacttaaaagtttcgtaaattcatgaaaaaaatattagagatagatgtagatataaaatacattctcaccaaatctcaactccaaactcaagttcgtttatgagaaacaaaaaaaacaaatttcaggtgaatagtgtcctgttattattcacctgaaatttgtcttttttgttacttctaaacgaagttgagtttgaacttgagatttggtgagaatgtatttcatatctacacctatctctaatatttttttcatgaatttacaaaacttttaggtatgattttcacgagttttcaacacttagctcattttcaccggatatgtccccattattaaactactaggtgatctcccgcactttgttgcaaaaattactaaacaattctcaatatatattttgagacaatgaatataggagttaaaatgaaaaaaaatgaaattctggtttatcagtacttatcatgaaacaaacaaatgatacccgcactttaatgtgaaacatattgataagtataatttaaatattataaaaatgatagataggtttgttaaaatattgtgtaaatgatgtaatggttgataattggatatggttacatgttgatttatagaattaaataaattgtagatgaagtatgcttgcattatgttaaatatgtaattattgatagtgagtgatgatgtgttattgttgcgcgttgagttgtaaatttagcggactataactttattatagaaaatataaataggtagatacatcatatcatcattagtggtaatcataaagcttagcatagttgtaaatgttactacttcctccgttccgataaaaaacaaatctaaataaaaatgtgacatcacctataatgaaccggataatctcaggtggtatcacacttccatctagattggtgtttttttttttgacagaggtagtactatgtgtttacacaggcgagttgaacaaaatactagttgtatttttttacagaggtttcgcggtgaggaccaaggggttgattgggaaaatatatagtacaaaccacatatatagtggaaacttagaaattaccattggatcgagaa

SEQ ID NO: 86534 - DNA, 902 bp, Oryza sativa
gacgatgcccatcaacggtggtgtgaccaaccgaccgtataggcgaggacaccagtcggcggcgacggaggcaggccggtggtgaagtcgtagacgcccaacagcagcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggtggtgaagttgtagacgcccaacagcggcggcataataggccagccgtgtaggcggaggcaccactcggcggcgacggaggcaggccggcggtgaagtcgtagacgcccaacagcggcggcataataggccagctgtgtaggcggaggcaccactcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcgaggacaccagtcggcggcgacggaggcaggccggtggtgaagtcgtagacgcccaacagcagcggcataataggccagccgtgcaggcggaaacaccagtcggcggcggcgaaggccagccggtcggtgaagacatggacgcccatgaacggtggtgtgaccgaccaaccgtataggcgatgacaccagtcggcggcgacggaggcaggccggcggtgaagtcgttgttgctatcagcaatggcggtggcgaggacaagccggcggagtggactcgcggccgatcgaccggaaagctgagacgcctcgagtccatgaccagca

SEQ ID NO: 86535 - DNA, 1332 bp, Oryza sativa
caattacctagcccccagccgtgaagttggaaaaaccaatttccaattacacggcttggttaatacgcattatggagcactcttacatgaccaggttttacatggtcgtttggctctttaggatctgacaagagcttatctgctctgggtgtccccagccgaaattcccttaggtttctcggaggcttgtcagactggcgtaaagggacaataatttcgatgtcaagagtaggtgttatcgtggttagggatctctggacaaatattgcacatataaacacttacagaagatgacgtagatgatgagataaccaccacactaggcaaagcccaggcgtatagttgtacccaataaatcgcataggtagtgggagaatcgctacatcgttggcagaaaaccagttgtagtcatatctcgaccactacgacctactggttcaagaaccaggagtaggagtctctcaaccgtttgaaattgaggtgcgaggactactacgctactggtcgaggaccagttatagtcgtaactcgacctttggaagtcgtggtacgaggaccgctacactgccgatcgaagaccagtcgtagtcgtacatcgaccatcagaagtcgtggtgcgaggaccgctacgttgccgattaaagactagtcgtagtcgtacctcgaccatttgaagggaatcagagtaatgtatggacgacattcccgtgacttgcgagaacaacctcctgatgaagacgaagacaatgaggaattatcgtagtcggaggttcggctcctgtacctactacctcatcctcggaccctctagaagtctggggatctcgagtttcgtcgtcgtcgtgtgatgtagttaaccgtgtccgttgtcgtcctgatgtcattagtcctcgacattgtcgtcctagtgacaacggcgatctagtcagtcttggttgtcgttatcacgacaatgctgattgtcccgttagatgtcgagagcttgctaaccgattagtcgaggaccaggagtaggcgtatcttgatcacctgaatatgaatttttaggtggtgagagatcgctacgatctactggccaaggaccaggcgaaggcgtatctcgatcacctaaagacgaattttcaggtggtgagaaatcgctacgatctactggtcgagaaccaggtgtatgcatatctcgatcaccttaagacgagattttaggtggtgagagatcgctacgatctactggtcgagaaccaggtgtaagcgtatctcgatcacctatgaagttttaggtggtgagagattgctacgatcgactagtcgagaaccaggtgtaggcatatctcg

SEQ ID NO: 86536 - DNA, 2474 bp, Oryza sativa
acctgtaacttctcatatgtatttaccatatcctataaattactttcctccgtttacatggatttgatcacttctgaaatcaacaagtgtgcagattacgaccatgagtatttttcagaacagataatgtcactcataactaaaattgtctaagtaaatcagctcccgtagcgtcgccaacacgcaggagacacgggggtgaaaccatagcgtcgccgccccctcccctcccccctcccccacctcaccgccactggagctcattgccggaaagccgattggcaagctaggatggcggcggtagggcctacttcgtggcggcgctccatatcaggcgcgggggaggcggcggacacttggcgatggggagtggcggtggcgagccctcccagcgaggaggcagcagatccagcaccgccatcacccacgggctgccctaggctagatccggctgggcgcagctagggcagcgggctggcagcgacgctgtggagcagtggcaacacgacgcgaggaggcgcggtcggcggtgtcggaggccggcacggccggcggcggtagtggagctcctaaaatcagcggtggtggagttgaggcgacgtgatcgttagacgcgggttttgttcctggacctgtggacggcggaggccgatgcagcgaaaggaggcgcggaggtcaacgtggcgcgaggaggcacggccggcagtgatggaggccggctcggtgtgaggaggcgcagccatcgaagaggcccatcgactatgggagaccagtgcggagagcggatggccgcatggtggcacacgcaggctaaccggtggggggcgccggtgcaacagtgcccacacaccgatgaaggatggatggtggtggagcaatggagcatcaattgttgataggcaggtggcggccagcggagcaatggagcatcaatatgttctatcactttctttgggagtttgagtgtgcacatataaaaggttggcggcgaagagaggacaaaattgacaagggtaacaagggtaagtctttggccatgattaagaaacatggtgattgccataagtcttctttcaactctatcaattaggggggagggggggaattcaacaattcttggctttgttgttccaaccggaagacccaaataagtgaagggcatcgaaacaatattacatcgaaaagtaccagtaaggatttctagtttttcttcattgacatgaattggcatcgtacaagatttatggaaattctcaaatactccctccgtttacaatgtaagtcattctagcatttcccacattcatattgatgttaatgaatctagacataatgtgggaaatgcttgtctagattcattaacatcaatataaatgtgggaaatactagaatgacttacattatgaaacggagggagtagtagagtaagcaaatggttgggtaatacctttgagacaaaaagctctttttgacaagctttcagaatgatgagaatatcatctgcatattggataattgggaattttcccttccacttgtgggattggcatagataagattccctgagaatgagctttgtttatccttgaagtgttttctttgttggtcaacataaactgtgggagtactagtagtggctttccgttgtttctattcccatctaaagtgctgacatcgcaggtaaacaattacctcatgagaaaacccaacctatagggtggggaaagaaggattttggtcttcaccatcctcactaatgtcctgtttggatccaagggatattttttagtccaccctcaaatagcccaaatagccccaaaaaaatccaaaagggtgagctttttgagggctatttggaaataacccacccagaaaaactatcccatccaaggggtgttaattggggctatttcgggtgggacccactgaaaaagtgtcttctctctatctctctccatgtgaaggtacattaaaggccaaatagctctcaaaataacccttggatccaaatgattagagttattttattgaagggctatttccttatgctaaaaaaatagctctcaaaataactcttggctagttttccaaacaaagcctgatattgcaggtgaataattacctcatgagcaaatactagcctagggtagggacacatggatgatttttttttaaccacccttgcaatgtcattctgcaaaatgtaaagtcgtacaagacaagaaaaatcaccagtagtctttgcatgaacattttccatccttgaagtgatgaaatcggttcgtatctctaatatatatctccctcccctcgaaagatgatatgaacttcattgcttcatggcagtcaccacaaatccggagattctttatcacctgaatcaaatatcccttgcatctcagcatcctcacttcaccatccttcaccatcctcacttcattgcttctcagttattgcagccatcgggctgcagg

SEQ ID NO: 86537 - DNA, 2610 bp, Oryza sativa
aaggacagctcccgtccggcatgtgcaggagcaggacgacgcagccggtggcgccggaagggctcgcggacatcgccacccggcggtacatccaccgcctcgcccgccgcgccatgacctgcctgacgtcgggggagccgcccggccgccggccgaagtcgacgtcgtacgcgacgccccggcggccgccgtcgccgggggagaagacgaacctcctgcccctgacgcgcccgagcgccgtggccggcgggagcgcggcgcgggcgccggtgagcgggttgagaaggtaagggttggcgtccctgtcgcttgtgaacagccacccgtgcgccgaaccgacgacgccgctggccgcctcctcgtcgaggaggggcacgcggaagtgggcgccggtggacgacggcgagtagaggcggacggcattgtcggcggcggcggcggcggcgtacagcaggcagggcgggtgcggcggcgaccggaggccgaggcggcggaacgtggcgaacgccgagtgccacgatctgcagacggcgccggagtggactaggtcggggagttgcatcgcctccatggcggtgagcaggaggtcctccggcagcccggaccaatcccggaagtcgtcgccggcggcggtggacgccatcgtaagttcgtgaccggcggcgagtcgcgtcgcatgcataaaactcggcgtcgtgtttacttcaaaactcaactggggctatgcgcgttggattcggatccaaatagaaaggggaaagttcaactagactccctcaaatataggtcgaatttgattcatacccctcaaccgcaaaatcaggtataacaacgcctccaacagtttaaaccgtacaaaacgactcctaaaccggtttttatatatggtggttttctatgacatgacacatcgaccctggtctttggcatctatataggcgccggcgaggctgagcaggcaggaggagagacgagggaggtggtaatgccaagtcacaagcccagcatagcgttgcacgcctatgtcttcatgacgttctacactggcttcgacgtcgtgcaacaccgtcggtcttggtgggtgccaatattgaagaatgtcggaatggtgttgcttgcttcgtctttttcttcttcattatcattccctctcgtctctctccccctatctcctctctctcattacagtgagcccttaccgttcgaatttgggattgtgctagattgcatcaagcagagatgaacaaaacctgttctaagtccaaaggatttttctttgacttcttcctggatcaaaagatgcaatcaacaacggcaattgtcgtagcaatgccatcatggtctcatggatgctagagacaggagacgtcattctgcttccgtcctcactgggagttgacgcctggaacggtgagcggaagattggggggaggatggtgtcaaggcggcactagaaggagaaaggagatgggacagctacaagaagaagagaagggtagctgacggagcgtggggctcctcaccgggagaccgcgcaggcccccctttgccggttcggccgggggccctgggtgaggttctaagctcttggtctgtggaaagttcgcgagagtgaaatcacacaagacacgggcgatgtatacaggttcgggccgctgagaagcataataccctactcctgtgttttggtggatctgtgtatgaagaagctacaaagcgcgagccagcccccgatcgttctgggattgtttttccccccttcaatcccctttctaagtgggcaaggtcctccttttatacctcaaggggataccacatgcaccatctctctcttttttgtggggacttatcctattttattcataaacagacggagacttgtatggttgccgtccgaatgaccttctgacgggaccgcccatacctacctccacttccgccggaagcaggcgcgacgtgggaacatggctgtctgtcgcgcccagaagttcttttccctagcaaaaattcaattaataaatggttggaagaaattatttctttagaggcaagagagaaaccctaaattaataaatgcaaataataatcggaatcggcatgtggaatttttcttggattctacatgtcaaaatatgctaacaggatttttagtggaattttcagagcattggaaataattttaaccaattaaaataagcaaagtgcaatattaaatccctgggaaaatcctttttccttttatcttttcttttccctcctttttccttttcttgggccgccggcccatttcctcccgcgccggcccgctcctccctcccactcccgaagttcacccggcctccctctccctctcgggcgctgacaggtggggcccacctgtcagccctttccctaacctccggccgcccacgcccgcgccaaccgccgtcgaaaccaccgcccacgccgccgcgtatcccgctgctcccgcgcccactccgcccgtaccgcacgcccacgtcgccgcccactttccccgcacctcccgccagctcgcgcgcccgcaaacggcgggggatttgaaatttcccccactctctctctcctcctccacctcctccactactccgg

SEQ ID NO: 86538 - DNA, 1917 bp, Oryza sativa
agtaattttattacaacaataaatctaatagtacttatattaccaaaagtaaaagtttagtaactttgtttagagtgtaagcactgtgaggtcaataaattacttttgcatgagatactcacaaattgaacatgtgatagtttagtaagttggttaaaattgtttcctttaataaattttaataatgaaacaccatattatctggctactactgtaatgcaaaattaaacaataccaataaaaattctagagtccacaagagtttggacaaagaaccaaaggataacattataagattctagagtccacaagagtttggtcatcatcttcacacatggcatatcctgcagagcaacaactccaacagcaagctttgatagaagatgcagcagtttagtgcatacctcatgcttgccagttagcttacaagctaatcaagaacaaagagagaaccttcattagaccttcggaacataaatgaggaaacaggctagtgtagcagcatcctgcaatagcaagcaaaatacttacggttccggtgtttcagttactatttccaattaaacttctttgaaagttgaaacagtacagtactaaggtaaagcaaaacttacttcagatgtcaaagttatcagctaaaatagaacggtgatggccaagttgtcatactatatactaaccaattcacaactcttcttttagaaagtgtccttagatgaaacctactcgtacttataaactacatgggccaataagcacttgaacagtatcaaactccaaacatccatgctccagaaattaaattcctgtggcatacaaaggagtttgcaagacaatgcaaatagcaacatactcacaggatgtaattgcacaaaattatacatagattaattccaacaagctcagggcaaccaattaaccaaacataacataggactacagactatagtttcccaaaagcatgcccaggcaattccacacatgctccagagaataaaactccaacgagtgacagaggaatttacaacagttgaacagaatgcaagtagcaaccatgtaaatagttccacaaaaattagatctagttatcactcgttgaccagcagacacagggcggtcaaacatcacatacccaggaatcacattcacatggtttaaaatcagagctactgttccagatcactgacatctgactaccaagctaacgatctaacatccattttccaatcatcgatagcactaaaactaacacaaacagatcaaactacaactattagcaatagcaatagatagatgcaggggtgaagcctaagcggaggtgaatttagtgacggccttggtgccctcagagacggcgtgcttggcgagctcgccggggaggacgaggcggacggaggtctggatctcccgggaggtgatggtgggcttcttgttgtagcgggcgagcttggcggactccccggcgagcttctcgaagatgtcattgatgaaggagttcatgatggacatggccttggaggagatgccgatatcggggtggacctgcttgagcaccttgaagatgtagatcttgtaggtctcgacgctcttcttcgccttcttccgccccgccttcctcccctcgccgctgcccttctcggccttgccggcggggagacgcttctccgccttgggcttcttccccgcgggggccttctcggccttctccgccgcgggctcctcctccgcgggcttcttcgcggccggcttcttctctgccttgggcgccatggatgccgctgctgtcttcttcccggggagaggagaggagaggaaagggaagcggtgggattcgcgagattgcggcgtggggaaaggagacgggggaagatggttttgtacaggaggggacgtgcgccctgattggtggaaggcacg

SEQ ID NO: 86539 - DNA, 2943 bp, Oryza sativa
gaccagcccaggatcctgggccatccaaatgggccattagtatttggattacttgtcacaaagcctgtgagctcatgagcgccagtaagaggcattttgcacctataatattattattattacacttctgtcatggaattttaggcagaatcagagtttttgacatgatagaagtctaggaaactttcagatagatacatgaattcctgctcctcaccatttgttgactggtattttttttccagcattacttctacaagattacgcattccaaaaactggtgcaaaaacaattgctccttcaaccccactcaatatataaatttcaaaacctttcagcacatgaattgaattcctaagccctaacaagtaacaaccacccctccaaaccttgttctcttcaaggagagaacagaaagaatgttaatatatacatgaggataatagcattccaccatatagaacagctaaaccaacaaaatttttaggggcaaaataaaaaaactagctaggctcaaaactttgcaagctgaagagtgaactctgtcagaagcctgtcaaacacaaagtctgccaacatgttccccaagtgatcagcatctctctgaaaattcacccagtgatcgttcttggatagatcattcgacaaaattgtgtcaatttctatgctggactgtggctgttcatccagatggcagcttactttagaccacaattccttgagggcatggtttcccacaggtttcggtctatcaaaagacgaaaaccgggagagcaaggacttggaaacagaatatttcttgtagatgtcgagcaacacttcatttgtcaagtcagacagaagtagctgatcagctgacatctcagtgaaatcaaatgcagcggcagcagcctcgtagtgttggcaatcctcttcttggagaactgtaatgttctgtgagcaccattcatcaaatagtacttcattgcggaagcttgatttcatgaatatattcttcacatagatcaacccatcttcattctttggatctgcttggagagagcttagttcatcagagtcactttcttgaacatttttgtgacccaggccagcagttgaaagttccatggaagtgctggtattgagatccatatcagctgaatcatcggtatcacttaaatggaggactcttggcttcaacgacgaatctgcaaaaggaaaaggaaaaaaaaactcaatttaaaattgaagctgaagcttgaaacaaaagctaattaaatgatttttttaatgattgaactgtattggactttttaatgtcccctgcaactcataaagtaaaaatacttgatctggctacctttatgtaaatttaattcagacacttacagtgacaggtcactgaagctccaaaatcaaaggctctaaactaaacatcgtattttttttcaaattatagaaaactaatgtatgtatgtaagttttctgctactaaacggaaatctcaccatccaggattgtatatttcactggactagcaggatcatctgggaaggtcatgtcaagaacagacattggactatcagtttcttgttcacagcttagatttatctcagcttcaatttcttgactgggacgaggaacacaaaaagtaccttctcttgacttcagaacatcggatgaatgaatttgtttgtcatctgaagttgttgtatgttcttctgaaatccttccgtcttctgaaactttagtagtatgcatacctgcttctgttgacaaattagtatggtcatcgtcacaagttgttccatgttcttctgggacatcaatttcttctgattttgaatgaacagtacacatattatcttcagttgatgagtgaacctgatcgtcatcacaagttgctacatgcccctgtgaaatatcaatcacttctgaaagtaaagggggagtacatatattagcttcagttgacacagaaacaccacactttttgtcaacgatgtactcttcgattaacacagtattttcagagccatcagcatccttatgaccagagatctcatccatagcagcatccacatctccatccacaataattctctctggaacatatggtgccaaggcatgttctgggatcacgagattttcagcagtcataaccaaactctgcaacccagtcatcacagcaggcgcatccaaagaatgatccctagtagattttgaacttgtcagcgtcctcttcgactggttgcttgaaatagaatccagcaagtgagaatatttctccaatgattcagtgagggaacgtgaacgccgaaaaccttggtttacaggtctttttgcagcagttacagtataagatttcaaaccatccctgtcatatgtggcggaggctgaccgggaaagtccttctttaattacatcttcagatgccttatgtccataagggaccttatgaagaactccatccattgaaatgctacggtggctcctttgtttcacatgaatgtcacctctctttagaagcgaagaacttgtatcattatcgcaaccatcctgggtgttgaatgtagcattttggatatttgtatctgtggaatttggcataatactttgtgaagaaccatcaccattggaagcagattcaccatcaagaacatactcattgctttccaggtaatgtattgaaagggtacggagtagcttcggtgcaacaggaagcatcttttctttatggccttcctttccatacagcttttttagaatcaaggagcccaaacttcccttaccagaactcttttttgaagacttgtttttctttgttgtctgtaataggagaaatgaaaacaacgtgataagccaactccaatatgaaataaatattgactatatgtgggggttttttttacgtaactatatgtggttttggaggagacaagtactacctccgtttcaggttat

SEQ ID NO: 86540 - DNA, 5088 bp, Oryza sativa
tttcatcaccaacaaaattggatgaaaatcaaagtaaaggatttgttactttcaactctatactttcatctaggaatgctgcaaaaaaaaattattatataaatatcttcaagtaaaaaatcatcataattatcaatatcataattaatataccaattggataatataagtgtatttgggttttatgaaacgttttgcaacaatatcgggtgttctttgaaacaaattacaaaacctgggattttgagtgaggaatgctccaaacttaaggttttgaaaattttactcttatttattttttctgtaattactattatttaaaattggcaaaaaaaaattacctggatttataagaaatgatatgtgaatttctttcaatgtattgaacatatggcaaatcatcttctgatcaccttctgcctactgccataagaaaaaaaagattaccttagatgaatgaaaataatattacgcgtgtacacaaaatatacacattattcattatacttcaaagaagagaaaaaaggttgcatctgctccatttttagaaagacgttgacaaatgtatgcctttccttgaccatcataaggtagaagaaatgaaatgtcattctagatatcaactgaaattgcattttctctattttaatcgggttcgccctgggcgtgtagtcattcccagggcatgtgcagctgaagctgttgttgtagctgtaaatcttgtaaagtttgaactttctcccctacttaaataaacttcgaccggctttcgcactggtccagcgaaaaaaaatgtaattgcattttcatacatatatatttgtgtgtatgtgttctgaaagaaccttcaaatgaggttaagcgtataagcgacaactacattcaatccactaggccttaattatatctacttcggttgattataccgatacgaagagtttggtttccctcaatcctaataacattagatttgcctccttggttcataccagcaaaagaaagcagataatcgaattttgatccaatttttgcatatgaatttaatccactctaacatcctctcaaaaagtgaactctaatataattacccccttctcttcctttacttttttcccccttgactcctattgttgtatttgaatcctatctttctataaagttaaagcccactacatcttaagctcaacatgcaaagatgctatatcatcactaacatttactacatctcaaatctcatgtaggcatgctaatttattaagttttagagctttaaaatgcaagcatgttaattaaattattatcccacataatccacataatatttcaatatacctctccttcactttttataatatcctatatgcttatatagttaattaaaattttagagcttaaaaaaatccaagcatgttaaatcatcatttcacataattctcaaaatatttcaatatatctctccatcattttgtataatatctatataccaatacaattcattctcacatagttaatgttatttctttcttctttcattaagctatatcacctcaattgtttctaacgctcaaatgattaatttatggttggaattatcttcctcatttttttctttcataaagccacatcatattacttttaaatttgggtcatcattctgtatactatttaaattattataaaccacatcaacttatgcaagtttctatcatctagctatcttacacattatttatatttcttattatcataccaaactcccgcagcaacgcgcggggtttcatctagttatattatattttactgccatacctgtgccttctctttcttactgcactgaatatatgaaattgaaattgaggccacaggaagtttgtatggctgaatatgaggcacttccaagggttcatcacccttgtctcaagagttcaatttaagtacaagcaaaacccactatttaagccactaaaagaaaaaaacagaatttaaatggcacaatcggggtaagaggattattggttatgtcaccccacataactgaaacagatgtacttcgatcgttgtttatcacacccagttcttgcatattccaagtttaacatgttgatcgatctgaagtcctgaaaagtatttgtattgagtactgggaacgtctattggtcatgctgttcaagatatttacatggaggagcccaacggacaagaacatgttcaaaaactcgttggatttgaaatctgcacaagctctcagaggctgctcagcctgaatcagtcttggagatagcatcacactatgctgcaatcgaggcagcatttacacccaccgttcttacctccagcagtggcaaattgatgttagtcttaaccttgagtcaggcaacttcacctgaagggatatctagttttcgacagtgctgaccaagtttccaaatttttgcatttatattaagctgatgaattcaagctataatctcggtaaacgatgttgcttccttctgttaggactgcaccaagctgcatttaccactggactgcattttgaataccattggctaccacttaccacagaaattgaattgttttcctgtaacatttcaggtgcactagtatcaccatttccttaagtgcgctccactctagtactgcaagaagagtgacaaaatgattaaatgaaggatattttgattgtaaatagtttaaattatgatgtctcggtgcaatagccagaattacaaaaacaaaagataaaccaaaccatagtacaaacagaatcaaaggaaaagatcgagactaacaaataaatgtagtagaacttcctctaataatttgtagagtaaattgctcacctgcctaattatagagagattcatctggaaagatatccctgccatctgcaccaactgtaacaacatggacggcaagttgttggtcttccaggaggctcatcctgaattgcttcgcgttgtggcaatcgaccatgtagagtctctttagtgagattagattctctgcctgatacagcgctggacagtcctgcgcaagcaagtcctttagattacagagattggaaattctcctcaaacacctgttgttcttgaccttgagccataacactgaaggaaggttgtcaacttcttgcagcgtgtgagcaccttcgatatggattcttcttaagttagcaatcctatgcaagtcttcagggagagcccttagttttgggcagtcgttaagaaacaaacgcttaaggcaaggcatcagaacaagctgttcagatttgccacacaaattccatgtgttgagagaccaactttccaaattgctcatgttagtgatgagaagcaattcgagttttggaaaaatagttatatgctttgcgctattgacgcctttccctagcagctctgcacccatattcactattgcatctgcgcctttaatcttaaaaactagcagttctggcatctggcctgctggtggaagcactgaacatgaagtgcagtcgttgaggtgcatatgacccaaatttggcatcttacgctctggttctgagcacaaccaatctgggaaccttacaccagggaacccgacaagaaatatatacagtaagcttggcgatggaattagcagttcgtagacttgctgaattctctcaatctcgttggtctgataataagttttatcatgacctccgattgtgcaaccgagccacaattctcgaagatgaagacagttcttgagtacaaatgaaccccctggtgctgctttttctagcttcacaatccggagacgttggatattggagagacattggagttcatctagtctgaatccagttccactgtcaaaaactcctctaaggttgtagagttgctgcaactttgcaactccttttggaacatggtcgattgcagtctgttctagctctaggaaacttatgttcgacagtctcattaaactatctggcaggctatccaaatgtatgcaaccatgcaaagaaaggtattcaaggctggtaagatttcctatggattctgggagtttctgaatttttgtatagcttagatctagaagcctcagtaacaagaagtttcccactgactctggtatgatttggatgcttgttccactgagaactaagacacgaatatgcttgagttctctgaaaatgtccttattaattttcatgaagtttttgttatcaaaaactaggaggctcctcaagcacttcagctcttctatagcaggtatttcttttacatcattgcttattactaagtgacgtagattcagtaaggttttgctattttccatattcatgaataaggaatgatcctttgtcaaaaattgtccaagtgacctcaaaagatcatgcatcgttgacatccatttgtcaacaaactctggttttggctgcagaagattcattctaattagctcatggtagtattcttctgcggcttcatgtattgagtacccatgcattttcgtcacaaagccttcagcgacccaccagtaagcgacagcatcacgatggatcccaaaatttgatggtaacaaagcacaccagagaaagaattgcttaagttcaggaggtaagttgctgtagcttaagtacagaggacctcctagttctttgggaagtccatgaatagaccatttgctatctcggatgctctcccattctgcctttgttttcttactagataggacacctgcaacaactttgatggcaagaggaaggccatcacactttttgacaatttgatacccaacaccactgaattctcttctttgctcgtatggccctaatgacatcttcatcagcagttctaggccatcgtaatcattcattttgtttaccctgtgggtataagttgcatgcatttcgaccaaaacatccaggtttcttgaggtcacaaggatacgagaattcaagcctctctcggaaggcgatcgaagaagatcaatccatacatcagatttccaaacatcatccagcacaagaaaaacactcttccctctaatagtgtccactagaagcggtagaagctcagtcttagtctccagctgatcacaaattcctccagccat

SEQ ID NO: 86541 - DNA, 3351 bp, Oryza sativa
tggcatgaatccttttggagagatgagcaccggtcaatagcacttggcccattacgatgtgtatctacaacctccccccttggctatgcatgaagaggaagtacataatgatgccgattattattcaaggcccaagcaacctggtaacgacatcgatgtgtacctaagaccactggtcgaagatcttaaactgttgtggaagaaggaaggtgtccccgtgtgggacgaggacaaacaggaggagtttaacgtatgagcactgctgttcgtaaccatcaacgattggcctgcacttagcaacctatccgggcagtccaacaaggggtacaaggtttgcactcactgtatggatgaaacagaaagtacgtatcttaagcactgtcggaaggttgtgtacatgggtcatcgtcgattccttgcagcaaaccacccagtacggaagaaaggcaagcactttgaacatacggtggaccaccgtacgaagccaaaacatcgcagcggtaaaacagtgtttgctatggtgaaagatcttaaagtagtgcttggaaaggggcctagcagccagcctatagagagcgaagatggtcacgcggcgatgtgaaaaaaaaactccatattttgggagttaccctattgggaattcttggacgtccgccatgcaatcgacgtgatgcacctcactaagaacctttgcgtaaaccttcttggcttcctaggtgtatatggaaagtcgaaagatacactggaagcacgtaatgatctgaaacatatggaacaacgcagcaaccttcacccggaaccaaaggagaaaggaagccattacttgagtccagccagctacactcttagcaaggcagagaaggacagtatgtttgaatgcttggagagcatcaaggtatcgtcaggatactccacgaatataaagcgaataataagcacgaaggagaagaagttcacaaacataaagtctcatgactatcacgtgttgatgacacagctgctaccagttgtaataaggggtatcctcccagacaatgtccgggcaacaataacaaagctatgtgctttcatgaacgcaatttcgcagaaggtcatcgatccggatagattagaagcccttcagaataatgtggtgcaatgtcttgtcagctttgagttgatatttccaccttcatttttcaatataatgacgcatctgctttgtcaccttgtcaaagagatcggtattctcgaccctgtgtacctacacaacatgtttcctttcgagtggtacatgggcgttctgaagaaatatattcgtaaccgtgctcgtccagaggtaagcatcgccaaggggtatggaacagaggaggtcattgaatttcgcgtagaatttattgaagaccttcgccaatcggggtacttgaatcacaccatgaagggagactacggggaaaggggactctcggaaggaaagcaataatgacggtagacaacaatttatttcgtaaagcccatttcacagttctgcaacaatcttcattggtggctccttacatcgaggagcacttggctctagttcgtgccagaaacatcggtaagtccgatgcatggattacacggcatcacattgatactttctccgcgtggctgcgacaacatctcatgggtaacgagacgattaaccaacaactggccttcctggcgaggtaaccatctggcttgatcacgacattccagggatatgaaatcaatgggtacacattctacacgagagcccaagacatgaagagcacgaaccagaacagtgttgttcgtatcgatgccatgggacacgatggtacaactggcacgtattacggtgccatcgaggacatatgggaacttgactatggacctctcaaggtccctctgttccggtgcctatgggttaggttgactggtggaggcgtaacgaatgatgacagtgggatgacaacggttgaccttaacaaggttggatactcggacgaaccttttgtccttgccaatgatgtaacccaagttttttacgtcaaggacatgtctagcaaaggaaaaaaggctaaagggcttgacgagccgaagcgccacgtggttctcccaggaaaaagaaaaatcgtcggagtagaggacaagactgacgagaattacaatcagtttgatgggcaaccccctttcacggtgacgattgaccctagcatcctcctatcaaatgaagacaccccttactcacgtagccatcacaaggaaggaacaatagtgaggagaaagtacgtgcggtcaactgtcaccgctgatgtattgccgtaattgttctgtacacgatgtaaactatgttggatgtactgaatatccatacaaatcaattgttgtatggcatatgttaaatttgtatgattattagaatttttatcaaattgaaatcatccatatgctagttatatatgattattagattttttattaattatgtataattattagaattttaatcaaattgaaatcatccatatgctagttatatatgattattagaatttttaaaggttttaaatcatgcacgtggtatttacatatgttaattataattttcaacagtttaatatcatgatatgctagttatatatgattattagattttgtattaattttaaatcatgcatgtgctatttacatatgttaattagaatttttaaccatttaatatcatgcatatgctaattataaatgattattagaatttttaacaattttaaatcattcatgtgcttattatatattatccacgtattctagtacatacaataataatttttcgaaggttttatcattaattgttcgactttaaataattgtaatgcattatttactattttagaaacacatatgcaatgaaattcaagacacagctgctattatctttagtcccagttcctaaccctaaccgggtttaaaaagaatttgaaaatagcgggaaaagatctttagtcccaattggtgagaacaaccgggagtaaagatcttttatttagtctcggttgttgttacgaaccgggagtaaagatatttttactcccggttggtctcaccaactgggactaaagatccgggggtatatatattgccggtgcgccctcgtcttctccaccaacacttagacgtttttcaatcttggctcgatctccttcgccgccaccgtgcctagggcaaccctgcgccgacaccgccgtcgtctctcgccgtcgcttggcggtcctcgccgcctctgccgcagacgccgccaccgcatctcttgggtgagagccgccgctgcctctctctctctcgatctcgatctcgatatctctctct

SEQ ID NO: 86542 - DNA, 1037 bp, Oryza sativa
  unsure (1)..(1037): unsure at all n locations
cggcggcgaaggcaagccggtggtgaagtcgtagacgcccaacagcggcggcataataggccagccgtgtaggcggaggcacccgtcgccggcgacgtaggcagnccggcggtgaagtcgtagacgcccaacagcggcggcataataggccagccgtgtaggcggaggcaccactcgcgggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacgtaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcacgccggtcagtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggaggaagcaccagtcggcggcggacgaggcggccggtcggtgaagacgtagacgcccaacaacggcggcataataggccagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaatggcggcataaaggccagccgtgcaggcggaaacaccattcggcagcggcgaaagcaagccggtcggtgaaaacgtaaacgcccaacaacggcggcataat

SEQ ID NO: 86543 - DNA, 8095 bp, Oryza sativa
tattaacatctatatgaatgtgagcaatgctagaaagtcttataacctgaaacgaaggtagtagctctcactggagttggagtttagagttaggagttagagtttgaagtttggagccctaccaaatagggccataatttcacgtcatatcaaatataatttcgcatatcaaatacacaagctgcgtggtgactaaggtgctaagggcagcaggcccatttgggtcaggtggagaccggctgaggagctgttccagacttgcagttgggggctgggcagatggcccagccggcccagtgaggagacgtgcaaagctggcccatctataagctagcacgtgcgcgaggaaaattggatatgaatttttgcgcgaggacgataagaaaatcggagatatccttttttttttttaatctcggacgaatatttttttacggacgaaaatttctagccatctaggtcaagccgtcaactcccgtgtcgtctcccttccttccgagttcgcccacaccttacgccgccgatctatctcgcaagcaggccgcgacgccggccgtcgtcccgccgcgccatatccatcctggtaagcaatcccatccgttatgcacatcctccctctctcattcatctctctctgacacccacctaaccctagtgtaccaaatcccaagttagactggacccaggtcccaagttagatccgcctgctgatatttaattaatcaatctaagaaagacatatcgatggtgctgacgagttaattctatttgctgttctatttgaattatgtcggtctagttaactactacagttaatttctcacgctttgctgcgggatatatgtagatgaatgcatactatacgttataaaaatagtagatgtatctgtttaaaaagtgtgaaaaaaatatgaagataatgatttgatattatttacctattgagttttaaaaatataacaaaattataaatgatatttcaaatattttaaataataattactagtggatgatagtgataatgtgacacactgtcatattaagccttaggagctagtggacaccaatcatatagtaagataggactgatgtctcaagtagaagatcggtacgcatactctactggagatagagatgcaacctatctggtatatctttcttgtatcattggaatgctatcttcaccgagtgagaccagtctcatgggagattttttatttctgtagtggcgactggagcgtacttcgttgggtagctttgtcatcacaattttttccacctagtacttgataaaatcaattcgcctaatgtacaacctgactagagggatcaagataggatccccctagcttttttttttaatttttgattaaactaaatgactagtgaaagaatcttaaagcaagccttttttttactagcaaaaatgcatgtccgttgcaataggtgaatataattttcatgatggataaaaactcggccaattcaaatgataaaacgaaacaagataaacaaaacaatgaaaaacaaagttagaaatcatatagcattgaatccagttgcgctcgcttcatgcatcatcatacgaaaaatcccttatatacaccttttaatagcctcacaaatcgatcgggtggctaatccgtaaattgatgcatgggtatttgctatagattgctaaagagatattatcatcgaccaaagattgaaattttgattattcaatttgtgaaaggtttttttactgtagattgggcatttgcaaagtaacatcatacctaccttaaacaacgataatttcaaaaggaaagtatttacgagagatattaggaagagaaaaaaaagaggaaaaaaaagaaaaagaggataatggagagaagatcagaagaagagggacatgatcaggatgatcggaagaaaaaggagatcagaagaagagggagaggatcaggatgattggaagaaaaataaagtgaaaaaatggagagaaaaaaggtactgattgggagaggagcgcaagcagagcggcactatggtgtgggtcggttgggctaggctaggaggaggatatataatagttattcacgttaaactggatacaggcgatgcatcaaacggctgatagaaatatcttcaatttttataaagataaagatttgatggtaaacatctattattgtttctctcatttttttttgttgtttgtggctttcgtcttgttatttttctattctgtaaatgtttagcattgtttctctctttttttcgcttactcactatagtagcgtctgtatatatgaaattttttctatgagaatagtaatgcgaacatccaacatcagtgtgaaaaaaatgcatctgtgcaatgttcaatggatgtcatgtgtgttcttaccaaggggaccttttagctatatcaaatattgaagcacattgctaaattattattttttactatgttttggttcaaatggccttacacttcataatgattcacttcaacgcgcgagatcttacaacgtgaaaatcttagagagtaaatggtattgttggtacacaataacataaaaccttatcaagtgggtgtaattttgtacataatcttgcaaacgatagttttggttcacgaattcgtctgatgcgtgttgtttaagacttcagctcatgcccatattattattattgtttttttaccatgcaatggttattaattaatcgatctctctgtaaggcaagctgatggagcatggttaattctaattttctgtttgatttgaatcagattggtctaactgtttgcacatttttgatgcctcgagtttgtgatcggacggtgctctcgggaggtagagtcaccgccgagctgtcatgcctttcttgcttcggtgggggatgctatcttcaccgagtaagatcatgggggcttcttacttgtgtagtggcatctgggattgtacttcgtaaaatcactttgtcatcacattaacttttatcacttagtgcttgatactatcaattcacctaatgcacgacctgaccgaagggattacgacaggttacgtctacccattttgatttttgacgaaatgaatgacttgtgaaagaatcttaaagcgtcagcctgttttattggatggtaaacctctagtattgtttatctccatttttttaaggcttctgtcttgttattcgattataaacatctaaaatatttgtttctccattttttttggttgttggcttacttgcttgtccgtatatatggaatttgttttctgtaatgcatcagaaaagatattgcgtatgtccaatgttgttctttggatggatattaccaagtagatattactcaagaatggaaaggcacttgggcaattgggcttgggacagtctatgagtgctggggtagatcaggggctaagggcatctgcctcaggttattggacggtgttccaacaacatccaaagcatgatgttgttattaacaacatccacatctggatgccctgaaacatatacatagcacccatcccacatttacaaattacttcctccataagaaagtatatgatatgtacttttaaaaataaaaaggtataaatcttttgaccaacaattaattagattacaaatacacttaccaacaattaatcagattattaacatatctagatgccctcgctctgcctcccatcccacctgccatcgcgcgctcccccctcaagttgcgttgccccgcacaaccgctcagttcgttgatgccttcttcctcttggaccctccgccacactgttgagtcacatgatctggattggaacgtcctctatctccgcaaagcaataaaggccatggctgccaatctactagccttgtagcaccccaagtaacattgtttgtcttcctcggctcaaatgaggcgagcaaaggagaggagcactgtttgggtgatagttttggtgatggaacaatagcaacggtgatatggcgggacacatctcatggtgcggctcaccaaggaaggccactcctagttcagggaacaatggaaaagcggagaacggcgtggcgaagcttgagatctggcattggaaagtatctttacccagtctttttacagcatagctctagcaagcaatggcgtgtatgtcaaccatggaccagaagtccctgaactagtcggggatttcgaagccattggtagagaagagcgcaacgacgagcctaccgctgctgtgaaacagcaacttcggagacgtcgggacaagaatcaggcaacaccagggcatcctttggcttggtttgccatcgagcacctggcatgtgtggtgaaacaacgcctccggcctctctccgcggccgctctggcgtgacctcgagtgtgcacaaagagtacaactcgggaggtggagatagatgaataaaggggagttggggagaaaggaggaagaagaagaggaggggtgaggatgacatgtggggcccatgtcggcctcaccatttttaaaatattttttgtgtaactgacatgtgggcccataatttttattatcttccaaatcagattgccatttaagctccacgtcattgtcacgtcatatgaagaccgagtcaaattaaccacataggcgtcacgtcaccgaaaaccgttgtccataccgtcatgggacctgtattgcattggttttgactgttgagggacccattgtatctggtttttcggttgagggacgaacatcggattcgttcacaagttaaaggacctcaaatgaacttattcctaggtgcgccgattgagttggagggatggaggccttgtcagaagcccacgtacgtatgccgcgccgagccaggggcgaaatgggcctggcctggcagaatcgcgtggtggtgtgttggtccaggttgatccggaattctctttggtcacgagtatgagttggatttttcacattctgatcgttttagaaaacttattctacaaatagatcctaaaaacttattcttgaaatgacgcggctccaacatcattagtgtcaggcaaattttgctataggacatcgcgacttcgtggttttagctatgagacaccgcacgaagtcacttttgagggaagacactctcaaaatgtgattatttgctaatggacaccgcagacaataaaaaataattgctagttcaataggagagaaaaacagtgtaaaaggtcaaaaatgcccccgggcccacttttcatattctttccccacaactaactccctctcgcactccggccatagcaccacgtccggtcgtcgcaggcgaccaccccgaacctccctccttgcctcatctacccccaccggtgacgtcgtcctcaccccacgcatggccacgagcgacgagctcggcgctgggatggagacgagagacgtcacctctgcaaggagacaggagtcagaagagcgagagagagagagagagagagagagggagggagggagggagggagggagggagggagcgcacgccgacggcgctaacctgtgaccccgagtagcctccgccactgcccgttgccatcccaccgccagtgccgtccaacgccctcctcggcgccgctcgtcaccgtgaagcatctaggcccccggtgttaattttggtaattaatgacaagcactaattgtggactaaccgttgtctttgagctatacattttaagttaggtccacgtcatatgtgcacatggatgattatcgatggattaaaattgacggcgcaaagcaaagggaaagaagacggtaaaactagcgctttaatttagaattgatcgaggtgtagggcgatcaaatttgctagtttaattttagtttcgctgtactattaagaggggtaatgacctagcaaagagatgattttaattgccacattaggtcattgcattttcatttgtgctctctttttcattacacaaattcactgggttcggcctgaccactgggttcggcgtgccctggccggtcagaccggctacatagtggcggtctgaccggaggcactttcccggtcagaccggcctcttggaggccgagacgatgctgctcgggatggccgatacagagccgaccgagctgtagtcggtcagaccgagccgatggcggtctgaccggccaggccgatggggccctctgacagggctacaacggctagttttctagccgttgtagagtagcacggtctgaccggccacatacctccggtcagaccgacagagcacagagttgggggatttcgcccccaacggctagttttggtgggtgggagtataaatactcccccaccagcagcaagggggctctcttggcacccaattcaattgcatacaccccttgcacctctctcacactcacttgagctttgtgttcatccatctagtgttagagggttgattagccaagagtcaagtgcatttgcttccattgtagagctagtgtggcacttgatcatctccacgtcgggtcattgcttgttactcttggaggttgccgcctcctagacggcttgtggagaagttgcccggtgacctctccgagaagattgtggaggaggcccggtgccggttgtgagtggtttggagttcaccaccttcggagtgaaggaagaactaccctagtgatcgaggcttgggtagtcctctccgtgggccggctcccgccttgcccaccccttgacgaagggggcgtgcggaggcttcgtggttgagcggtggagttgggctcgcctcaacggggagtaggaaaccgacgagtttccgaacctcggtgaaaaatctcttgtctccttgtctcatttgtttgtcgcatttacttttgtgcaatttacttttctagagacaaacttgagatcatatcaccctaggattgctaaacattgacataggagtgtgatttactttcctagagatataattgagcctctatcaccctaggtttgcaaaacataacttagttgcttagttagagttgaccctcactaagcctagcaacttaggttagttttgattaggtgtcatttagttttaaatcgcctattcaccccccctctagtcgacatctcgatcttacaagtggtatcagagcgtggtctctcttgattgggcttcaccgcctagagagaagatgtcgaacgaggtgaaccacgtagggaaggctcccatgtttaatggcacaaactattccacttggaaaattaaaatgtctactcacctcaaagctatgagcttccatatttggagtattgtggatgtaggctttgcaatcaccggcacgcccttgacggagattgatcaccgcaacctccaactcaatgcccaagccatgaatgctttgttcaactctttgagccaagaggagtttgatagagtgagcaaccttgagaccgcatatgagatttggaacaagttggcggagatccatgagggcacaagtgagtacaaggatgccaagcttcacttcctcaagatccaatatgagacattctccatgttgcctcatgagagtgtgaatgacatgtatgggaggctcaatgtcattgtgaatgatctcaaggggcttggggcaaactacaccgatctcgaggttgcccaaaagatgcttagggctctaccggagaagtatgagacccttgtcaccatgctcatcaactccgacatgtcaaggatgacaccggcaagcctcttggggaagatcaacaccaatgacatgtataagttgaagaaaaaggaaatggaggaagcctcaccttccaagaagtgcattgctctccaagccgaagttgaagacaagggcaagggcaaggtgaatgaagtcaatgagaacttggaagaagagattgcccttcttgctagaaggttcaatgatttcttgggaaggagaaaggagagaggaaagggctccaactcaaataggagaagaaatagaagacccaacaagactctctccaacttgaggtgctttgagtgtggtgagaagggatactttgcttccaagtgcccttccaaggatgatgatggagacaagtcatctaagaagaagagtggaggctacaagctcatgaagaa

SEQ ID NO: 86544 - DNA, 675 bp, Oryza sativa
cccaacgtattctgggtcatcgtagtcccagtccccaaagttgtagagatcccagtcgatcttggcccatagttcgtctatctgagcctcgcaggcggccgactcagcgaggtaactctcatcgaccagatagtagccatccttgtcgatgccgtcacggacatccttctggagcttctccaagtcgtcgtccagcttggagcggcgttcagcactcttcaattcctcactgcgcttctcaggcgagagggagtccaggtactcgaaggtcggccatggctccctcttcagtgccaggatcatggcgacgaaattctcaggcatgggcaccttacgcttctggtcgccttctccacccgcggcggcgacggcgacggcggactcggcgttgacaacctgagcagagccagtcgccttctccctcttcttgtttgcgtcgcgctccttaagcggaggcgccgcttccgccttgccgccgccgccgcccagcttactcgcgcgctccaccaccaccgcggtctccgtcgtggtaccctcctcaagcgccgcctccgccatgaactcggtgatgcgcggaacagcagcaccggccatctggaatcgccagaagatctctctctctctctctctctctctctctctatatatatatatatatatatatatatatatata

SEQ ID NO: 86545 - DNA, 987 bp, Oryza sativa
tcctccaccaccaccaccaccacccaagaagagcagtccgccgccgacgacctctcctccctcctctccacctccacctccgacgagccctcctcctcgaagaagaagcggtcgaatagcagcagcggcgcgtcgagcatcccgacgggggtgcggctggagggcatcgccaagtcctacaagggggtgaccgtgctcagggacgtttcttgggaggtgcagcgcggcgagaaggtcggactcgtcggcgtcaacggcgccggcaagacgacccagctccgcatcatcgccggcctcgaggaccccgacgccggcgccgtcgtcaaggccaaggacaacatgaggatcgccttcctcagccaggagttcgaggtgtgcgcgtcgcgcaccgtcagggaggagttcctcgccgcgttcgaggaggagatggaggtgaggtcccgcctggagaaggtgcaggccgcgctggagggcgccaccgaggacatggacctcatggggcgcctcctcgacgagctcgacctgctgcagcggcggtcgcaggacgtcgacctcgggatggtcgaggtcaagatccagaagctcatgcccgagctcgggttcgctcccgaggacgccgaccgcctcgtcgcctccttcagtggtgggtggcagatgaggatgtccctcggcaagattcttcttcaggtacagataaaaaagaaaatttgagctctacatgtagcaatcaatggttgtcatattgtgatggagagaaaaatgagtggtattatggccaattggtgatgaatttggtctggattgttgaatttgaattgtagtttttagtgtctgtgtgcatttccaatgctgaaattgattgtgtgcaggatcccgatttgctgccgctcgattagcccaccaatcacgttgatttggacaccattgagtggctggagagttacctcaagacgcaggaagtgccgatggtcctcatttctcatgaca

SEQ ID NO: 86546 - DNA, 648 bp, Oryza sativa
agaggagaaatacatatttataaatattttaaaatacttgattttttctcgagtattatatttatatcagatactactcatcctatatgtttgttctgcaggatccagatccagatatgcataaaagggattcatggctttaagcttatctcttacgctctaggaatggatcagtcagaacatcaccaccggccgcctcgtccgccgccgactggtgttttcgcctgcacggttggcctattatgccgccgttgttgggcgtctacgtcttcaccgaccggccgcctcgtccgccgccgactggtgttttcgcctgcacggctggcctttatgccgctgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccaccgactggtgtttccgcctgcacggctggcctttatgccgccgttgttgggcgtctacgtcttcaccgaccggccgcctcgtccgccgccgactggtgtttccgcctgcacggctggcctattatgccgccgttgttgggcgtctacgtcttcaccgaccggccgcctcgtccg

SEQ ID NO: 86547 - DNA, 3422 bp, Oryza sativa
cgaagaggatgtggttcgccgtgtcaagatcctgaacgcaaaaggggcagcccaagtgactatcgatgccacgcttctggatgagatcagccgtccagcagcgccgctggaatgcaaaccaaagaaagaacctgcatttggcaggaccctttgcatgccaaaaaagatcagcacaggcaaaggaatgctggccatagaagaatgcctggtatgccgaacgcgcagagtagcgctggtcagctgtccagcgccaaatgagacaatcctcgacacctggcgagagttgtacgtgaagcaccgcatcccaaataaggagaaaatgggagatgactgggatagtgagggcacctcgaatatcagagacccaggagttgttcgctagggcagaagcaactgtgcgtgaacctcaaaaacgttggggaacgacgaagaggagatctggagccaaggacgccaccgagcggccgtcgatccattggtcagatgagaagagcatagactcaccatttcccggcacaaagaaagtggatgccgcgaacatgtcggagacggtctgctagactggggcctttaggccatcctagtaggggtgccctgagcgctgaagccaaagccagcgaacacgtagggcaaaccctgccaacctgaggtcagtgatccccaactcaccaccggttttggagcgacaaacattcgtccaaaacacctgacactgcccaccatgggctgagtccgtacctgtccacaggaaggcgcgacgcttattgtcaatggccttaataacccagactgggaggccgatcgccatagattcatggactggaatggagaagagaaccgactggaccagcacagaacggccagccagagtggtaaatcgtcctttccaaggacccatgcatgttgctaccccggaccaacactgtaaattttctggataatgtctaatgatctgtatgaatcataacacatcactgaatcttgtctaatgttggccggagaataccctgaaaccagcaaccagattatttgctaaccgctgggtgaaccaatcactatttaccacagcaacaggacagctagaagcctaacatccagagcagcagagctccttgttaaaggaaggaacaattctagtctagtttcaattaattttacagctcaacaaaaggggttggtcacactgacaaaagaaaaaagactggactgatcgattcactggtaaaggtttgatcagacgacttcgacctttcgtttggaagagactgatgacctccattactttgctcttgtcacgctatatgctgcctgctatacctttaatttcctgtcgccaggcaaacatgttttgaggaccaaggagaaatgtcatcaaactagccagcactgcaatttgcttcacatcccattttagtcggctggtctgttccttgatgcttgcttgcagctgcaggtgcatttctccttgtcttccttcagagtctgcacacagggaaaaactcagtgttgtttccgggttgcgttgtgcttttatatatatatatatatatatatatatatatatatatatatatatatatatatatatatgttactccctcatatccgtcccaaaataaatcaacttttagctatgtctatgtttgtaatagaagttgatttattttgaaatggagggatacttgattactcatactgagctgctgttttacagtgcaatatattggtattccatctagctatatatattctgatgctaacgggggtctttgtaactggactggtacatcgacctatcaggcttctttaggcagcagtggcttcaattcagttttgccattctgaacatgcaaattagtaacacgcatacgtcattatacctgcagctggctctgcagtcccttgatgtgatcaactgctaagtccagcatgtctgaagtactcgtttgctgccacattaatttgtaagaagaacaaattagaaagatcatcaattgaactccaactcaataacctgaagattgttgtctgacgaaaaagttcagacaaggactggtatatacatgaaaagaacacacgtatggcacacaccttgtccatgttgggcaccagggcctgcaacttcctgagcttctcgctgatcctcgttcttctctcctgtcatcatcgatcgatcatatgcctgaagattaatctggcatgcacgatccaaggaggaacaacaagaatgctactggctagatgcatgcatatgaagaacatcttgaaaggttatcaatattcttatttggtaacatatcatgtgcacacaagtttcgcatgcaaattctatacacaccaacaaacaaatatcacaaaaaattctttaaaaaatacatattataatttcaaaaatgctacacctttgtgtaaaatcttaacctcaaatttgttatatcataggtgtaacaatttttttatagttttaagacaataagtatatcagaattttatcatttttgttgctctatctatgtaatgaatttgaagacatgactttatgtgtaaatataatactaaaaatacatgtatattgattttttttctaatttttttatgatatttgttaatttgatgtacggtgcatactatacacgttaaaggtctatgtatctaggatacgcttccatgctagttgacattacagtatatagttcgacccgctacgtacgtacataaaaagttggtactatgatggggcgtagaattagcaagggaaaatgtcgtctatacataccctctctgcgatgctccgtgggtgcgtcgcgcatccacgcttggcccgtactctgaatggcacctggtcgtgctgcatctgcaggtatttctctacgccagccatctccctgggcgcaacaagctgcatcgcagatgcatgtatatacaaattagacatgaaatcatccctcacattgtacacacacacactaataaatcaaactataaatacgaaaaatgaaaaataaagataaaacgcatatatatatacacctgagattcgtagttgctaagggtggcgatgatgtcgtcgttgccgtgcgctcctgatttgcccgtcgacgtggagaacacgatggagttggagtcctcccatgacccgatcgagaacccaccggaggagaaggagcggacgacgtggtcgtgggtggagacgttctcctcggagcgcccatgatgatgagcggcgccatggatgctgtcagtgaggtccgggatgccgtcctcggatatctgggagaggccgccggagccctgcctgctgctagcgaagctcagtggggccttcatcttcttgttgttgttgctgctgctgctcatggcgccatggcgaacctcaccgagtgatgatcctgctggtctagcactcgatgagaaacctattg

SEQ ID NO: 86548 - DNA, 3820 bp, Oryza sativa
tgatgctaaaaatgtaaaaggtgaaagcattccagatgaaccaagaaagagaaaattggatgaattgacagatagtgtacaggcaactgttgggttacactgaaagtgcacagtatcacaatgatgaagactatagatttaatgacgatacagtcaaagaaaaggatttctcaattggaggacatgaatctcattcaacagaactgcaagaaagattgaatgcattgaaaagtaaaaatccacagctcgacgaggcattggatgctgatatagatagtatggaagaggtaacactgtctacattaaactcttttataaaattcttttgaaaatatctggttttgtgtgcaaaatgccatgcaaacaattcatttgttaatgtatattttatgcaaatgaatcatttgaaaattgcatctggcaggatactcatatggatgaacaacatgctagagatgaaggtactcttttacaccctatactagtttttatttttcctgtacattagatctttgtttttgccaagttctactgacattgttattttgcacaggtttgctgcgttcaacaagaacaaggtggctaatgaacttgtcctgtttcttttcatttcttttcttcatgttgtcgttaacctataacattctctaaatgcactaattcaggactgtagcaaggtacttccatcaactactcgtggaccagaagtgccaacaacggaacaattctgtatgccttggtcaagcactcgaaggaacgaaaagaaaaacttcagcaagattcttctatgaaactctggtacattttctgtacttatttcttggacacagtatctgcatgagttttagttgctttttcactggagaatgactggtcttgaggatcccatcttgtgtattactgatctatttcagttctacgcaagaacaatcttccttgtgataaaattaatatgtgcattttttagtgcaattcatgtgctttacttgggaaatatgcaagcacttctttggttccatttccgttctgtttatcaaaactcaaaagttgtttgtttgtttcatattttcaactcctataagtataacagaggccctatgatccttacagcaatttgtattgtttatatcgtcgtttgctctcttctgcagatcctgaagagtggtagtctcatagaagtcaatcaagagcagacttatggggacatcatagtctcagcgactccgcggctcgaggcggcattgcggagtagtgagaagcaatgacttaatttgacgcaacatgttcattggtagttttcgggaaaaagagatcccagcttcccaggagcgtttcaccttgttttatcttctgtagcatgtttatgatggtcagtcagatgtatatacttagttgggcgcatgtagcgctagatggttaggaacatgtagagatgttagttgtttcccccttttttttcccctttagatggatagcttagttatttataataactttaacagttgtaaattgcagtttcctatcagtgttagatcccgtgttcttttcagagtttttgatcgtgcgtgtttggttcagttgtatatgtgagtttgccaggatgttgtctaatctggaaatgatgcagctgggaacagtttggaagctatgatgggaacagcgagccatggtgatttgaaggtactgtagttgggctcagttggaatgtatcattttggtgtatttaactaagtcttaataaagctttcattatcttaaaaaaaagatactgtagtcaaagcagtagcaaagcctcttgaaggagctgatgagtcccacacagtcgccgtcgttcttcgagcttctcgctgttccattgtgaacttgagaagcttatgcttttcttgattttttttaattcttctttctttttatttgttaagtagatgcaattctatttgtcgaagagcggttgaatctacatactgctgaatgtccagttttagctgaatcaacaaattcaggattagctgaattcacagttgaggtatagatgaatctaggtgatccaagagcggagcagctgagccgtgctcggtgctccacagttctttgtacagcaaaggcatgcacggaaaatgcatatagcaggtgcagatcttgtcaatctacactcattttcctgcatcgctgagccaggaaattcgacggtgaaaattggtaagatcctggcacgattggttgctcagcgtcagccggagcgcctagcgttaaatgggccgaaatacccacacgacccacgaggggcgagcgacaggccgcctagtggcccaagtaaatttcgttttatgccaccttttattattgaagttttactttatgccatcattatttaatcattgttttcaagcatatcatcagctgataacagctctatccataccctttttcccagttttttttttaaaaaaattctgttagctcctctatagttgtgacgagtagttttgtataacctatgtaaaaaaaacctagctatatatatggagatatgtatgtctagatatataatcatggtttgtcttttttttatatgggaaagctcttattagactagcggcactggctgggagcggtttgctagttagaccttgtttgattaatccctatgaggctatgcttggttaattcccaagagggagggagttgagcggatttatcccatacctattgtggcgtgaaattattcctcctcaatttcctccaattctcttcaatcactctaaaccaaataagaccttacttggctggaatcgatttcccagttatttttctgtgcactcttgctcttatgtttttttagtgtgcctttttatgtttttcttgtattcatgtatggactaccataacaatcctatttgtgtcgcagcaggcgtgcttactgcctcaacgggtaaaaggaagggatcaccctctcaataagatggcgatggtgattctcaagctgccaaaataatgagaaattcaatcccagaccttcctgaggtaccgaggcattgagttctgatgatgcaggtttagattgcaagcttattatcaccatgactccacttatccaaaaaaaaggacagacaagattaatttagtgctacgatttcttactgaattagtgactgtcctctctgcaaaggctgctaacatctccaacacatcttccagaatttgattcataagtgggatgctttcgtacaacttatagctaatttagtgcttcctccgtttcaggggttaagatgttttaactttagtcaaaatcaaactgcttcaactttgatcaaatttataaaaaaacagtaatatttttgacccaagataaatttataataatgataatttaattattaatttaataaaactattttggttatgtaaatattattatatttgcctataaacttagttaaatttaaagtagtttaattttgacaaaaatcaaaacatcttataagctaaaacatagggagtacaaaggatgctttggtactacaccaaaagatcacaaaatgaactttgaaactataagactaaaaaaattaaatatttgcttataaatataggagtaaattttacaaaactatatgttttatggttcaagttacagaaaaccacacatattttaacacttggtacttaagtatatatattttggtagtttagtttcacaaaaccacactatcgatgaatggattcacccatgatatgacgtggttgttttatctaggatgtggacgtggcatcctattaattctgtgcgatggctggtcataggatgccatgtcct

SEQ ID NO: 86549 - DNA, 5063 bp, Oryza sativa
cgttacaaacaaaaacttaaaatcccttatattatgggacgaagggagtaaatcccttcaaatcccatcaatcccatgagagggattaaacgaatcaagcctgatagtcaaaactgaccacctgagccagaacttgtatcgaatcttgtactgtctaatattgcaaattcgcaactgcaaacagtaagatgctactagcaaagtaatagtagcaaagtactagcaattagcaactcgtgtagtcgaacgtgtgtcaattgctcgtgttcagttcagagtagagttcagagagcgttgatgggctagggctactaaaatttaaggcctagcatggcacgaggtggcgaggggcccagcccatcagtactcctgttatttcccccattttaggcccagcccatcagtaccatctcttctttttccattgagtaaatttcagaaaactgtaactttagtgataaatgtatcagtttgctgcaactttagcgacatgtttcagtttgctgcaacaatagcacggaaaattatcataaaattgcaatttttatgttatatgctgctacagttgtcacatatatgtactgtagcagcatataacgtaaaagttacagttttgtgataattttccacgctattgttacagcaaactgaacatgtcgctaatgttgtagcaaactgatagttttgtttgcagttttaaatttactcttttccattttactctctcctcgaacactctcgatggctcgatctgaacatcaggcacgagagacgagagcgtcatggcatcactctcaagcaccacctctctctccgccatgcagtggcggagcggcgaggcggcatccgctccgggcaagacggcggatggaggtgcgtccttttatacttccgtgtacgagaggagagagagagagagttgggggcattgaggtgaggtgggtgctgtctggactctcgggcacagggggcgtcgcgccacgcacgcttggtgtttgaggaaatgcccgcgctgaccaatagatgactggtcaatcggcgacgtgatctgatggagactaatggagttcgcaatctatttcagacttgcaaagtctgcatttttgcgattactgtgtcagtaactccaatggccgtagcaaaattacccataaagtgcggctgtttgattttaggcataatgacgaaagaactgggggggggggatgggttgactttttcttccttacaggctactgcagattctatcctcttcttttacctggagtgtggaagaactctgtgggtgcctgggtggcgttcagctgagctagtacgttaatgttctgtatgtttgtatttcagcttctgggtctcggcacacccagaaggttgtacgtttttgtttagaagttttgattgtgtcgtgtttgtactgttttatccttcgttcttagtaaaattctaatgcaaaaaaagtacgaggtaccatgcgcctccaatatttggaaaaatataaacttcctctatccaaagtccaaacttgtataggtctgtttcatctggcaataggacaaggaggcattgaaaatgatttaatcatcccctgattatatatcaaagtgttccaaaaaatctctatcttgcttaaaatttctctaaatctaggattaatcaaatgcatgtatttgtatgtacaaagtaaagatgggcatttctcagggcctcggcatatggagggaagaacacacttattttactttgaatataaatgaggtgtacactgatagacaagactattatcaaaaacaaaggaggggtactccattaaatatacaagttaggacatatttgcacatgttccataaataggaacacgatcaattagaaccagacagaagcatgatatctcaaagaaatttgtctgcaaaaatgcagaagctatgactggtactaacaatgttatgtattcattgtgtatatattttgttacatttgttgcataaacatttctgtccaaaagtggaactgagggccttcactctagactaatctcgagattcgacagattattcaaactcttgggtatgtgcagctttggacaactagatatgtgcaaggatctcagagaggtgaaattcttcaaccattctgggaaagtttccaaatttgtgcactctgttattgtcaaggttcggaggaatgacaaatgctgcatgccatggggcaaagaaatcaattctgtgcaccttgaaatatgaagttcctcaatacctcgaagttctctcagcccctcacattctgaacactctaatagcccgtcacacagggaaaccgacagagatttcaggttttgagagaaaccttccagtgctcctctagatccaatcaatttatcgttgttcaacaacatgattaagcttttgacaactgggagtttcacatgcactgctctaaattttgggcattgggtgatagtcaattcttgaaggtttgggaaaattgcttctctctgtgatggaagccatatttctaggttgcgcatgtgaaagaacgagagtttctccagtgaggcgaatgtgccatcatccccatagaattcgtcacctacacgtgtgacagcatttattccacttaattcaacaatcttgagaagaggtaattgccccagtggaggtaggcattcacatgccaaattaactagcttgatctcagtaagtgattttaagtatgctggcatgcttgttatccatgatggaagcttctttgctggacatgagaaaatgcataacactttcaaaccacggtttggcttaagaagttcaagtatttgctgtgcttttgaactaatcataggatctgtacagcttcctgtccaacttaatgccaaagacacaagcctatttttcttttgcaggattacattccttgcgtcatcaaaagaagcattttccatattgcaaatactgagttccttcaaactaactaagggacgcaactctgagatggtgtgctcgtgattttccgctgcaatgtaccttggcaatatctcgaggtttctaagttggttcatctgacagggcatttgagttagtaaaggacattcaagaacgtttaggtaggcaagacttttcaagtttttcatgcttcttggtaaaatagcaaggtaatgacagccttcaaggtttaggatttgaagattcacaagattgcttacagattcatgcaaatgaagaagtttttcacaatgagatagatccaaaacttgcaaagcttgcatctttccaactgattctggcaattcagcaatctcagttcgtgaaaggttgaaattcttcaagaactgaaggttgcatattgaatctggtataatctctatatcattgtgggagagattaagataggctaattttttaagcataccaattaacttaggtactcttttgatcctgcaagattgcatgtgtagtacacgcatatctatcagacatttgcagaattcttctgggatgtctgtgattgagcacttcttgtcagacaaaagcatcttttcatctctgagcaagattagtgtcctcagatttcccatttcaaacaattctgttggaagctcagttgtcttcgagtcaacgagtaaggagaggcaccgagcacttttttttgcattttctacaggccaaactaattccttcctggcatctattgctaagtgaaatcccctgctaatcatttgtgcaagaagttgcatcccagggtgcatcttgtaaatagcgtatgctttgtgtcgaggtttctgcattacatcatagtagtgttctgtcattatcttggagaagtacatatgcatgtcagatttgctgcttgacagttttatgagatcatcagcaacaaacatgccagtcaactgttcgggagtaaagctatgaactgggaacagtgaacagtatagaaagcattgctggatattggaagggagttgttgataactgacgtaagttgcatccaacagaagtgggtctgcgtagaaaactaggtcaaatctgctcaggacatgctgccatgcaacttcagtcttccgtatgctcttgagcttgtttgatgcactgagtagtagtgagggcacgccacaacatgtgtcagcgatcatttttcttattggaattagccgcggcggcaactctgcagaattttgcatccattgtgtgagaaggtttgaagaatcgattggtaagagacgcttcaaagtgtatggtctgagagagttggtcattgttacaacatctggaacgcgactagtcacaatcatcttgcttcctgacttggcactctcaaggacctcaatcaatagcttccatttctgcagattctgaccccaaacatcatccaagacaataagaaactttcgcccgcatagtcgctgcttgacaaggcactgaaggctctcagagtccactgtgttgcattgcctggtgtttagaaattctgctagtctgctcaatattatcatatcatcgaaactactagacaccacgacccaaattcggtcatcaccaaatgtcttgacagcccatggatgtgagaacactaactgagcaagggttgtcttcccaattccagccattccggttatgggaagcactgacaggccagctttgccatgatcagcttgcatcattgttagaacatcatccacttccttttcccttcctagtatcccttctggtcgtatgctatgtgctccttggcaaaccataggtgtgctgatatctctatgtttggctgggaatcggattctatatgtctgtgcatagcattcttgcaattcaactattgattgtttgatcttatggacaatgcggcgtcgaaaagggagccttctaaggatgaatgagctgtgtacctgaattgagaggacccttgtttttgttagatagcaagagaccttgttgagcatgtcatcaatgtcaagtgtgagagaccagagcctctgtagaagctggtggtactgctcgttgttggcgctgatcatgagaagtgcactgtcgttgatgccactgatcttcctatggaccatcctgaaaagt

SEQ ID NO: 86550 - DNA, 5239 bp, Oryza sativa
cccccaggggtcgatgggccgggaggaaatcggcccatcgacccccgggggaggcaaaatagacttttgcggaggaatttgatttggaaggattggattcgggattggactcgacgatagatcggggattgagatcttaagatggcacggacactagacaacaagcaaagaaacaaatttcgcaattagggtttttaagagataattttcccgctaggcgccacgacggaacgggcgctacacgccgccatgccggccgccgccccaccgcgccgccacgccggccgtcgcacaggccgccgccccgccccacggcccgccgtgccggtccaaatcttgtgcatgtccaaatcttgatgagatgcgggcgtgccagtcggtttgattctgcaactgacaggatatgcaaatagtagatcaaaacagccgatcagctgacaagccgatgtagtgattctagccgatgccgataatagccgatgccgatagggtgtaagaactcggctatatgtccaatgtagataatggtataatggcaatcggttgttgatgatgtaataaaataacaatataatccagtataaaccaatcggctagcattgatatgatagaataagcactgatccgaaggttaaagcacacatcggctggaggtccaatgtcatgaaatccacaagattagattaaacagtgaaacctttgttgtcatcggctaaatccaacttgtatatatatgtaatccttataagccgatgcaacgtcccgataacttatcggctagcaccccgataaaatattagcatgaacctattagcttagcaagacttatattatcaacacaatctagtaggtcgaacctaaccgatgcagcacgagattgtatatgataatctaatactcgatgagccgatagatctgtctaatgtgatggatataacaaatctatttagaacagcattgtaattgtagagatatatcggctaagacagaagatcggacctaaccgagacagtcccaactaaaccgatgcgtctctaaacacaatggaattagagatagacttgagatatcaggtaggcaaatcaatcaaccaaaccagagcgatccaagagatcgaagcgatgcagccttgaacgatgccgacgtagatgacagattcaccagggcccgacagaacgtaggacttaccctttcgccggagatcgaactgaaccaatgcagccccgcgtcaggtgcccaaatcccgccggaagataagtaaaaacctcgggaaagatggtggcgatgcgctgagttgtattgatcgtggagatagattacatagaccccgggtgtacatatttatacccatgggttgatacaagtccttgtcggacaagaaagaaacttttctaaagataaaagaaaaagataaagtccttataagacactaaacacactttcctagagataaaaggaaactaacaaactattcctaattaatagataacttaccatgccgcattctctttgaactcggtctcttctggataagcttcctttagtagatcaatttccttaaccgaatatagcaagaatccgacaactgacgacttgacaactctcatcggctaatctcaggacttccaagccgatgctgactctaagccgatgactactccgggcttaccaaatttcactgttaacactcgttcgatcaaaaaaaaaagagaggaaggaagaaagagataaggcaggagttagagaggaagaaagaaagaaagagacagagtttgttgcgtgaacgagagaagaggataagtaatagggattatatagtacgtgttgatttttattcccggttagtaacaccaatcgggactaaagttagatctttagtcccggttggtgttacaaaccaggactaaagatcctaggcgcctgacacggtctgacatggaaccaaccgggactaaaaatcatctagtcctgttgttcttataaaccgggactaaaaatcgtttttagtcccggtttttaatgaaactgggactattgtagatttgggtcgaccgatcaatgatggtttctccaccagtgcatttttcattagcacacatttcaaactgctgatatgattttttcaaaaacattctatatagaaaatgtttcactaaaatcaaacaaattatttttaaagtttgtaattattaaattttaattaattatatactaataaactttctctcgttttatgtgaaaaaaatcttactttaaactcaccaaaaagactatatatgcgtctcaggtcctgtttagatcccacctcaaaatttttcatcctgtcacatcaaacatttgaacacctgcatgatgtattaaatataggctaaaaaataattaattgcacaaattgtgactaatttgcaagacgaatcttttaagcctaattgcttcatgatttgacaatgtgatgctgcagtaaacatttgctaataacggattaattaggcttaataaattcgtctcgcggtttactgacgaattctgtaattagttttttattagtgtccgaacaccctcatacgacactctatataatacccgatgcgacatgccaaaactttacacccctgatctaaacaccccctcacatgcatggaatttctatgatgcacgcagagtgcatgctactaggaatcattcttaccggctacttatatcgttttctaatccatctccgacctacgacgatgaacgctaaccctgtgacctagttggacagggccaacctatgcgactgcaattatgcaagccgatgccactgtgtcataatccctccatccaaaaatctaagacttatttttctatcaccaaaatcaagaaaagaaatagctcacttagcttgcatataacgaagaccaaagacacgcaacagtaaatattaagataggtacttgaatttcgatcaataatttaatttagcattggaggctataaatatgcctaattcatttgaaaaaaatagaaaataaaataagtcttaaacttttggttggagagagtatatagatagtgttatagctagctaggtaacgtcagagagggattttaatcacccgggtggacgtttacctatttattgcatgtcaactaaatatctatgaaaaaaaattcaaaaaaaagacaagatatattaatatgaaatatatcacttcataaatatataaattcaaatttgacatctacaaattttaacaaaaacaacaaaattaattgtgaatatacgtaaactaattagattttaatttgttgttttcgttacaacttgtataaatcaaatttgaacttgaatacttgtggagtcatatattacatactattttatcttcaattttcattaaccatggaaaattgaaaccgtgttattataattttacaaaatttgatatatgccatcctgacccacatgtcatcgactcatatgggtcctacttgtcattgagataccgatgacatatcttaaactttgcaaaattataatggtatggttccaaattacccttttattttatatgcgataaatggctagatgtccaccccgttcatgagacgagcacataccatccgttcattattcaagctagcgcgcggcgccggtgatcgcacggaggagagaaacatgcgtctccccgaaccaaagcatcagcagctagccactgcacccacacccacctccgctccgcgtcgcgcgcgctatgtatacacgggagagataatagtaggatatagggagaattccctatatgccatgccaaattagccttatcccttctatgccactgaaaattgtctctttccctctatgccactagtttgaaattgttccaccctcatatgccactgccgtcacccctccggctcatcactgttaataggatggggttagttgtcagttttttgcataaatggcaaaaatgccctttggcccaagttgaggatatggcccaaactaaccgaactcccgcaccagccatccccaaactgcagcagctagctatcgccaaaccctagctatccccaaatcgtatcgacgggcgacggcggcggcggcgacggcggcggcggcggcgaggtggctagggcaacggcaagggctcacgtggtggtggcggcggtggcttcggttcccgtggcggctgctgctgctgcgcgaggtggtggcggcggcggtggctgcggttcccgtggcgccggctgctgctgcttgaggaggtggcggcggcggttgcttctgctgcttgaggttgtggcggcggctacggctgcagctgctgcttgaggtggcggcggcggctggtgcagactgaggcggcggctatggctgctgctgttgcttgaggcagcggcggcggcggctggtgctgattgaggcggcggcggcagctactgcggcttgaggtggtggctgcggcagccacggcggctgctgctgctactcctcaaagctgtggcgcccgcgcggacggctactgcggctcccgcggcagctcccgcggtggcggctactgctgcggcttgaggtggtggctgcgaccaagacaacagcgaaagatgaaggctcaagcaagcaaatcgcctccccaatcttgggtgcctgaagggtatgtgtccattttccccttcccgtttggcaatgatttttgttgcatacatggtaggatgcacttatttttttggcatgcattttggataggatggatcctggtaaagcatatctgttgaaaatcaggctccatgggcaccaaagtagagaaaactttacatttagaacagaggaagtgatatatagcgacagaacaaacttcaaggattttattgatcacattagagagaagtacccatggggggtgaatgaatttgtaacaatgaactattttgatccagtaaacagaaactaccctcaagtatgctcagaccagtcaatgctagaaatgtttgacaagaatatgactagcaaggaaatatctatgttgattcaaattcataagaacaatgagcaagctgtagttctgccacttgctgattggccaacacctaaaaaggtagttagtggggcagaacctaatgcagttaatatacatgaggtgccatgtactccatctcttgcaatgccatctcaggctactatatctcagcctagcagcagcacacaaccagttgttgatatgtacttggaaaatttatttgaacaaaatga

SEQ ID NO: 86551 - DNA, 7493 bp, Oryza sativa
tttgtgaaggttggatctcacctccgaaagggaagagatacctttagtggaaggaggagtgcttagtgcaacctcttgaggaaagggttagctaagacccggctcttagtgagctcctcaacggagagtagaatcccctcaaggattcgaactttgagaagaacttcttgagcttcatctttggtgactttacttcctccctctccactagctttgcttgtttgagccgctataggtctagtggctgtttgtgctagcatattcttgttgtaggctcatccaacatggtcctcgccatctcaatgagagtcctattcttcctctcggctactccattttgttgagatgaatatggagccgagaactcgtgcttgatgccttcttcatcaaggaaactctcgatgcacgtgttcttgaactccttgccattgtcgtttcgaatgttcttgatcttgaggtcgaactcgttttgtgctcttcttgcaaacttcttgaagatagtttgtgtctcactcttgtcatgcaaaaagaacacccacgtgaagcgtgaaaagtcatcaacaataacaagaccatatttgttacctccaatgcttagataagcaattggtccgaagaggtccatgtggagaagctccaatggtcttgtagttgtcatcacattcttgtcgggcgatgtgctctaatttgtttgccggcttgacatgcactacacaccctatctttctcaaattgaacatttgttagtccaaggatgtgatcgtgctttagaagcttgtgaagattcctcataccaacatgggctagcctccgatgccaaagccactccgtgttggacttagccactaagcatgtctcatgtttggctttacttgaggaaaaatccacaaggtaaagctttcccttgagaacacccttaaagactaccgaggaatcattccttctatagacggtcacatccacatcggtaaaaagataattgtaacccatagaacataattgagaaacggacaaaagattgtagtttagagattttaccaagagagcgttggcaatggaaagatcattagagattgcaatcttacccaatcccataacatttccctttccatcgtccctaaagactatgttatcttgtgaagtgccatttggatcaagagttgaaaatattgattcttctccggtcatgtgattggtgcatccactatcaatcacccaacttcttccaccggagacatattcctacaagagatcaatttctagttttaggtacccatacttgcttgagtcctctcatgttagtaacaagtgccttaggcacccaaagtactctcttgatagaaatattcttgccccttagactaacatacttagcaacaacacgaccactagcattcttcctaagaacataagatgcatcaaaagaacaatgtgaagcataatcattaggaaggatacttttggccttaacaaaattgctaagaccttggggcctcttgatcatcacactcttgtccacctttccttttggtggaggaacatacctaagaccctcatggttgaagttgtccctttgatagcctaggtactcctttagggtcttactacccatatgccacttaagtaggccattgtgaaggagtcccataagcttctcattttgcttttgcaaagcactcaaagaaatagagttagtagcataagcttcaatatcaatatctttgcatctcacacatggttcattgcttgggacaattttggaacaagatggctcgctagggagagagacactattctttaaggtttcgaacttctcttcaagagtgaggtatgctttgtccaagccatccactctctcttgaagttgagtgttcgccacctcaagattagcatgagactctttggtttgcttgtaaagccgtaccaatgcctcatttttttctctctctccttagcaagctcactcttgagttcatgggaccgctctttctcacgaatgagcaaagcctcttgcctctcaagagttgcatattggtcttcaattctcccaagcaactcactcaagtgtggtagggattccttagttatggacttgaacaattcatcatccataacctcatcctcctcatcactaacaagatcaacattaaatgacttgagaggagaaggtaccttaggctcctttgccatgaggtaaacgggagcatcctcatcacttgagtagtcgaagagtctcggtggtgatgaaggcttgacggcgaacgtggcgactccttcttcatcacttgagcttgactcggagtcagagccgtagatcatcccaaagtgagcttggccataatgtaccctcttgctatgcttgtgcttctccttcttctcatccttcttctcactcttcttcttatcttccttgatgtgggaaccatccttgaggtgagggcaatccgcaatgaagtgcccgagctctttgcacacgtagcacactcttgcggagtgtcttccacttgacttgttggagtagtgcttggaagatcctcccttgaagaagccgcttcgcctcatgaacttgccgaacttcttgatggctctcttcatcatcggtctccaccttgctcttacacttgcggttctcttcttcttcttccattgccttcaaagccaagtcatccttcttgatgcttgcagttgagctttggttgatgtattggatgacatccttggactcttgcacgagcatgtcatgggcaaggatgcgtccgagcaaatcatgaggtgtgagagtcttgtagtccggacgctcacgaatgatggtcaccaaggtagagtttcttggagtgattgctcgaaccatcttcttgaccacaacctcatcggtcatgtccttggagccaagtccttgatctcattgacgatcttgctcaaccggtcgtacatgtcgcttgggctctcaccatccaacatcacaaatctctcaaattgcccctttaggatctccaccttggactcacgaacactatccgtgccttcatgcaagttccgaagcgtgtcccaaatcactttgtcactctcaatgccatccacacggttgaactcacttccactcaatgcgctaagtattgcattagcggcttgagcgttcttgtgctcgttctcgtcgtcctccttggtgggatcttcgggattctgcaaaacatagcatttttcgactattctccaaatagatgagttaatagacttcaaatgcatcttcatcttatgcttccaagcggcatagtccgtaccattgaagtacggagctttgccactataggtactcacataagatgtagatgtagggggatagtcataagggatcttagctcccttatcactatcgatcccctcccccgcttggcccgacatgatctctctaagcggttaagcctaattaggagattaggctctgataccaattgaaagtgtcaattaggcctagaggggggtgaataggctaattcaaaaattcaattaaaagcggaagcagtaattttcggatatttccgaaattttcggatatatccgaaaattttcggagtcagcacaaatagcaaagtaaatcctagatctagttgcctacaacaagaatatgctagcacaaacaacaactagacctatagcggctcaaacaagcaaagctagtggagagagaggaagtaagtcaccaaagatgaagctcacgaagttgttcccgaagttcgaatccttgaggggattctactctccgttgaggagctcactaagagccgggtcttagctaaccctttcctcaagaggttgcactaagcactcctccttccactaagggtatctcttccctttcggaggtgagatccgaccttcacaaacttctcccagccaaccacaagtagatcggtggctcgggagtgacacctagccgcctaggagtccttaacctccaagagtaacaaatgtagcaaagaactcccggagatgatgcaagtgctcacaaatcttcacgaagtcaacaacaagcactcacacaaactcgaatccacaactctcacacacacaccaaatccaaatcgaacacgggtgagaggggaaacaagaaagcaaggctcaaaagtgctaaagagagagcaagccaagggcacaaatgattggaatggaaccagcagccctcacaagtgaggggggggctatttatagccacagcccaaattctgcccattatgcacaataattgagattttcggatattccgaaagattttcggacaagtccgaaaattccagctcagcaccaacagcaaagtcaacgaaagatttttcggacattccgaaaattttttggataagtccgaaaatttccaccaccaaaacatggttctggatgttttcggaaaagtccgaaaatcactttcggacaagtccgaaaatacacagaagcgatttctgcctttgctgaagtttttcggaaactctgaaaatcaattttggaaaagtacgaaaataaacagaaccacatttgccttcacagtcattttcggaaagtccgaaaatgtctttcggacatatccgaaaatttccagaagcaaaaattggttctgtgcattttcggaaagtccgaaaatgactttcggaaatctccgaaaatttccagaacacatcaaactgaggggaaacacttttaaaaaaagattttgagcactttgatcactcctcatatgtcaatgcatcatccctcttaatagtgcggcattcctattgactcaaatgaaaagaaaagttacaatgtaccatttgctcatctgccgcatcgcatcacatcaacgtatttggcgggatatgcattatggtaactcattgaggacataacaaacttcacatttgcttaaataaaaatgttagtcctctttaatcgcattgtaattaatcaccaaaatcattaggggcctagatgcactttcatgcagaaaagggatgtttcagaggaataaaatgttcatacttagtgtatctgtcaacaacaaccaagatcacatcaaatcctttggaaacgggcaaaccttctataaagtccattaacacaacttgccaggctccagaaggaattggtaagggctgtaacagaccagggtaagcacaattttcatgtttagccctctgacagatgtcacactgttggacaaagtcagtcactgatttctttaatcctacccaaacaaacaacttcttgactcgctgataagttgcttgaactccagagtgacccctcacagcagagtcacggaaagcagatatgattttggtttgaatagctgaattagctcctatccaaaccctgccattcttcttaattaatccttgagacaaagtaaaaccctggccgttaggagaagaaatggccaattctatcagcagtaattgagcctgagaatccacaacataagaattcaacacttcttgtatccacacaggctgcacaacagaaatagcctggagagaaaagaaatgtcccacccgagacaaagcatcaactgacttattgtccactccctttttatactgaaacctatactaaagaccaattaacttggtcatagccttcctctgtaattcaaaacccaaaacttgatcatccaaatggcacaaggattgatgatcagttttaataacaaatggtccccttaacagatatgctctccatttgtcaacagccatcattatagccaagaactccttctcatagatggataacttctgattgtttactcccaaagccttactgtagaaagccacagggtgcccctcctgagaaagcacagctccaatgccagtggaacatgcatcagtttcaatggtgaatgacttagaaaaatcaggtgatatcaaaacaggagctgtaaccatatcctgttttaaggccaaaaatgcctgatgagcttgatcagtccacacaaacttagcatttttctgaagtaacatagttaaaggtttagccaaaatcccataattctgcacaaacttgcgataatagcctgttaaacccaaaaaaccccttaactcagtcaagtttgttggaattggccattgccgcattacttgagttttatcagggtcagtggccactccctgagctgacataatatgtcccaaatactctaactgactagcagcaaaagtacacttagataatttggcacatgattgatgttgctacagcactgcaagacacatttcagatgctgtaaatggtcttcccaagattttactgtaaatcaaaatgtcatccatgaaaagcaacacaaacttcctcaagaatggagcaaagatggagttcattaaacactgaaaagtggcaggtgcatttgtgagtccaaagggcataactctaaattgaaaatggccatggtgtgtcttaaaagctgtcttatactcatcaaactccagcatgcgaatttgatgatacccactgcgaagatccaacttagaaaaatatttagtgccagccaactcatctatcagctcatccccaataggcaggggaaacttattcttcacagtgagagcattcaaacgccggtaatcaacacaaaacctccaggaattgtctttctttttgcccaaaagcacaggagaagcaaaaggactgcaactagtggtaatcagtctagctgacagcatttcagacacttgacgctcaatttcatctttctgagcaggagaatagctatagggacgagaattaacaggaatggcattagggagcaaaggaatagcatgatccaaagctctatggggaggtaaatcagaaacattctgaaaaacagactcaaattcagatagcaaagactgaatctcaggaaattcagacacaggtatagtcaccccaccagattgttccaacactgcaatggcccacacatcattgccctttgtccatttcacaacctgttcaggagtagcttcttgaggagtggttaagtcagaagaagactgaattccctgcagcttgatgagagaaccctgatacgaaaactgcagccacttagcagcccaatcacatgtcatagggctgtattgagttagccaatccattcccaatacaagatcatagccccccataggtaaaaccctgactggaaaagaaaactgatggccttgcacccaccaatcaaattgagaaatctttgcatcacaaaccagaacttctccattagccactctgacagaagtgggtggaattggctcagacagaaggtgtaaacgatgacacagagcagaattaatgaaactatgagaactcccagaatcaaccaaaacaataagcacctgattgctagacagagccctgagttggacaatgttggtgtgagaagtgccggccaaagcatgaagcgacaaattggcactgtcttcagacaactccaacccagtaacagcatccaaaagttcatcagtcagaacaattgcctcctcttgtaactccat

SEQ ID NO: 86552 - DNA, 6056 bp, Oryza sativa
ggtttttaaacgaaaattaaaaaaaaaagaaatgtagtttgggaatttcgaataagtagtaatttgatggggaaaatgggccgggttttgtggtggggcccatggtgcatggacctggtgtttgtacaccgggtgtattacaagtggggccggatgtgaaggtgtatgaaagctgggtctagggtggttgggatggggaagcgtacggttcagtggacaggggacatgaggcacagatgcttcctagcctggagctccactatttggaccacctggctgtcattgatctgtctcactcgagggagttactgcctccgtcccacagtaaataaagttttattttttttcttgcaacgttaatacaaatataaaaaaaaagttatacttaaaatacttttatgataaatcaagtcacaaataaaataaataataattttatattttttaaataagacgaatgaacaaacattaaaaaaaactcaaaacgacaagtattatgggatggaggtagtaaaaaaaaacatgaatactagggaagcatctgatattgaataagtggaaggggagagattttgaacccaagccaactaaatcatcatcttgtggagttagctagaggatccctgggcgtttctctcattcgagtgagtcaatggcacagtgccacagtgtttgcatatcttcgttctaagatataaggatttttaattttacacacaattactaagacagtgggtagaattaaaaggagaaaattatgatgggttgaaaaacaaaggtaagtgggaattaaacggtggaaggttgtaattgaatgaaaagtgattgttaataaagaagttatattttgagataaattttgaatgctagaagtagttataattttgagacgaaaggattcgatttctgcaaaactcatttgaatttggtggtttttttttcatataaatttgtcaaaagtttaaagggtaaacatggaacgatgaattcgtacaagtctgatgtcacatatttatgcagatgctccagccttggagatagatagatcgatagataaaccatgggattcacaatgtcttattccctctgaacagtatgggatgggattcatgtaaacctcgtgttaggaatcggatccaaaccgaaacacccagcgaccacatatgaagacaaagactgacaaattcagggcaggatgcaaatcatgcaaagtatcattaagctttacttgtgacttgtccatcaaaaacggacccaagagttttaacatttagtaacactggaatcagtgccaactgccaagggcacattttattatctctcaacagctcacgtagtgcaatctggggatctctgtaaagaagacgtgcagagtggccctagtttacaatagaaaccgagtacaaaaccacagatcagcttttgttctgagatccttcaacgctcttccttagtgccgatatgacctctcctggttcagctgctccaaatattgagcttccagcgacaatgcagttagccccagcagatgcagccacatcaatggtggaaggacccagaccaccatcaacctaaaacaaaaaacaaaaacgaatatgttttgataaaatggaactaaatagcccccgagcgtctgtacgattaaatcagtgtgctttagacaagaatcataaataacattgcaccacactacactgtgaagaacatattgtacctcgatgtcaagggatgggtacttctttctcagggcacgcacctaacgcaccatgtttcaaaatgatcagaatagttgtaaaacatagatacacaaaaatacagtataaactataaacaatcaggaatactaaatggcacttgatgcagtaataataccttttccatcatttctggcataaacttctgaccaccaaagccaggttcaactgtcataacaagaaccaattcaacaggattttctgcctccacctgaagaatttgttatcaatagaacaattgatgatgcgtgaaactcacagagcaagatatgcccacagccttaactagcattgtcagaaatcagtttcagataagtgagagtgaagttgctagccaacaatatgattataatgaattcaataggaaaaaaaggttaggcagtaaattgctagctccttatcacaagtatcttgagacctgatcattattttgttaaacaaatgtctcttgatcttcgatgcaggtcatgctgcagaaaacagacatgtaatgctggatatagtgaacgggaagttagctatgcctgaacatgggaagaacaggatttgcttatttaccaatcaaagaaataacatgcaaaatatattgccactagagtggtacagaatatacagcaaccaggactggtacatgatcaccgttcaagagttaagattcagaactacagagggaatatgcctggatactgagaacaggataactataaatgaaacaaattgcgcagctcgagtgtaaatgaacataagcttactcccagtttgagcacttattggatatgttaagaaaggcatttatgtcataattatgaactgcgtgtggaaatagagcatgggatctagagaagttatattgagcaattaccaggggaaaaacttcctccacaggagtgcctggcctcaatgatacacccggtcgcataccctttgctttgatactttggatgagttcttgccaattgtctgcaccaggtttttcgtaagacaaggaaaaccattaactgcttctcaacaattatatatttacctctggatacttctatatggaatgtgaaacctgaggcaccagcttttgctaatggttctacataatccgaaggattggtcaccataagatggcagtccaaatatgccctagaaaatttcagaatggtgagcattataggtacatataggaacaagagttaacaaggtgagtaaaagagcaccaccatacttggtgtgcttcctcaagctctgaatcactggagctccaatagtaagattaggaacaaagtgcctgcatatgtgaattagttctttagcactacaacaccaccacttcaatcgccattgatctatcatattctggtgtttgcaatacataaactcacccgtcctgcaagagcatatggagaaagaaaccataggtcagcaaaagccaagcttcgcattttcgattcataatcaataacacacaatcctcttgaaaaggaaaaaaagaagtgaaacgtgatcaccagagaaatcaggattaactgaaattgtcaccatgaaaaccaggctgttagaatgaagagacagaaactaacgcacacataacattctctcatagtctttgctctgaacatctatgagctatgctacactaactttccagtaagacatgaaacaggatatgtcgaacaaaaggtcattttgaacaaatattatcagattcctgcgatttagcacatatataagtgcatggtaactccaagctaaagctcaatcctaaccctgaccaaatcatcctacaaaccaaagggcacgcacggtcaaaagatttgggggggaaaccggatactactagagccactgctttcgcgcggatcaaaaggtggggggcgaggcgagagggggatcgcacacgttaccatgatgtccatgtggagccagtcggcgccgaggcggaccatgcggtcggcctccgcggcgaggttggcgaagtccgacgagagcatcgacggcgctatcttcgccgccgccgccgccgccatgcctcctgcttgacctgctcccgaaccaattccgatagtgttgggtggtggtgtgtttggggggcggcgcgagtagaagtgcggtaggtgacgttcttcgggtaatcggcggccgctgggaatgggaaacgaagaggttcggtcgtgtgtatggcccacttgtcagtggcagggattgttttcacgaattattatctattttaataataaatttaatagtttaaataaagaactttaaagaaaagcttataacagtgagaaagtttgagtttagactttagagacgtgtaccagataattcatcacaataagtcaataacaatacgatgaattaacccagaagaacatgattaggctgaattaaaacaaagtactcaaagcaggcacggctggtcgctactcgctagttgccagcgtaaaagtagatcagcaagtagagcggcgatttatttttgtccgtcctgaaacacatgccttcccaatccgtccaaaaataaacgaaccaccattctaaaataaataaacaaacctagtcaataaacatatcgaatatcgagcaaacacaagcacagttcaacatatcgaccattgtgatatttctgacaataaatatgttcggtctcatttgcatcaaggcagcgattagttcaacaaagcaggttgggagaatcctggtacagaatagaagcaagaaagcacaggcgtttctatcaagttcagggcatgattccctggcgtatcagggagaatgttcgaagcaaatttgttgatgcaaatttgcggtaactgaagaacataatcgtcgatctagtccttcctcaggtcgatgtactctcgcttcgtcccagctttgttgatgacaactatctccagcttatcaccctgcaatatttgcatgcttcgagcgtcagtaaagtggcaaatacgacggtgtgaaacacattactgatgggattgcagtactgagatggtgaaacatacagtgtagatgtccctctcagttgccgatgcaaacacatccttcactaaatcgaccgcctctgtctccgacaaaggtgtgacggcatcctgcatgcatcagaaatattcttaggactagtggagctattcaaatcagcagttgagcacttatttctgggtggcacataaacttgcatgtcaaatcaaccagatgatcacatgacatgatcaatcataatgcacatgccaggtaacaaactagtaaaacttcagtgccttactcttgcagggagtaatagtggactaggtgattttagttggttgtccagcactggcatgatcaaagcagatcctgttccctgtgcactgtagccagtcctctcataggacccaactgcatcataggtgaaaacacatcctttccctgtgaaaataagatatgtgtttattagctattagagaaatatatatgcttcaacaaacacataaaacataaattggaaaaggagaaaaaacataaataaaaatctgcaccttaccttcactatcaagcccaccaagtacattgaaagcataatatgggaagaatcgcttgtagtacagagtgttggagagcagttgtgccatggcagggcagctcatccttttattgtgctggtgctggtacagctacaaaaacaaatgggcagcaataatttagatagcaatactgggagcatcctgaacattcagaagtgcatatttgcattagcttgaacacttccaagtgtataaaactataaacttctttactaacaaataatgccaataaattgcagcctagccagcttaacagagttcctgacgaaagggaagtttgatttgtgaaactaacagctgaccagctaggaggctgcgtagagaagcaaacagaaggaacaaaagaaaaaatatatatttctgacgcaagatgcaagtcaatcagttcatctgcctttagtatcaaaaattatactagcagcattaagtgcacaataaacaactatcatttcttgtattgatataacaacaaaaggtctaaacgaaagtacaaccctgttacagtggagaagttatggctcgggaacttaccaattctctggcagccaagttcttgtgcagagctttgatatcaccttggaagccggaagatgctagtgcgcatttgtccgctctaaacacgaaaaaaagaaaaaatgtcttaattttgtattattgataacgagcatattggaatgtcatagcaataaagaacaagacttccttccgtttttccccgcaaaaaaaaatacttcctccgtttcacaat

SEQ ID NO: 86553 - DNA, 632 bp, Oryza sativa
  unsure (1)..(632): unsure at all n locations
catactctggttaccatcagattcgcatggctagggaggatgaggaaaaanctgcattcattacccccatagaaacttattgttatacgacaatgcccttcgggttaaaaaatgcaggtcctacttttcaacgcattactcgaatttctttgggtagccaaataggacgtaatgttgaggcttatgtcgatgacttggttgtaaagatgcgcaaccaagagaccttactctcggatctagcggaaacttttgagagtctccgctccgcccgcataaaattgaaccccgataagtgcgtgttcggtgtacctgcgggcaagcttctcgggtttttggtctctgcccgaggcatcgaggccaaccccgagaagatacgagctatagagcggatgcgcccccccagcaagcttagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctggtcgccccggagccaaatgaacccttgctactctacttagcg

SEQ ID NO: 86554 - DNA, 1441 bp, Oryza sativa
attcgcgggaaatttcagagagtattttagggcacaaagaatattacaaaatattctcagccaatgatttttaaaggaaatttttaattccctcaataattcacttgattaagttgatttaacttttatttaatttctagaaaatgcattatttaatgatttttaatcccgaacgaaaatcggggcgttacaacgcgtccagcgcatctccaagcgctacgtactggtggaatggaccctctatcggcgcgcggctaacggagtcctcctgaagtgcattcctcgggaacaaggcgtcgagcttcttggcgatatccatgaaggcgagtgcggagcccactccgcctcacgcaccttggttggcaaggcctttcgccagggtttctattggccgacggctctcaacgatgcggttgacctggtccggcggtgcagggcgtgccagttccacgccaagcaaacccatcagccggcccaggccctgcagaccataccactttcatggccgtttgctgtctgggggctcgatatcctgggtccgtttaggcgggccccgggcgggttcgagtatctgtatgtcgctgtcgacaagttcactaagtggcccgaggcttacccggtcatcaagatcgataagcactccgcgcttaaattcatcaggggcatcactgctcagtttggggtgcctaatcgtatcattacggataacggcaccagttcactagtgaactcttcggtgactactgcgaagatatgggcatcaagctctgcttcgcctctcccgcccaccccagaagcaatggccaagtggagcgcgccaacgcagaaatcctcaagggcctcaaaaccaaaaccttcaacatcctcaataagcacggcgactcgtggatcgaggagttgccagcggtgctctgggcgaactgaaccacgccaagtcgagcaaccggggaaacgcctttcttcctcgtctgcggcgcggaggcggttctcccatccgagctcaccctgaggtcccctcgggccgccatgtactgcgaggctgatcaagatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgctgcgtccaaacgcgtgctggactgagcaagctctcaccaatgtgggagggtccgtatcgagtgatcggcgtcccccggccgggctccgttcggctggccatgggcgacggcacagagctgcctaacccgtggaacatcgaacaccttcgtcgcttctacccctagcgggggtcgggtgttaggtctcgggcttgggccaaccccgcacccccccgggcgtgccgggttggccgggggctaccac

SEQ ID NO: 86555 - DNA, 1697 bp, Oryza sativa
tcatatcgacctcccggtcaccttcggtggatccggcaacttccgcacggagcgggtgaacttcgatgtggcgaacctcagtctgccctacaacgcggtcctggggaggcccgcgttggtgaagttcatggcggcggtccactacgcctacctccagatgaagatgccgggccccggtggccccatctctgtccatggcgacctcaaagtcgcgcttgcttgtatggagcagcgcgcggaccacctcgccgcggcgtccaagcccgagggtggcgacgggaggctcagcacctccgtcccggccgccccgaggcagcggatggtcacgtgcgacgaggtcccggtcaaagaggttaccctgggcgacggcccgtccaagaccacacgaatcggtggtcttctggacgacaaataggaagacgcgctcgtctccttcctgcgggcaaacgccgacatcttcgcttggagatcggcggacatgcccggggtccccagggaggtgattgagcaccgtctcgccgtgcggccgggcgcaaggccggtccggcagaaagtgcggcggcaggccccggaacgtcaagccttcatccgcgaggaggtggcgcgacttctggaggtcggattcatccgtgaggtcatccatccggagtggctggcgaacccggtcgtcgttcccaaggcgaacggcaagcttcggatgtgcatcgactacaccgaccttaacaaggcatgtcctaaggacccttaccccctgcctcgcatagatcagattgtcgactccaccgcggggtgcgaccttttgtgttttctagatgcatactctggttatcatcagattcgcatggctagggaggatgaggaaaaaactgcattcataacccccataggaacttattgttatacgacaatgcctttcgggctaaagaatgcaggtcctacttttcaacgtactactcgaatttctttgggtagccaaataggacgtaatgttgaggcctatgttgatgacttggttgtgaagacgcgcaaccaagagaccttactctcggattgtcgcgtcccaaatcgactctaaaatctatcctcaaaattgtgcaaaagaataagtaaaattcaatgtgaaagcctccaacaattaaaatgtgcaaagataaaagtcaaatgaggcttggaggatttttgtatatttcctaaaagcctaaaatacttaaacaaattttagtggaattttcagagcacaaataataatttaaaagaaataaacaaagttaaaaaggttttataaaaagaaaatcctaaaagaagttcttttcctccccccccttccttcttgggccggctcggcccattccctccctctctctctctctttcctcccgcggcccatcggcctccccgcgcgcgcgcgccgctgacaggcgggcccgcccgccactctcgctgacgggtggggcccacctgtcatctccctcctcccgccgcgccgccgcccgcccgtgccctagcgccgccgccgccgcggattccgccgcatcccgtcgtctccgcgcgcattaaagagaggggaatcactccccgcaatcccctctcccgattccccctctttcccctctctccctccctcggattcgctcggaatcaatcccgcaaacctcgccggcgtattcaatggaccccagaactccgcgcccgtttcc

SEQ ID NO: 86556 - DNA, 1387 bp, Oryza sativa
cgagggtggcaacgagaggctcagcacctccgtcccagccgccccgaggcagcggatgatcacgtgcgacgaggtcccggtcaaggaggttgccctgggcgacggcccgtccaagaccacacgaatcggtggtcttctggacggcaaataggaagacgcgcttgtctccttcctgcgggcaaacgccgacgtcttcgcctggagaccggcggacatgcccggggtccccagggaggtgattgagcaccgtctcgccgtgcggccgggcgcaaggccggtccggcagaaagtgcggcggcaggccccggaacgtcaagccttcatccgcgaggaggtggcgcgacttctggaggccggattcatccgtgaggtcctccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcaacgcactactcgaatttctttgggtagccagataggacgcaatgttgaggcctatgttgatgacttggttgtgaagacgcgcaaccaagagaccttactctcggatctagcggaaactttcgaaagtctccgctccgcccgcataaaactgaaccccgacaagtgcgtgttcggtgtgcctgcgggcaagcttctcgggttcttggtctctgcccgaggcatcgaggccaaccccgagaagatacgagctatagagcggatgcgcccccccagcaagcttagggatgtgcaatgcgtcaccggctgcatggctgccctaagtcggttcatatcgaggctgggagagaaggcgctacccctatttaagctcctcaaacgctccgggccgtttatctggacggaggaggctgagcgggccttcactcagttgaaggcgtacctcagttctcccccagtcctggtcgacccggagccagatgagccgctgctactttacctggcggcaaccccgcaggtggtcagcgcggcgttggtcttggagcgcgacgaggacaaccctcactccgcgcatccccaccctgtgtcgactcgacccgggagagagcagggaggagaggcccccgagtcgaacggcggcccgaggcccccgacggccggagttggccctccgccagcttgtccgacggtgtcaggcacccccgacccc

SEQ ID NO: 86557 - DNA, 5386 bp, Oryza sativa
ggcggcggcggtagcgtgcacgggtcccctgacattaggaacgtcatctacgagcgcctggtggcgattcgcaacgaggaggccatctccaacccttcctccttccgcgttgagctcgaccgccacttccttcgcttgcccgaaaggtagtacacatacgatgcttctcgcctgtctctcagttgttttgcttttctcgcctttcaaagtgcaatcttcttgcctgtgcagctatttgatcgatctggatgtcagcaaggcagagcaagtgctgctgcaccggaggattctcgccgactgcgccgaccctgaaaagcgcccaatcttccatgcccgctacataggggtagactctggatcaactccaactgaaaacggtaatggtgggggctttctccctatcaatttgaggtataggtcaccaactttccaatgcttttatatatatatatatatatatatatatatatatatatacatacatacatactttactagttgaggacacagttgatttcagtggagtgtatgtacctttcttttcgtgttcggaatggtatctctttgtccaaacaaaaatgcttcttcttctgtaaatatcaagccaacttatcagtatatctttcgtgttaacatcgattgtgcctgtgaatattggacagagatgatgaattcacagaatccgagccatatgaaaggatgatggaagacctgagtctagagagaggaaaaggtgtggatgacttcgaagccagttctgcaaggtatttttgttactaagctgttgtgctgtgcgaatgacatatctataccataataacaatcaattaatccggaacgtcagtttcaggtttcaaccatctggttcgatctaaaaactgcaagaatgcgaaatttccatttcatttgtataaacatagattatgtttccagaagggtgctaacttgactgaaaggttgttctgtccataaaacaacactgtgttcctctttggtacaaagcttccgtcatgatacttaagagcaacctttatagttggtgttactgctccccgcaaaaaaaaatagttggtgttactgcagttatatgcaatcaggctagttgctctaatcagccttgtttgaattgttgagttttgtggatatgagcctttgctctctacatcggtgcacaacagttctcatataattctttgaaatgattagtaacgtcttctttgcctattctttttatatggacttctttctgatatccagactagtttagcactcatgtattatatgctttcttttcgtgaaccattctcttaatttgcctgagcaatcatctttaatcattttttacatgatttgtccataaccattctcttaattttgcagaagggactcgaaattcgtccgtgttcatgaaattattttttcttccatagacaagccaaagctcctcagtaaggcaaggccatgtactttgtgatttctatttagagacctccatacgaataccacaccttcttgtgtcaccgcttgaactgtgagatattgttttacagctatccgcgatactgtctgatattgggttgaacatccgtgaagctcatgtgttctcaacatcagatggcttttgtctcgatgtgtttgttgttgatggctgggatacagaggtaaacttagagcatcgtcatggttatagcttatttttttcacacaattacagaactctacaaattatgtttcgaacttttaatcatgactacttatggtgggaaaccataaaattagataatcagattgttaagtacactatgcttcaaggtgttccacaaattaaaacattgcctaacactatgtgcaggaaacggatggtttgcttcagaagcttatagaggcagaggcaagcagccatgtatggttcttcctatttctccatttaatcaacacgattgcttgaaatttaaaggtgtcttgctggttaggaagtcaacatgcttgcaagttacctcctttttgcattaaatgcagtcctgtaaatactctcaagtcagcattacaagacttgaagaaatgaatatgccatccctatccttttcctttacagaattgaacttcttgtatgtagggctcattgtctaatccgacaaatttgtcacaatcagagaaagttctagagctgcaggaaaagataggagattctgaattcgacaggagtttgctgcaaattggggagaaaattgcatccggatcttctggggatctgtaagaaacatgcaactcttattacttaggaataatgaatattaggaaagaacggaggtagttatttagaacaacaggtacaactcaactgctagtgtggattgcatgacctttcttacatctgtttacaagcaaatggtttcacaagggggcactatcaacaaatagtcacaaagctagttgtgttctgggtttctgatttcaacttgtggagacatattgctgtgtgcattattctatattttttaatgtttctagcaagatcagcagttcattaaccaagtggtcttgtttgtatcctcggctgcagatatcgaggaacttatctcggtgtggatgttgcagtaaaatttcttagatctgaacatgttaacgattcttcgaaagtggagttcttgcaagaaataatgattttaaagtaagctttcttttgaaatcactttgatgcatagacttgactttgaatcatttaaaattccagataattctaatacagtgaagtcatgtccaggagtgttgatcatgaaaatgttgtccaattttatggagcttgcacaaagcatcgaaagtatctcattgtaacaggtgacacaaatattgctgataatcttgcctgctgatttttttcgtaggaatcaaaatccttgtttctcaagattcagatagcagtgcttgggcatatttacaatctgagtagcgttggtggctaaaagattgagctcatgtctgggtataaccaatgtgcttggtttttcatctccagtttccttggcatctaatgtaaataactgttgattgaacatttttagttttgcattttggtgagcgtcattaggtggaattgttaaaaacaaaaaatctcgaaagacgggggataactcctgtcttttatccattttggtagggacttcaagagcagctaagtctataggagggatactgtaaccattacatttgcttgttgcgtccatgcataaagaattctacaccatgatggaaaatagtgcaagatatgtctggtcagaagaatattgctactctattcctatcaacaggtctctacccacccttcaattagcctgtgaattactactttctaattcatgcatgtgaaataagtcttcgttcctaatgagcacacaaattttcattttctaaattaccagccaaatttctgtattgtttacacatcacatgagtatttttttctattattgtattgcaaggcgatgagttctgggcccctagctgcaaagttcatatcagactcatcctgtatagcacctataaataaggagatgctatccatggatttataagatacatgtatcatccacacgttttaacttgacattagtttattgagattactcccattgcataattgattagcagtaaggtattggttgtccaatcttgctgttaattaaatatttagatgttttgaagagctttattaggagggtgttaattcattttactgcaagtgaacttgtgttcagaatcccaactaaactcttttctagtcacttaaaaaaagatatttgtgcatcttctttactgaatcatcgtattcacatgggagtttggttcaaatatttcgtacagtctagtctttatttattcagaagatgacaagaattatactttttttagataatggacaagaattgcatggatagtaaataaataattacttatgtacaatactgttattctgttcccttgtcatgccataggatttcttacataatatcaagagccagcgatctagatgagttaagttagtagtagtatcattgtagccatgagatcatttatatatttatcttactgcttttttagggaaaaaaatgtttgtatgtgtcagttccgatttccaactttccaagggtgcactctgttttcttgcttcaatcccacaaacgagcataggccatggattgcttgtttgtatttttatgtattgagttttccgaattgatcaagtcagctcaatgtagagcatttatctatctagggtatctattatcgggcaatttcttttctgcgattatttcatgtcaactgatattttgctttgttatttgtgtgtctcatccagagtacatgcccggaggtaatttgtatgacttccttcataagcaaaacaatactttggagcttcctgttgttcttaggattgctattggtatctcaaaaggaatggattatttgcaccagaataatatcatccatagggacttgaagactgccaatttgctaattggctctggtcaagtatgcatattgtttcgaagttgcttatcaattgaaggatgtcgaagcactgattcaattcttaataggtcgtgaagatcgcagactttggtgtctctcggctccgatctcaagggggagaaatgactgctgaaactggcacgtatagatggatggcacctgaggtactatgttgatccttttgttccttatcctctggtgtcccttttttccctttattttcctttctgattactcgataagacttttgtactgcaacagaaagtcttttctgtttgctaatgataagttcagtttcacaagcccatttcaccaggcttaggcacatatacagatgcatgatgcactattttactgttttcacatgtatgcatacacagactacctgactatgctgtccttgcaagcatgttggcttacatattgatcacgcttgcatttacttactgcactgattttttggatcagtgtgcaaaagccatacttagaagagttatgcaaagctaagacaatatgcatgtgcaatgtacttattagaatcgcgtgtgttaccaggtaataaaccataagccttatgaccataaggcagatgtcttcagctttgctattgttctatgggagttggtcactacaaaggtaacctgtggctggcaaggcattgtgtgacgttttcatagttctcaatttttttaacagcagtgaactatggtcagatgtaataaccactaatacatgtgctatgtagataccatacgaaaatctgacacccttgcaagctgcactgggagtaaggcaggtatgtatttgatgccaataagctccaacataacacattggatgttaaaaaaagtaa

SEQ ID NO: 86558 - DNA, 4691 bp, Oryza sativa
atatatatacacacacatcaggtgtggctcgtgtgccaccagattcaatttgattgagaacttgagatccgcgcggttaacaaagacaacaactagcttacacacttgtgagcgatggacaagaatctcacctgccgcgggcgcttcaggtatgtaaactcatccgatatttcatgcaaagaacataggtcatgtaaataatattttctccatctcaaaatataaaggattttaggtagaatacatgaatctggacataggatatgtcacatccatccaaaatctcttatattttaggacagagagaatactatgtattaaagataattttagtgatccttttgctataataatgccatctaattagtaggttatgtgaataatactctctgtgctgaaatttaacaatttttagctctctatttgaacaaaactaaaatatattataatttgaaacggatgtggtactactgtgtataaaaagatactgtactatgataagttgcatgaaaatctaacactagtatgaggcttcgtagtttgcgcatgcaagtcgcggagggaagtcacgcgcaggttaattgacacgagtcagactccctgttgtggtgcagcataacggtgtttcttttccagaagtcaaaccagctagtttttcgatttaatttccattagcactgctttctgaactgcaaaataattccaatatatttttttagaaaatcatataatttacttttgaaaattataatagctaatattcccttcgtcctaaagtatagcaagttttgcccaaatttatagctaaaacttgctaaaccttaggacggaggttgtaattaattatcactaataggttttttttcgtttcgtgtacggctgaaaattaaatctcatcctagctgcccatacgaatgcatgcatcggccctatgcatacccacgttgacgaaagcttttaaaaacttcatttgaaagtttgaaatttttagttaaaagttcaaatttttggtaaagttttcaaaaaaaaatcatttttttccaaatttgagttggatgtttcgaaaattgaattgcaagttctaaaacttaagttgaaaggatcaattttgttggtagaaagtttactttgaatttttctaattcgaaataaaaacttttagttgaaaagtctttattgaaagttttattcaaattttgagagagcttagaaataactacaaaactatatagaattcaaaagctattcaaactttcaaaatagaaattttaaataatttcccatctattctagccacttaatattcgtcccataaggcccaaaacgcggcagtagccatgtctcgcgtgcaaaaaacacgttgagagaatcctgttcgacatttttgttgcgagtcgcgacgcgcgcgcgcaaattagttcttctgaacaaaatgcatgttgaaaagcatatccaacatttttttgtctcaaaaaacacggtatgattagatttgtcttttttgatattccctccttctctaaatgtttgacgccattgacttttttaaacatgtttgaccgttcatcttatttaaaaacttttatgaaatatgtaaaattatatgtatatataaaagtatatttaacaatgaatcaaatgataggaaaataatcaataattacttaaattttttgaataagacgaacggtcaaatatatttaaaaaagtcaactgcgtcaaacatttagggattgagggagtatatgatatgctttaagtttataataaatgaaaccacatcctctctattttcttatttcctctctcaattttcttgttttttttttcagacaagggaagactggttttaagattaagaaaaagaagtttaggctatgtgttcgcgatgagcatggcacctgggtctgcagtgaacatgacaccatggctaaaacaacgtcactggggcgcgaagtatcgctgcaactggaaaaaatgatactgggggattactcctcaaaacttaagatgttaggtatgcttaagtggacaacttttaaagaccagcgatgcggtataaatcacttgataaaaaatattaaaaataaactcaaacggtacaagtatcgtcgattggaacgaggaatcttctacttgacaccatctgctacagtgaacagccatttataccacatgccactcaaagaagcattggtgagaacaaaactagatttacgaaggcgaaaggaagtattagatagatacaatagctcggagggatcaaaattccgtagtggtgcaatggtttcacctatgaccaagttgtcgatatgcatcctgtcttcggtgattttagcttatatgatagtattcttttaaagttaattgatgtactgtagagtgtttgtaacttgtttatatcattgtgaaggcaagttctttcttctatttaagttgaattgcagcctataaatcgaacacctaatctcccctatttatggatttgtcacgttgggcatgtttttatctcacacttagcatagaatgtgtgcctggggtgtttcagacgaaacatcagtagcccccatcctggcaaatcacactaaaatagcatttcatcggtaaaaaaaaaagtattaggaacgacagaaattttgggttaggccaaaaacaatatcttcggtacaagaccagactacatgcaccaccaacatgctcttttcacaagaggtactgcagtggcacacgccattaaaacaacagcacatcattggtcagattgtgcgtcaaagttgacacgagtagcaaaatggtttatcgtattgggtgcagcttttgaagatctaagcattgcaacctgcaaaatagatcaaaatatgctatatcaaatgattggcccaaaactccagacagtttagtaaactcaacttttcacatagaatgggaagcccctaatactaccttaggactgttcatattgcttccgagataaccaacaccaaatgaaggggaggaataggcagcaacaagttcagcggctcccaatgcagatacctcccctctctgcagaatgttatattgttaaatcaaagattatccatgcaaaacccaaggagacgtatcagcaaagtaccacctttagaacatcagcctgaattagcaacaacccagcgcctgtatcatgagacatctcgctgctgctttgaaccgcttggcgcagaactttggtacaagcagaagcagggccagattgtatcctgagaaaatacaaattgagttccaaccaaaagagaatatgatgttgaatgtaacgaaattatggtaatagattatgtagaaaggttaggagtccataagcatggactgccctagatcatgttatggccaacaggaatgacagaactggctagatcaagacatcaagtgacggcaaacaacagtgctcaaactgtagattaagatagcaaagctgaagccagtgtaaatatgatgcaagcagtcctacatgtttgcaaattcattgaggctgaatgacatggtgagaattgtatagtgcagaactgtatatcaataagagcaaatttgtagagatgagcatacaatgatgatgagatacaacattcacgtgcagcaaatcctctaatcaagtgttcaccggctccagttgcacaacacccaactataaacggtgtgccaaagggccctttggatgaggcccagcacccagacccatacatagcagccaaaccaacccgtccatctacctgcaagaaaccaatgcttattgaaggcctggggaatctctatgcaaaggcatcatacaagaaatataaataaaagagtcctcctcaaacaaatttaagtatcatacaatgaaaaaaatgaccactggacctttagtgcaatgccaccactggatgctcctgatgctatatttccataagcatcaacacaaacagcaccaacagtatccatcacgcagtcttgatcatcctccatgattgatcgtgtgatcatcttcatcttctttacaccagtaatatcctcagcttcagctcctaaaatgaaatggcaacatgtgatgtggactggccaagtacgttattacatatactgatgcacacagaaagcacaagcaaataatgagcagtaccacaagcctgggacctagtgctgcatatttgagtgttgaattatatatatttgaaaggaatctcgtacagacattagcatctagatgaccgtttatggaggccaaaaatcatgcagatgaacacaagagaatgccggcatacagaagaacacgcaatagcatatgtagcatagacaactattggaagaccttgtgaaaaggagtggtgtgcatttgcatgaatttaacacatatacgagaataaattaaactgcaattaagttttagaagatacttcaaccaaagaagcgttgtggatatgataaataaccacttaatcaatatagaagtgattagagatactaacacacagatgaaataagagcaacagtaagggagaaaaaagacctggtgcttccaactgtactgaactagattctgaaccagaaccagtgctatgattaactgattccttggcacttgcaagcaatgatctgtattttccccactgtgcttttgcactctcagtcaccaaccactatttgagaatataccaagaacggatttcaaaacaagt

SEQ ID NO: 86559 - DNA, 8653 bp, Oryza sativa
ggggcaaagcaagagtgcggttaggaggcggcgggcggtggttgcagatccggcggcgaggggccgccagagacggggaagatggagggggcgggggcacctcgccatcgccgccatgaggagaaagagaggggggagggggctcgccgacgcagttgattctttccagccggcaaggcaggcggcggcacggtggggcggtggtggttgggaatcgcacgatggcgtgaggacgggaggagtggtggcagcgatctgaacggggaaggagaggagttagggttagggggtttgcacgaatcttaaaacatatctaatggtccaaaatttaaatgataggaggtgggattttctgtcacaagatatatagacaaccccttcttttatatgttcctcttaattttctccttctgttccttccgtgtgtagggtttcagccgccgaaaatcttgggaatccacagagaccgtgtcgatcgcgggcggcgatgagggacggtgagcgtgcggaggtcggggcggccggggtgaagaggaaggaggcgagcgcttcgtcggactcggagccggccgggaagaaggcgaagaagaagatcctcccgaagtggagggccaatgcgatcccgtgcgaggggggcgaggtcctgaggaggaagaaggaggcggtggcggccagcatgctgtggcgcacgccggatgtcccgggggcgagcgatgtctgggattcgatcgaggtcccggcggagatgctggagctgtggctggagaggcaaaaggcgaaggcggaggccgcggctgcgaagaagaagaggaaggtgttcaagtgcagggtgccgaatagcctcgtcgaagtgatgatcacgcagccctacaagtgcgttgatcacaatcgctctcaggaggagctggccgaacttgctgtgccacatcgccaaatctacatcctcaggaagttcatcgatgaaaagaagatgaactacgagcagaccctcatcgaccagtacgccacacagggctacgcagaggacgaggaggaggtcaccgatgacgatgacgacgaagatccagctaccctaacctaggtcaaatgtgtgctgatctgctcatcaatgactatatatggtgtaatcatcatcaatatcatctcctatgttatttgcaaccggtgattattcctgtatatgtaccttgctactggtattaattgctacttttgcaatcgatgaatcgatacatgtgttttatgcctgtattaaaatcactggttcacaatatttaatttgctgctgattagtcctagtgcatttgcaagatcctggaaggttgtgcgttgtgccaaaggaacggctttgatagcttcagggtctatctctattcttttgcgaccacaattaaagttaagcttatttttcacaccttctatcccaccattctgtccttcccgccacaccctctgcacaactctaactggcacatcaaactgcagtgcaactgccttggagactccatggtgcatcacaggaggatgtgtgcatgctagcaatttcagatatatggcgatcttcaagtcatccggatagaaccttctctttttcacagtcccacctgcaaatgacaaagaaaaatcaatagtgaaattgggaatacggtagtgtagcaatccatacaaatactgaaaaaaaacagtttaattctgaaaacatatgcaatccatacaaatattgagtctgtaactctgttgctaatattttcaggttggtactagaagtaattcataaagacttgacatgatatatatgtctgtggtaggtggaagctaaattcatgattgaaggatagggttgtttaatttcatgattgaagctaaattcatgattgaagggtatatatgaccgtggtaagctaaatacatactgttttcagatttttgcagacaagatgttttctaacctacaggagtcggcgaacagatgttttgcaatgataaaactatactcattgaactataagcgctgaacagatcatgtaggcagagagctaggcaaaaacagaaactaaaaacaaaagctatctggtggcagtacctccatctccggcagcggcatctccttcgcctccatcttgggcggcagtacctccgtctccggcggcagcacctccgtctccggcggcagcatctccttcgcctccggcagcatcagcatctacgatagcaaactgattcaaaatcaaactataggttattaggttcctaaaccaaaaacaatggcacatagataagtaccttcatctgcatcagcccacaccatgtcataatcaaggtcatgagccggcccaatccaatcgccaatggcatcccaatctatgggaggctcaagattgaggtctaacaattgtgccgccgccattgatcatctacagctttgtgtgtggtagaggcaaggaggagaagatttgaaaactgaactcgttggtgcatgccgtcgtcaaatcgctgcttatatagggccattgaacctgtgaagttcaatttttgaattttgcccgggcataaccccatccgttttcagcgagcgatcgcgagtaggcgagcgaaaaattggcgtggcaaaaaattatttcgcgcgatcgcgagcgctgctaatccgaacggttaggcgaaggattttgcggagccgaagcgtcacgctcgcatgcacccagctttaattgtgggccgagccatgcaggccttggatagctgataagagcctgggcttatctttcttagtctgtgtgtcaagctaaaatatgatgatcaaaaatagatggagggagtagtattcttactagtagttgattgatatccccaatctcgatgtttcactacttctgccgtaaccttgttttgtaatcatatgtatgttctatttcttcagttgttttggaatccaccggttctcatttcttggatcaatttggctttaccgtccttaagccgttgttacatgatatcagagggcttgtttggatcaatgccttaccaattttttgtagtgccaaaacataggcaagttttggcactaccaattatttggtagaataaatttggtattcatcttatttagtttgctatcaaaatatagccaagttgtgatactatagtgaagaaagttctagattgccaccaaatttggtataggcattaccaaaaagttggcatcaatccaaacaaacaaacggtgggtactatttagactacgaaaatattggtagagcaaattttggtagcaatccaaaactgtccagagtcttcctcgtcaaatgacataaagcattgcattgttccttcaccaatgcacacatggtacatctctgtgtgcattggtaccaaaaccagaatattccagagtccaagtgtccaacttgtatatgtagattgcggtcatccttatgtagtttgccctgcaaagcctgccgtcatgtccaggtattatattttctgtcaatgaaatgcatttttacattctatggaagggaattaactactcccatcctagaattgttgaaggaaatgatcaacagtggattggcaaaacagtggacaatcgccctctggagcaagctgcctggtaaatcttatctgtagcaacctcaagcttcgctcttctcttcggcgagctagacagtaacgaagactcgttcccacgaatgtaattgataactactagctaccgcatcactaggcgatgagaatcagcggactacttgcaatcttcattctagatatacctcttcattaagcatactttattatattttgttttcacaaagggattccggtaagatggatcagtttgctacaaagagtttacaaggtacatttgatatattcaatatttacatagtaggaacagtgggggtgcaaatgcctgacgaggctcattaagaaatagtgaggaacagggtcaaaagaagagaagtccgatcatgctcattcagaaattaggtgcccatgatttacagacctggccaacattgatgttcagcacaaacaaactagcagtgtaaactgtataggcagtacaagataatctcctttcactaatacagaaatatccttttgacagtgacctattcgatgaggttcgtaaaacaactcatctagtttggctaacatagacagtgcggtttcttgctggtaggcaaccaaaagagtgcagagggcatcgtgtcgtcagtttgccaggttcataaaagaccagcttgaagggcataactcccgcaccgtgttcccatcctcatccttgatttgaacatcagcatgatgcttgacaagcaactcagcaatatcttctcgctcacagaggacagcatagtgaagcgctgtttgtccttcattgtcctgaatataaaagggacatggacagtgttgctcattgatctcattataatgtttagactttttcagggaagcagtgcctatcaaaccaatatatatccactagtagtacctagccgtggcaatctcatatttattgacactattatatggccacaatgaatagcaactttttattcaatgtagtacataatgtaatcccaatgaaaatgccacgccaagatatattaccagcttcttgctccaattacatactcaccaactttatcagcgcgtgaattctactagaatgcactgagtgaagcattaaaggtagagtcaagtacctgagcattcacgtcagcatttgcattgacaagaatctcaacagaatttagatggccacggtcgacagcccaatgcagtggagttctgccttcactatctgaaaccatcataaatgaaactatgcttagatgagctatgctaagcctaagctacaaagagaacataatggtgaacagttcagaacacaaacctctcatgttgacttctacaccagcagccagatgcttcgctatgtcatcaattgctccttcccttgctgaaacatggatatcgccaagttcactgcagttacagataagtttgttgcaatcatggaaacactgtcatgtaactagatgactgaataaataatgcttaatagcaccaacatggagataattagttgcatacttcatgaaataattaatcatgtcattgttatttgctatgatttatcagccataagagacgatgcccaaatacaaacctaactgaacttgaatcaaggccgttttaacacataataataagaccaaaggtacaggatatacttcgtgtcgaaaacttacgagtcatttccctgatcttcctcctcatacattaaactgctaaatacaggtcccattggtcccttcgaacttgaagcagatactgtggtatcttcatctttccttttctgaaatcatgtaaatcagattatcaaataagccaatatagtgatgggatcccaactagcacaaattgagcggtgttttttttttcaggaatcatgtaaagcagactataaaataagccaatacagtgatgggatcccaagtagcaaaatacgaacagtacaagaggacataagagaattaccgtgctcgaacccatgctccagttagggaatagctcatccacaactgtgatgtacttctgcatagcttcttctgtcggcatagcacccaatttatgccaagcattccttggatattgacaccatatgaaaattaggatacttgtaaactagattaagtctttaaaattgacagagatagacagcgcaaaagacaaacagtatgatgttaataaaagttagctgcaaacagtagatatcttaattcagactccagtgccaaattcaaaagggtaaattcaaaaccaccaaaggaagtcaggaaacaataaatcaaacaacataatgcaaaagtaagttgaattgcagcatctgactgaggaatgctactatttgtgagatcatcgagctaccaggagatttcacttccaatgaaccaaacctgtaaacctagaggcaataacaatgagttaagtttctaacaagaatcatagctacaagattaacacacaggaatttatgagtctcctctggtcagtgcaaagcacaaaaaacctaccaccagatttcgtgatcagcaattctagcagtaactgaacctaaacttagataacgataaatttcgatccatttccctaaaccctcgaactgaaacagtgggggttaagcggagcccgactctaacagatgcttgaactaaatccagaagagaaaaaagatcagggaggcagggggatcgaatctaccacttggcgcgggccttgagcttgagggcggacggctgcggcgcggtgcagggcccctcggtggcgatcttgtagagcccatagagctgaagctgggcttgctcggggacgctcgtgccagacgcagcggaggcggcgacgaacgcggaggcggcgctgaactcctcgtcgagctccgtgctctccacgccctcccagtcgctgtcgctgtcgctgccgctgccgtcgctggtgtccccatggccgccgtcgagggaggccggaggtggggccggggcggcgggggtgtccgcggcggagggggaggtcggcgtggagcgggtgattcggaggttgtcctccttgaaggcgatgaccgtggagatgagcttggcgacgaggaaggcgaagaggaggccgattaccgccgcctgggcaagctcctgccagtcgccgcccatggccgacgccgacgccgacgagtcgccggggcgagatgggatgcgccgcggatggaggcggcggcggagaagagaagagagaagaggacttgggtgatattttgtcgagggccccttgcgcttttcgtttatagaaattttggtaaaaatattcccaattgtgggcttagaatttggtaattggacgcctaatcatgggctctcgtcatggttgaaattagaaagatccaacaaatatctgccaaaagaactggatcactaatcacttccacttgagatcacacacgagtgaatatattttggtgttttttttaattttcaacgtaaaccttaaagatggtgatgagtggtgaatcctaaaacattgaggtagatggatttttgttactttcccaaccttacatcaaatagaaaaaaagtcttttgaagtgaggtggaaatgatggcaaatataatgtgaccctaagaaattataacgacggtagttttattttaatttttgaaactttagagtgtatggcgtggttctcttattcaattttccgttgcagtgcacagtcattcagctggtagatgaaacatcttgagcttccatatatttattgatacagatatataacctgtttatttttaacttttgtttggttcaacatgaacaaatatctttgcaaaatcctattagcatttatggatccatagcttttttgtatgtttggatcggcagcacgaacagacgacctcactccacaaaattcaacgcaagttaaccatagcctataataatttcatcataagtccatttttagccaagtattatccaaatagccacctcttgcttcatgtaaatttgcagctcttataacctgtcaagagaaaaaaaaatcatgtaccactagtaataaataaaaaaaaggacatttaaacttaattaatgaaactacactattattgttattaagtagaagataaattaatatactccatccattttatattataagtcactttgacatttcttctagtcaaacatttttaagtttgatcatgtttataaaaaaaatagtttttcaataaaaataaacatattatcgagatatattcaatgttagacttaataaaactaatttgatgtcgtagatattgctagatttttttataaattttaggaaaaaggtcaaaacgtcttgggatagtacttactaggatcgacggttgtgataacgccggtctggccgaagtcacagtcaaactcatgctggccgttggattgaaagtaaagattcatcgcgaatgctgcgtgcgcctgcacgttgttgggatcgtagcacgaaccccccgcccggatcgcgccacagtcgatgccaccttgtccgcacacgaagtcgatgttcacctggagcgccacctcgtccgccgccggcttcggcacgcaccaccgccgccgcccatcctccgccggcgccagcgccggcgccggcgccggcgtgaccttcgtcccgacgatctcctgcggggcggtgaggatgccggcgtcgtagaccggcgtcatgtcggcgtggtagaggccaaagttgcgctcggacaccgggccgggcttgaggttctcgtcaaacagggagaagatggagagctcgaaggtgcggttcggcatgagcggcgtgcccacgccggagccgaggtggcggatggcgttcttgttgtagtccctggcgaggtcggcgccggcgccgacctcccagtactcgccggcggacggccacccggtcccggacaccacgacgtcgacgtcgccgaacccgagccgccgcatcgcggagtggacggcgtcgagctgcgcgtcgagcatgttggcgtagagcaggccgtggcgttgtccgtgacgccgtcgttcacccggaacagcacgttgtcgagggtgtcgttggtgagcccgccgtaaaacgggt

SEQ ID NO: 86560 - DNA, 3659 bp, Oryza sativa
agatttcataatcctcaagaagctcacgtacagtgtaatgtagcatactgtacttcgtatacagggcagcgtatacgtacgtacgtgcctttataagggggctcttccccaaggtagatctctcgtctctcctcttgcatcttcttccacaccgtctctgtctcctgcgccgcgccgctcaccaccgctccaccgccatggcctcccatagcaagcgtgacaggaactgagaatgcagagttttgaaaagaaattgttcagttgaagttaagttctgagaagaagaggagataaggagatggacggcccatattacacgataccggttcacaggagaagttaatgaagatccaagggatcacactgatcgaagtagtagctgtagctgtccgttgccgtactgtgctacgtcattttttgtgtgtgcttgtaatggcgtaagaatataagccgcttctgaatctgaaggatgtatcgaacaattcaaaccctaattttatctactcattcttgcggcgcacagttctttcctttcccttttatcttttccagatatgatcccaataggtagctacatggctaaatttctctgaatttctgttgaatcagggctcaaatcggccgggtcttgacaatctggtatcagagcaaggcgattcttggccagcttctggatctgggtggtgctaagccggtgagggttggagggacaagtaccctctgtaaaattccgcagccaggctaaggagctcaatccagaagcagagttgtgagaagagcaatgaaggttggggagggcttcggtttctctctgtaaaatcccccacttgttgctgctcaaagatggcgaggggaagaaatttggaacctgtgttggaggaggcggatccggcatgggctggagatgtaggggagttgaggcaagctgtggcagaactccaggagaagtttgaggaggagaacaaggcgatccatgagcagattcaaaatcaagctatgcaggctcaagttcatcgagatgagataatgcaatccatgaagatgattcaggagatgttgagttctacggccagttgctctcggaaggaagctaaggtgaagcagaggtggtaaagatgccgggggctactcagtcctcaacacaaaatcctcaaagaagtgaaggtatgatgatgtttccatccactccagggagggtggacttaaggggagtcacttgtcccatgactcaacccgatctatttactactgctcacactactagtattggtagccacataccccaagttcccacttttactgcccctgagatcaatacatcagtgttcttcccaactcataccactccacctcatactagttttggaactcagtactaccatccaaatgctcacatgatgaattatcacaattccccatactttttcccacagtatgctcctttccaaccaccttgggtctacacacaaccagggccttacacttaggtagataatccaccacatgggcaacatgataatgtgacacatgagcaacaaaggcacagaggtaggaatcaatatgcagaggaggtgaagaaaggacccaagaagtttaattttcctgagttcaatggggaacatcctgaagcttggattagaaaggcaaacaaatattttgcacttactaagacccctgaagaagagaaggtgctagtagctgaggtatacatcactagtaaggctgatcagtggagtgatagctatgacattcctactgaaaccctatcttggccagaattctgcactatagtttgtaagaggtttgctgctaagtctaaggtggagataattgacatcttcagaaacctaaagcaatatggatctgtggagtcctatattgacaagtttgaagagattgtgccattggtcaagagaaataattccagcttgaatgaggagtatttcctggattatttcatctctgggttaaaagatcatattaagaggccactcaaatccatgggaattcatttgttagtgcaagcttatgagcatgctaggaattatgacagtggaccttagttcagtaaaggcagcagtggactgcaaaaacctgagaagaagggtgaatgggttggaaataaaaagggaaaggatgataaaaatgagactggtggaaaaattaagtggaatggcaaatgctttagatgccaagaaccttgggttcctgggcatgggaaagtgtgtaaggccaacaagcaggtgtatctggtgactatggaggaggaagaaactgaaaatgaaggaggatatggtgaaattgttgacactgaagctaaattcgatacaccacctgacagcccaagaaacaaaatcaaaaaaggagaagaaaaggagtaagctatgcatcctatcggtgaaggagatatgggagccacaaccttgaccttaaaggtcagaattggcaaggtgacagccacagccttggtggatagtggcaacactactacattcattacaccatccttggtgagaagggctaatctggagatagaaaactatgaaccaattccagtgaaggtagctaatggggaaattttgtatacaagggcacattgtcctcaacatgcataccatatccaagaggaagaatttgcatctacattcagggtgttggaaatcagaggatatgacatcatctttggatgtgattggattcaccagttcagccctgtatctcttaatcttaaaactaaagagttgactatgagtaaggatggacacaccttggtgctctcagatgtgtcagttcctgtaaggaatttcttgattagcatgcacaagctggagaaatgggtagatcaaggaatggctggaacagtattgcacttaaaaccagttcaggaggatgaagggagaaaaggggaaactcctgaagaggttaatgaggtgcttaaggagtatggtgatgtatttaaggagccaaaacaattacctcctgctagggactgtgatcacacaataccattgatccctggagctaaaccagtgaatgtgagaccttaccgtctacctcatcatcagaaaaatgcaatggaggaattcatgaagcagttgattacttccaatactatccaacccagtatgagtccttactcctcaccagccattttagtgaagaagaacgatgggtcttggaggatgtgcattgattacagacaattgaactctaacactataaaaaataagtacccaattccagtaattgaggacttacttgatgagctccagggggccaagtatttctctaagattgatttgaggtcggggtatcaccaaatcaggatgaaggtaaatgacatacccaaaactgcattcagggcctgttcactttgatgacattttcaaccttaccaagttttggtaaagttgctaaaaaaatggctacattagtttgctgccaaattttggtaactatataagaaatcctgccaaaattttggcaagttaccaagcattgctaaaatttggtaagtttttttttgcatcaaagtgaacaggccctcagtacacatgtggggcactttgaatttgtggtcatgccattcaggcttactaatgcaccagctatattccaggccctaatgaacaaaataatgtgaagtaccatgtaaaaaa

SEQ ID NO: 86561 - DNA, 1988 bp, Oryza sativa
agtcaacggcgtcaaacatttcgaaacggagggagtagtattttcctctgttcagacttcagagccgatggtggagccgcatccaagaaaaaggggttcggggtcgacgagggggagggtgctccggtggtcgacaggctcggcgaaggggtggacaaggacagcggcgtcgcggcgaagccggtgagggcggcgccgaggcgaggcgacgtcccgagcggcggtgacagtggagagagagagagagagagaggagtggcgggagctcggttccgagcgggtggcggcgtcccgagcggcggcgacggcggagagagagaggagcggcgcgagctcggttccgagggggtggtggcgtcccaagcggcagcgacgggcgacctagcacgccggcaacggcggagagagagaggagcagcgagagctcggcggcgacgagcgacggcggcggcatggattcgggggccacacggcctccgcacccctgggtcatcgtcgaggccaccgttgccgaggtcgtcgtcgcaagccgctgccaccgccgtcgtctacgccgtctccccgaatccacgccgcccgccgttgcccccacgttgtctccgatggtgtggagtgagtggagagagaggggagaagaaaagaaaaggtagagaggaggggtgaagaagaagggtaaggtggctgacatatgggaccctctgtcatagagttaaaatggagagcgtagatggagaggctgttgaagtaggtaaggagtttgacttgctaaatcagatagagagttggctatgtgggtgtttagagagtctaatttggagggactgttggagatgctcaccggccgtagtatccgtccccaatgcccaattccccccaccattgccgactctcttcctcgcttccggccgacggccgcacttcccatctccgcctcccctagttggctactcctcccagcctgcctccgatccaccggatggcgtgctcgtcgctccaggccgccggcggcaactatggtccatggactgtggcagctcgacctcagtcagatccatggcgaggtggccctcaacttcaggcggtcggcattgctccaccttgcagatccaagtgctgtggaccactgcttttttcttccctatggagcacccgttccttgtacaaggggtgctgacatcatgcgaggtcattcctcgttcgtcttctccaccacgctgtgcataagagtctacatgaatggtatccgatgcaaggccactcgttgtcgcctgggcaacgcgtcactgggaaaatgtcaaaaaggccgtggcagatgaaaacgatctggatggagatgtgatgccgattcatcagtttttcaggctttgaatcatgaaactagctgcaattttcctatacgtgaaggactggattggcaaaatgtggaaaattcatggcaggtgaaaacgatatggatggagatatgccgtaaatttttcccatttaagcccttttcgggacactccgaaccttcaattttttttagcaacactttttgtttgatcagtaacaccgacgtaacaaggtgccccccccccccccccccccgcctttgctctcttcgtgtttcatgccatacaattcgttggtcttatgtcaatctttacttattggatgctagcatgactatcgtgcgaacaattgataaacacttgggtagaattaagtgctatttttacttacacttcctcttcgtctttccaagatgatagctcgatcgcctgcctttctgggatgatagttcgcctttctttcttcttctttttttttctttcataatagacagataacaagcagctcgttttgcagtgaaatagcaatcgacttcaactgtcattgcaccgtatgtagtccagcttcatgccaatttgtcccaaaatatgctatttttcactcacttttttctctccaggaaacatgtttgtcccacatactgaggctgcaggaat

SEQ ID NO: 86562 - DNA, 1258 bp, Oryza sativa
gtttgttatgaagctggttatccgaacaaaatcgacgcgtttgcatgtgatttgctagttggatttgttatgaagctggttatccgaacaaaatctacgcgtttgcatgtcgcttggtcaggaatcgatatgtagagagggttacgacggcagaggatggtgtttttcgtcgaagttgctcgattctgcaacattgactagactcttctatattgttaatctagaaagacccagtgcaatgcaaacaatgggctcgggctgccgtcgtctaaaacgttgaaatggggaagctgcagggcagggcttactcttccatctcttctcttgtgtctctatccatcaacattgaacaaagttgtcctagacctagctattcttcctcgtgcgtgctatggcatgcaaattgcaaagtaaaaaaacaataaaattgaatgaatctatcatcatatggacacatgaggaattaccaagctatcaatctgtcatctgcactaattaaataattgacaacaaaagaatgaatgaatgagaaatagtgcaacaaaataaaacgtaggtcaagccatgagcatcatgaccctgaactcgtcaaaggagagcacgccgtcgccgttgaggtcgaacctgcagatcatggccctgcactcctccatctccagccgctgatgctctgaccccagccgcctcagcatccgccgcaggctcgccggcgtgatcaccgccgtctcctcctcctccgcgtacatgtcgaacgcctccctcaggcaccttaggctctcctccgctggctcctgcaactgatgagcagcagagagcctcatgaactcgtggtggtccagcaagccgtcgccgtcggtgtcggccgttgcgaggatcgccgccgcctcctcctcggaaacctcctccccgagcgccgccgccatgcagccccgcagctcggacgcggacaccttgccgtcgccgtccttgtcgaaggccgcgaacaccgacgaagctgacgatgccatggcactgtcagtgattatatgatatctaatctaaggagaggattaatctcggttgctcctggatcgacaatataatcagagttcgcaagtatatacgtatatatgtagtgagtctaatttgcgacttgtctctgctgcaacttactatcgaaatcatcggtcgatctgatgatagctatatactcctatatataagatgatagagatgatccagcaggcaatacttactaaggaagaggacagaaggttca

SEQ ID NO: 86563 - DNA, 1930 bp, Oryza sativa
gtgacactatagaatactcaagcttgtttcagtggaatacaaccagcctagacagaaatgtctgcactacgagatcctatgggaaagagagcctgactcagcacaggtgattaaagattcttggtccagttcgggtgagaaatcagacttgggggacataaatcggtctctcgcaaaagtcatggcggctttgcgttcctggagcaaaacaaaggtgaaaaatgtgggtagagaacttgcaaaggcaaggaagaagctgggggacttgattgcttcagatgctgataattcccaaattcgttttgccactgaccaaatgaatgaactgttatacaaagaggaaatgctttggcttcagtggtctagagtgaattggcacaaggaaggagataagaataccaaattttttcatagtagggcggtatggagagcaaaaaagaatagaatcacaaaactgaaagatttgcagggtactgtgcaccgtacgacaacagcaatggaatcaatggcaactgattatttccaggagatgtttgctgcagacccgaccttgaaccctgaatctgtcaccagattattccaagctaaggtaacggctgaaatgaatgacctgctctgtgcagacttcaaggatgaagagatcgctcaggctttgttccagattggaccgttgaaagctccgggtcctgacggtttccctgcccgcttttatcaacgaaattgggggatcattaaagaggacatcatcagtgcagttagtaagttctttcagactggatgtatgccagaaggagtcaataatacgactatagttctaattccaaaaattgagcaacctatggaattgaaggactttcggccaattagcttatgcaatgttctttacaaagttgtctccaagtgcctggttaacaggctcagaccgatgctcaatgaattggtatcagaggaacagagtgcttttgtccgaggccgaatgataacagataacgcgctcctagcctttgagtgttttcactatattcagaaaaacaggaaagctaacaaggcagcgtgtgcttatgacagggtggattggcgtttccttgatatggcaatgaatcggttgggtttcgctcaccgctgggttaactggataatgacttgcgtaaccacggtgagatattctgttaaattcaatggaacttttctacgatcatttgctccctctcgaggattaagacagggagaccccctgtcgccttttcttttcctgttcgtggcagatgggttatctcttttgttgaaggaaaaggtccaacaaggttctctgacccccccccccttagtatctgtcgcaatgcgccgggcatatcacaccttttgtttgccgatgacacccttctgttcttcaaagcaaatcaggcacatgcagcaacggtgaaagatgttgtaaacacttatgcgcagggaacgggccaattgatcaacccggctaaatgctcaattttgtgcgatgatgcttcccccatcgagatcactgaggtaataaaacagattctccagttagaaaagagcaactttgaagataaatatcttggttttcccaccccggaaggtagaatgaacaaggggagattgcagagcctacaaagtaaaatctggaagcggctgatccaatggggtgaaaaatttctctcttcgggtgggaaggaagttctggttaaggctgtaatccaggccattccggtctatgtaatgggcttatttaagctcccggattctgtgtgtgacgacctaacaaagctcaccaggaatttttggtagggctcggagaatggtagaagaaagactcactggagagtgtgggagtgcctgacaaaaccaaagttttgtggtgggctaggcttcagggattacagattgtttaatcaagctcttctcgctcgtc

SEQ ID NO: 86564 - DNA, 7235 bp, Oryza sativa
gctatttataggattcgtgcgaagagattggatcaaaaacaacgggatttggcgagagaaaaacgagggtttatccgagttcgccggaaaaacggagctcgaaaccgcgtcgaattcacgcgatatacaacgatattcaaaggggtttcttagggataaggtagaggagatcgaggggaatccgtttttgcaaccaattttggaaacggagcacaggatgcgacggattttgcgaaggaagcggcggcgcacgcacacggctcggctctgtacggctcggctggaggaggaagaaggtactgtagcgagggtagataaagtagacttttcctgggcttccttttccttacttgcttggcccgattgctagagggaagaaaactggacttcggctaagagagagggagaggagtgggctgaattcggcccaaacaaagaagaggaattttaattaactttttaatttaaataatttctgaaatgatctttcatttattaaaaatacttccaatgctcaaataattctggtaaaaatacagaaaatacttgggaatacaaagtatttaataaaattttatctagctcaagtttatgttcaaatttttcatagattttattcacacacttgctttaattattaaataaattctaaaaattcctttttcacaacaatttataatttagcgattttcagggtgtgacaaagtttcataactttcattgtcttcttgttgactaactatcacagctaaaatttaaattttcgagttagttaagtttttagttgttatgaagttttttcatcatagtttatcttcttccacccttagttttaaatcactagtaacacatataaaagttgggatttgctatatatgtgtctacattttttttggttttatctataaattatttttggtttgtttcttttagggcttattagcctacaactgaatcttgtcgattatgaaagtatggtgaaatatggcgcaaatggccatgcattttatgagattatttttttatgagagatcggtagaatatattcccttcgtttttttaatagatgacgttgttgacttttaaatgagtgtttgaccattcgtcttatccaaaatttttatgcaaatgtataagatataaatcaatgcttaaagtcaagcataatgaggtggagaattcgtatcattgggcttgtgggcatgtgactctttgttttttttgattgtatgctaaacttggatgtctttacttctgttttttcactgaatagtttctctatatgtcttgctgctacaggcgcccaacatcacttcatgactgtggtagggatagtgatgatgacgacttccgagacatggattatgatgtggtagctcttactaataacttgagccaggcattgcgatatgggatatatagcaatgatgatatggaagaggtgtgtgtgtgaatgattttgtttctatcgctttgatggtttgcgtcggtcaacatgtttctctgccagcacattttgttaggtttaatttgagaggattctatggtggataaaatatcatcctgttactcgtgctattgcattatctacttgagtgactcagcagctctaccatattccagatttgcagttccttacagccttactatactagatactaatgatgcttgtttcttgaatgcagaatcaagggacacttgaacatgatgatgaggtatatttaaggattctagtttacccccatttattgcttttttgttcttttcacctggttttatgttcaatttgattaaattttcagtacaactccttaacgtttgcttcaatcagccatgtaaaaagaacggaatgttgcatgcggaaaatagtgtctataaccatatttgttgaagctgtacttctgacagagtggatttccattgttttctcctttcaggatgtctattttgatgatgaatcagcagaggtcgtaatatgttctctgcgactgggagatgaccaagatgggtaatttgtgatcttataatatactttggtatgcttgtttttttttttgcccttgggctaattatgcatgtatgtatttaatagcagataggctaacctttggaatcctattttcagaaagaaatacatataccaatatgaattcattctaggattaactagatacacacaattcgtgagagcacttttctaatgtatatatgctaacctttaccataggcttaagacatagttatactaatcttggtttatttaataattgaaaattacatatgtactcgtagtatgtgctatgaattactcatataaatttaaattcagtacttaattttaaaattgttttatctatttttaatacttataggcactttttaataacggataaagttaaatactactcaggatttcagcgcatgcctatattttaaacctattaagaggtcagcgtaatgtatagtgacgctgagttccttttacatggctaatttgtgccaagtcgggtagtgctgagacgttttagttcagcgtcatcagggttagcgctgaggtcacggtctatttttttaaattagtttgacatggtttatttttaaaatttttatagaaggattaatttgtcaaaattacagtgtaaacagaagtatccaaatcaatacgtatagtgatagaccaatcttttcctcttttctttcttcccacgtgggcctacttagtccattcaatcgtgcatggaaccttgcccatgatgctgcatgagccatgcacaactgtgtataggcgggttgcatagcatcgtacacgcgtcagaaaagcattatgccacctagaccaacaggcagctggcaaaacaaccatcatgagaataatagatagattattattttgtttgctctccgtccagcagtatgctacctgcgtattagagggattattaattgagtacctatatttatgtcgccatatttttcatgaaaaaatagtcaacatgtatttacattgtaagtctttaaattacatatgtaattttagtgtatttacaatgtaagtcccaaaattacatatcaagtctctaaattacatatgtaattttctaattttacaatgtaatttaactttgcaaccggttgtagacataatggaggaccgtgtacacaatataggagaagaaaaagcaaatttattatcaattgtacgagtccacgaaatgcaaatgcaaatgagcacataagagttggagcttgataaggtgtcccaagttagttacgctttcggatagctttgatctgacacaaaaaaatatctgactgtagtcaggccccaaatatgtcgccacacgtgaagcaaaaccttattaattttgttgacataaatgaacgaacaactaataagcatactgtaatagtgtcaatcggttaattaattagcttgctagcttcaggggtgcaaatattatttgttttttcacggtttccacaaattcccgatgttgttcttgttcctttttctttggctaaaatttaagttccaaaaaaagctgtgtctatgctaattttgatcagaagtcaaaaaaggtcatcttttttaccaagggactactagatggatatcccaataacttccaaaggctctacgatttgagataattcaatatgcaacttcttcccaagggctgctctactatttggaaataatttaacatgaacttcgcaagggcgctacggttttaagataattcattaaattgataactgcattatgtagtttgatatgcgtacatgtaatcctcaagatatctctacgtataactaatctcgcatatcctgcccattcaaaattagatctcattttaactctcaattaataatcgattaagctaaaaataccttgacaaatttttctgttaagatttgttgaattttcagccgttaatctaacctttagatccgtgacctctttgtgtcagcgctcccacaaaacgcttaacctgcgagtgctggacctggactacctggtactgtacatccatgcatacgactgattatctttgtcactcactaattaaatagtttaaagttgttgttaaacgtctggtgtactgtttcctgtcaacttcactttgcccaaaagcgtacaggggatgaaagcctggtaatgatgagagagagagagaggaggtaagttgaggaaaaaatacagtgtaaatatagtacttttagggtgtaatttgttgtaattacattgtgactcgttgtaaattacaatgtaatttcttttagatttgtatgtaatttatttttttccctatttttcactattacactttaataataaattatgtgttatgatacatatgataagttatacatgctatttccatatgtgtattaggtaattattaaaaatctgaggtgtttggtttaaaagtctgtcgggtgatctataaattcattattactaataacaggtacacacacaaacacaaatattatagcggtggataagagctctatcgatgaggctctcctccatggcaaacatgagcaagaagatctatgggatgatgaggtggtttatgacgtggagcagcagtagatcctcggctcgttctgcatgactggcgcttccttcaggagaagctgcctcaacctcagcaacgtgatctgcagcatcgggatgctctacgtgtcgtacgtgctatcgcagggcaggtggcccagcctagtgctcttcaccatggtcggcgccatctgtttccacaccggcaacctcaacgaccgctgcatgtgctgatcgcggcgtacggagatactccttcggcggctatggccggacggccatcggcctcgtcatgtacgttgagctctacctcgttgccatcagctttctcatcctcgaggccgacaacctcaacaagctccttccggcacggtggtggagatcctagtgtactaggtgcacgggaagcaattgttcgtactcgcgacggccactatcatcctcccgacgacgtggctcaagaacctcagcatgctcgcctatgtctagcggctgggctcgtctcgtcggtggcgctgacagtgtcgctgctctgggccggcgtggtcgacaagggcttccacgtggctcttgagtctgagcgggttgcccactgccctcagcctctacttcctctgcttcgcaggccatggtttcttcccaaccgtctaattctcgatgaagtccaagaaagattttcctaaggtatactttttaaaatgtatttatgtgttgtacttgataataagtttgctaaaatttatgataacaattagcaatctaaatttagaattatggttaatgaaaatttaaaagtcaatggtggaataaaattagcaataggtttaagaacatgaacattttgtttttttattacatgcatgcatggaagacatgcacactcataattgtttttgagaactcgtacatcactaatcatgcacacctcttaatcatcatcgttgctacattatcatcatactcaccattgcatggccctcatatattttgttggccctcatataagtttattttgatcatccaattaaaagtaagaattaggatatgacgaaatcaacattaaaatcatttattaaaataagttgtactatcccaaattaaaagatgttgtactacttataaattttgtaatgttaatttatagtgataaggaatggcgaatgcaatacggaattaatggcaagtgcaatattaacaatttagcatatatatatattgcataatgccataaatttagggtaatgttgggttggcctttcgaccagtttagcatgtgcagtgatgtggaggcatactgtgctacattacagcatatcaccccagcggaataaattggtgactagcgtggaggtgtattgttctatattacagcctatcaccccagcagaataaactggtgacttggaggcgattagagtcgtctctcaactatatttggttacctctcatccacccatgtaaaggcaatgtagcttaaagataaagctaatcatgagccgcctaatatggtttcatttatatgttaaaacctgaagttagaagatgcgtctagcacttaaaataaaagaattatattaaccatttgaattagagtttacgaaatttttttaaagtaattttatgcgtagtccaatacaattttagataaatcaaaaggtagcgtatctaaatttggaagatgtgttggatcataaacttttatatgccaagttaaaatagagatctattatgttgtatatcttcttgtactaagtttagactcaaccaacgtgtataagaattgttagggataagatgcaaaagtggtaggacattgactattgctcaattaactcatggaagtttcttgaacaatcttggaccattctccattcttttactgatacttatccatgatctaacggcatatattatatctactgttgcattcaattgtccatatatttagagatttgacaaccaatgataattgatcattggattatcagttcgaattatcataatttggtttatgaaaccatggcgataatgagaatggatcagtactccaataatgttctattcctctccaattaatgtgcaggttttggtgatctcttcagtgctgtgcagtctcaactacgcagtgacaacaatgttgggttatctgatctatggtgaagttgtgcaggcgccggtgacactgaacttacccacggggaagctgtacaccaggatcgccatcctgacgacgctgatcaccccgctagcgaagtacgtgctcgtgatctagcccatcacaacagtgaatgaggagaaattgtcgacgacaacggtggcggcagcggacgtcgagcacaacgggcttaccagggtgctcaccagcacagccgtcgttgtcagcacggtggtgctggcgtgcacggtacccttcttcagctacctcatgccgttcaacgtatcttcgctgaacttcaccattgtcgtgttgttcccatgcctgagctacctcaagatctacatgcctcgatttggagttggccgcttcgaggtggcggcgatcgtcggaatactagtcatcggagtatgcatcgccttcgttggcacctacacctcccttcaccagattatatgcacagtttgattgtgcatttgtgggtaaggttgtagttttggtagtgattaaatatgt

SEQ ID NO: 86565 - DNA, 8376 bp, Oryza sativa
ttgcgagttaagcgtttcgtgggagtgctgacaccaagaggtcacggatctcaaggttagagtaacggctgaaaatttgacaaatcttaacggaaaaatttgtcgagatatttttagcttaatcgattattaattgagagttgagatgagatctaattttgaatgggcaggatatgtgagatttgtacgtagagatatcttgaggattacgtgtacgcaaatcaaactatagaatgcagttatcaatttaatgaattatctaaaaaccatagtgccattgggaagttcgtgttgaattattttcaaatagtagagcggcccttgggaagaagttgcatattgaattatctcaaaccgtagagcctttggaagttactgggatatccatctagtaatctggtccgttggtaaaaatgatggcattttttgacttctgatcaaaattagcatagacagctttttctggaacttttaattttagccaaagaaaaaggaacaagaacaacatcggaaatttgtggaaaccgtgagaaaacaactaatatttgcaccactgaagctagcatgctaattaattaaccgattgacactattacagtatgcttattagctgttcattcatatgtgtcaacaaaattaatacagttttgctacatgtgtggcaacatatttgggggctgattacaattagattttttttgtcagatcaaagctatccgaaagcgtaactaactgggacacctgatcaagcttcaactcttatgtgctcatttgcacttcgtggactcgtacaattgataataaattcgctttttcttctcttatattgtgtccacggttcaccattatgtccacaatcggttgcaaagttaaattacatttaaaaaaacaaaaattacatatgtaattttgggacttacattgtaaatacactaaaattacatatttaatttacagacttacaatgtaaatacatgttgactattttttcataaaaaatatggtagcataaatataggtgctctgaattagtaatccctctaacatatgggtagcatactgctggactgagggagcaaacaaaataataatctatctattattctcatgctggttgttctgccaactgcctattggtccaggtggcacaatgcttttttgatgcgtgtatgacgctgcctatacaccccgcctatacacggttgcgcatgcctcatgcaatatcatgggccaggtgccatgcatgcacgattgaatggactaggtaggaagaaagaaaagaggaaaatattggtctatcattgtacgcattgatttggctacttctgtttacgccgtagttttgacacattaatccttctataaaaactttaaaaataaaccatgtcaaaaactacttaaaaaaatagaccgtgacctcagcgccaaccctgatgacactaaactaaaacatctcaacaccactcgacgtggcacaaattagctatgtaaaaggaactgaacgtcactatacattacactgacctcttaataggttttaaatatatggcatgcgctgaaatcctgagtagtatttaactttatctgttttatcaaaaaagtacctataagtaataaaaatagacaaaacaattttaaaattaagtagtgaatttaaatttatacgagtaattcttagcacatactacgagtatatatgtaattttcaattattaataaataaataaaccaatattagtattactatgtcttaagcatatgataaaggttagcatatatactttagaaaagtgctctcacgaattgtgtgcatctagttaaacctagaatgaattcatattggtatatgtatttcttgctgaaaataggataccaaaggttagcacatatctgcttttaaatacataaacgcataattagcccaagggcaaaaaaaaaaagaggataccaaagtaagttttaaggtcatctcccagtcgcagagaacatattacgacctctgctgattcatcatcaaaatagacatcctaaaaggagaaaacaatggaaatccactcagtgagaagtacaatttcaacaaatatggttctagacactattatccgcatgcaacattccattctttttacatggttgattgaaacaaacgtttaggaactgtactaaaaattttaattaaattgaactaaaaaacaggtgaaaagaacaaaaaaaaagcattaaataggggtaaactagcatccttaaatatacctcatcatcccgttcaagtgtcccttgattctgcactcaagaaacaatcatgtatcattagtatctagcacactaaggctgtaaggaactacaaatccggaacatggttagacctggtgagtcgttcaagtagataatgtaatagcatgggtaacaggatgatattttatccaccatagaatcctctcaaattaaacctaacaaaatgtgctggcagagaaacatgttgactgatgcaaaccatcaaagcaatagaaacaaaatcattcacacatacacctcttccatatcatcattgttatatatcacatatcggaatgcctggctcaagttattagcaagagctgccacatcataatccctgtctcggaaatcatcatcatcactatccctaccatggtcatgaagtgatgttgggtgcctgcagcaacaagacatatagagaaactattcagtgaaaaaacagaagcaaagacatccaaggttagcatgccatcaaaaaaaaaaaacaaagagtcacatacccacaagtccaatgataagaactctccacctcattacgcttgactttaagaatatcatttatatattatatatttgcataaaagttttggatgaagtgaatggtgaaacactcatttaaaagtcaatggcgtcatctattaaaaaactgagggaatatattctaccgatctctcataaaaaaataatctcataaaatgcatggccatttgcaccatatttcaccatactttcagaatcgacaagattcagttctaggctaataagccctgaacaaaacaaaccatagataaaaccaaaaaaaaaaaattgtagacacacatatagcaaatcccaacttttatgcgtgttactagtgatttaaaactaagggtagaagaagataaattatgatggaaaaacttcagaatatattaaaactgaactaatttcaaaacttaaattttagctgcgatagttagtcaacaagaaggcaatgaaagttatgaaacttccttagtgataatacacaaatgcattccaggagtactcatgcaatatatagccactcagttgattcttaacactctgtataacatatatgttgttttttcaggaaaaaaaagtaaaaaaagaatttgaaacatatttaatcactaccaaaacctacaaccttacccacaaatgcacaatcaaactgtgcatataatctggtgaagggaggtgtaggtgccaacgaaggcgatgcatactccgatgactagtattccgacgatcgccgccacctcgaagcggccaactccaaatcgaggcatgtagatcttgaggtagctcaggcatgggaacaacacgacaatggtgaagttcagcgaagatacgttgaacggcatgaggtagctgaagaagggtaccgtgcacgccagcaccaccgtgctgacaacgacggctgtgctggtgagcaccctggtaagcccgttgtgctcgacgtccgctgccgccaccgttgtcgtcgacaatttctcctcattcactgttgtgatgggctagatcacgagcacgtacttcgctagcggggtgatcagcgtcgtcaagatggcgatcttggtgtacagcttccccgtgggtaagttcagtgtcaccttcacctgcacatcctcaccatagctcagatatcccaacactgttgtcactgtagagttgagactgcacatcaccgaagagattagcaaaacctgcacattaattggagaggaatagaacattattggagaggaatagaacattattggagtactgttccattatcatcatcgtcatggtttcataaaccaaattatgataactggaactgataatccaatgatcaattatcaattggttgccaaatctctctaagtgaaaggtaaaacttaaaatgcaacatcattgagctacatcatctgaagatatgtaccattgaatgcaacggttgatataatatccactgttagatcctggataagtatcagcaaaagaatggtaaaaggtccaagattgttcaagaaacttccatgagttaattgtgcaatagtcaatgccctaccacttttgcatcttatacctaacaattctcatagctgttggctgagtcaaaacttagtacaagaatatatacaacacaacacaatagatctatcttttaactcggcattaaaaattttatgatgcaacagatcttccaaatttagatacgctaccttttaatttatctaaaattgtattggactacgcattaaattacttaaaatttttttcataaactatgtattcaaatggctaatataattatttcattttaagtgctagacgcatcttccaactttaggttttagcatataaattaaaccgtattaggcggctcttgattagctttatctttaagctacattgcttttacctgggtggatgagaggtaaccaaatcccaacttgagaggcagccctaatcgctaccattcaccagtttattccgctggggtaataggctttaatatagcatagtacgcctccacgctagttaccagtttattccactggtgtgataggttgtattgtagcacagtacgcctccacatcaccgcacacgtcaaactagtcgaaaggctaacgcgacattaccctaaatttacatcattatgcaaaaaaatatattaatgctaaattgtgaatattgcacttgccattccatatatctgaaattaacattacaaaatttataagtagtacaacatcattttttagcgatagtacaacttattttaataaatgattttaatgttgatttcgtatgatcctaattcttattagacgaccaaaataaacttattagctcgaattttatctacatgatgtatatgtagacctgctatatgatgggagcgccaacaaagtatatgagagccatgcaatgctgagtatgatgagaacatagcagcgatgatgattaagaggtgtgcatgattagtgatgtacgagttctaaaaataattatgagtgtgcgcgtcttccatgcatacatgtaataaaaaagtaatttgtttgtattcttactaaacctggtgctaatttaataccaccattgacttttaaattttcattaaccataattctaaatttacattgttaattgttatcacaaattgtagcaaacttactatcaagtacaacacataaatacattttaaaagtgtataggaattatgagtgtgcgcgtcttccatgcatacatgtaacaaagaaacaatttgtttgtattcttgctaaacctgttgctaatttaataccaccattgacttttaaattttcattaaccataattctaaatttacattcttaattgttatcacaaattttagcaaacttactatcaagtacaacacataaatacattttaaaagtgtataggaaaatccttcttagacttcattgagcagtaaacggtcgggaagacgccatagccggcgaagcagacgaagtagaggctgagggcagtgggcaacccgctcagcgcaaccgacaaggccagcccgaccgccgagataggcaagcacgctgaggttcttgagccacgtcgtcgggaggatgacagtggccgccgcgagcacgaatagctgcttcccatgcacctggtaccctaggatctccaccaccgtgccggggaggagcttgtcgaggttgtcgcccaagaggatgacgaagctgatggcgacaagctagagctcgacgtacatgatgaggccgatggccgtcaggccatagccgctgaaggtgaggtggccgatgtccagtagctcagcgatcgacgcgcatgcagcggtccatgaggttgatggtgtagaagcatatagcttggtgaagagcgccaggctaagccacctgccctgcgagggtagatcagcgatcgacgcgcatgcagcggtccatgaggttgccggtgtagaagcagatggcttggtgaagccacctgccctgcgataccagcatggagagccacatgccctgagatagcgcgtacagcacggagagcatccttacgcttgagggagcatgttccttacgctggagggagcacgtgcgctgtacgcgatcgtccctagatcttcttgctcatgtttaccatagaagggagcctcgtcgatagggctcttatccgccgccataatctcatgttccagacggttgacgtttgaccgcacggaaaaaattgtttctctactagtgtactaacggcttctataattagtttttttctactagtgtacgaacggcttctataattagtttttttattagtgcccaaacaactcatgcaataccctatataatatccgatgtgacgtgccaaagctttatacccatggatctaaacaccccctatgaactgtaaatatgggatggatgtgctatttatttatagcctagctattatttgtaattttttccgacatgacgtgggtcagttcgaatggaacacgtcctttttgataaaaaagaaatctctctgcactcctcatacactacacaattgattttcgaaacgatttccacatcagccttctgttatgttacattactactaggttccatcaaaatttgaacaattttatatgttcttgtacagctctttcaaagagggccaattgatcttcatgatcactttagcttacgctgctttctactactcgactcccctggctgcacgttgcacctgtgcttagtgtaggggctctcctgatctccggtgggctcgaagtagagcttccggtgcagcctcgccgtggggctctcctcttcctcttcctgctcgcgtgggtcgtagtagaggtcgccgacgttgatgctccggtggcggcgctcctcgaactgcacgctcgccgccgcctccagcttcagtttggagaggttctccatggccgccatcctgatgccgtctatggagttcgccgtgttgcggttgcggtgcaggtgcttcgtctccaacttgtagtggagcttgtactcctggttcttgtagaacacgtcgaaaccatgcttgggtatgtcgttggggatctccttgccgatggccaccgccgtctgcatccatccacagaaattcatcacaacgcgggatcagcattgccatcaaatttggataaatttcgtaagaaacataaaaaaataaaattctaatatctcgagtggataactcatcgtgtagcttttacttccaaattcaatacatatggttgtaagaaattctgaaagaaattgaccgtgttgagtataatagcatctatcactctaaaaatcaagttgaaattcgacttaagctttgattaacaaatgataaattcgggtgcgaatagtattcatacaataaattagtcccttttttttatatctcaatgtgtgatttgattttgtacctaagttttttccttttggagtgggatatgtatatatgttgtatatatgaatattgctacgtttttttaataaaaaatcataaactaaactatttgaaagggttttaaacaaatgagggacgaggtatcaaaatagttaatttctcgtacaaacagttgagagtgagtttggcagaaattaaattgagtgagttttgtaaaatttagttacctcattgcaccagcaggaggcgacgtggttgatggtgtagccgccgccgccgaggaggaggagcggcaggttgaagctgcggatgaagctgacgcactgggcgtggccgcgcgtggtcaggttcagctcgccgagccggtcgccggcgagggagtcggcgccgcactgcagcacgacggcctccggctggaacacctccatcaccctcgccatgatcggctcgaacagccggtggtactcctcgtcgccgatgcccacgctcaccggcacgttcagcgcgcagtagcggccggggcccttcttgccgacgtcggcgacggcgccggagcccgggaagaagccgccgccgtgctggtggaacgacaccgtcatcacccggttcgacgcctcgaaggcggcctggacgccgtcgccgtggtggacgtcgatgtccacgtagagcacgcggcggaagtgggcgagcagc

SEQ ID NO: 86566 - DNA, 1584 bp, Oryza sativa
ttcaattgtcaaggaatgggtcatttcgccgacaagtgcccaaaaccgagaaacgtagctgccggcacgtcagtccacgcaactccctgcaatcagaagcttgctcctcaacgaattgtcatccatgcatcccgaagcagtcctatagcccgcgttgcaacaactccaattccaatgagtgcactaccacaaggtgtcaatgctcaatttcagccccagccaccagctgacaagacagaggccagtatctgcgttgtacctttggaagttccaatacagcagctgagaaatcaagtacaagatgaagaacccgagtgtaagaaagttattgtttgttacaactgcagtgaagaagggcattactccaaaaactgtccccaaccaaggcaaaatcgacctccacattaccgccaatttacacgaagcagacattccaatcgtattgtggtcactggagcaaacgccgtacccgtaaggcctcgtgttaatcagaacccatagcagaaacaatgcaccaatgctcctcctgctgcacctgactcggcaataaatcttagcaaccattctctgcatcgacagcctcagcaaagaattgttgtagatggaagaagttgtgtctctccccgacctactccaggcctagccaagggcaatcaacctccggagggcgataccaagcagaagaccgtcatccgcttcaaccagcaatcagaaggaagcttctcctgtgaatgatagcattatgcagtcctatcacatcgtcacagaaccaattaaggatgcagtcactagaacaatgccagctatatctctccagaatcaaaatgagcagccatgtttgtggttttcagttcgctacttatcatggtgtaatcgaaagtttgcagcaatcatgtaattcataaatataatcatgtctgtaaacagtgagcttgctatgcttatggatgattcatattgagaatacaatgtaccgatgttaagcaccgtccctttttgtttaaggcagtgccttgtattcgtgtaataagggagaaatgtgtaatacagacaagttccctgaggattcgtttgaaagatgcggatatgtgatcatgtgtataattgtttactgacaaaggagacctagggtctcgtgtcagaggaagtatattctaacctcgagttaataaccaacctgtggatagaaaagaaaaacaattaaactgtgttgggttaaaaagccaacgagacagtagttgaggataggagtttggatacgccttttacagatcaagataaggattgttggaggaaacccctaagggtacccgccatgcctctacattgataagatcggatatacctgccaacagttaaggagatccaggagacatcaatatttgagaacataatagtcgatggttggtaattagtttatctggtatcagaaaaaggtcaaaggtgatgtggcagaagaacaatttggatgctccccatctcgaggaagcactaaagatgaccatcggcaattaaaccctagtggtatagatacagatagcaggcaatgtatttccctgaaggtagtcagtgtagcttttgacg

SEQ ID NO: 86567 - DNA, 922 bp, Oryza sativa
gtctcctctttcatgttcatcatgggcatttttaagtattgggagagggcgaaggctatgctgctcgccaacctagagaacttgcgaagctcaatcaagaagaaggaggaggaggagacaaggagacgacgaagcttgagaaatatttggcgtccaagcagttcgaagcatgataatgacgaggaggcactgctggttgctcatggcctgctcgacatcaccaaaggcgccttcgtcgtttcttcagtcgacgagcatcaaatccctgtctatgctgccaggagacgagagatatttcctaagagtggctgggggatgatgtacaaggtggtcgacatggagctctccctcatgtatgacatcctctacaccaaggcggccatggtgcacacatggcatggctacgctatgcgtgccgcctctccgttcgccacttccgtggccttcatgctgttttggtttgacagcaagcaaggtcagcggatgaccgatgttttgatcacctatttcttgctgggaggtacggtcctcctagacatcatatggcttctcagagcagtggcatcaacaaggacctattcgttcctcaatgataggccacacttgtgggttcatcacgcatttttgtgctctgggaagtggcgcctgctccgtcgtctcattgtctccctggatccgtcgttgatcctcgccaaggaaccaagtagctacaggaagtggtctggaaaaattggacagtataacttgttacacaagtacactcatgacaaggacgaaaggaccagagattacttgagctatgtggtagagaaagtagcatcggaagacatctcgatggagtacgaataccacaacttgaggggtattcatatttctgtggatttcaagaagaacttgttggattgtatttgggactatatgt

SEQ ID NO: 86568 - DNA, 850 bp, Oryza sativa
ataaaggccagccgtgcaggcggtgacaccagtcagcggcggatgcggcggccggtcggtgaagacgtagacgcccaacaacggcggcataataggccagccgtgcaggcgaaaacaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggtataaaggccagccgtgcaggcggaaacaccagtctccggcggcgaaggcaagccgatcggtgaagacgtagacgcccaacaacagcggcataaaggccagccgtgcaggcgaaaacaccagtcggcggcggacgaggcggccggtcggtgaagacgtagacgcccaacaacggcggcataataggccagccgtgctggcggaaacaccagtcggcggcgacgaaggcaagccggtcggtgaagacgtagacgcccagcaacggcggcataataggccaaccgtgcaggcgaaaacaccagtcggcggcggacgaggcggccggtggtgatgttctgactgatccattcctagagcgtaagagataagcttaaagccatgaatcccttttatgcatatctggatctggatcctgcagaacaaacatataggatgagtagtatctgatataaatataatactcgagaaaaaatcaagtattttaaaatatttataaa

SEQ ID NO: 86569 - DNA, 4939 bp, Oryza sativa
gttttcgcgcaagccaaaaccactgatgctcttagcaaaaagctggccacctatgacaagatcttagagaacatatatgttaagctagaaggcttccgcattccaaaaccagctaagcttcaacaagatgatagagatacagctggcacagttagctgctctagtcgctacaaatgagtctaggaggattctaggacaacccgaaccttccttagagtatgttaaggcgatcaccatgagccggggaaagtctactcgggatccgccatatcctaaccctgcaggaacacagagcagtaacaaggaggcatcacctgctagtccggctgataccgacaaagcagctcaaccaagtaaaatagtgccgcaagagtactgcgacacatcggctgcttccgtttccccaaagatacaagaaaccgttagtggacgagcagttcgctcgttttgttgaagtaattcagaagatccacatacacgtgccgctgctagacacaatgcaagtacccacttatgcacgattctgaacaaaagagatcgctgccaacaacggaagtggtcatgctgacaaaggagtgtagcaatgctatactctaccggcttccggagaagaagaaagatccaggggtgtcccacgattacatgctcaatcgggacacaactattcgaccaggccctctgcgaccttggagcaagcgtcagtgtaatgcccaaagaggtctttgacaagttcaacttcacggtgttggcaccaacaccaatgtgtctccaactggccgactcgtcggaccgctacctagcagggattgcggaggacgtgccggtcaagatttgagacttcttcatcccggtcaatttcgtggtgctagatatggactcggataaggaaacaccgctcattcttgggcatccgcctctgagcaccgccgaagccaacatagacatgggagtaggcagcaaacgtttccacatcaacgagaaagagaattttgagtttcggctaaggatgaaacaatgctccacggtgaggatcaagtacgggccgaatccatagaatattaaagaggtctaagtgaagccgcccaagatggataacctcatgcattcatgaagaacttcctagagaaggaagtgtcaatgaacaggccctgtccaaagaagacaccggtgaaaactagtgcactggcaaagcagcctgatgaagcatgtatgcccccgttgttaatttggtaattaatgacaagcactaattgtggactaaccgttctattgagttacatattttacgttaggatcacataatgtgtgcatatggatgattatcgcggactaaaattgatggcgcaaaccaaaaggaaaagaagacggtaaactagtgttttaattgtaaattgatcgaggagttgtgcgatcaaaatttgctagtttatttttagcttcgctatactattatggggtgtaatgacctagacaaagagatgatcgaaatgccacattaggtcatttgcatttagacttgtgctcaatttatatacatttgagattgtctgactagggccggtctgaccgaggcatagatgccggtctgaccgatgggtagcggccggactaaccgtcgggttaaccacggtctgaccgcccccctggaggttggcggtggtgctttggggaggggatccagagccgcagccggtcagaccggtagcacactgagttgggagatttcgcccccgacggctagttttggttggtgggagtataaatactcacccaccagcaacaaggggtctctcttggcacttgcttcacttgcatacaccccttgcatctctcccacactcaattaagctttgtgttcatgcatgtcacacccagagttttcccttcccttagatttcaaatcactaataattgacttcaagaatttgctttggttaaccaggataaaaccctagttaacgatacatttaataatcggaattgtcagggagaatttttttcgaattctctttgctctgtaaaccgctaacaggacttaaagagtaaatatcagatcaccggaggcaatgttgctaagttaaaaagtgtcaagctaatctccttcctttacctttggtcgtgaattgtgcccaattcactcccctctcagtccgcactttccttttgcatgacgaaccgtattcgtgtcagttcgtgggatcgtttcttttcctttcctaaaacagcatcgcattgtttttccttttcgggaaagacctagtctcccctagtttccatttccctccccctctccccaaccagccatgccccctcccctactcgcatgcgcgcccctcctcccctcttatccggctccctcccctcctcctagtcctacttcctctacgactccaccattcctaatccaaccctctcctatatgtgtgtcctccccttgtttttttttgtttttcccgagtcctagtcgcaagccgccaccgccgcttgctgtgccgccgccgccggccggtgccgccgccgccgtcgccaccgttgcgtcgccggtactccgttccccctcccctttagatgtatttggtcctgcactcatcaattcatctatctaattccttccgttcaatcttttccagcgtcgtcgtcgtcgatcccgagctcgccgccagaaccgccgccgccgtcaccgtcctttctccgctcatcgttgttctccggtgaggttctccgtccttttagggttaagatttttctgttcctagcgtttgtgtcatgtgtcgttgccctatccctagagctgagccgtcccgctgttggcggttattaaatgccaattttataccgccaacatctgcataaagtccagataataaaacatccaacatagtgataggtgttaaatctcacatatttcacaagtgttaggaggaaaatcagactaaagtgtgggagaaatatgtatccatacaaggatggtttgtgaacttcatcaaaataccaaagaatcagtccaacactcccagaaatggatagaggaggaccaggggaagagatgggtcgaaggccaggccaggtgggcccagcccaggttcggccgaacccgagccaggggtctcagccgttcaagctggggtttggcatggacgtcccagattactccctgatggcgattgcggggcaattcagacaattcacataaggataaccgtcatacgtacctctatataaggagcttcactccttcactcacacacactaccaagcttgagctgaattgtaagaggctctattgtactatattgtatactagaataggaagagagtagagtagaagaagtcggaagaattccggagttgtcggtaatcttctctcatttattttattctgtttattactctgatttcaatagagttatcttcctgagtaatttagatttatcttgtgagatttatctcttggttagttcctaaatagcataggggattattgttcactataatcaactaaaatatagtgattgctttagtgagttataagcactaaagtagatcttaattgcttagacgtggtgtttaggtaattgttatccaataattgatgtgtatcccgcagtacgtttgaggtagatgtagaggtggtgacagccctcgagatcacttaagttctccctgtccgggtacgtagtagagcaacatctgggaacagtgggttgccagtgcctgaagtattgtgttaggattaaacttaagcttaccctagacacactgattctcactagtaaatcctctctatactagcctatctttgcttggtgtccttggatgaaccggagaaaaggtctgatcacatacgttcccttggattcgatacccatagaatagtccataggggaagtgctacatcggcatatccatgcgcttgcggatttctatctgtgaccgtaagaattaccaacaagcatttctggcgctgttgccaggtaacggttgctgatcatttccgaacccagttcatcctcgtatctcttttcattttctattctacctttacccctgctacccagagaagtattcctgtcaaactcttctcgactatggagcaacctctcttcgagctgtctgttcctaggggcgaattctatgagccacttccttcattggagccaatttatacatctggctatgaaattcgccccgaactaatcagtatggttagggaaaactctttctggccttgatctagaaaatccctaccatcacatataggactttgagcaagtctgctcatgccttcagattcgtagcatgaaggaagaaactgtatggtggaaatttgtcacgcccggaatttctatccaaaattccaaacgcttacatgtgtgtgaaccctcgtccaggaatcagccgaggcacacaataacaaattgataatagagtacaattattactctaattaataagcaaataaaatgtcattacagaggtagatagttcctctcaatcaataaagatctaagcagcggaaaataagataaacggcgcagacggctccactccacaggcagcttgaccaaggctacacctaatcctccacaccatcagcatcattgaagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttcagaatttaataaaacagttaagtattaaacaatattaatccaacgctacacaacataccctgttgcataggcccagccattcagatcaaccatcccggctgcatagttctatctccaaaccaggaatataccattccaaaccaggagctaataaaattattaccagttatagcatcatttactatggtgaga

SEQ ID NO: 86570 - DNA, 2126 bp, Oryza sativa
gggttccgaccgtaggtgggattgggtcggtactcttgtctatggctaggatgggttggaaactatgtcacgtcttccttccgtataccgtggtggtatgcggcacgtggctacacgtgaggaagaagtgtcttgtgggtaaagatgtacacctctgatcagagtataatctattcgaatagccgcgccctcggttatgggcaagccgagcaatgtacccaagttagtgtttttaatttttaaaacctgcttaacaactaaaatgtggaatggttggcctgggttggcttgggacgagctgggacccagggtcgggttgccagttcggtctgaatcatcataggccttgggttaaggcaggttcgtgtgggttcacggccttgattaataatattgtatagctttggaatcgtgtttacaaaatagctttgagcaactaagagtcttttaatgctgtttactgcaaaccctaaccctttatattataacccccttgtactcccttgcatttatcctgcacttgtgggtgtgtcttgttgagtacggtggttgtactcagtcttgctcaatttttcccaaacccagaagaggagcccctagaagatgaaggctttggtgtctagctcgtgcctgccgtcaagcgcctgtggtcgtcgccctagtcttccgctgtttctcgtttgtctttgtgtgtgctgggccttcgccgcccatgtaataaattaactatttacgcttccgcttgataaactctgaaatgtatcaacttttggtgtaccttgcctcctgggacaaggaataatacacgcacgtaaggaacgcccgttgggttaattccggtcgtgacaagtggtgtaacatcccggcctagggcttaataggattaatagaatactcatatcaacaagttgcaacttcttttccggaagtcaatctccaaagaactccagggttaagcctgcttggcctggagcaatttgggatgggtgaccgaccgggaaattcttcccgggtgcacacgagtgaggacaaaatgtgcagaaaagacatgtgttggtctatgagggcagtctatgacctatgaaagctatcagatgtaagtgggcccggcctgggggaggcgggacattacacttggaaagacctgaaacgatattttagagatgtttatgttcccatgtattatgctgatattctgctcaacaaactgcagtgtttaaaacaagataccaaaagtgttacttcatactatcatgatatgcattcttgtttattacgttgtggcttagatgaatgtgaagaagctacataattgaggtttttacgtggacttaacaaaaaaattcaggacatgcttgcttgtgaaaagtatagatctctttctcatttgttacaacttgcttgcaatgctgaaagtaaaatagagtaggatatgaaaaagaaacacgctatgtctttgcctccaatcactaaccatttgcaggaagtgcgtaatcatgaaaaggaggagagagacatgaaagagccaccaattccattgttcacacttaagttcgagacaccaccatcatctgaagaggacatcaaaggtaaagtaaatggtactgaaattaatcaaggtgcgtgtgttgttaacgaagtaaatttgtccacttttcatgcaaaactagagcaaccgttagtggaaccaaatgttggaattcctttgtcacaagttgatttactcgctgttccttgtgataaagaagagttgtgtgataatgcttcacttatatccatgccacaactagtgaatgaacatgctattcctagtgtttctttgtgtgctgattttaagcatgctgttcacattcctaatgaagttgaggaacgtaaattgctatcttctttaaatactttgggctatgttcagtttgatgatttttgtgcgctcgataatttgaaggagaaattatttgctaagtctgatttgccatatccaaccaatgttatatttcacatttttggcgaatataatgatcttggaatatattttgtgcatagagtttacatctgctcggatttagaacttactgtacatgtggataaaacatacaagctagagagaaatgttattgctaaccaaa

SEQ ID NO: 86571 - DNA, 2458 bp, Oryza sativa
gaaggagaaattatttgctaagtctgatttgccatatccaaccaatgttatatttcacatttttggcgaatataatgatcttggaatatattttgtgcatagagtttacatctgctcggatttagaacttactgtacatgtggataaaacatacaagctagagagaaatgttattgctaaccaaattgtctcgagtttgccttgttttaattggaagaaacaggttgttgtaaatggactatgcaaagagcaccatatggaaaaaccgaggacggttttctgtgaagaagggggggatgatgtgaccatggctaccacggatgcaaccattgctcacatcatggatgaacatcatggagcacgaccctaggcacccctaggtcgtcctcccacccctatatatagctaggtaccccttcagggtttcttcggttttgatagattaaagtttagccattgctacttgcttgcagcgcgcgtgtcggctacaccctccgtctgcttatctttggaaccccaatttatgttttgaataaatttctggttgcaatatccagattgcttttatcttggtcttgcttgttttttcgatttgcttgcaggaatagggttgatctgcaccggcaagatccacaacccatggagaggtgtatcgatcgctaagccgcaacacaacgtctcgtacggttgtagtcggatcgtcaacgtttctcccaaatcatagttctcacaactcaccgaaagatcgggccaacaacagccttgagtgtcgagaggacctcagggttcatcaaaggtatcgctgatcggctagaggcatcatcactagatagtttggtggttgattgtggctcaattaggactcggctacacaaaattcaggctctgatcccagaggagttagccgatatccttactctagctgtttaccttgagcaacatcaattcaaactagagaaagctaagttaagactggccgaatggcgagagcgcaaggacaatgaagccactatccaagctaatcggcaactggtgcatgaagagaaatccaagcttgatcaacaatctgaaggcccaatcaaatctaacattgatcggctcgaggctcgcaagattgaactcttagcacaacttgaagaatgcaacgctgagctggatatagaacacaaaaaactagccgatctcccaaagtctatcaaagagcagaaagcaagactcaaatcggctatcaagcatgtcgctgatctgaccaagtctctgaagatcatccctagaaccgatgcttaagacgctcaagccattgaagaagtagagcagattaggcaaaaagctgtatcggctatccagcgctatctttctcaataactttcatgtattaggctttaggaaattttgtaaccggcaaagatacttctaagtatatcttgataatcttttgtgccgatacatgtataaaacatcctaatttgcttaaatttatcaaaatttgcaacttatggatatatgtgcccccctaattttacgatgccacaagtagtgataaaattaaattgtgaactaagggcgatacaacaatatcggccattgtacatcggcaaaccacaaccgattacattataaaaaacaactaaaggcgatataacaatatcggccatctcaaggcgatgtaaacacatcggctgtcatacatcgacaatactagccgatgtcgcgtctcaaaacgactttaaaatacatcctcgaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattaagaagaaataaacaatgttaaaaaggttttataaaaagaaaagctctaaaaagtcctttttcccccctcaccctcttgggccggctcggcccatctctctccctctctctcctcttccccgcggcccattcggcctcctccccgcgcgcgcgccgctgacgggcgggcccgcccgccaccctcgctgacgggtggggcccacccgtcattcccttcctcccgccgctcccgccgcccgcgccctagcgccgccgccgccgccgcgaatcccgccgcccccgtccgccccgcgtgcaatcaagaggttggaaatattccccgggatcccctccccctttcccctcatttttccctctctctctccctcggattcgtttggaaactttccccctaacctcgccggcgccattaatggcggccaggactcccgcgcctgtttccccctcctccggccaccccctccctctcttaaccctatataaacccctccccgtgcctccctccacccgttccgccactcgccgctctctctgcccgccggaatcgagctcgcg

SEQ ID NO: 86572 - DNA, 2652 bp, Oryza sativa
attcctgcagcccccaaacattcgttgtgacaggatgaaaagtttttgcgtgagaactaaacagggtctaagtgcagttttacattgtttgtgtttaacgtttaaccgttcgtcttatttgaaacatttttatgattagtatttttattgctattaaatgataaaacattaatagtaatttatgtgtgactaattttttttaaaaaaaattataatttttttaaataagacagatgatcaaagttgtacacacatatccacgactgcacttattttattataggatggatgtattatattttggaatggacgaaatatttttgcaattacttaccgaagccctttgtaagcaatgtgtactggtacgtcaggtccatgcatatgaactgcacgtcgaacgcctccgggtacgcggccgcggcctcgccggagctcagcgagcaggccttcgacgccgcctccgcgaacgccgccggggtggtcacggcgctcggcgcgtcgtcgacgacgaacccgccgtgcaccgccctgtcgtagaagtaggacgccacgtagaggtcggccatgccggcgccgccgccgccgttccacacgccgttgaagctgcagttccgggactcgcacggcgcgtccaggcccagcgccgccgccgcctcctcgccgcacttgccgtggtccgccccttccggcgacgccgccgcgtcgtactcctcgccgttgtacttgtatgtaccttcgtcgaggtcatcgaccaagaataaatcgtcaaattattttcgtttgcagtttcgttttgaacatttcttaacgggcgaccgtgcaaaaaagaggaaatttaatttgcccctatttgaataaacgttgactaaattagaaaaaaaatgattttgttttgaaattttctggctaaatagtttcatgcggggttctaaaattcctcaattatttatgtcgaaaatccatgaaaatcattccaccagcctatacatatagacgtattcggtattaatgtgacacatttaaatctagaaattaaagtattttttctgggacataccattgaatccgcgaagcatgcaggagctgaattgcccattcttcgtcttaagaatctcgacgcgagaagcttggagcccataatgcaagtaactgttcattcaagattatgtctgatcatcaccattgcctaaagtatataattactacttatttccttgtgttacacaactaactctgaatgatgttcagaaattaatcaagcccgagttagtctgttttaagctttcttttaattaaccacaggtccacagccttttgttgtcaatacagaccaaaattaagttaacaaaaattgcatggagctgaagaagtaagatataatttggtaagaagttgttgtcgattctacctgtgaacataaaggttataatcttttcccttgagatactcctttgtaacataaggatctttgccgacagggactggaggagcgttttctgcagcatctgaagaaatggcataggccatttgaactgaaccacctccgagatcgatcactcctacggtttttgagtaatcccctcctaacttccccaaaagatagttcagagcaacctgcaccatgtaccatatggaatttttattttctgaaatgatatatttatataaagatgtaaattgtcagaaaatttctgctctgaatgacagtatgtcaaacatttcatacccagaggttggatccttcttgagaacccccaaggacactgatccattctggtttgtactggaaattgctcttgctgtggacaagatctcgaacctgtaagtaatattattgaaaacatgtcatttttgtgatcaatatatagtctacaaacggttaagatctttgcaaaagtagagtacatcatctaatgaaaccagattacggtgagaatattatttaccgcttcaagaatttgctctgacttctcatctccaatcagtcttagaccagcagtggcctgaacaccaatttgattacaccaaacataaaatagttcttaagatcatttcaagaataattaattccagtttcagtaagatcagtaagtaccccaagtttgaggggagttcttttctgaagctgcttgggaacaacacctttagccttctctagcagaggagcaatggagtttgcagcttcctgtggtttgccagcatatgagctcaacccgggcttcacctatatttttttttcgaatgtgagcctatatgaagttacaacttttttcatagaatccacaaactatcctcataactgttccatgcacgtatgctttattgctttacacttcaaaaagatgctgcagaaatcttgaagcatgctatacgcacgcttcacactttaaaaaggagaagcgataatcttgaagcatactccaagtatatggaatacaacgtcgcgttttcttgctggcaagagcatttgaaattcaactattttttgtggtcttccaagtgagaatttgactagaattttatagtaaaaatttatttatgaaatctaataagtttaagtgattataaaattatttttcaagaaaaatattactggtggagaaaccatctttggtcggtcgaccagatttcacaatagtcccggggctgcag

SEQ ID NO: 86573 - DNA, 1880 bp, Oryza sativa
aataattaatgaaattattcgtgtactatgatacagtgccaggcttgcagtaaatagatgggcaaactggctcagcagctctcatcaagctccaactcaatgcctatccagcacacctttgggtgaaatcaatgaccatggttgcacccaaggtgtggtggaccagatctcaaatccagtggaggcttaagttttacccgatcctcaaagcccttctgtgaagcatgctcagaaggcagtggcttatcatgcaaattccacacgctcacatgtcccatccttccaaattgagggctcagaatgtcagcttcagggactgccctctcctgaaaacctagcgagggttgtttcactctaacaaaacgaccaaggaccggatctggaggctggtttggcaagggctcatcaagacatctcgatgtaattgtgaaaccctcattattgtaagctaggtgtcttgcatggttaaaaggaatagctccattaccaccagtcagaggagtggaagcacctgaagtagttcttgggctcgaaatcggagagggtgacattataccattttgatgttgtggagatcttgacctcagatgagggctcccacatggagaaacagggcaagatatatagcttcgtacatgaatatcactgcaagcaccgatgattagagtacatacatttccatgcagatatacattcactgaactgttttttttttaaaaaaaacgaggaactgtatttcttataggagtacaggactgagttatcgaaaataaatgacagcagggtacagaacaagggtaaaatgtgaaaaatattacaatagcattaaacactgcttgaattttacagtgggagcatgttgcagctcagatgaattaagcagggacatcaacaaaacataaaagcacatttgggcaattattcatacttgcatgttgaaaaaaggacattagtaagatttctagtagggttcacttagtgtcctcatatataaaaaattcatacaaaggtcatttattttgtattcatttgaatgtcattatttaggggtaactgccaaaataaaaggaggaggagatagttcagtaatgtgcagctaaaatttcctactttgaaatgttagctaatttacttttcgtcataccaaagcataaggattatgatatgagaggtttggttgcggttctaatttaattttttcagcagagatttataagttagctactgctcctctagaatatttagtacacacactccaaagcaatattcttatgaattagcaggtagattcaaatattgaatgattcacctgtgcacagaagaaaatttagcagctcttctctggtaaatggattgcccttccaaacccaaagaagacatatttctggcatgcccgaccacctgaaatgtcacaagagacaaagcgtaagaaaaatggaacaatcaattgtccatctgataaccaagaccttaatactctaagtaggccccagtaacatttatctgtcctagttagctacaacagccagaaagaagcaaatgaaaggaaacaaggtaaaaaataaagtaaatgatttgtagaattaatgcatacagctgctaactgggcaaacatgcatgacagatgtttagctaaaagacaacatgttccaggaaagcagttgataccttcagatctggtttgcaggatgtagtagacaactgtagcaatggatccgacagtgatttttcaagtggagatgcatttcgtataaatgaatgctgcaaaagatccactgctgttggacggctggatggattgcgctgcaggcactgtcttataaagtctctgccctcttctgagaggtgatctggtattggtggaagctccttactgtttc

SEQ ID NO: 86574 - DNA, 1485 bp, Oryza sativa
ctgcaggcactgtcttataaagtctctgccctcttctgagaggtgatctggtattggtggaagctccttactgtttcctatcttaaacactgcagcaatctaaaaaacaaagcattgtgtcaacatctggctcataacagatcaatgatttattcctactgccaatccatacaaaatatttaaaaggaacaaaaaagagaggggggggcacttttagaacgaatgttactgcggaacaagagacatgtcaagaatataggaaagaggtgtcgcagattgttaagtagtatttctcataagggcaccttcaacgtgaagcttagatggatgctttggggaaaaaaataggatagcaaaataacatgatgtaaaatccaaaaatagaatggaattaacactaaaaactgctagatctaggtcaatatagtgataatcagtatgcattataataaataaaagattccagttttgacgccaaagggatccattgccccccttagcgaatacatcatgatgcaatgtctcaaaaagtccaagataaatagaaggtgaagaacatataaagaagtctaacatgcaaaacctcaaccaaattttcaatatacaaaaaatatataagcattcacatggtaccggtcatcatgtggttcctgtaccacttgtctgttttatattcaacataaaaaaatgaatacaaaattaaatcattgcatctttaaacaacctttttgttttggaatttttcaaacatagtgtcatgttggattcgtcagatttcatcaaaggggatgctgggcctcctggccaccacaaacttttgctaactaaaaagagcattgggaaaataagacaaaacaatgagccatgctgaacttgtttttttaattaaaataagtactgaagcaaaaccacaacaatgatacagtatccaccattcatcttctatagtactcccttcagccaaaactatatgacatttgacttttttatggtcttcaaaattcactgttgaatcaaatattgtagcaatgtgcagttattcaaaactcgtagcaaagtgccattattcaaaattcaacgttgaatcaaatatggttttacattagaataagtataaaatcttgtaagtttatgatattatgataatacttttcaagtcgaatcgacacataccatttttaagttgaactaagcccattagaagttatgatggtcaaggtttcaaaagtatgaccgtatattgtcctaaacgttcccctaaaaagatagtccgaaacatcaaatatttatgaccaaagggagtaccttctcatgaaaagaaaatgtgtgttgcacaaaaacataaaatacagcttaagagcctagtataagtactaaccccttcatattggctccatggtggttttgaggtagccatctctaaaaccgtgcatcctaagctccatatgtcaacagcaagattacatccattagggctgcaggaat

SEQ ID NO: 86575 - DNA, 696 bp, Oryza sativa
agcaatgttgcttagtaagttgaattcgaatctttgcgctttcgcattttcgcgaagaacgctacgaaaggaccgagtgaatgatctgcaccgattgaaagaagtccgcaaaccagctttattcagtcggcccgatattacaaagggttgcgacgttatcataatcgcaatgttcgatcccgtgctttcctagtcggcgacctggttttgaggaaaattcaaactatacgagatcggcacaagttatctcctctatgggaaggccatttatcatctctgaagtcacccggccaggttcctaccgactcaagcgcgaagatggtacacttgttgacaattcttggaatatcgaacatcttcgtcgtttctacgcttaagtttatccatgtatttccctatcttgactgtcaacatcaagctttcttcttgaggttgtcagtcgggggctaccataataataatggagtgtgattttttatcaattcaatttgcttacttggtctatcattgccttgtttgatttttctacttagtttacgaggactgaaagtttttaatagcttttgcgggttttaggctcaacaaagcttgataaaggcttttaagaaatcaacagctaagccagaaacaccaagcacagcataaatacaccggtattatacaaattgtgcctccatcattcgtcattcgaaacat

SEQ ID NO: 86576 - DNA, 1353 bp, Oryza sativa
ttccatggtatatatcctttgtattgtattgttaaatgcagaacataatgtatatcaatttaatgaaaacctaggcgataaacctgccgattgtgaataggattcaacaaacaatttaaggtgaatgaaacacagctgcatggtcaaactatttttcacctgtttcagtgatatccactatagctcccaaaaaatcttgatacaaaatttgtacttgaatattaaaatcagttaaagcagacaaaaataacaggcgaaaaatattggaatcgtcatacttgagaagttctggagatgggcaccaacatttcaagaaattggtggtaccagctattacattggtttcctgaattctgcttctgaatttgtaagataaggtcataagggaatttcacgatcaactgaacgttggaaccaaaacatcacttagttcgcattaagattgaacatggaagtgcacatatgcgaagcactagatcattggcatttgaactttgaaacagtatataaccatacaaagtagtgctgaacaattaaaattgtccgaaaagcatcatcactccaataggtatacaatgtcagaaaggagatggtgtcttcttgcattatcattgacaagctaatgttgtattcatgtttgcgttttcaaagtaataccataaacctaagtacctaactcactcttctattagcttgagatttttctaagatggaaatgattaaccattacagctgtatgttgatgagggagcactaagctatcccataagcaatagaacacctagaaaaacagaaataggtatgacactttcatgaagaaaacatgttatcctataaaaaccacatgagtaatttagagaacaacagggaacatgaacacatctaagttttgaagtaaaagtgtaactgtaatgtgagtgcaggtaccatgctacaacaacaatactacctcttgaatttcctatgggatatgattatgataatcttgaagcatccgatgcatatccaaacaaaagaacaaaactgcatatatgctggaaatattgtagttcagccttcagacattagagtcctttggagatgataccaagctttgcttctcctcatctaactcagctgtatcattatcagccttcccttgtttagctacagcctcacgctgcactgaagaattcccttttaatgtaactgattgctgatagagtaccccgccagccagagtgaagagcaagcaaaccagaccaaatgaactcgcatgcttatcccagatcataacattgattgcaactgtgagaaacttgttgacaacacctgttactgtaaaagccgtggcggagattgctttccttgctg

SEQ ID NO: 86577 - DNA, 4284 bp, Oryza sativa
accagtaatatctgtattgataaacatgataattactataatgttttgataacaggtacattgatagttctggcttcagtggtccattcccttcaacattatcaaaacttaagaatctggagaagctgtatggtcaacaacagagccatagtagttatatttgttgtgcttcatatgctcaaattgtatttatgttgttgttcttgcaggtgggcatcagataatgatttcacagggaaaatacctgattatttagggaccttgacaaagttggtggaactgtaagatttattgttaacttatcagtttaatttatgttatttatcctatacaggatacaaatagatcgattgtgcaacatatctgctctgcatatattattttcatttgaattaggagaaatattcatcaacacaggcatctgcatgggcaatatgttttatttttggtggatcagatatttatttatttttctgtagactctttgtgttttttgcatatttgatcagtatctaacaaaaaatagattctaaccatccatgccaagcagttcatacatgtaggctttcttcaaatagcttttgtgactaactcaaactccatctcaatgtatgtgtgcatggtgttttgaatattttcttagttacttatattggggactcaagacacttgtataaattttaatagaactcaaacatatttgttagggtatctgtgcaatacaccaattaagatattgatcctcttcctatctaaaggatatgctggttaaatagattggattgttagggtttttctccttttcttgattattttgcgaaattttgattaatataggaatttctgcccttttagctatctacgagtaacgtgggggtttctaaaaaagggtcctggagtatagtgtaaagaaagccaaagtttcactttccagttcttgctatcttttgcttgaactctgaaatttgtcattccaagctctttgaaatgcagagcatacttcttatgttaatttatttagcatattcctaccttttcttaaagtgtaaacttgtaggaggttccaaggaaattcttttcaaggcccgattccagcaagtttgtctaatttgtccaacttgacaagcttgtaagtacttctttcttaggtgacattttccccctgatggttggcaaggccaagcttgtcatgataatttgtgttctaaatacacatatgcagacgaattggtgatattgtaaacgggagctcttcgctggcctttatcagtaacctgacgtctttgaatatcctgtatgtgacatgttttaaagttttattaaacatcttacagttttatacattgaaaacttgtttctaagtttggatcttttgttctttcagaatattgaggaactgcaagatatccgataatctcagaacagtaaatttctctaagcttggaagattaaccttgttgtaagtttttcttgacatagtaccacgttctattgctattggttattatttctcgtagttttatgtgtgtttacttaagtaatattgctaaacgtatgccatagggacttgagctttaataatatcacaggcgaagttcctcagtccatccttaatctgaacaaccttggatacttgtaaggaattctttctgaagattattgctgttatagaaacgcctgttaagctgacatccatgttttgtcgtcttgaatggtgactcaattcaggtttctcgggaacaatagccttacaggaagcctgccagatgcgaagagctcctccctaaccaatttgtatggctgccaattcaacatatatagtattatagccaaaatagatttcagcattgcaatgatatattcatttcatatgttagtaatcttggatttttgcagagatttttcatacaatcaactcacgggaagctttccttcatgggttaccaataacaatttgcaattgtaagttaaaatttctgatgaaaaatggaaataaagacagactatgttgtatgaagtttgttgcctgacaagttacacgcgttgtttgtacaaggaatttggtggcaaataaatttaatattcgtgagaacaacaataggtacttgtgtcatttatctacaagcctatgttttttacaaaacctttttgaccattattttttaatgttttattccattacacacagtattctaccttcaggactaaactgtttacaacaagacactccatgtttgctaggttctccagaatgtatgttatttaaaacttaatcatttgtagcagttgaaaggattcgggaatttcagtaatggccataattttgtacatcttaactgcagactattcttttgcggtagactgtggcagtaataaatctatgaaaggctcagataatactatatatgaagtagatgctgcaaatctcggagtcgcatcatactatgttaccagaaatacaagatggggtgtcagcaatgttggaatattcaatgatgcctcaagtcgaaactatgtaataaatagttcccaacagtttcaaaacacattggattcagaattattccaaaccgcgaggatgtcaccatcatccctaagatactatggtctaggacttgagaatggaaattatagtgtcaagcttcaatttgcagagtttgcttatccagattcaaagacttgggagagcacaggaaggcgaatttttgacatatatgtgcaggtagatacatatcacaatgcgcattaatttgtttacctgattttttttctttatatgaaaatgttcacttgacatttgcatagggtgttctgaaagaaaagaattttgatataaggaaagcagttggtggaaaatcttttactgcagttaacaaaatatataatacaatcgtgtcgaaaaacttccttgagatccatctcttctgggctggcaagggcacttgttgtattccaactcaaggttactacggaccaatgatatctgcactaagtgtcaccccaagtaagcccaacaattgaataatttaacctgaataatggattatagtatattctaattactaaaaccctttttccagattttactcctaccgtgagaaatggagagccaaaaaagaaaagtaaggcaggtgtgattgtcggaatagtgatcggtgcattagttttaggatcagcagccttagttggaatctttatgttgataagtaagagaagaaaagcgacccaacagcaagaaggtatcatcatttattagtgcagctattcaaaaattgaaattttcaaatggtttattctttcccatgtgtactgaaaattgcagagctgtacaaccttgctggaaggcctaatgtctttagtaatgctgaactaaagttagctacagagaatttcagttctcaaaatatggtgggagaaggtggatatgggcaagtatataaggttagtggccccccaactcaatccgtgaaacttatcttactaagttgaactgcctttgcaatttaattggtatataatcaaaatatgtatgtaacctagagatcttcctttggcagggtaagctacctgatggaagagtcatagctgtcaaacaactttctcaatcatcccatcagggaaaaagcgagttcgtgacagaggttgcaacaatttcagctgtgcaacatcggaaccttgtgaaattgcacggctgctgcattgatagtaacacacccttgttggtttatgagtacctcgaaaatggaagcctagacagagcactctttggtaagttccattttgctcatcactagcacctgttaagctccttgcttcatgcactctcgagaattatcttctctacattagaccatcatcttaattatcaagaccttatttctacatgttcaggaagcaaaagctttaatctagactggccaacacgctttgagatcgttttgggcgtcgctagaggcctaacttatcttcacgaagagtcaagtgtgcgcattgtgcatagagacatcaaggccagcaatgtcctacttgacaccgacctcaccccaaagatatcagactttggactcgcaaggctctatgatgagaagaagactcatgtcagcacggggattgcgggcacattgtaagcacatttcaccatttctcttgtggttgtcctctaaaatgaaagctaactaaaacttgtctaaccttttgtcaagtggttatctggctcctgagtatgcaatgagacgtcatttgactgaaaagggtgatgtttatgcattcggggtggtcgcatta

SEQ ID NO: 86578 - DNA, 1566 bp, Oryza sativa
ctagtagcaaaatttggcaaagtatggtgtaactgatcatgtagagtaacatacgagctactgtacaccaataattagattgaggaatattataagatagaatcaaattgtactactccctccgtttttaaatatttgacgccgttgacttttttaaatatgtttgaccattcgtcttattaaaaaaatttaagtaatcattaattattttcctatcatttgattcattgttaaatatacttatatgtgtatatatagttttacatatttcacaaaagtttttgaataagacgaacggtcaaatatgtgctaaaaagtcaacggtgtcaaatatttagaaacagagggagtatgttgtaacgattggaaagctctaccatgcatgggttacttacactgtgtaagttcccaatatataaaacatggaaggaaggactattggactaataataactgcatgtaaaaagggaatcatgttcttgtgaaactatatttgtttggtcttttgtaactcattttctagtttagtcagtaagtaaactaaaaagggatttttttaatataaaatagagctgaccttgtaaacaaggccatagcccccccttcctaggatgttatcctggctaaagttgttggtagctgattttatttcaccataactgaagacatctggccttccaactacactgagaagctctgcaaaatccttcacattgtcagacaaaacaagggaatcatataaggctatgtttagttcacgctaaaattgaaagtttggttgaaattagaacgatgtaatggaaaagttagaagtttgtgtgtttagaaaaagttttgatgtgatggaaaatttaaaagttcgaagaaaactttggaactaaacacggccataaataagtcccactttttccaaagagtaaacagttatgtaattttaactacctcccatctccgcctccatttttttccttttctgtctccaaagaaatgtccctgtggataaaaggcctaaaactatagtacagacaacaactccagctaccaaagctattttacttttaccagcactgtttttaataggaccaggatcaaccttattgcctgcaggtcgactctagtaggatccccatgaaacaaaatagatgttaattataagatgatcacatagaaccaatggctcttgatcaagttaggtaatgaacagtaccataaggagatacacttaatgctgagattaatggcccgtaggatccctgtctaggaatgcaacaagttccttttccagcccagaaaaggtgaatctccatgaaattttctgtaactctaacaacatactgcctcaaaacaacagtataagattttccatttgtttgtttctttatatcgaaatccttttctctgagttctccctgcagtaaattgaaaaatagaaggtgtgaatgcacaagaaaacgtgcaacataactgttgcacactattaaaaggtatacttattttccaaaaataacattcattggacctttataaaaaatccacctgaataaatatgtcgaaaatccttgttcc

SEQ ID NO: 86579 - DNA, 5980 bp, Oryza sativa
gtccgccctcctcctctgctcggtcgtcgctgcgacgccgccgtccgccgccgctcctccacgcgccggctgctaccgcctccgcctcccggcagccaccaccgccgcggcctccacgccacgcgccgccgccaccgccgccgcgtcacgcgccgcggctgccatcgctccgtgtcccccgccgctgctgaccctgtgagagagagggagagagagagaggaagagggagagatagagtcgtgagagagtgtgagagagagaagagagaattgtgtatgaccggtgggtcccacaattttttaaataaatagaatgctgactggactgccacgtgtacgccacgtagaccaaaaccaccgtggattgggtcgaggggggtaattcgtccggtattcatagttgggggtgaagaatgtccggttctgtggttcggggggtaattcggacgaccgcgatagttcgggggtgtaattcgtactttttccttaacattaaggcaaagatgaaaatgcttctaaggtcttttggccaatgcaatacaccacaacttggtctcatctctaatagttgaagccctgaaattcctatggtttcatatccaccaagcgaccaatagtactaaccaatgttgcttagtgatttgttgcaaagcctgacgccactacttgctgaaaacaacgtcatctggccctgttgtttgatggtgcaggtccaaccaagaacagcacagatcagaagcaaacacacttgtcaacacacacatcaagtagtcagcaagtgctgcatgttctcctccaccacacacatatatagtgtgaattattcatggtgatcaagactgcgacgacccaatcggtcagcagtccaacaacgattcagcgatgctaaccacactgaaattctgcagcgaaatggagccccaagttgtccaaattagcttccaatgctcaaattattccaccccctgccccacacacacacacaaatgaccgttagctgatctagttgtaacttgtaatttgtaagcacacctgatctgaagaagatgtggtgtccatatgagttgatctcttccactccaagagtgaacttaatcccggttcaaatttcccaaagttgaagatattccatcagagggttggggttggtaaacctaccctgatgtttttgttagcgcttcataacgcgttcttcaggtagcaattctccttgtcacatgctcacaaagagatggcgcgagatcaaatgaggatttgccatgtaaccatttatcactactaccttaaaatgagtatcgtacgcgaaaagtaaccatcggttccaatgttctattctcaatcaccctcctagcatatctctaattgtataagcctagcctgttagtacaacgtaaagacattattactagtcagaaaaaaaagatcatgttgccatcctcagcaatagacatgactaatatgaacaacataaccaccgagttgggagatgctgtggaagatcgggtttagaaattacgagtactggttttgtcatcatggaaaaaaatcagaataagtactttcgtatttgttttctgcaacttacatcaacatacaattatataggcaggaataatatccaaaattgtcacttgaaaccaggaacaacaatggtttgcactttgcagctctgcattcaccttccttcgtcaatgcgtccagctatccctggatacgagttgagaggggcggtctccctcttctccctgaactcaccagtagtagatccagagtagtaggagctggtggcatagctagtgtcacctcctcctctgagctgccattcagtgatgtagctcggcttcgtcaccacctcagtcacctcaatatctccggctaggatagccatgactctggacattgatggccgctggtgtggtgacccttgagtgcaaaggagtgcggcacagatgactctcaaggcttccttctcattgaattccttgagttttgggtctacgatcccgagtgcttgcccgctctcatatagtgtccaggcctataaattagcaaatgcacagcttacattactttagggactagcatcagctgatgtgttctcctggattcaaagatcatcaatatataggcttacccattcaaagagatagatcttatcttcttcacgagagttgtcggtgtttggtcgaccagcaacagtctccaaggcgactaccccaaatgcaaaaacgtcggccttttcagtcagatggcctctcattgcatactcgggtgccagatagccacttgaaaaggtcaggtgaggataaaaatattaggttatgttttgaacataaactcggaataagagcatggtataaaatgttcatacagcgtgccggctatttttgtgctgatatgggtcttcttctcatcatagagctttgcaagtccaaagtcagagatcttgggggtgagatcagtgtcaagtaagacattgctggctttgatgtctctatgcacgatgcgaacgctagactcttcgtgaagataagttaggcctctagcaacgcccaaaacgatctcaaagcgtgttggccagtctagattaaagcttttgcttcctgaacatgtagaaataaggtcttgataattaagatgatggtctaatgtagagaagataattctcgagagtgcatgaagcaaggagcttaacaggtgctagtgatgagcaaaatggaacttaccaaagagtgctctgtctaggcttccattttcgaggtactcataaaccaacaagggtgtgttactatcaatgcagcagccgtgcaatttcacaaggttccgatgttgcacagctgaaattgttgcaacctctgtcacgaactcgctttttccctgatgggatgattgagaaagttgtttgacagctatgactcttccatcaggtagcttaccctgccaaaggaagatctctaggttacatacatattttgattatataccaattaaattgcaaaggcagttcaacttagtaagataagtttcacggattgagttggggggccactaaccttatatacttgcccatatccaccttctcccaccatattttgagaactgaaattctctgtagctaactttagttcagcattactaaagacattaggccttccagcaaggttgtacagctctgcaattttcagtacacatgggaaagaataaaccatttgaaaatttcaatttttgaatagctgcactaataaatgatgataccttcttgctgttgggtcgcttttcttctcttacttatcaacataaagattccaactaaggctgctgatcctaaaactaatgcaccgatcactattccgacaatcacacctgccttacttttcttttttggctctccatttctcacggtaggagtaaaatctggaaaaagggttttagtaattagaatatactataatccattattcaggttaaattattcaattgttgggcttacttggggtgacacttagtgcagatatcattggtccgtagtaaccttgagttggaatacaacaagtgcccttgccagcccagaagagatggatctcaaggaagtttttcgacacgattgtattatatattttgttaactgcagtaaaagattttccaccaactgctttccttatatcaaaattcttttctttcagaacaccctatgcaaatgtcaagtgaacattttcatataaagaaaaaaaatcaggtaaacaaattaatgcgcattgtgatatgtatctacctgcacatatatgtcaaaaattcgccttcctgtgctctcccaagtctttgaatctggataagcaaactctgcaaattgaagcttgacactataatttccattctcaagtcctagaccatagtatcttagggatgatggtgacatcctcgcggtttggaataattctgaatccaatgtgttttgaaactgttgggaactatttattacatagtttcgacttgaggcatcattgaatattccaacattgctgacaccccatcttgtatttctggtaacatagtatgatgcgactccgagatttgcagcatctacttcatatatagtattatctgagcctttcatagatttattactgccacagtctaccgcaaaagaatagtctgcagttaagatgtacaaaattatggccattactgaaattcccgaatcctttcaactgctacaaatgattaagttttaaataacatacattctggagaacctagcaaacatggagtgtcttgttgtaaacagtttagtcctgaaggtagaatactgtgtgtaatggaataaaacattaaaaaataatggtcaaaaaggttttgtaaaaaacataggcttgtagataaatgacacaagtacctattgttgttctcacgaatattaaatttatttgccaccaaattccttgtacaaacaacgcgtgtaacttgtcaggcaacaaacttcatacaacatagtctgtctttatttccatttttcatcagaaattttaacttacaattgcaaattgttattggtaacccatgaaggaaagcttcccgtgagttgattgtatgaaaaatctctgcaaaaatccaagattactaacatatgaaatgaatatatcattgcaatgctgaaatctattttggctataatactatatatgttgaattggcagccatacaaattggttagggaggagctcttcgcatctggcaggcttcctgtaaggctattgttcccgagaaacctgaattgagtcaccattcaagacgacaaaacatggatgtcagcttaacaggcgtttctataacagcaataatcttcagaaagaattccttacaagtatccaaggttgttcagattaaggatggactgaggaacttcgcctgtgatattattaaagctcaagtccctatggcatacgtttagcaatattacttaagtaaacacacataaaactacgagaaataataaccaatagcaatagaacgtggtactatgtcaagaaaaacttacaacaaggttaatcttccaagcttagagaaatttactgttctgagattatcggatatcttgcagttcctcaatattctgaaagaacaaaagatccaaacttagaaacaagttttcaatgtataaaactgtaagatgtttaataaaactttaaaacatgtcacatacaggatattcaaagacgtcaggttactgataaaggccagcgaagagctcccgtttacaatatcaccaattcgtctgcatatgtgtatttagaacacaaattatcatgacaagcttggccttgccaaccatcagggggaaaatgtcacctaagaaagaagtacttacaagcttgtcaagttggacaaattagacaaacttgctggaatcgggccttgaaaagaatttccttggaacctcctacaagtttacactttaagaaaaggtaggaatatgctaaataaattaacataagaagtatgctctgcatttcaaagagcttggaatgacaaatttcagagttcaagcaaaagatagcaagaactggaaagtgaaactttggctttctttacactatactccaggacccttttttagaaacccccacgttactcgtagatagctaaaagggcagaaattcctatattaatcaaaatttcgcaaaataatcaagaaaaggagaaaaaccctaacaatccaatctatttaaccagcatatcctttagataggaagaggatcaatatcttaattggtgtattgcacagataccctaacaaatatgtttgagttctattaaaatttatacaagtgtcttgagtccccaatataagtaactaagaaaatattcaaaacaccatgcacacatacattgagatggagtttgagttagtcacaaaagctatttgaagaaagcctacatgtatgaactgcttggcatggatggttagaatctattttttgtt

SEQ ID NO: 86580 - DNA, 2697 bp, Oryza sativa
ccaagcatgtaaaattcctcaatgagtggcttaaagggtgggatgaaagaggtcacagaaataaacagaatatagttactaacgggagcatgaatggtagatcctgtcaagatggttctgatacagattattcagaagatgcttctgattatgagaatgtgcttctaattactggaccagttggggtgagttccattttgaagattacttgccgtttgcattgtatgcttcacgtattgttttgttttttcttttgaatttgctgggcatcatctccttgtgtgttcgcgtgcgtgtgtgttttgtggggggtttgtgtgtgtgagaggggaagagggggggggagccttatcttatttgtttgagctcgggacaataatttttacaccccctggaacttgtcgggaatttgaattggtctgtacgtttgaaagtactaagctacgtctaggcagaatagtaagttttcgaccacttttttctccacatgaaggtgtggtaacataagattactggctgcaatcaattgatgctcctatagtattctattatatatttttgtatgctgtacttgaaaaaaaaggtgtaccaacctataagcaatcagttttgttcccagctgcaaagctgcttcttcattctctttgttcatttttacagtgtggaaaatcagccgcagtttttgcatgtgcgagagaacaaggattcaatgtaattgaggtattgtctggaattccatttttctctaccttgtaagagcttccatattcctatattatttgtgtactaagatactaatatattttggcttgatgaatcctttcagcttcttctttccttttcgcctgtttttctctacaatatctaccaattcgggacttttttgtaacattaaaatgctgtaaaaatgataatactgtattggaagtcctttatttatatactccctccatctacttttgataggcatatttccaaatctgaaaaatttatttttgataggcatatttcaatctaacaacttatcatcttaatggctttcttggatttaatgcgtgactctccattcttccacacaagattagctacatgggcatcgagaaatgtaaatattaatgaatcgcttgtttacgaggaatgactagtagcatatttaaatgaatgataagtagaaccacttatcattgttctgtgtgtcaagatgaaatatgactatcaaaagtagatggagggagtacaacacacacatgttcctcccttaggaacatgaaaaatctaagggtgatttagtatatgcttttccatccctctcttgacacgaccagcttaatatgcccaaaacagttgtgttcccattcttaccgcacaacaagcttcttgctcaaaccctggatctgaaacctgacaagcttcatgactccagtcatcctagcatcaagtacattcccactagagtatttgttcatatgaatagaaattctattatatccatttctgcacattcaaggtactctatgtatagaggaataaataattttgaacatataaaatatggcgctgtttgggggagcttctggcagaagaaactgaaagatctcattgaaattgagcctaatcccattttgggtagattacaccgctcacacaaaccttagcttatgcatttgtctttgcttcgtgtaaaagggttacatgggggttgaagtgttttggtacttggtatatatgttggtacatcactcgttaaactagcaagatggtactattctaccatgcactcacgcccacatgcatgggctaaagttgggctcaactcgcccctcttgggttgggtctcatgttttgaattcaaggagggttttagttatactgatattgtggaatgtgcttatttgaactcgactttgttaagatatggtgatgcccagaaattagctgaaatccatttttttttgctcgctatgaggtgtcacctggcttggttatttgggtttcgtttgtatatatgagaaatgctaacataaccacctccatgcgcacccatactggtgtggatcagtcttgctttagctactatggaatttcgttattattatgaggcacttagctagctcatatccataatgatgacatcaagttcataatcatgtctagttctctaagcgtaatcaaacttcattgtctagtaagcacagacaaaacttaaggttctctaccacctgattatttgagttatgcatttatgatttgtctgttggtctaatcaagctaacatatgataaaaggctaagtaaaggtccatggcctataatcggttctgtcttcatccttatgtttggatatattctaaagtataatcttgaacttgttccagacatacttgattgtaaaaatgcagtagtgtcaggggttataggtttttataggttacagtcagtaaaaatgttatgttaatatggaattatggacacatgctattcaaaatgcagtgctttcattttagagaaaactaggacatgggacatgaacagaattctgagtattctcgttacctagtttacagtacttcagcaaaatttattcctgaaatttcaactctgatttctaaagcttgatttttttattctgatggaagtttgtgacgtttttctaggtaaatacatccgatatgagaaatggggcttatgtaaggcagaa

SEQ ID NO: 86581 - DNA, 1804 bp, Oryza sativa
tttcctgctgttatgaaatgattgtaaacatattatcacatgtgtacttttatagtgattttgaatgattgtagcttcccccctccacataacataggcatgcagcagtccgatatttgtaagaaacatgggaaatatttttcagctaagactctcagtggtatgtgttgcagcatttagatcttgaacctgtgcgcactgaaaggccaggagagttgatagcatattacaagatagccagtaggtggtcctccttgattgatgtatgctgattgaagatagtgatgataccactgatccttgtcctgataactttcttatttcagaacattacaaatgggccttggatgagctattcatcaaacacaactttgcgcgagtaataattctggaaggtgttacaccttggatgctcttataactattttgttctttgatctgtcttctttccatcccatttatggttaataatttgctaatagatgatatggagatcgcccctgatttttttgactacttcgaggctgcagctaaattacttgataacgataagtatgttgtatattatatattaattatagttggaaagccaaggatttcatctgcaatgtatctaattgctttgctgctattcctgtcactgtggtattgaaggacaatcatggccgtttcttcctggaatgacaatggacaaaagcaatttgtttacgacccaagttagtactctgatagacctgtataaaagttctgttctgcattaatagggaaagctactcattttcctacataaacattttgcagaagctctttaccggtcggatttctttcctggacttggatggatgttaacaaagcctacatggattgagctgtcacctaagtggcccaaagcatatctttactgttgcctactaatttttatattagcatatacaatattttccatctaccatatatttcttccttaacaagactttacttattgggatgactgggtgaggctaaaagaggtacacagagaccggcaatttattcgcccggaagtctgcagaacatacaattttggcgaacatgtatgttggctacttcatcaatgcaaaaattaccacatttctgcacactagtagccactggatagtaatttagtctttgagccagtaagtatggatgacttgaatttacactaatagattttcatacctccttttcaggggtcaagcatggggcaattcttcagacagtacttggaaccaatcaagctaaatgatgcccatgtatgcaaaccttccatcaccttttgttttgcttaactgttgcaaattctttagtgcagagatttaccattttacctcttccttctttgtggctatagatcaagtggaattctgaggacctgagctacctcaaggaggtaagaatttgtttggactttgaaacagtagtttgcagcaaatgcctaatatttatgttggcaacaccaggacaagttcctgatccaatttgggaaagacgtcgctagtgccacccctctccatggatctgatgccgcgttgaaagcccacaatatggatgcggatgtaaggatccagtataacgatcaggaagactttgagcggatagctcgtcaatttggaatatttgaagaatggaaggtttacttctttgaccccatttttattcataaataatgctcttgtcaaagtaggtcaagtgacaattttgtgtctgatgttttcagtggtgattgttaggtctagtagaaaatgtttcagtttgcagttttgatctagatagacatcagccc

SEQ ID NO: 86582 - DNA, 1962 bp, Oryza sativa
ttggtctggagagaggatttagaaccgcattgagcgactttgtactgatgcagctgcagttagcatctgttttctttacattctctctcgggaccaaaactcactactatggaacaacgctgctccatggaggagccgagtatagagctactgggcgtggatttgtggtgttccatgccaaatttgcggagaactatcgactatactcacgcagccattttgtcaagggtattgagttgctgattttgctaattgtgtatgaaatctttgggcaatcatatcgaggagctatcgcgtacatcttcattacattttcgatgtggtttatggttgtaacctggctctttgcaccattcctatttaatccttctgggttcgagtggcagaagattgtggatgattggactgattggaataagtggatcagcaaccgtggtggtattggtgtaccaccggagaaaagttgggagtcatggtgggagaaagagcaggagcctataaaatattctgggaagcgtggaattgttctcgaaatagtgcttgcattgcgcttctttatctaccaatatggtcttgtttatcacttgaacataaccaaacacacaaagagtgtcctggtaatttgctatcttcatttaatatttcttggtgttttcctggtctatgcttattagcacaagctattgaaccaacttttgaatgttatttaatggtctttccaggtctattgcctgtcatgggttgtcatctttgtaattctgcttgtgatgaaggtaatccctagcattcatattttttcttcagtgtttcatcgcggtgctcatgagcaacattgtggttagaacacagggggtacccttttttctgtatgacaattataattttagctgcacagagtatggtagttttcttgctatattcctatggcagtaaatgctagagatatgcctttgcaatacctgaggaccattgcggtcaagttgctttgctgatgataccagttgttagaaacctgttgtgttgtgcacacagactgaaccttggtttactcatgtttgcagaccgtgtcagttgggaggcggaaattcagcgcggacttccaacttgtgttccggttgattaaggggttgatatttataacatttatctccatcattataatcttgatagcaatccctcatatgacagtccaggacatctttgtttgcattcttgccttcatgccaactggctggggtctgctgttggtaagtggatatcaattgtttttggcctgtaagcggctggtttggcttgcttgagctgatgatggttgttgggttcaggttgcgcaagctatcaagccagtaattgtgcgcatcgggttgtggggatcgatcaaggcgcttgcgaggggatatgagatcatcatggggctcctgctcttcaccccgatcgcgttcctcgcttggttcccgtttgtatccgagttccagaccagaatgctcttcaaccaggccttcagcagaggtctgcagatctcgcgaatccttggcggccacaagaaagaccgagctacacggaacaaggagtagtagcctgtctgccattcactggacatgtattctgttgtgtcttcttccctcctgttgctgctgtaatttgttactcctattctactactccacttatcttgattgagagacccaaaaaaaaagaaaaagaaagaaagcgtgcattttggtagttgctaatcgccgcgctgctgaggccgcttattgtgcggcccagggagcgatgtgttgtagaatagtacagtagaatgtgtaaagttgctgtttggtagtgatgtgatgtgtgtgtatgaaaacaaacttgggaagagaaatgcaattgtaagacaaaataccttgcctgatgtgatgaatgtttttttttttgacatgtgtgatgaatgttttaattcttcttcttcttgagatg

SEQ ID NO: 86583 - DNA, 2415 bp, Oryza sativa
accaaactgctgccgtcctgtttgaggtcctcaaagccgtcaatgtctcccagaaaattgaagttgatcaagcggtaatcttcttaactataacttgattatgcatttcttcattttcttcttctactaacttgtaataaataacctctcttgcagattttggagacacacaaccaagtcgaggaaaagaaaaaactttatctcccttacaacatcctcccgcttgaccctgacagcgctaatcaggctatcatgcgatatcctgaggttcccattcttctcaaaccctacctatcttaatcttacgtatcttttccaactcattctgcattttttattctcctcattttacagattcaagctgcttttcacgctcttcgtaatacaagaggactaccgtggcccaaggatcatgaaaaaaagcctgatgctgatcttcttggttggcttcaggcgatgtttggatttcaggtaatcacaccgccctcaggctcacccactaacttaaccattattttccttctcttcacctatctgtcacttatttgcaattcaactatcactctgcagaaagataacgtgtccaaccaaagggaacacctcatactcttacttgccaacgtccatataaggcagattcccaagcccgaccaacaacccaaggtctcactcttactcaacgtccatatcggtgcttgtgtcattctggtggtgcttgtgtcattctggtgtttactcttttctttttcctcacattttcagttggatgaccgagcactggacacagtcatgaagaagctatttaagaactacaagagatggtgcaagtaccttggccgcaaaagcagcttatggtacgatatttaatctaaaaatacgaatatgcacaaggtctctcaagcttgcttgatgtatcactatcagatggtcatttcctttccaggttgccaactattcaacaagaagtgcagcagcgtaagctcctctatatgggtctttatcttctcatctggggtgaggcggctaacctgagatttatgccggaatgtctatgctacatctatcatcacgtatggctgatcccttccatttttccccttaaaattagtatatggtttttaccaagctagtaggcctggatcttaaagttgcgcaagcttcttacctgaatacccaatgatggtctggtcacaataaaattgacttatcggacctttttctttgtacaaagctatttccaatttgccatatttggtttctatctacaaagtagttagctggatcttaatggagtccaggctccaatgctgatgatgttcctggccataataacattgacttacctgacaatatatgagagttgcacacagctattgccatacacaaagaatcacattctgctcacgttgataatatgaggaagcatatcttggatggaattcatctttccccatcatgtcaattatgatgggatatttctgtatttgtaactcttgtgatgagattattttggtgagtgctgactgtgtaatattgttttctcatagatggcttttgaactatacggtatgttggctggaaatgtgagtccaacgacaggtgaaaatgttaaaccggcttacggtggtgatgaagaagcctttttgaagaaagttgtgactccaatatacaaagtcatcgagaaggtaccccccacccccccaaaaaaagtatatctctgtttccagctccatcaacttatacactcaagccttttacataggaagctgaaaggagtgaaagtagtgaaaggagcgaaaggagcaagacaacaaaatctaagcactcacattggagaaattatgatgatctaaatgagtacttttggtaagcactagcctaatttattctgagctacttttatgagttttagtttgttgtttcaaatttatgagctacttttctaaggaaacctgtgtgattatttctgcatttattctcaggtcaagagattgtttcagattaggatggcctatgagagctgatgcagatttttttaagaccccagattatgcttatcatgatgaagtgagcggagtaagtcccttatgatacatacctacctatattactttcatgaagaaccttcagcttagtaatacttctgttagtattccattcatgaatcacataggtggtaaaacaggtctatattattttttataacaaaccaaaacaattttgtagtatacgtcttcatagggtattcttggcactgattttttttaaaaaacttgtggtccaggagaacagaagagttggtagtggccagtggatgggaaaagtaaattttgttgagataaggtcattttggcacatcttccgcagctttgacaggatgtggagcttcttaattttatctttacaggttaattg

SEQ ID NO: 86584 - DNA, 1890 bp, Oryza sativa
cagaaatcctcaaaggccttaaaacctagaccttcaatatgtctcaagaagcacggcgattcatggatgcgaggagttgccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgtagagatgacctcgactacttggaagagcgaaggcggcgcgcggcccttcgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgtacggctggccacgggcgacagcactaagctgccaaacccgtggaacatcgaacaccttcgtcgcttctacccctgaggggggggtcgggtgtcaggtttcgggctcgggctaaccccgcacccccctcgggtgtgcagggttagccgggggctaccacacatgcacagccttacttttcttatttcaagcatttcaataaaagcactttcaatttcctaaaggttgtgtctgtgccgtttttccttctcaagaatcttaacttgaaataaggtcactcgtgctcaaccttgccctcaggggctcggttcggtcagctaaaatcgccaagcggggcccagaaccgagccgtgccccggggcgtggtgaactccgggggggaatcggcaaaaacccacaatcgggtcacccataaccctcggtcaccatgttcccggcctggccagtctcgacatgtggatctccccaggcactagccccgacccgagccatttgaggatcgggacttgagcacgagcccttaaatcaagctaaaatgcaaaaggaccacggcacaaatcatcctcaactcatatgcataacaaaacaaagttaacatagaaatttttcatcatttttgattgcagattaagttgatctatacaaaaagaagaaagaaaaagaaaaaattggagattggcgggggcctgggggctcattccaatgcgcccgggtcgctggcctcgtcgccaccgtcgtcctcgccgctggcgtcgccctcctcgtcggagctgggggcgaacgcgagccgaggggccgacccctcgaagctttggacgatgtggttggcggcatcccggacccgcgcgcgcgcatcgtcctcggtcccgggagggaactcctccagcgccatccatggggagaagccggggtccctggcctggtaactcgctaacacgagttccaccgctccttgggcgaggtccctcgaggatgacttgatggtcttctcgagctcctcggggagttgttggacagcccaggccatcctcctaaggtgcggggcgaggccttccagattggtggagcgcgaaattgtctggcctttccagaggcccgcttcccgaccggcgcgatccagccgggagactgcatcccaaagcatgccgggccctatctcacccgacaagcggagggcctcggcttccccggtggatgagtccagggcgcgctgcatgtccgcgacgttgtgttcggcagctgcgaggcgggcgactaagtcgctttcgcccgtagccgccccgccgctgcgcttcctcgcatccagctccttttctcgtgtctcgaggttagcagcctgctgctccagcgcggctctctcggcgcggatgcattccagattgcggcgcgcctgctcctcctgcgctgcctcgcggagggacaggctg

SEQ ID NO: 86585 - DNA, 984 bp, Oryza sativa
tataaaccagatgtagaggcgagggcactagtcagcagcagacgagatgaccggcgatgaagatggtaaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcgaggacatcggtcggcggcgacaaaggcaagccggtcggtgaagacgtagacgcccaacaacggcggcataaaggccagccgtgcaggcgaggacatcggtcggcggcgacgaaggcaagccggtcggtgaagacgtagacgtccaacaacggcggcataaaggccagccgtgcaggcgaggacatcggtcggcggcgacgaaggcaagccggtcggtgaagacgtaggcgcccaacaacggcggcataataggccagccgtgcaggcggaagcaccagtcggcggcggacgaggcggccggtcggtgaagacgtagacgcccaacaacggcggcataaaggccagccgtgcaggcggaagcaccagtcggcggcggacgaggcggccggtcggtgaagacgtagacgcccaacaacggcggcataaaggccagccgtgcaggcgaggacaccagtcggcggcgacgaaggcaagccggtcggtgaagacgtaggcgcccaacaacggcggcataataggccagccgtgcaggcgaggataccagtcggcggcgacgaagg

SEQ ID NO: 86586 - DNA, 2393 bp, Oryza sativa
cgctttcaccgccggcctgcctccgtcgccgccgattggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgttgccgccgattggtgcctccgcctacacggccggcctattatgccgccgctgttgggcgtctacgacttcaccgccggcttgcctccgtcgccgccgagtggtgcctccgcctacacggctggcctattatgccgccgctgttgggcgtctacgacttcaccaccggcctgcctccgtcgccgccgactggtgtccccgcctatacggtcggttggtcacaccaccgttgatgggcatcgtcatcttcaccgccggcctgcctccgtcgccgccgactggtgcctccgcctacacggctggcctattatgccgccgctgttgggcgtcttcgctttcaccgtcgaccgccttcgtcgccgccgactggtgtcttcattgttattgatggacaactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggctgcctttgggccgattcctagcacccgggggctcgttggatggaccgagtaacgcaaggtgctaagtattattcggaataaatcaaaagcatagagataagataaattcattttctgctcttaataattgcaaaagtacccgagtagtaaattctgattcgtgaaactttgttccattaatggcgaactcatgtcactcatatgcatgtctgggaagtgcctaggccgactcccggtgcttgggggctatgactagtcggacagagcgtttaaacgtaatgaatcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttacctcttacgctccaggaatggatcagtcagaacatcaccaccggctcgcctcgaccgccgctgactggtgtttccgcctgcacggctggcctattatgccgccgttgttgggcgtctacgtcttcaccgaccggcttgccttcgccgccgccgactggtgtttccgcctgcacggctggcctattatgccgccgctgttgggcgcctacgtcttcaccgaccggctcgcctttgccgccgccgactggtgtttccgcctgcacggctggcctttatgccgccgttgttgggcgtctacgtcttcaccgaccggcttgccttcgccgctgccgattggtgcttccgcctgcacagctcgcctttatgccgccgttgttgggcgtctacgtcttcaccgaccggcttgccttcgccgccgccgactggtggttccgcctgcacggctggcctttatgccgccgttgttgggcgtctacgtcttcaccgaccggccgcctcgtccgccgccgactggtgcttccgcctgcacggctggcctattatgccgccgttgttaggcgtctacgtcttcaccgaccggcttgccttcgtcgccgccgactggtatcctcgcctgcacggctggcctattatgccgccgttgttgggcgcctacgtcttcaccgaccggcttgccttcgtcgccgccgactggtgtcctcgcctgcacggctggcctttatgccgccgttgttgggcgtctacgtcttcaccgaccggccgcctcgtccgccgccgactggtgcttccgcctgcacggctggcctttatgccgccgttgttgggcgtctacgtcttcaccgaccggccgcctcgtccgccgccgactggtgcttccgcctgcacggctggcctattatgccgccgttgttgggcgcctacgtcttcaccgaccggcttgccttcgtcgcgccgaccgatgtcctcgc

SEQ ID NO: 86587 - DNA, 5641 bp, Oryza sativa
agcattgtctaagcttgtagaagagagtttttcacaaggagaaggaaactaagtaaaatagtcttgcctttaagaaggactcattaagttggcataacactaattgtttcgatggatggatatttaaattccaattattatgttgacttgcattagttaatttgtgtacatagcatgaccaagaaattggttgtggaaggcaaggcacaaaaatattgtggtcttatgaaattcatctatgcatatcgattagatgtcaaaactattgtcaataataatggtaccttaaatcccataaggtcatcggtaaattcaagtttaggttgaatgagatggataattgcctttgggtggacattaaccttactagtactctgaaagggtcacttaggcctagagaggggtgaatagactaatttcaaaacttaagtaaacgtagaagcaagaattttcagaaattccgaaaatcacaaagtgtgcgcacgggtaaagaaatgctagatctaactacccacgagaatgaataactagcacaaacagtaactagacttatagcggcacaaacaagtaaagctagaggagggggagagagatttcaccgatgttcttgtaagattaggtgttcccgaagttcaaatccttgaggggattctagtctctcttgaggagctcagaaaagccgggtcttcgttaaccctttcctctagaggctacgcaaagaattacttccagtagtgctatctctttcctttcggctctttcctttcggaggtgagatccgacattcacaaacttctcctggccagccacaagtagatcagtgactcaagagtgacaatttttggaaattctgaaaattttttggacatattcgaaaatgacctaaaccaaaattgcttgcagacattttcgtaaattctaaaaatagtttttgaataagtccgaaaacatcctgaaccattttggtcgctcagccattttggtaaatttcaaaaatgattttcggacgtccgaaaatttccaaaaccgagttcgacttcacagccatttttggaaattccgaaagtggaactgtactactattttctcaactcagacaactttcggaaattccgaaaacacatttcggacaagtccgaaaaactccagaactgatattttgaggagacactttgaaaaattgatttttgagcacccaacgcattcctcgttatcaatgcatcattcccctatatagtacgccttctctaatgacacaaacaaaataaaatttacattataccatttgatcatatgctgcatcacatcgttttctcactttcgccgggttttgtattgaaccatgctttaccgagggctaacattccttcgcacatattcaaataatttgttagtcccctctaatcacattgttattaatcaccaaaatcatttggggcctagatgcactttcatactctatatgtctaatgtcccattagcaagcacataagtaagagatgcatcagtgaagggatttacttttaagtttaagtccaaagaagtactagacttatttattttcatacagtggcagaaattttgggatataatgtgaggttgatttttcacgtctgctctaattagggggaattagttaatcagataaagttaagttgattccctatgtttttgtcgtcggaagcaaaataagccctatgtttttgttgtcggaagcaaaataagcgctaagcctggatgcatataggttttgtgttatgtatcgggaacttcggtagatttaagttcagagtaaaagtatctactaaaatatgaggatgtcttgcatattgtttgtaagtgtcttgcatattgtttctaagtgattcgaagatatgttcacaataagaaattatgatgacttttgagtgaagttattcagatattaattttcaagggtacgtgaataatatccacgttaagttatgctcttattcctgtataaggagcaaaatccatggttaatggaaccaaatattattatactacatagtcgacaatgcaagctaagtttgtaacattaactagtcgacaattcaaactaagtttgtaacatgttaatgagcaagagtatgacttaataatacttttctgcaactaagagtgatagattgctttctaaaccacttaatgtactacgataatgagaatgcgcaacattataattcgcagtttgctattcaagtaacaatgtcatgtgtttctgccgaacacattaacatcatgttgtgaaagataggtcccacgatcaaactaatgagcatattaatgtgaagttcatgctcatggatccacactacatagacttataacttaatttgaagtaagattatgttgctagccggtgcatatgaaaagtaatgcctttaacaaaatcctagatataggggcataagaattaattaacacccaataaaagtaagttaattcctaccaaggtattatgatgactataggtattgttgtcatagaagcattatgttgactgctataacacattgctttggtttactattttactaagattggactggttaggcttaacccatgcaggagcgacaactcacgtacgctaaaccattcccaaaaccccaagactaccaatcctaaggcgtgcttaaagggaacaaagggcgaatttccatcgccaatgcaacaccaccgtgttcctgtcactgctgatcccatcaccggcaacctactaccacaacaccaacgccgacaaataactaccggcaacctactatcacaacaccgacgccgacaaataactaagggcgacactaatggcttctccaaacaccggatagcacaccaccaaattccacatagtgatcatacatagcctaaaagttcatgattttaaaaattaactccagtagtagttctatccatcctcctaatatcctctcttgtaggatttctagagctgatcttactagccaaacactatcaggcaaactccatatcgcacaggagctagttcccactgaagtcagggttaggagttagaatcagtgagttagagccccttataaacaggatttgcatgtccaatttacagcaaggacggccacaaatccatcagatgatgtgggcatgtcacgcagagctatttaagcaggcaggaagaacaatgactaccaccccaactaagctgccacacttacaaactaagctacaagtggataggcgtaaaaaatattaaaatgggtaaataacactccagtttccgtgccaactttagttcacaaaagcacaagagttttcgtggcaaaaagatgtactggaactagcaacagagcagaagctcaacttctactgacaatataagccaagtcactgattattcttaacgcaccggtcattcttcacggcctgaagcgctgccctacaataaagaaaatgttttcagggtaagcattagacagcataatttatagacagcttttccagctttgtgcgggcaatgtttcatggagtattaaggaactatcacttcataataacaaggcaagcaacaagcagacgaaatactagcattccaaaaggatgtaacatttactattcatagaagcagcaaatattcctttactcaacccatcacagtgaagggtaacgagacttgccacaacgaaaataaagaccaggtaccttagagcattctcaatatcaacatttgctgggtccagcttcaagccatctgaaaaggcatcacaagcattaccatattcctatatgcacagagcaacaactaatcaattttatgatcaaaaaaatttgtgagtaatatgttctttaataacttaattattccctaaaaaaaccttaagaagcatgaaagctgctccttgccgatagcaggcttttatccaatgaggccggaacattctgcacatattagcatcagcaagagcttgttttccattttccaagcgcaaccagcagagactcctatttgccagcagagttgcagaatcatcaggactaggtccaagtcccagtgcctacattacaccaggtatacagctttcagcaataaccaaaaaaacatcacacaaatgaagctatgaaagccttccaaaaatcatttttaaaatcatcgccaatattaatactaaaaaacagtagtactgccagtaattatgaacagtgtcagatagatgacttgtttatcttcttcatctcaagtgtttgcaggtttgcataacttctttctgttgcatgcataatgttatcgtattttttgaaacaccgcatcgtgatgtattttctaacgcaggctcaggttcccccggacaccaaaactttactcagtaaagctacagtcataagagagctataatgtttgcaatgagtcaggggatgatgatacagcccatgactaccagcactatacaagctgaccagcatgtgggtatatttctctcttaaatgactccactttccaattcaggctcacccttttttttcctacccagatatttgtcctgacaaaagcacatttagttcattcatgaaatatatcttttcaatatgaccaacaaattaaaaaaagtatattcatttttttagagataatctacatctgttcttgtttctcagacaaaaaaaaaataccatcagaatacccccatgcctcaaatccacccaagtttcatccaacagacagcggaacaaatcctaccagatgcaaggcacatgacattggccagaaagaaccttcaattaataggtgtgatttaaagacaatttacttggtacaaagaaatcaacaaattatctttatatacaataactttttgtaaatagtcaacagagctataaaattgatacaagtcatctccacacaaattaacaatccatttcaagacataaagatgttctgcaatgccttacacttgtatagagttgtgccgcaagtaaataatcctttctcttgaaagcctctttaccttctactttcatttgagctattttctttacacaaagatcttcaggctgagaacaaacttattgttagagcagcagtacatttaatgctgacatgaagatgcattcagaaaactacttcggcagtttcagtatatatggatgttgctttagattacacatgttaaaacttcaacaactttggcccctaatatacaagtagctgttcttgatcaaggaaaacattttttttttgcaaaaaaaaaaggtgaagtaaaaaaatggcaccatcatatcttcaagtccaagtccttgtgaacatcaggagcaattacaaaataaatgatcgagagtaataaagttggagaataacattatggaaatacaaggatggaaaaaaaaagataccaatggcttcgaaccaaagttttttgcatgggcaaagattccatcaatactccaatctggcaccgttgaaattggtgaagtcaaaggaaataacatctcaacaatttccctatggacttggagagcagcaacttcaattggaaaaacaccaaactgcaagatgaaaaaaaaaagttctttcataatatatcatgactagtacaaatgccaactataattgcaaagaatttgaaccaaattagaaatatttcgggctgcagga

SEQ ID NO: 86588 - DNA, 1565 bp, Oryza sativa
agtgaagcccacgagctgcaccaatgcaggcatcaactcgttgcttccatgtcagaggtgggaggtcacttccataaagatggcttcgcaatgtccccttggccatgtattcgtagactagaatcatttccttctgctcttcacagtagccaatcattgcaacaaggtgccggtgcctaagcttggagagcatctcaatttctgtttcaaattctttcaagccctggccacataatggatttgcacgcttgattgccactgtagtaccctcatcgacctcacccttgtaaaccttgccaaaaccaccagtaccaataagcaaagcctcatcaaagttctttgtagcagccctaatctctgaaatgctgaatcttctgcccattctatgaccaatggaagatgaattacgtgtcaagggtgatttaccggctgcacgggcatctgtggtgcttttcatagcctcatggaggaccagtgggtgccaaccgggaggggcctccttctcatcagcttttcgtttccttcttacatagcaccatgcaaatagaaccacacttgtcagtgtcacaaaagaagctgagccaattccgacttcttcccataaaattttcctatttctatccttggaaatacccctttggttacccatgtcaatatggccaagaacataagcgaggttgccattcctgctgagcttgaatatctccaaaccattcagaagtggatcggtgcctgaagcactggtcaaggagtcagggcctagctgaagccagagtgagtctacctgctgtggcaagttgtcaaaatagtcttcatgatatgccttattaataccccctgccctgacatacacatcatagtcctcagcagctgtcttgttgttgatgtagatcttgaagaccctctggttgggcttgtcatagaaaagctcacagaaatgaaggcggaccaagtaatcaaagttggggtggacatagaatcgccatgaaacattgaaccgcttgtccacaaccatgttgttgctcatgattcttgcagtctcgtatacatcaatgggagaaattgaggagtcattgtttgagagataacttacacttgaagtgttggacacaatctgagcagcattcgcagaaaacatgaatgcttcatcagtgtaccatggtctgtgcagatactgatcgctggaagaattaagtgcatgccctccaacattcaaccggtacattgtctctaggcctctgttgcttaaaccaagaggaagctgcccatttccagcgctgccaactttgtttactgtgtcattgaacaggttatctggagtgagcatcacctcaattgcattcacaaaggcaaatgacccagggcttggatcaaactcaacctgcagaccacgagaaccaactaaaagaaaatactccttgacaactgcattgatggctgaattgctcacagtgctcctccaaacaatctcctctgacacgttgaatttcgagaccagcttgaaatcatttgcagtgacatcaaacaatgaatcattcccactgaaattcccgaatgtgtcaggg

SEQ ID NO: 86589 - DNA, 1633 bp, Oryza sativa
agcatcttcctcttgtttattggcccgggggaaaaaagggtaaaatgcggctaactctttcgagtttatgctcagttattagcatcaaagatgctcaaagagtaaaaaaaaaaaaaaaaaaacgcagccgtgtaggcgtgtgtagcttcaagcagcaaccttcttgcagtggttctccagccactccatggtgacactcttcggtctttcgagcggcaggccaagagcacggtcccaaatgagctgcgacacagataatgtgaaagaattggttgatagaatgaagaaggatcctctgcattgtagtacaaaatgcagagaagatccaaagaaatgaggtagaaagtggaaagtgagagatacctgagatcctattccaatgctccttgaaactccgaaaagaacagtgtaatacctgcgcagttagagaagttttcttaagtactcgttctaaagttagatttgctactctatcataagttcaagattaaattagacatggcattagattgtttaaccaatacagataaacataccgagcttcagataatccaaagtggttcagtagaactccgctgtgagcatcaacattaggccatgggtttttgacctgaaaatgtgaaggatgttcttatttcttagccaatgagatggaagtaaactgaaggagccgtaattaaaggagcaataattattgatcaatctagtagcattaccttgccaagctcagtgaggataggaggcacaacttcatacaacttggagacctgaaagaggataggtcgatataaatcctattgagacagtgggactgaagagagccatgcagctagaatttagactaaccagttggaaaagtggatcctcaggcaagtacttcaaagcaaactccctctgacatgtataccgtggatcggtcttacgtagaactccatgaccaaagccaggaacaacctacgaatgaatgtgtcatggcatactatctgtgaatttttcagttagagttcaacaaaaagagaatgtttattccagatcattagaaatcatttgtttgtataatataagtagctaaagaaaacagatccaatataacataacaaacttagaaccactgcttagcaatgaactctcagaaagttgagttttcatttcagttaaaacatgatgatatgcacttcctcatcaaatagaaatataacacggagataagctacctttccactttttagtgtcttccacacatactctttgagttgatcagttgtaacgtcactaccagtctcacctattacagatttgatccacaacaacacttcctgcattggatgtgaactatggttagttcacacacacacactaaaatatcaatttaaaaatggaaggaacattatgttccttcttccaaagataatctgcgacatattttgagtatgcaatgcagtgaatccttgtttagcaggatgtggcagagaagatccagtacaacaaactgagcatacctgattagccaggccgtgcaacggtccagctaaaccattcagtgcagctgcaaaagaaagataagggtctgacagagcacttccaacctgtaattgaatatcatgagcacggaatgaagaggtcagtgcccata

SEQ ID NO: 86590 - DNA, 2296 bp, Oryza sativa
gaatgcattaattgcataaatgagagtaaggtggtgtttgaatctcctgaagatgaagatgaagataacgattaagtgttttacgcaaaatgaggtggtaataatgtgtgattaattgagttttaattattacaaatttgaaaaatggattaatctgattttgtagagcaactttcatatagaaaatttttgcacgaaacgcaccgtttagtagtttgaaaagcatgccacaagtatccaaaatttcatccaactcttgttggagaaacgaacgcagcctaagagagaggagatgaaaaatttagccaaccttatagctaatctattatacatgttaactctaatgtgggtttataactagcagttagctctactattaaacttgctctaaacttattcttacatagtttttaggttgttgggttacagctggaagaaagtatgaagtttgtccaatgctgaacttattgatgtgctattaataacatactgtgctttgattttaaccttttactatagtcaaatttctccttttctgtaccaacaggttgctccatttaatacctactacccacaattgggtgaacatctggcaaaagttggtgtggatcctgcaatcaataaatgggaccagccttttgtgttgggagttgttgatccgcacgattcattatcccatcccgcgggggtttctgatgttcaggctgaatctgcagctcgtctagatcctgatctattcacaaactttatggtacatcatgtatattttgggccttctgctttgctaaacttcatgaatataggaagacagatagacgaatttattcaatctgcaccatattattttctgctggctgtcttgatgggattggtgcataacatggcatacattaaaactcattcattcatcttgcttgcattgtccatcttatccactgcacttgaatagagaggccattttgcaaacacatgctagtagtggtggtagggagctgctactttgttaaagtaggagctggtgtttttcttttataatacagctaactttttttttctagtacagtgttgtatcatgactgttttcctcctgcagattcctagttggtttgggactgaagtgcaagaacctacaaaatgctgtccttttccattgcctgaaatttattgtgcatcccagagcaaaaaggtatggtgcattgttaaattcatcaaagcttggtcttcaggtgctcttgctctgacttgattaattctaattatgtcccctactgttcttaaaaaaaactctttaaaggtcattgttcagacttcggactacctgcatgtgcattgctaatttgtctatacttgcgctggtgcctactttagaatgaaccctcgaattttttcccactccatgactttgtgggcttgtggctttatgtacaaattgaacaataccattgaaataattggtgcttcgatattcttccacaattcgcatgtctaaattgtagtagcttagtgtgtacgaatctagctgcattagggatgctggagttatggagcacaagatctggttattatttgtgaagtaggagaaaaatttgtcctgttgtttttaccactgacatttgcctcatttagatttttctaattcaactctgtgtttacaccattcatattcagcttgctgcactggaagatattaggaggactattcgggagctgcaaattgatgacaataggaagaaggaattgacaaatgccctccatgcacagttcaaagattggttatatggtaagttttcatctgtacattcagttgctaatgcattcatatctcctttatgcttgttttagtgccatttgcctatgatggttttgcctaagtcattagaattgcaccttgctttctgaaatttagtctcttcaaagaaacagtgtcaagaatcaaattgtttgctttgaccatacaaacaaatttgcatgaatggagcgctcagtaatgagtaattactgctcagcatgaggattcttatgtactgttgggtagctacaatcaaatgtgcacactaatacagtacaaacctgtcacaagaatatatgattgggtcaacctagtagcttcaataagtgttttttttccaatataggtgtagtatagagtatgacggccatacataatgaacttgaaccattattctgggcttccaattccacatgattctgaatccgttttattcagcatgtcagctggagtattaagtacaacatacctacatctatactactttaaaagcctcttgtggtggtg

SEQ ID NO: 86591 - DNA, 3031 bp, Oryza sativa
ccggcgcctccgggctccacggggctcaccgtctacgtcgccggcggccagggccaggttgtcggcggcagcgtcgtggggtcgctcatcgccgcgggcccggtcatggtgatcgcgtccacgttcgccaacgccacctacgagcgcctgccattggaggaagaagaggagggctcaggcccgcccatgcccggcggcgccgagcccctcatggccggcggccacggcatcgccgacccttcggcgctgccaatgttcaacctgccgccgagcaacgggctcggcggcggcggcgacggtttcccatgggcggcgcacccccgcccaccgtactgatcgatggcaatagcatggaagattcatggcggctagctcgccgccaccggcagcggcggcggcggcgatggccttctcttctagcaagctctagctagctgcatggttactgttccattggaggacatgatgatcgatgtgatgcaagatcagtggcgccattaattaggttagtacatatgatgaagtggtgagattaattagctactactgctactatgctgctgctacttaatttgttgtggtgaaataattaaggtaaggtgatgcttgtggtttaattaatttgtacttaattgagctagctatctagctaaatctagctcggatgatgatgcatgcgatgtttcaagtgtttctaatcgatgtttttcggtttaatttagaggtaatttgtctgacattgttgcaacttgtggccttttctagcttctttccttggaatttgatctgtgcaacatgtgcttctcatacttaatatatgagtttcaggagaaacgatcatttctcccatagatcttaactactatgcatgttctaccagtatttgcatatatagtatgtaagctatagtatctgttggtcccaaatctagcactgctttgagcaaatttattaatactctcttctctgccttctcgatcccatcttcaaaatctgatgcaaaattagataatctagcaagcgtgatctcaactttgttaatttgaatgtttcaatgtaagcatgcacgcgtgcgtgcaaatgtttactgtgtttccagatgtaactagctctagcgctagaacttgagtttttttaccaaactaacaagagttttcagtaaacttcagtactactgaatgtgaaggcgtgcagtgcttcagatcaactttcacgtgcagcactccatgatttcaactttcaatcaaatttttcagtaaaaagatgagcttggaatcctaggatcgtttagggaattaatataaggagctagctgcatctgcatactgaatgaaatcaaagggtaaacatgattgcatgaatactgaataagcttctgtgtatgagaactgaagcttatacacttacttctaattggggagatattgatgcactattatataagctagtttcatgccatttagagctctgaaatgggggacctgtagatactactatgatttcaaatgcatgaaactcaatgttaaatgtacttttttctaaaaaaaaaagaaagatttttgtgtatgcatagccggccatgtataacagctcaattaattaagtgtagcatgcatgttattaatgtggaaaacatttttccgaacacaatggttcttataaatgttgatcaatgtctgttgtataaccaaattaatgcatatatagctacattgatcaaatacccagctaaaaattatataattgaagttaatttgaatttcagttcagacttgtgtgtgcaaattgcttagtcccaaaatgaaacttgatatggccagttttctacacgtgcaactccttgaagaagaatacacattttaggccccatttataggatttgtggaggaattttgtaggattcaaatcctataggaatcttttcaatttttccctttaagacgaaggattggagtacgctttcaaaattatgtgacattgctaaggaatgtctcgatacatgtagattttggaggaaaattagagcttcaacctattgaaaaaaaaattccttttgtcttcgattcttgcatttttcttgggatctatatattcaaacgattatttctattttcctgtgtcttgtgatcatctattttgcacttgcattcctgtcaaagtaaaaatcatgtgtttttttctattcattttctcaacctcatgtttcaaagaatgttgcgatttcttatccattttgcaaaaaaaaaatgcatgaagagatgaggtaatattgtgcatttacattttgtttgtcttaaagttcgttgatagatatatcttttcaagcactagctattagcaagctagctaggaaaactattagctaattatattaaagcatgttgcaatttctttcacaataataaaatatgtaggattaaatctactaatttgggatatttgttgaaggttaatataatttctaaatttgtattcaacagccaattaattagcatatatacacatataattagtatatgtgtaggtgtccgctttgacatatgttatctactaataataattaggtggatcaattcatgtgtgcatggaatatcacaattcaaattgtggtctaaaattgtatctataacggccgtctgtcaattgatatgatatacaatatgctgaataatgcttgcgtttcgaaaaaatatatcactatattgtcaatctattatctattacttcctctttttgaaaatataaggcacataggttttcacataaccattatttttctaattcataatatattatctatatataacaaaaaaaattaacatcatatgaaaatattctcaaatgcaaatatagtgatactatatatgtgcatggcactagttaaccacatacatttttagcttaataattagtaaaaaaaagtttaaatgttgattttgcagtataaggacgtcttatatatatttactagctagtattctattactagtgtatacgtttgttttccaacgaaaaggcagcacaatataat

SEQ ID NO: 86592 - DNA, 3739 bp, Oryza sativa
gccccattatgatccagctaggcataggatttcaaagcaactctgaaatgcaatggcaaaacataaaggactataaggaaaattaaggttttcacaggaccacagatataaccagaccttcatggaaaaagaacagcatctagtaaagtatgacctgcaatgcaagattgaccctggatatggcaatctttgattgctaatagcagattagaagttctcaacaaaaaaatatagcaaaagttcacctagcagctgttgttatgtttaaatatgaaagggatcttcgtttcaaaaaatgtccaaaggctactcatggtgcaacaaacatcatcactttcctcatagtactagaaaattatttgcagtaaagaaaagaaatatttttgcaggtaacaactacttcatagcagaaattcaaaagacatctagaaggcccaagtgggcagaaaccagtaaagcatcatttttggcaaatagaatgcccaagtgagcataaaccagcaaggcatcatttggcaaatcaatgtgtagagttccacctccccaagaccccaacaacaaattgcataaactataagaatatttgtatttgtacctgcagcaacaattattgctaaggagttcttagtctatccaaatttagcactgatatttcaaagagcacagtattttcttttccaactggaacatcttttcctccatctgggttgtggatgcaactgtgcaagaatgtctgcagtgtaacatgtgttacacatcctttaacctcacgtacatttagtttgtagtaaatggtacttgccaccaaatcattctccaagtgatgagactgcccggccacttacatgtctagatgcactgaagcagtatatttccgtaaaatatgtattctgggatttctgctctcttgcaagatcatacctgccacatttcaaacatgccaccctatgagattactgcaacaaacttttcagagagccaaaacgcttgtcgaggattagacaatagaatcattcaatcagcactactgaccaccctgacaagataaagaaacatctatatctggtagataagagaccaaacttcgcattttaaactctgtaaaggtttttaagtaaacgttgagcttgccatgtcattcctggttttgagaatgctctgcatataaaactaagagtgcctttagatggactgaatcctttttctttcatatctttgagacattttttcacctcagttccatttcgaatccttgaccatccacttacaaggatatcataagtacaggatgtaggatgaacacctctcttttgcatatccttgaagagctctttagcttgagtcatcattcctgctttagtgaagtcacttataagagcattataagtgcttactttaggaacaaagccctttcccaccatttcacaatacaatctcattgcttcgactttgttgctttgttttccatgtcctgtagccagtatgtcataggtgagattattgggttcaagcccactcttctccatctcaatgagcacggtgcctgcttctccgatccttccaacagactcaagaccacccagaagcgtgttgaaagtagctatatttggtgaaatgttttggtgaagcatctgagcatatgtagcaaatgcattatctagatggctgctcttgcaatgaccaagaataagagcattgaatgtgattgtgtctggggcaattccactccccaacatttcttccagaacaactgtggcttttcttgtcatgccatggtaacacagaacttgcaaaagcgtattgtatacggtgatatcagcatgaagcccagcattcatcatccattcatgaatatccagaatcacatccaacctcctgctttgtgaacatgcttgcaaaacccgtcgatgagtcagagaggatggagagaatccagctgagaccatctcatttagcaaatactttgccttctccactgccccagtcccaaagagaccagcaaccagtgtgttgtatgtgatgaggttaggctttatggagctcatcttcatttcatgaaggagttttagagctttagcagtctctcctttcctgcaatgcgaaacaatcatagtgttatatgttgattgatcaggttttaatcccatatttctcatctctgtcaagaaggattttgcttccttaaacttcccaagcatgcaaaggcaattgataaacacattataaacaactgcatcgggcaacatgtttctgtccattaactcctgaccaaacttaaaagcagtaggcatgtcgcctgctttgaagagcccatctattaaagtggtatagtttacgtgatctagtgacaggccactcccactcgcatctttgaacaatgccatggcttcctctatttttccgttctgtctcaaaccattcaccagagaatcaacaatgaatttatttaccttgacaccctcacatagcatgtcatggtacacctcaagagctgcatcttgcccttggaacttgaagaaaccatcaataagtgttccgtaggtcaccacatttggattgatgcccctttccttcatcatcctcttatactcagttgctttgtcaagcaatcctcttttaacaaagccgttgatgaccgatgagaacgtaacaacatttggactgatcgatttctcctccatttccagcaacacctgctctgcctcatcgacgttgtgagctttgcagagagcgtcgatcaatacagtgtatgtaacaccattgggggagagattatctgaaagagcaaaacgaagtgtgtcctttacttcatcagtcttgccttgtttacccaaccagtccatcaaagcagtataggtgaccaaatccatgaccacgcctctagaaaccatctcccccaacaggctgagcaactccttgcccctcccagctttcgccagcgagtcaataagcgtacagtaggtgacatggtttggcgcagccccaaccttgtccatctccctgaaaagagcatacgcctccgagaagcggccatccctacaaagtccagcaacgagagcgctaagcgtgaccacatccagcagcactccattcctgaccattccctcatacaaatcgaatgcctcctcgacccctttcgtcctgcagtagtacacaatgaagggtgtgtaggtcgccacattcggatcaacccctgcctccttcatcatgtccagcacgccccgcgcagcatcaacctggccggcgcggcagaacccggcaaccaaggtattgtagcccaccacatccattggcagcccctgtgccgtcatcctgtcggccacggacaatgctgcgggcgtgtccccaaccctgcaatatccagcaatgagagtgttccagccgatgacatccaaggcgtggatccctccgcccctgtcggccagggccgccgccgcgtcgacctggccattcctgcagagcccagcgagcaaagtgttgacggtgaccccgtcgaacggcaccccgcgcttgcacatttcggcgagcaccgcgggggcatgggcatggtcggagagggcggcgagaaggatgttgtaggcgacggtggtcgggcgagaggagcggaggagcgcgatggcggggcggagcaggcggaggcggcagtgggagtagaggagggcgttgagggaggcggggtcggcggggcggaagcggatggcggcggcggcgaggccggaggtggcgagggcggggatga

SEQ ID NO: 86593 - DNA, 1398 bp, Oryza sativa
gagagtaaatgtcgcaatgctcgaccaatatccacaagaaacagaggacaatctcgtccatctcctgaaggcgcagcattacaagacgttcatactattgccgtacaacacagagttagtttaattttactgtcttcctacatactaaatttcattcccgtacgaacttgctaagtgtttcatatgtaatgcatcccacgcacattgcagattccactgggtgcttttactcttcgacctgtcggcctgcaccgtcaacgtatatgactcaatggataaaaaagagtctacgtttaacaaggttttcgaacttatacacaggtaccgtcataagttcctctgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgatttaaatacatacaagtgtatattaattagatctctcgttgtttgtcatttatttgtagtgcgtaaagcaaaagcagggaactaacttgtgcggctattacgtgtgcgagtattgccactgccttgcagaccaaatcatcaccacaagagagctcgatgtacgtacaaataaattcaaaatttcattacgtaacgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactatgacggaaacacaattcaccggtccttagtttctgagctagcagcgagtactactactacgtcgaaatcgtagctagctaggacatataatggattataattaatacatgactacatatgtttctatatgcatgtgtacacattttctataatgtaaatatattttggtcatatatatatatacacatatgcatttgcataacatatatatgtataaatatatatatgcatgtacatatgtactgtatatatatatatatatatatatatatatatatatatatatatatatatatatatataaaatatgtatgcatatatatgtattgaaacatatatatgcatggtttatatatatatatatatatatatatatataaaccatgcagcaacagggccatgcaaaaaaaaaaggtcagctcgatctttagtcccggttggtaacactaaccgggactaaagatcgagcggaccttttttttttgcatggccctgttgctgcatggtttatatatatatatatatatatata

SEQ ID NO: 86594 - DNA, 3069 bp, Oryza sativa
cgtgccctgtttgcaaagcactacgatacaagattagacgagacgatctaggggaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgctgatggttcgtagtggcgaaacatcgacagaaaatttaaagaatttggaaaggacgcacgaaacagacggtttggttttagtacggatggcatgaatccttttggagagatgagcagcggctatagcacttggcccgttatgatgtgtatctacaacctcccccatggctatgcatgaagaggaagtacataatgatgccgattattattcaaggccccaagcaacctggtaacgacatcgatgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttagcaacctatccggatagtccaacaaggggtacaaggcttgcactcactgtatggatgaaacaaaaagtacgtatcttaagcactgtaggaaggttgtatacttgggtcatcgtcgattccttgcaacaaaccatccggtacggaagaaaggcaagcacttcgaacataaggccgaccaccgtatgaagcctaaacatcgcagcgggaaaacagtgtttgctatggttaaagatcttaaagtagtgttcggaaaggggcctggaagccagcctatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacgaaaagtcgaaagatatggaacgtaatgatctgaagcatatgtccgggcaacaataacaaagctatgtgcattcatgaacgcaatttcgtagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctgtgtacctacacaacatgtttcctttcgagaggtacatgggcgttttgaagaagtatgttcgtaaccgtgctcatccagaggcaagcatcgccaagggttatggaacagaggaggtcaccgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcacgccaggaacatcggtaagtccgatgcatggattacacagcatcacattgatactttccccacgtggctacgacaacatctcatgggtaacgagtcaatcaaccaacaacttgccttcctggcgaggggaccgtctgggtcgatcgcgacattctagggatatgagatcaatgggtacacattctacacgagagcccaagacatgaagagcacgaaccaaaacagcgctgttcgtgtcgatgccatgggacacgatggaacaactgccacgtattacggtgccatcgaggatatatgggaacttgactatggtcctctcaaggttcctctgttccggtgccaatgggttaggttgactggtggaggcgtaatgattgatgacagtggtatgacaactgttgaccttaacaaggttggatactcggacgaaccttttgtccttgccaatgatgtaacgcaagtctttttcgtgaaggacatgtctagcaaaggaaagaagggcagagggcctgacgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcataatttactatcattcatatgctacatttaattgactatcattcatatgctaattataattgactagagaatttttaaaagtattaaattattcatgtggcatttacagatgttaattagagtttttcacaatttaatttactatctttcatatgctacttatatatgactattcgaatttttaaaaggtttaaatcatgcatgtggcatttacatatgttaattacagtttttaacatttaatttaatataattcctacgctaagtatatatgatgattataatttttattaattttaaatcatgcagtatgtacatacatatcttaattagagtttttaccaatttaataatatcattcatatgctaagtatatatgattattggaatttttattaattttaagtcatatatttgcttattacgatttatccacttaatttattacagacaaaaataatttttcgaagtaattgtcattaatctttgtactttaaataatgttaatgcattaacttctattttagaaacacatatgtaagcgaaaataatatgcagtgctataatctttagtcccggttcttaaccctaaccgggtttaaaaataatttggaaatagcgggaaaagatctttactcctggttgatgagaacaacc

SEQ ID NO: 86595 - DNA, 1158 bp, Oryza sativa
aagagataagaggagacagggacgctttatatagacccacgggggtcgatcgtggccgggatggccgcgatttcgccggcggagtggggagaagtggggaggagagagagactggattcgaaattcgaatcccggctgtctcgagcgcggcacgggcgggagagagaggaagtgggcgcgggggacgcgggcgcgggtggcgacgtgggcgacttggcctagaagacgagggagcgagggtgtggcggcgccggctggaggttgggggaggacccgacaggtgggccccacctgtcggcgaccccgagagagaggaggggggcggccggctcagctgggcctcgtccttcggccggcctagcggggagggggaggaaggagagaatgggccggcggcccattccgaaaagaaaaagagggaaaaagaaagaaaaagaaggaaaagaatttccaaggaattaaatattgcttgtgctcatttttaattggttaaaattatttctagaactttgaaaattccactaaaaatcttgttagcttatttcaacatgtagaactcaggaaaaatcccacatgctagttccgattattatttgcattaattcctttagggtttctctcttgcttttacaccggtattttcttgagaccatttataacgtcaatttaggcttgagaaagaactttagggtgtgacaattaacataggaacttatgacaatacctgtctataagttcgaaagccttgtcaaacgtagactcttttttatccattgagtcatatacgttgacggtggaggcctccaagtcgaagagtaaaaggacccagtggaatctgcattgtgcgtcggatgcattacatatgaaacacttagcatgttcgtacgggaatgaaatttggtataggaagacagtaaaaactaacactgtgttgtacgacaatagtatgaatgtcttgtaatgctgcgccttcaggagatggacgagattttcctctgtagcttgcggatactggtcgagtattgcgacgtttactttccgagggtcgatgaatccagtatcgaaaaccccctgccgtcgggccctttgaatctccattctacaacgataaaaggaagtatatattatatatagtaaatgtaataagaaatctaactg

SEQ ID NO: 86596 - DNA, 3641 bp, Oryza sativa
atgttccaggtcaaggctaatgctgatactcctgcggatgcactgactgcaagaaataacggtgcggaagggattgggttgtgcagaacagaacacatggttggtacactgctttatcttattattcaaggcatcttgatggattaattctgacagctgtctctgctacatttgttctttagttcttctcttctgatgaaaggataaaggccatgagacagatgataatggcggaaacaattgaacacaggcagatagcactagatcgcctcttgccatatcagagacttgactttgaaggaattttccgtgcaatggatggtatgtgataccattacatttagtcttaagcttcatccaactttctcaatatcattactggcttcatagttaagataatgtttagtgcttaatgcatatgctataatcatatgattttgtacattactttcacattttcgtgcaaacatgtaatatttgtagtctctgatcattaattattgcatcattgcttgtgtttcaggacttcctgtgactattcgactcttggatcctccactccacgaattccttccagagggtaacgttgaggatatggttcgtttgttgtcttctggaaacgtatatactcaggaggaaattcttacaagaatagaaaaactttctgaagtgaatccaatgcttggcttccgtgggtgcaggtcagctctttgtgttgtgctttcatcatgcatttgtttgaccgcaattaattattaaaaaggaggtaccacaccagtgattctgatttgcaatttgtttgacacttcaggcttgggatatcatacccagaattgacagcaatgcaagcccgtgctatctttgaagctgctatttctatgactgaacaaggtgttaaagttttcccagagataatggtgcctctcattggaacacctcaggtatacatgtatttattgtctggcattacatagctatgatatgcttcacctgctctatgccatctatattaagaatttgagttactacagtgctactgaactcccaatattaggatgtattgtattttctgtagatggataagaaagatttgcttattttgagaagaaattttccgtcgtcgcttattccaggttccatacattttataatttttgagcttgaacaactaatattattatgttactcttttaggaactcgcccaacaagtagatgtaattcgtgaagttgccgaaaaggtttttgcaaatgcagaaacaaccattagctacaaaattggatccatgattgaggttcccagggctgctcttatagctgatgaggttagttggtatcgactttgctgtttatttagcatgtatttctacctaatttgtgaatactgttctatgtttctctgaacttcaataatggatgacagatagcagcactagccgaattcttctcgtttgggacgaacgacctgactcagatgacatttggttatagcagggacgatgttggcaagtttctgccaacctacttgtcaaagggtatcctccagaatgaccccttcgaggtaatcttactcctgatcaagctcttaatctcaaattctcagttgggctacaaatacatgacagcacacctaagacagctccatatattattctatatttttctgttgatcaaaattgtctgctctgagattatctcatttagctaatccgtgtctccctgaacgcatgtatttgcaggtgtttgaccagaagggagtgggggagcttgttaaggttgccgtagagcggggccggaaggcaaggcctgatttagaggtataatcagctcctaaggcataagttatcgtgaaataattatgcattaccgtgtacctttcgaacatatatattgaagggcaaaacttgtttgattataatcaatcaaattgatgcttgtcattgaaaatatatattttttgtaataggtgggcatttgtggggaacatggtggtgagccttcttcagttgcatttttcgcgaaggttgggctgaactacgtttcttgctccccattcaggtcagctgccgctttcaaatttgattagttaacaaaatcaacatatactgataaatattgatcccaatattttcaaacaactgtgaaactactgctgattgatctggacttgacatacttaacgatttggattcagggttccaattgcaaggctagcagcagcgcaggtgatgctgtgatcggcgagtactaatgaagcaaaccgttggtgcatcttgtaaatatacgaagagtaaataatgcttaaataatttatgttacgatggacactcgcaacatgctttgcttgacgaaatgtatgatgacctgcaaatggaggtttgcatgtgtataaataatattttttgtttgtgtgcccacggtaattgctgccataaacatcaaacagctatcagaggttgcatgttaaggcacctgaaataattgtaatttatttcgagaattactcaaatgaaatgtcatgtttttttgtacctatttattgaggaaatgttttgcacattgtttgatccttgagatcgtcctagtaattctcgcttgacacaatattttatttaatttggttgtggtgcttttgctagtcatttccacagctgcttgtgttatgcaaatgttctagagcatgtgtggccgccgtgccaacgttatggtaggatgcccgacaagccgacagttttcgtaagcctttttaagatccaatttcaaaaagattgcttctctcttagacaataaattagtctttgttcttttccctttttgtgaaacgaagactaaaaagtcttgtactcttgtacatattgtttgcatgcaaccttattgattgcagcagacaccttatgatacccgagatcaattatttcttggcttcagccgagtcaatgggtaacaaagataactgaaccaatgccccgtagcccgtaggccatatggctaaagctccagcccaaccatttcgagcctccgatgtactccttatgtttcaaaatatcaaaatataataatttatagcatttaaatcttgtttcaaaatataaaaaattttagcatgatttagagtactccctccttccaaaaatctaagaaatatttcattatttggtttttccaaaaatcaagtttgtagttactatgtgttaaattaaattgttgatcggaaaccaagaagtcattctaatacttattggttatatgttcattagttttgtcatatggtgagtgagttaattactttttggttttgatgcaaaagaaataggtcttagatttttggaaagagggagtactatttatctctttaatcaccttctattgtaattcctttttatcttttcctttagcctacctcatccatctcatatctttttacaggataactccatctgatcccatattattttaaagggatatctctatctgatggagtgaaaaataagaggtcaaagagatagaaatctactaagggcttgtttagttaatgaaaagaaaatttttgggtgtcacatcggatgtttaatcggatgtcggaagggcttttcagacataaataaaaaaaataatttcataactcgcttggaaaacgcgagac

SEQ ID NO: 86597 - DNA, 2238 bp, Oryza sativa
actaacagtatgacctgcacatttcaggagagatgtacaatctgctaattttcaagcttcatgatgttttttcaccttagcattggcaacaatgtaaatgtactcatttctatctatagcattaagcattgtattttcaaacttaaatttgctttatgacacaaatccagttttctcttgtgggattaaaacccaggtaaaaaagacaatgaacaataaactttagaccaaacagtaaagaatgttatatgttgcatatagcatttacgaggagccaaaccggtgatgttgtatgagaggattgtgagttcctttcagttaactaaggcagtggacgtcatactatacatgaactttagaagagcatatttcaaagaaaagggggagcataataacgtattcaatgtaatgttctagttgtggtcaccataccataaaatttccaaaataacgtttgcagatgaaacatgtgcaccaaagagctaaatggattcatcattactcttctcacctcctgtgctcaacttgaagatgccagaagggaaagcccaagaaataacccttgtggatcttggggcctgcagacgacactcttctatcaccggagtaccgcagatgccatccttgatgaatgattggccacaatctaagttccttgcaatatttccacctatgactcgattcttacagagatttcaagatgccaatagagccctgcacattaactaggtctggctggatgggtataacatcaatggtgctcgctgcctctgtaagacgacctgatcgtcctaacatatccagaaagagtgtgtagtggctcctctgtgggagaacaccaaacaaattgcccatagagttgaagtatttgatgccaatgtcaactaagccactgcggttgcaagcgaaaagcattagtgagaaagtgatgccatcaggcttagctccaaccaatgtcatgtcttcgaaagccgacaacgcttcattataatactcgttggataccagtgcagacatcaaggcattccaggacacaacttttggctcgctgattgactggaaaacgctcctagcatcccccatacacttgcatttgctgtacatgtcaataagactgttagagaccgaaatgtcactactcaatcctagtttcaccgagcagctatgcaactgcttcccagtctctatggatgccaagcttgcagcagacgaaaggaagctagcgatgctgaaaccatcgatatcaacatcctcatggaacatccggacaaacatttcaagggtcctctgttgaaggcccatctgatttaaccctctagcaaggcttgtgtatgtgaacctgtcccttatgaaggccattgtggtcgccactgcccatgcatcatccatccttgcaaacctaacataaacatcaaccaaggagttcccaacagctgcatccaaagattcaaagctggtcttgagaatgtagccatggattttcctggcatgcaggaaagctagcgaggagctactgcctttgagaagagtggagacggtgaacgagttgggaagcaccccgctaagccgcatctgagaaaatgccaaaaacgcctcctcatctctgccatggcatgcaagtccagcgatcaaggcagtccaggacacgacattcggcttgtcgactgcatggaaagtgtgcaacaagtcgagtaaacggctggaggacttgctgtacaagtccacaagtgcattgcagactgaggtatcatgctctagtccaaacttgaacaagcgggcatgaatctgccgtccaggctgcagtgcccggaaggaggagcaagcagagatcagggcagcgtaggtgaaggcattgggcagcactgcagcacgggtcatggagcggaacatctgaagagcagactggaggtctccactccgcgcgtagccagtaatgatggcggtccagagcacgacgtcggtttgaggcgtggagtggagcacggtgtgggcatagcccatgttgccgcagttgcagtacatatggaggagcgcggtcttgagcaccaggttgagacccgctccccagcgcaggagctgagcatgaagctgagtgccttggtggtgcaggcggccggaggcgcaggcagagagtagctgggcgaaggtgtgttgagtgggcggcgcaccggcttggagcatgcagggatagagcgcgagagcttgcctccatgggccgcgcccgcgcggacgagagca

SEQ ID NO: 86598 - DNA, 3993 bp, Oryza sativa
cagatagatcaatatagagagatgtggcagtaactaaaagagcctgttcttttttaaaaatctgatttggcagcttatgcgatgagtgccacaatagcacccatagaaaggtttgtgatagaaaattccccaaaaaattccttgtttgcaagagcgagcttaaaaacagtaatatacatagtaggtgatataggtttgcggtgctctcttgccacagccagaaaataaaagtttacgatgcaatgtcaatagtcagctctgaaatgaaccaaaaaggaaagtataacttacctaagtaagaaaattactatagaggagaaaaatagatagataaaagactaaaaagaaattacttcgattgcattccatagtcgaacagttccatcagaagatgatgtagctaactgagttgaattcggtttgaatcttatatctgtaataaagttcgtatgttcttctattttagtatccatgttaagattgtccatattccagaggaagacctgcaacattgtagaattctttagaaccaaatatgccccagatatacaaacatctttacttctcttcccaagtcaaatagaagaaaaaggcactaagaaaattataacatcattctgcatgtaaaagtggggcaaaggatgtacggagaagacaatgatgaaatgtcattactggaaacacaaatttgattttgccagttataactgtgtgaaaacatcaaaattacttttattagttgaattgcagttatagaagaaatagcaatgatcttcaaggaatatatattcttacgatctggcacaacagagcaacttcttgcgagagaaattattaaaccccctcaaaatatataatagagtttaacaaagcaacctttttctcatggccagcactagccagcaatttcccatctgtggagaagtgacagcaaacaaccttattgttgcttgtacggttattaccaaactcactcaacgagagacctacacaaaaatgaacttattctaaatttttctctgttcacagatgtatgacacaaatcaagaacttgaaatatttaccctttaaggaatcctgctctgaggaccctttcttcaatgaagcaaatatgtcccgcccatctccatcatcatttgacaaaaatgaatcaacgttttcatcaaaatcaacaaaactatccagattatcctgtcaataacagaagttactcaagcacagccaactgattgccaaaaactgataacgttgatggaagagcacagcacataccatttgatttgaggatgaagcaagtccactggttccatctgcaccgcaaattaatgaactcttttgtacaatgttcatgttgctagccactggtaacccaccaccaggtgtgtgagtggaaggagttgagggtggggaagggccaacagtatttcctgtgcctgtactattagctgcgccggaagaggttggtttccgttttctagtattctggatatcaagaataattggaacattcaggtatcgcccatatagagttagggaaagttgatattatttgtaacaagctaattagttcattcaacctgttgcaattgctgctgctgctgctgtaattccataagacggtgacctgagggctgctgcatttgagccatcttcaactaataggattgcaaaatagtgtgtgcagttaatgaatacatgcatacagtactaaaaaacgacaaaaatagtataattacccatagaatatattgtgttgctagaacaaggtgaaaatgaacctccagaattgttctcaattagaaattatcacattatcagagaaagcgaatatctaagccattgattttgaggtgggtccataagttaaaacaaaaaaaaatactgaaattcggatttagattttttttttaaaatacaagataaagagctaatgtcaaatacaaagcagggaaaactgtaatattattacaaaataaaacaaaatggccagtttaatttccattcaaatatcaaagaaaatatcctgagtaattataacacagaacaaggaacagaaagtgaaccactaacgtagtgttcttaattgaaacaggtgaatgtattgatagaaccgtagaataatatgaaagcaaaacataggtcattatggatatgcaaacttatgtttggacatgtcattaactcttaaataaagtttctcagaccgattgcatactgaccttcatcatataatctgattcatctggtcgaacctttggtgaaccagatggagctggagaacccattctagcaaggtcattctgtgattgtgcttgagcaattaattgttgttgtggcgataaaagttgaaattggtttggagatgccatcaactgcttctgcacacctaaatttgaccggagttggtcaatacctgggaccttcagcaggcaactagtaggtaagcttttcttcaaggaaaccagagaagtatgcaagcatatggaaagggatatcagcaaactcactgtaagaggccagcctttcagtggtacactaccaacaccttgatttaatcctaagtagaagcaaaagaattataaggaaaaatgtgccttccatcatttactggaattgctaatcaaacgctgatggccacatgctaactagctacaaataaatcaagaaatccccaagtgtgaactttggggctaaagcttatcttccatctgagaatactaggcataaaaaaaaagcgcttgtacacaaaacagatttttatgggaatgtcatgcacctattccataaagtccaaggttaccatctgttttcctcatagagaaacagagagaatagttgtgtgattgcaattaactcaccagtggaaactaatccagattttggttgcatcattcctgatccatacaaagttgaagggtctgtaggcattgatctttgtgacatggcagcatcacctttcatgtccttgaaaatggttggacagagagtaagaagtgagaggcggtacataaaccaatggagtttgagaagatggaagggtattacaggttgctggtttcttgagtggatctgctgtagagctgacatgttgaccgaggcaccctgaaccagttgtctgaatggcgagagttttcatgaggaacggtaatctttgagatggttgctggggggaagaagaaaataaagttacccagtttggttagttgctggtttgaggagagcaatcctgttagcgtccaggagttggtgggaagcatcggaatcggtgggattggggttcctcattcggtcttgcatcattttagaagcgaggacagcagaaacatcagagttgagagcatccatagcagcattgagagggggatctcttcgctgctggtgggcattctgctgctgttgcagtagctggagcctcatctgctgttccctggatttgatctaaaacagaggcaagagcattagagattttgggacccggcatgattgtgatgatgattttctgttacgagtagtgcgagaatacgtctatcggaataggaggaggaggctgaggctgaggctgtggtggtttgtctcttgttcttgcatcgaagatgtcccagaagatggaccaccattcgaagaggaagcctccaggagcatcgatggctgcgttccgttggctcagcatcaatcaatcaatctatcaatcaagagaagaagaagaagaagaagtataggatgcgtgcgtacccacgggatcggtggcgaccttgccctcggtcatgaaggccttagcggtgttgtgcatgttgcgcttcaccaggtagtcgtagatgtacacatccagcctggaatcgcacgcatccatcagatcagttcagttcatccacacccccaaatcgatcgatgaatctaatcaattccgcatccgaaaggaggaagaagaagaagaagaagaaattcacaaaacacgcacatcttgtctgcctcccaattgctccgcgccatcta

SEQ ID NO: 86599 - DNA, 6016 bp, Oryza sativa
tttaaactacattacaggcttccaagagtcgtttcgttgtgggatctcatgtctgggtcgaggacccagatgaggcttggatggatggcctggtagaggagatcaatgaaaatgatctcgtagtaaactgcacttctggcaagaaggtcaccattaatgtgggaagtgcctatcctaaggatacagaatctccccgaggtggtgtggaggatatgacaaggctagcttatttgcatgagccaggagtactccaaaatctaaagtccagatatgcactcaatgaaatatatgtaagttgagctcccaacatatcatctttagctttattattattgtatccaatgaaaacactttcgcttatttttataacttcttccatgaacattgtttgtctcgacattgctttaaaaaaagaaaaagaaaaaaggacctatactaagctggtgtttgaatctcctgaagatgaagatgaagataaagattaagtgttttacgcaaaacgaggtggtaataacgtgtgattaattgagttttaattattacaaacttggaattggattaatctgatattttagaacaactttcatatagaaagttttcgcacaaaacacaccgtttagcagtttgaaaagcgtgccagtttacccaacttttgttgtagattcgaacagggccttgatacaaattctacactaccatattttggtgttagcaccactaaaataatcagctcaatcgaaactaacccatatcaaatattatcattgacttaataaaaaaatccaataagataaaaaaaaactttacttgagttatctatttattttgccctaatatataagtagctttgtttcgtattatgaagtggttatatatactttagaaaaaaactctttacccttgtgagtgctgggatgtccttatagaaaattgtttatgcatgttgtgtgctaatcatcttggatgtgctggtttggttagttctccttatggttccataattcttgatgttttggacagctgcatggtctccaaaacttctctttgattatgattttcaattataatatattttataaaaataagtaaatgtttcattgcactaaagtacttttagggactaatctatacatcgtgttctagtgtctccaaattaaatgttttaaaaaattattgatagttgaagtactaattgtttgacctcaatctttgtccaaaacatcaagaattatttgaccagatggagtagaagcagattagccaaattatgttggaattctcccccccccccatattttcattcctccatcacctgcctcccttccttggtggcactgttggccaccgcctctccatgggcagcccattattccttttcctcttgacactgtcgatgattggttcatcaatgtgctgcatggttgagcaattttttttctcaggatctgcattcccagctcccattcctctctcacaaatgcgactgcgccgacggggagcacgttgtgacggcagcgaactagaaatgcatgtgatggcttgcttttccaaactaccccaccctcatcgcccaagtgtcgtcatcatctgcgggcgggaggtctccagatcttcgagttcatggcggattcaaatcagaaatggtagataaggcaggacaaaaccaaccatgcatccatgcccccccccctgtcccatgcctccactgccatctctgcctcatccatcccgtacccacgtcgaggaccaatgctgccaatgctctgagtggaagaagaagaagctattttttaggtagggggctaatcttgtctaaactcacactgttaggcccaacaatgacgaattcggttttttttttttggagtgggggagggggggggtctgctacttggtgtttacctatgcttgctaccaatataattttctcaaatgatattcattttcttgtagcttccctaatgcatttaagctcttctttcagacttatactgggaatattttaatagctgtcaatccatttcaaaggcttcctcacctctacaacaatcacatgatgggaatttacaaaggagctgaatttggtgagctgggtccccatccatttgctatcgcagatcgttcgtataggtgggttttcctcctctctcacattatggtgccttattatatgtcacatatatatggatcatactcaagtgcccctcttgtttcctgtctagacttatgatcaataatcgtatcagccaagcaattttagtaagtggagagagtggagctggcaagacagaaagcactaaaatgcttatgcagtatcttgcatttatgggtggcaaagctcaggctgaagggaggtcagtgcagcaacaaattctggaggtacgtttcgtgccactccactttttttggtgtgggtggggaggtgggggtgctgacagtagaaacaccatacaaaagtcatcccttaattaatttcattttaacattcactctcattagtggttagacacttcacattagtaacatttatatgcctaccatcaaagatattctcctttcagggctaagaaacagtagtgtaccattcatatatgtttctaacatatctatttgggtgacacagtccaaccctgttcttgaggcatttggcaatgcaaaaacagtcaggaacaacaattcaaggtaaacacacaaaatacaacacaataatagtccttcacttttctaaggtggttattaatttatctttgaacctttccatatctctctctaacaatttggttttcacatgttcgtggttttgcagtcgttttggcaaatttgttgagattcaatttgatgacaatgggaagatttcaggagctgccataaggacttatcttctagaaaggtcacgtgtttgtcaaatatctgacccagaaagaaactatcactgcttttacatgctatgtgctgcaccttcagaggtaaaagcctcgtcaatacaaccttttattcctaaatttttgttgcacccacaattttggaactaccagattttatagttagatttttactgtgggtttgtaatgaaaacatgtcatgtgggtcctatttctcatggtaaatataaaaagaagcttgtgagcatctcaaaggtttgaaacgtatagtggctaactactacgaggtaaaatatgtacactatttcttccctgaataaaaatttcaccttcaaattttcatcttctaattctatcaagcttacaaaatggctaattttgattttaccttgcacaatttgatcattgttttgtttttagtccttttgacttataacttgtttacctatagctttgatatgtgaatgttgatcaggattgcaagaaatataaattgggagaagccaaaacatttcactatcttaatcaatctaattgtattgaacttgatgggttggatgactccaaagaatacacggataccagaagggctatgagtattgtgggtattagttctgatgaacaggtatgaccaaggttttaccagcaatcaatttagtacatcgggagtagaggggcaacattacattcaacatatatttccatgtcttaggatgcgatattcagagttgtagctgctattcttcatttgggaaatgtggagtttgcagaaggaagcgaagcagattcttctatgcctaaggatgagaaatcccaattccatcttaggacagcagctgaacttttcatgtatttatttcttcactgttttagtttagaggtttacccaaaatttcctacttccatcccttacttggacatggattggctacattttacaggtgtgatgaaaagggtctcgaggaatcattgtgtaagcgtgttatggcaacacgtggggagagtatcacaaaaaatttagatccacgagctgcagctcttagtagagatgcattatctaggattgtttattcacgtttgtttgattggtaagtttacaagcaatcattttgggaaatatttttctgctgccttgtataatacatggtacagacagtaataagttataattattgttaactattgtattttcactactacaggcttgtaaataaaatcaatagttcaattggtcaagatcccgattcaaagattttgattggtgtactggacatttatggttttgaaagtttcaagacaaacaggtgcttaactggtatgcttttgcatttaatctactatttatgtccaaaatacatttagaccttacatatagaggactcttggtagatgggctttaccatttgcatatgtacccaatatgaagtatgcctgagtatgggttgggtggaactaatcaaagtttatgtatcgaattttcaaatattgtgggtcggacacttgtacagctagtaacaaaatttctggggcctacaaatatgtgtttgcgcgcgcacgcacacaaataaaaacatgagtacaaagtgacctaagtattgattgcttaaatggttagatcactgtatacttggtacaagttggtgaagttgcgatgggagacaatgtgcactctacatgaagtgttgttgtagatattgtcatatttttcttttgaaaaaggcaaacagccaaacattcccttatgtcgaatgaaaaatgcttcaaggtgttccttctgttagtgaaacatcaccttgtttgttgacagtagaacataatgctaagtgctacggtctagataagaatgtaaacagttcactttgtagtgatacgtagtggttggaatcatgagggttgtttaacttgtagcaacctagatgatttgctaagcaaatatatgctagtaaagtagacacaagtagccatatgggactaatccctgcattaggccttcgtgagacaaactagactagggtatcgcagttgtcatcataatgaagcattgtcagaaacaagagggaaacaaatttgctacctgaataaaaaatagctctaatttggcatattttacttatgggcttagtgtagatgccctaactggttgaaggtgagttttagcaacttgtgaatgaataatcatctgcttatgtgtcaaatttgaaagaagatacctcttgtaagctgacatttttttaatattatgcagctttgagcaattctgtatcaatctaaccaatgagaagcttcaacaacattttaaccaggttataaactggaaatactccactgaaagttctacattttgtttgatttaggttattcaaccactttaactttgagttctctaatcaacacatctttcattaacagcatgtgtttaagatggaacaagaagaatatacaaaagaagaaattgattggagttacatccaatttgtagataaccaagaaattcttgatctcattgagaaggtaaataaatttagagtcttatttaataccatttttatgatcaattttggtgcctatcatcaaaattgtggtaaccattaagcaagacattacagttgtaatctaatgaaagcattgagtactttgaatttattatatctctttcactataactaggaagatgacaagttacatgtcgttaatgatggttagtaattaaacttttatagcagcttgctttgtggattctaataattatgttctataacttcttgcatgccatatttgcatttcacttaatagcgtaccttcgacccacgaacctacttatgtgtcaaataagtggtaacccgctagtttccacatcgtggctcagcttgcgcacctagagatgcaagtggatagacccataaattcatttatatgtcaaattagtagataacccgcaagtcaatccgcgggttacgtactaattttgcctataagcgggtacgctggttggcccgcctgtatccctatttctattgctttttattttattttctcaagcaatacatttttatagcctacttgattttggttcatgcacacttataggtcttgtatgttgtttagatattgaaaaaattgcaattgttgatcca

SEQ ID NO: 86600 - DNA, 6129 bp, Oryza sativa
tacatgcaaacagcagaaaataccaagagagattaatctgacatttagagatcaatctaataaacaacaataagttgaaaaggaaaaaaacccggcgaagtcggagattaaaaggaaaaaactcgccgagattgatctcttcgactgactccgagacggagcggaggaggcggaggtcgcagtcgcgggcggcgttggtgtccatcagcatgacgcaggacggcaggaaggcatcggcgtggctgcagccgtctcctatgcatccgattagatcggttttggcatgcttcgtgtttgtagatccatcttgcaacaccatggcatcctcgttgggtagattggaccagtaggcttggtggtggacgaggacgaccatcaaatccgtcgaactgtcgttgccccgtcgttgccgtcgtgctgatgcgaacaagatcaggcagagaatagcagcgacgattcgtcttgttgaagtcgtcggcggcgaggaatcaaggagctcccaaagcgaagacgaagccggcgactcataaagttgattccatcgcactcgtcgtcaggaaactcggcgtttacctctacctggcgcgccaactgtcgaaacatgaattcggcaataataaaagggggtagcgcacgagacctaaaagtggatggatgcggatacaaaggatttagacaggttcaggccctctcaatgagaggtaataccctactcctgtttggggatttgaatccgccgggtgtagtatagatctgacgatcaggttgtctcatgccccctagagggcttcctgcccaccttatataggatggggggcaggattacaagatagaaaccttaaccaacacggtatcggtttcctaaatctactttacaatattatcaaaccaggactttaggccgttccataatatacaaggaaacgtaatacccaagtcatgatctgttacatattccatacatatatgttatcccctattactagtcggataaccatgccgtgtggatatggggtacccataatctccacagtagcccctgagaccttcacagtcgaaaatataatcttctctcgaactagattactccaaagccgagtgcttcaattatcttcgccatggtctcccgagtacttttaccaaatctgaagactgtggagggctgaaaaataaagtcaggtgcatcgaatagatgcacctaataggtgtagcccccgactatgtggttaattgaaccaaccaaacatatagtcaaggaataaataatctaaccaaccgagtggttttgataattgtaatcaaccaagtgacttgatatcaatatatagcatatgcggtgtgaatccccgaataatatgatccaagtgatataccgactgcttggcaaaatatgatgcgtacaacctaaagttgacaacatctttgaaagttcacatagcaaaacagctataaagaagcttgtatgttgtgaataaagaaatttccaaagtattgggcatacgccatgcgcacactgctttaacagatgtgcttaagtccctagaagacacatggttccaccacacctggaaatatatggcatatgtggtataaaatccgagtaaataaactcataaaggatttaccaaccgcctggaaaaatgaccataatatataatcagcctaagccataatattggtcaataaaaatgcacacttacgtggcaaaaagcaatgatattgtatccaatcaattgcttgataaacccaaacagcacattgactatataaaaaaagtcagcggggcagctatataaagctttactgtttgacaccttttaagatgcattgtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaaatgtagctcatatgaagagcttctgatctgagtggttatcccttatgagatactccaaaatagatgtaacaattgaatcccgactggcgcaagtattcagttgataacccttacggggaataataaatagtccagtctttgagcatagaaaatagacccatgatcacgaattcatattgcatatatccagagcaagtccaaattgaaggtatgatacttgtgtttgagctaataagcccctgagcatatagcttgtccttctgtcgtagtcacaattgtccattgatggtagctgacgcagttggcatagagacaagacgaccaacatagagataatattgcccaccagaggtggcaaaaatattggtggtagtgaagataatgataccaatcaaaagtgatgaagttgcacagccgtggaggcgaagaaaccagtcggcaacagtcaggtcagccatcaatgaagatgaaggtgcccagcgataaagttatgtagccatggcagcgaaataatcaatcggtgacagacgaggcagatcaaaggcgatgacgaaatccaccaatcatgaagatgaggaagatagtcggcgacgacaaacgtaaccgacagtaatgatgataagcatcaacagagatgatcaaatatgatgacgaagttgcctatcaatagcagtagagtaagctatgataaagaggtttgacaggatgttgatgaagatgacgatgtcggtgatccagtcaatagcggtgtaatagccgatgataatgacgaagacgctcatctgcgtttgcatagtaggtcaaccgtgaaggcggaatagcaagttggcgaagtcttagtcatccattagcaacggcggaatgtcagagccgatgaagcagatgtgctggtgacgatgtcagtgacaataatccatcaaactgttgtagatgcttcacttggaggaaagtatatgctgttgttcaactcattgaatctgatatgagttgattggttgatgactccaaactcccagacatgtaaatttaatcttgacctactgctctgaagcgaagacaaaattgatgactcccagagttgacttgttggctgattaattgattgcttcatcttgacataaagcttgtcaaattttgagccatgtatttgtgtagcccccgactctttgattagttgggaaacaactgaacatagagtcgagaattatagcttcttgttgtcgagtagtcatcacttgattgaagatatgtgttgaagatgtccaagtagaaatcctgaatattggagagccacttgttgtagtaaaataacacggcatcgcatgccgagatgtcgaggttcacaaagacgtcgtggttggtgaagtagcaaaacttgcgaagcagcagcaatagagtttgccggtgccgaagataataaatatgaagtcgctctaccatgatgacaaagttgcatcgccgtgatgaagtgaacacgagtcggcggcaacagaagcaaactggtagtgaagacgcgcagttgtgaagatgaaagcaccagtcggcggcggcataaccagtcggcgacggaagacgatgatgtccatcagtagtggtagctgtataaaccagatgtagaggcgagggcactagtcagcagcagacgagacgaccggcgatgaagatggtaaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcggccggtcggtgaagacgtagacgcccaacaacggcagcataataggccagccgtgcaggcggaaacaccagtcggcggcggtcgaggcggccggtcggtgaagacgtagacgcccaacaacggcggcataataagtcagccgtgcaggcggaagcaccagtcggcggcggacgaggcggccggtcggtgaagacgtagacgcccaacaacggcggcataaaggtcagccgtgcaggcggaaacaccagtcggcagcggcgaaggcaagccggtcgatgaagacgtagacgcccaacaacggcggcataaaggccagccgtgcaggcggaaacaccagtcggcagtggcgaaggcaagccggtcggtgaagacgtagacgcccaacaacgacggcataataggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgacggcggcataataggccagccgtgcaggcggaaacaccagtcggcggcggcgaaagcaagccggtcggtgaagacgtagacgcccaacaatggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagcagtttataaatacgtatttcttctcttgttaattttgatttccccgagcagatgactcattacgtttaaacactctgcccgactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaattatcttatctctatgcttttgatttattccgaataatacttagcaccttgcgttactcggtccatccaacgagcccccgggtgctaggaatcggcctaaaggcaactatccattggcaaaccaaacggaaagcataggaagatggaactccataactcgataggcacttttgtactcagaatatgtcgcaagcaatcaagataaatattatgaaaattgtttaaaaaatatgatataacatctgtagcccccgactcactactcaatggaagaccaattggtgtagtgaggcagaggaaaaggcaaaatatcatataaagaataaaacaaatgatgacttagctttgtaatattccctcggtgacagcaaaagtagccgatgtgggaacgaagcagtccatcaatggtgacaaaaacatcagtcggcgccagtggaaccaagccagtggtgtagatgatgaagcccattaacagcggcggagtgaccaatcaaccatataggcgaagacaccagtcggcggcgacggaggcaggccggcggtgaagtcgtagacgcccaacagcggcggcataataggccagccgtgtaggcagaaacaccagtcggcggcggcgaaggccagccggtcggcgaagacgtggacacccatgaacggtggtgtgaccaaccaactgtataggcgaggacaccagtcggcggcgacggaggcaagccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggca

SEQ ID NO: 86601 - DNA, 4293 bp, Oryza sativa
acaggccccttaccaaattttggcattaccaaaattttggcatagttgccaaaattttggcatgattttttatatagttaccaaaatttggcagcaaactaaatgtagccacttttttggcaactttaccaaaatttggtaaggttgaaaatggcatcaaagtgaacaggccattgccccagttaactttgttccaaacatcaatttgttcataaacttcgaggaaattagtttttttaatggtaaacgatcaaagtagcatcatttgtgaggaaattagtttttataaatggtaaacgatcaaagtagcatcatttgtatggaaaagatcggtttccacccatcgtctcaaagttcatcaagttggtctgtaccaggattcacaatatatgtaaaccggcaaaaaccaatgtaattcggacgctttttctttgttaaaaaaataattaaattctagtttgaatttttttaacttgaccggaaaaactgagtggttttgtgttatcgagccgtcccaggaaatcaggttttcgttgggtttgtgaaccctggtctgtacgcacatgtgttctcctttcctgatgctaaatattgaatgcttgtaggctttggagatggccatgaggtgttcttccccactaaccgaacaggccaggaagatgcatgattcctcaaattctggcatcctccctttggacgtgctgttcgacgtcctggtgcggctcccagccaaggagctctgctgcctccgtgttatctgccaggcatggcggtccctgacctccgatccccttttcatcaaggcacacgcagctcaccacagacagccgctcctcttggccacatttagagacgacgaggcacatgttcatatcatggatttggtaggcaatgtgcttaagacgataggaatcccggttggccacaaggtgttgtgcacacacctcgatctggtctgtgtagccacaaattggaacagctgccgtgtgcttaatccggccaccggagctgtatacgatttgcctgaaaatccagcagaggagcacatgtaccatgcccacctatgcaaaccttacacctcatttgcatttgggcgtatcaccttattgttcaatttggggaatttttctagggttagccttctcagctcaccccttcctcatttattctattagcataacactttacagataggtccttggtacaatacatatttacaccaacactccccctcaagatgggcaaaagatatcaatcatacccatcttgttacatattgattgaatctcactaggacctaacccctttgttagacaatcagctagttgttcacatgacttaatatactccaaactaagcaccccgctatcaatcttctccttaatgaagaacctatcaatctccacatgtttagtgcgatcatgctgaacagggttgtttgcaatgctgatggctgatttattgtcacaatgaagcatcacaatgtcacttcttagcactcgcaattcagtcaacaagctcctcatccacaacatctcactcaagctcaaagccatagctctgtattctgcttctgcggtagaccgagccaccactgcctgctttttgcttcgccaagaaacaagattaccaccaacaaacacacaataacctgatgtagatcttctatcatccatactactcgcccaatcagcatcacaatatccttccacatttagatgctcattcttcctaaaccacaatccctttccaggagtccctttcagatatctgagaatcttatgaacaacatccaagtgaccagttcgaggatcatgcatatacctactcacaacactaaccgcataggaaatatcaggtcttgtatggcaaagatagatcaagcgtcccaccagtctttggtatgcttccttatcaacgggatcacctgattgagcacacaattggtgattcctatcaataggcgtagtacttgcacgacacccaagcattcctgtatctgtcaatagatccaaaacatacttcctctgagatagaacaatcccctttgatgaacgagcaatttcaattccaaggaagtagcgaagaggaccaagatccttcacctcaaatgcctttcccagcctttcctttagacacctgatttcttctacatcatcaccagtgatcactatatcatcaacatacacagccaagatggtgatgtgtgtccccctatgtttgtaaaagacagtgtgatctccattacactgagaataccccatatcacacactgcatgcctgaacctatcaaaccatgcacgtggagactgcttcaacccatacaaggatttcttgagtttacatacttttccaactgtctggctattcccaaatcctggagggatctccatgtagacctcctcatgtaaatcaccatggagaaatgcatttttcacatcaagctgatgaaggggccacccaaagttcaccgcacaagataccaaagctctcactgtacccatttttgccaccggtgcaaatgtctcatcatagtcaattccatatgtttgactgtagccttttgcgactaaccttgctttatacctatccaccttcccttcaggggtttgcttcactgtaaagacccacttacatcccactgcccttttttctggtggaagttttacaagctcccaagtcttattcttcacaaggtcattcaactcttctttcattgcatctttccactttggatcctgctttgcacacttccaatcctttggtataggcattgtctgtaatgatgcaataaatgttttgtatgctggtgaaacatgagaatatgtgatatagtttgcaatgtcatgcatagaactaagatgctcaaaaccaagacgtataggaggtctaccagcattggatctagtctctctacgttgtgcaagaggtaattctacatgttcaagagttggagaagtattaccaattgtctcaagagaagccaaggaggctggaggagagagactctgggaggattcagggactggacattttgggtgtggtaactcttcaatttgactttgcactaacccttttcttttctccccctgactatcaaaccgcctcctttggtaaaccagcacatccttttgtttcaccctttcggctccctccataggacatggaattgtcccaacaactacttctccttcttctccatcctcttcatgagggaccatttctctatcctcatcttgtgtatcttcaatgacttccactactttactcgcatcatcaatagagcatggtattgatccaatcactactgcctctccattcttgtcaccaacatttttttcatgtatgtcacctctctctctctccccctctcgactatcaacctccatgacagtcgagaattcctcaagaaattggtcaagatctcctttacttttataatagggctcaaactcacgaaatgtcacatccatactcacaaacagtcttctcccaatgggatcccaacatttataccccttctgactcgaagcatagccaacaaacacacactttactgcatgaggatctaacttgccaacagaaggtcggtgatctcgcacaaaacaaacacagccaaacacctttggggaaccttgaactctcgcttacccaataactgttcggcaggagacttcataccaagtattctggaaggcatgcgattgataagatatgctgctgtcatcacagcctcactccatagatactttggtacattcatctggaacatcagagatcttgccacttctagcaaatgccgattctttctctcagctacaccattttgaggaggggtgccaggacaagtagtctggtgaataatcccctcatctgagacatatgacacaaattcattattgatatattctgttccattatcagtccgaataatcttaacttttgcatcaaactgagttgtcactaatttatgaaagtcttggaagcaacgaaggacctcacttttgtgtttaagcatataaatccaagtcatacgagtgtgacaatcaataaaggtgacaaaccacttgaaaccactcacagaagtaactgggcatggtccccaaacatcagaatgtattaatattaagggctcacagttacgaagaccgattccaacatatgtagagcgagtatgtttgccaagctcacaagcatcacacaccaatctatgcttatccactctactaaagaggtctagatacaacttactcaaaatctcaaaagatggatgtcctaactgacagtgaagca

SEQ ID NO: 86602 - DNA, 2860 bp, Oryza sativa
attcctgcagcccagcagaaggggttgctactgatccggacaaaactaagatcatgcagtagtggcccactcctactaacaccactgagttgagaggttttttgggattaactggctattatcgcaagtttgtgcagcactatggcattatagcaaaacctctcaccttgctcttacataagcatgtgaagtatgaatggtctgctgcagctgaagcagctttccaacagttgaaggctgccatgtgtacaactcctgtactggctctccctgatttttctcggcctttttttgttggaaatagatgcttgtgccactggtattggggctgtgttgtctcaagatggacatcctattgctttttatagcaaggctttgggtattcaaaatcagaagctctctatctatgagaaggaatttttagccattatgatggtaattgataagtggcgctcttatttgatccggggtccattcactattaaaattgatcaccagtccctttgtcatttggatgatcaagtattggggagtgaattacaaaagaaagccatgactaaattgattggtcttcaatataagtttcagtacaagaagggggttgataataagttagctgatgcattgtctcgggtggggcatttctttgctgtgcaatctgtttcagtgactcaacctcagtgggttcaggaggtcattaactcctatgtggtggatcctgcagctcagcaactcttgactgaattagcagttgtcaatcctaatgctaaaggattttccttgtccaatggtctcattaagaaagagggcagaatatgggttggggctaattcggggttgcagaccaaattgattacaacctttcattcttctccagtagggggacattccgggattcaggctacttatcagcgtttgaagaaactttttctttggcctggtatgaaaactgccgtggcggaatttgtgcaacaatgtgccacttgtcaggctgctaaacatgagcattgcaagtaccctggactattgcaaccgttgcctattcttgctggggcttggcaggatatttcgatggatttcatcgaaggtttacctctctctaagggcaagaataccattttggtcgtggtcgatcatttcactaagtatgctcactttctaccactgaaacatccattttcggctcttcaagtggctgaagtcttcctggatcaggtggcaaagttgtatgggatgtccaagtcaattgtctctgatcgtgatcgagtgtttactagtaacttttggaagacactgtttggcagatttcatattcctcttaatttgagcactacctatcaccctcaatctgatggacaaactgagcgtgttaatcaatgtctcgagatgtatctcaggtgtgcagtttctaacactcctagcaagtgggcagtctggcttcctttggcacaattttggtacaacacttgttttcacacatctctacagtgttcacctcataaagccttatatggtgctgatccttcttatggattgttgccgtctttatctgagggagattctgaaggtcaatcggctgatgctgctgaaatactcaaaacacgcaccttctattctagcattcttcagcatcatttagcccgtgctcagaatcatatgaagcaaattgctgattctaaacgcacttttcgcacttttgctgtgggggattctgtttatctgaagctacaaccatacgctcaacattcggtggtgaatcgtccttgccacaaattggctatgaagtattttggtccctttgtgatcttggagcgtattgggtcagttgcttatcgtctggaattaccggaggcaagtcaggtgcacccagtgtttcatgtgtcccagcttaagcaatttgttccttcgtcagtccctgtcttttcggagctaccggacattgtggcgctggatgaggtggagctgcttcctactgcgattttggaccggcaaatggttaagaaagggaatgcagctgtggtgcaagtcaaggttctttggggtactttgcaagatcactttgctacgtgggaggattatgaagttctttgcaccagatttcctttggcgccggcttggggacaagcctgtgctccagcgggcggcaatgtcatatcacaggctatgacaacggacgaggaacaggagaaggaagcgtaatcacgctgaggtgtttttgtgtaaagaaagcgacttaagtaaatgtgtagtgtgagttcagtgtgtggccgtgagggcggaaacgcgaaggagtagtatataatccccgtgaactgtagttggaaaacaagtctgaagaaatgaaatcaaaacctctccccaaactctgtttcctctgcctctcttctcttctctgaaattcgaatccatcttgtgttcatcctcgttgtggcagcgagattctcgccggcgacgaggttgtgacacggcggaggccctcgcggccggcccgacctggtgagcgctctctctctggaacacgaaatttcagctgctcagcctctattagggcatcgatctgatgaggccatcacacctccactttgccgagttgggatttatttcagattctacacttacctagccctttgtgttagagagacagagagtatatagaatgaaaccctagaatatgtagaatcgaaccttttgtgttagagaacatatataattgaaagtttgatatttacaacctgtttcactttgatgcaaaaaaaccttgggcctgttcactttgatgccaaaaaaaaccttaccaaattttggcattgccgaagttttggcaggatttcttatatagttattaaaatttggcagcgaa

SEQ ID NO: 86603 - DNA, 2352 bp, Oryza sativa
cacgtgtgcagcttgttgaatgcccatccatctacgaaatgctgccaaatccacatttcaagtggaagaaagcaccagttgttcaggtttggagaaagaaacctgaaaaggatggaatagcggagttagttctgtatgaagctaccgattgtttatctctgtttcaagaagctttaaggaacaatgaggtagtcactctctgcttctaatttgtaaatacttttaaagcataagaaattagcaccgcactaagcgttactatcaaaagttgaaaaatcttttacatacagatgagaactactttgcgcactaactggaactaaatcatcacaccatcctttagttgagagggaaatacccagatagtatgcagaaggcaaaagcacgttggcagttggtattactcatgaaaaacatagtaatgctgtctactccattgatttgacaatgttaaaatggtttatagattggtggctcacttcgaacaattggagataatgtttactgcatgtgaacctttttttatgcggaactgcctatgtattaacattctgtgtgtacccacatctgggagaacttttgtcctgcccataaaaccattagtcgataactcgttgccttacaaataccatgtattgtttgacctaaaaaatgtaataaaaatatttagagcttgtctcatcattgcatcaagtttggatactaacatagccatggtatatccttttatttggtgatagtgctgtgttctgttaattgtatttgagtgaaacttgtttattctatttatcttttctatcctagctcaagtataatgggaagacaattgcactgccattcaatatgtcagtcttcaagtgggccactgagacccgccgaattcttgaggatgctgaattaccagatactgtgagcttttataatatatatgggacatcttacgatactccatatgatgtttggtgagtatttttgaagactgctaattctaacatcatgttgtccttcatgctattcttagtaggcaaccaatctagattcccatttttatcggtttgcgactctcaacctacaaaccaagatataaatagttctaacagtatccattacttgagctaattatctgcttagccaatataattgaataggagtgcatggaaagcaggatccgttacagcctttggttgatagagttctcttttcttgttccaatgtccaattgtgtgcatacttcaagattcttgttgaatagttgataagttattaatctaataacagatttattccgatttgacttatctagctttggctttgctgtaattatgttctttctgatttgcagttacggctctgaaagctccccaattggagatctgtcagaagtgtgccacacaatggtgctgaacttaatcaattaaaaaatatcgtttttttagttgtgtgatattgcttttactaaaatattatgctggtccatcttattttcagccagtgtacacttatgtggatggagatggcacagttcctattgagtcaactatggtagtcgctcttttctgtcatataatagatttcagctgtctagtttcctttctgtaatgttattcaacaaaacccagttcacagtattactcttcattatgcatcgagaaattactcacttgttgcttaatgatttagtagggaagcagaacattacataatgcctttcataaactttggatgttaaacctagttggttatgactaaataaagtgccttaattttgtaaagcctagcaaacatacgatcacaagatcatcttcaatggcatatcaaacattcttttgaagacaaaaggcattgcactatgacccgcaatttagtggcactctttcggatttcttcagtactgcttgatcctcgagtgttttgaattcaagggcaactcgttcaatgctaagctttgccatttacagtttaggatacaccatacatacttttccttccccttaaactatagcatctgccatgttgcctcatgaaaacaatctgggacacaatatgtcattgtttttttgttgtcggcaggctgatggatttgcagccaaggaaagagttggcatcgaggccgaccaccgagggctgctttgcgacgagaatgtgtttgagcttctgaagaaatggctcggcgtgaaggaagaaagcacacggcggcgtcggttgtccaagtccaaagtgacagactttgcaccatcataatgaaagtactaatcaagtcaaggtgctcaaaacaaaaccatcacaatttcttcaaggcagccattattttttgggctcttcacttgaagagaagatgaatatagcgaaaca

SEQ ID NO: 86604 - DNA, 7035 bp, Oryza sativa
aaaaaggcgccgacttatatttggcagctcgggcgctgggctcggttggagggagccttgttgttgttgttgttgggcccccggcccatttagcccactcccaccccagcctccgcccccacccccgtgtgccgccgccttcgccgccgccgccgccgccgtcttccctctccgccttccgccgccgtcatgccacgccgcacctccaccgccccgcgacccgagacggaggcggcggcggcggtgtagatggtcgtggcgtggtggccgtcgcgaggatttcgggtgcagaggtatgggattctggtgtagtggattttgcagagtagattttggtaactaggagtacttcagaacaccatggcttttgcatttgcaagtacggtgacttgggtgccgcactgaatctatgattcgattttacctgttttggttggatggaggagaaccggagaagtggcgtttcgagtaagtttggcttctttatattactgtactcaattaaggctaaaaatataaataaataatcctttcagatagagtatgcacctcttatttagagtgtagttcaaggatgcagacagaaacatcactgccaagtgcattttcacagatggaataccttttagtataacatagcattagtcatttgtctcttttgcaatgactttctccttgatcctgttcaatgacccccgtttaaccttggggagttggggagtactttgtaaaatgcctttgcctaactacctttctgctcattttggactctgccagtcaccaagtagcatactagcatcactggaatcttgtgtgttagaagacgccatcctatggttagtctatttacgcacttttgccaatgatattatggcttccttgtaactgggactggcagatgccaggataagcactacaaggaggtctgctgaccgcaaactgtaaacccgaaaagctcaatctgcacttcttggctccagcatggtgtgctctgctgttcacttttatgtaattgtgtgtaattcttggatgtttgatatttccatcatgttcgttttagctcctgtggcactattggtcattcagaacttgaatgtgaaaaccaagcgaagagggatgaaaagggtctgataccatatgagtgcaaagaaatttttttacttagaacaagccgcttctgcaggtagtaggagtggattgttttttccttttgttgctttgcatgtcttgagcgacttatattgatgtcgattgggtgcaaatggttgggattaaggtaatgtattcactgcacaaggcaactgcacagtatgtttatttttctttccagttccgttctttcaaacaaactgaaaatggaaacttgattacatcctggtctggatttcattggtccatcagttcttactgaatctttggtcgccactgccggtggggtgccacactaaatttatgactcagttgaataccactcttaaacaagtgcagcagttactttccacatttcatctgcatatctttcattgtactcttctagtgcactagtgtataggttatgaattgggggttttactcaccagcagacagcagtctcctttacttgttggtaattttcttcatttctggcattgaataacagaaacttattggtttaatttactgagatagacatccagtactacaaaacagttaatagatctgccagcataacaatattgcaaatatactccttaatccttattctgcaaaattctgtctgaaggtttgcttgattgtttagttatgtttcttgcggtctgagctaattgcacctgcctcctcctcccaagcgctgtctcttgggactgctatttttaaagatgagcgcttgtgcttctaatttgtttcttgggactaaaactcttgctcaataatttaattcttgtggatttttttctcttttacaatgataatgacatttcatgtgatagtgctattatgctttgcaactgcaattttggctacgttgcatgttcaacactcaaacattcaacttgaaccttttatttgttcctttgatggtgtcttgtcataactatgtgctatataatcataatctgttttattttttttccctgtaggtcagcaggttgtctttgaaacatttactcaggtgatgttgccagttgccacactattatataccagtggaacaccaaaaggagtgatgcttatctgctgaaatctcttgcatctggtcgaaagagcagtaacattcacttcttttacctgaaagtaatattgaaatataaactgtacttttcttgatgtgatttcttgtcatgtgaacatcagaacccctgttcctcttctatccaaattaagttctatgcagttatgtttgtagatgaaaactttctgggatagtattagcagtacctggtgatagtttcctaagcatgcttccaccatggcatgtgtatgaacgtgttatcaagtacttcatcttagcttatggaattcaacatgtttacatgattgtcaagtatctgaaggtaacatttcaggcatcgtcatagttagtaccatcaagggtcttatgatgtcattaaggatttattgcgaccaattacatgacctaatgctgtactattctttagcagcttactgaacgctgcaaagttgagtttgatatattataagcaaatgtaacaatcgtcaggtccagaccttctaatctactttagggaaacccaagtgtcatacttgatatgatagggttccttccctttacagtattctcctttctggtcactattttctatttcttatgaagatgctgatgttgttcaggtgttttgacttctactctattgataggaagttttgcaacggtaccaacctcaatacactgtatcagtaccactggtctatgagactctctacaggttagttcttctattacgatgaactgcttccatattgtattatacatgaaattgtatcagagatgtaacatttacttcagttcactagtatcctcaatgtggcaccatgcaagatgcataatctatattttatccatctattgtttctgttcaatggcataagctctaactaattttataggaagcacccaatcagtgtaggcaacattcttttttgtccttgatgctggcattttcttgcaaactggtaatgtttaatgattgctcctttatccattttctgatgtttcttctccactttgtaagtctcaattcagagacacatatcttccagttcaaatgctcgaaaattggctgctcttgcacttatcaagatacgtttgcataatctgtctcatatatcctctgtctcatatatgatgaccttatgatccagaaatttctatcccatgaattctacttgtaggtgtagcatgattctttaccactaagatccaactttcttctaattatctccttctcttccattggaaagggaatagtcctattgagcaatcccgtcaaaccatcatttattgtgcatatggtcaattggctattggcaagaattgttgctgcacttctgtggtctttgcataatctggcaaagaagttagtattcaagaaaatccattctgcaattgggattccaaaggtacttttacttatccccatgcacctgtttctgtgtgacattgataatccttgtgtaagtacttagtgtgaagggagtttccttaatgttgattacaaatataaactctgggttctgtggtaacttgctgtctggtattagcggtggtggaagtcttccaatgcatgtggacaattttttgagttagatgtatatcatttaataaagttctttgttaaatattcatgccttcattagtattttgttctttgatacatggtgtgcttccatagaaacgggaaaaaaaggtcacaattttatgtattttaaagcatattcttctcagtggcaatttcgtccttaaacaatgaattcatatatcattcatagtctgtccttgcaaatttactcaccataaatggaaacaaattcttctgagaggccattttccttcaacaatgaacattgatattattaacatcctctccttggtagatttactcatcatcaaacatttgatcttactacactagtagacttgtatctggaagcatacatggcctgtggaatgcataaagaagggagtccctattgtattcctggcatatttgcattacttctcatcatttatactattttctatgtatagcttatgataatactaagatatgtagttcatgccacattgcaggttcttggcacagttggtacccagtaaagcacacggaaatcaaggtagtgagcatagagaatagtgaggttctcgcagatggttcaaagggggttgtgaaagtcagaggacctcaagtgatgaagggatattacaaggatcattttttccagtttactgatgccaagttttaactataaattaaattgagctgtaaacagttgtttgggtcaaggtgaacacatttttgggtagaaatgcacatcagattatatatcttggtaaagacataatgctgcaggtcacagataacacttgcttattgtaaacatcatagttgtagcaatgatgaggttctagcaatggctaaaagaaagcctattcttgatgggaagccaaaggataagttttggaactttgtatgtaatgagctgagaactatttctctcctgtttcttatgagctctgatttctctagcctaatagtctagagaacttttgctgattttatgatgggtcacaactcacaatcacattggagttaaatctatcacctgagacatgattttttaaacattgaaggacagagtaggactgtgtaatttgttgttgatatgtgcgaattaaaaaccttacgagttacgagtctcgtactcccagtctcccataccaatacagggttttaggtatggtggcatgtcgtagtcggagaggaagggtgtgtagtttatatatgttgatttaattagagccatgttgaatgttttgttaatatataaatgccaggatgatgggttgctccttccaaatcagccctattctaattgttaacgaatcatttacggtaagttttcacctagtaattatatagcttttcttgctatcaagtttgacagtacttttttttttttgtattcaggtggataatggtttgctaacatccactttgaaaataaggagggacaaggtaacagccaaatatcatagagagatcgaagcattgtacaagtggtatggagtgggcttgagtaaaacattacaagtggtatggtgtgggcatgagtattttcgtttgttcttgccttaggggacatctctgatctctcgagtagaagtacagcagctagttcagcaatcagcatacaataatgcaaccatttttgtattattgtatgccagtttcgctcagcaaatgaaacagtagatcacttgtttgtgtcttgtccactggctagatttgcttgcaatgtgattgcaagtgcttttggacttgaaaagatcaatagcattcaacacttgttggaagcttggttaaatgaatttgacaaaaagaagaaacaactagttgcagtggggattgcagccacactgtgggcaatatgggaagttagaaataaagcatgttttgagcataagatgatctcacatccaatagaattgatatactatatgtgtcactggatttcatcctggtcaattttgcagaggtcggtggaaggccaaagaagtctacaatgtgggttcgacacttcgacttgctaaagcaggttgcaaaagagattatataattccaagtatggctggaactttgatagaagacggctggaggtgtgagacaaatcagcaaaggaaggaaacagggaatcgactggaggaactgaagcagaggaagagacaggtttttgtggctggaagaacaaagaatgggaagatcatgggatcaagtagttttagttgttcttttcgtctagttaaaaactgtactagctcgtctccttctttctgtttggtaattgctgtatgctggtgtggagatcacacataatggagggatgacactatttgttgtgtgatttgcccatggtccattaatgctcttctgtttcaaaaataatactccctttgtttcaggttatatgttttgactttggtcaaagtcaaactactctaagtttgactaattttgtagaaaaaagtagtaatatttttaacccaagactaatatattatgaaaatttattcaattatagatttaatgaaactatgttggtgttgtaaatattactattttttttatagagttagtcaacttagagtagtttaacatcttataacctgaaacggagggagtaataacaataataatgcaaccattttaggagtcacttcttcaaaccaggacaaggcacttcgcagcaagataaattaactatctgcgactcttacaagtgacacttaagaatttgttgttggactcacatattatagataaatgagggtccacatgtcatagacaaatgagagtccacatgttatagactacgagtgacaaatccttaattgccacatcttataaaagtttaaaaagtggcaaatatttataaagtgatggaaactcctgtgcatcaaactggagcttgggcttgacaatccaacgcgaacaaaactagtggttcggcccaggcgcagaatggaatgggccggcccaagtggcttctgcaatggggacccacatgtcctcctcccgtctctcctcctcagtcctcacgcctccaactccaagcgccgcctcctcccccaccccaagcaaagcccccatcgccggagaagcggaggtgagcccgtcgccggctgctgcgggaggatcatggcagggagggaggaagaccccgtcgcgcctgagcgagcggaggccgccatcgtcgccggcggcgtcatggcgagcagggaggagaaccccgccccccgtgaccgtcccattcctg

SEQ ID NO: 86605 - DNA, 3027 bp, Oryza sativa
catggtttaataaaaacttcccaggtatttttggccagaattgaaattatattagtatctttctcacaacttactgcttaacactactaacttaatttttaagattatggacaatccttctggtgacttcagcagaaagtaccgtcacatatctaaaggaggatgggccttccagttgcagatcaggggtggcaggtttcagattgcacagcagaagctcttaaggtgcagatcaaaatttaaatattaagtgaagaacaaattagcgctacctgatgcagacatgggtcaagcagggttgattttccatttctattcatctgtctaggtttaattgattctgattgattattctcgaaagtaaaatgaaaactgaaaacaagaaaaaggcatgggttgatttttccatttctattcatctgtctgggtttaattgattctgatcgattatgctcgaaagtaaaacgaaaactgaaaacaagaaaaaggcatgggttgattttccaagtctatattcatctgtctaggtttaattgattctgactgatagctcgaaagtaaaaccaaaactgaaaacaagaaaatggagcatggcacatatgcacctaaattccccccaaatctggtgttaatgtctttaagtttacgataccatctgatatcattataccatacatggaagatggagcacacaaatctacaacaaagtaatacagtttattgtttcaggctttgctactgctgtcaaagtgtttgtcagatggtgcagattatcaaatggaaacctactgctactttgacgcggtgaatgtattactctcgttacaggtgattattctgcagcgcagacagtaccacatactatagcatatgatttggacagagttcaccttaaaaaaaaatctactgcccaaataattctctagttccctagaacattaatcatttattttgctatcctatctgttactccctctgtcccaaaaaaaaagtagctatttttggttatgaagccagaaatagctacatttttaggcacagggagtagctaggaaagtaagggccctattcttgaggtcaagtactattcatgtcatcacgtgaacggtgaacagcacccatgggtactgtagaagtccaagttatcatataaaagggaccatgaaactccattgtaattaaagcaatgaatagacaagagaaaggatagatgtagagtaataaagatttgactgaattctatgcagaacccaaatggtgggtatggagcatgggagctagctcgcacatatccatggatggaggtaaatctgctcagcacctcaacctaataactgtatcaatgcactaaatagtgtaactgtaatggcctacgtatgctactatcctctttctttattatcctattatttgatttaagaattatatgattaacgccactgcattctgttattgtacacatatctagaatatactgtcagctcagagttccaaacatagaaaagaagtgagaaaatattaatgtgttattcacagtcacaaggcatacttcagagcattaggactatcaaaggtgaaggagagtatgctatgacttgcagaattcacatttaggatacataaataagagaatataatggaagcaaactagctgaataagttaaatacttagatggcacataatatcaaggatttaaggaaattaacgttagaggagcatggcagtaacaaattatatacatctgaagcactaaataatgagaatttgaattacgttttgcagattttcaacatgacagagatatatgcagacatcattgtggagcatcagtgagaattttacaatctttctttctcaaattctcctattgcagaatgctataacatgcacacatactgcaggtacgtagagtgtacctcatcagtcatccaagcattggcattgttccgggagaagtaccctgggcatcggaaagatgaaatagatcaatgcatcaggaaagcaacagaattcatcgagaagttacagaatgatgatggatcatggtcagcactccttaaaaaaaatactatagaaaattgaagtactaattaaatctatcaattaacataatcctagttacataggagaatgatggcattgctggcacactgcctctgtttagagtgctcttgccaaaatctaagagacagtatgcctaatccggtgaaactaaatgattcaccaaatcgccaaacagaatgggctagatcatcacgttctgagttgcaacacatatttcggattgacaatgtacttatgtacagataagaaaacaatgaaaattgagataatatacagtagcaaagcatattaagagaatcagttgccgatagcattactagtaaagacttttgtataacagaaaaaaatagactggatcgaggttaaataaattcaatggtacatattagattttaaaacactgctacaagtaaatgtaatactgatagctggttgagagattggtaatttggattaatatttttttttctacaggtttggatcatggggtatttgcttcacgtatggaacatggtttgcaatagagggtctgtcagccgtggggcagtgttatgatgacagcacctgcattcggaaagcctgtaagtttctgttatcaaagcaactaacaaatggtggatggggggagagtcatctttcatccagaaccaaggtaacactcccggaatgctttattgtgtcaatcaactttaatttttgacagcttagattaagcatcgggtttaggaaaacttctatctttctttgtcttgaaataaattgaagacaaacagatagcattttctaagaactggtaatcaggtaataacactaggagctaaaatcatccttagattaattagccgacagggtcactctagaaaaaaggacaaacaagtaaatgacatgcattaattgaaacaaaaactgaaaaatcagaagagcatgcaatgtcactgaaagaaaatgtaatagctgatatt

SEQ ID NO: 86606 - DNA, 9915 bp, Oryza sativa
gacaaggccaccagcaacatctgcactgcccaggtacacgcacgcaacgcacgccacccgttcaccaaattgccagatagcgacagagacgataagagatacgatgaatttagtaaacaagcactttttcgtagaggagtcagtagtgataaagatgcctgtggtttatactctgtaggccttgctcgccaacatggcagcgatgtatgctgtctaccatggtcccgaggggctaaaggcaattgccgaccgtgtacacggcctggctggtacctttgcccatggactgaagaagctcggaacagtgactgtgcaggaactgccgttctttgacactgtcaaggtcaaggtcgctgatgcgaatgcgattgcccaggaggcctgcaagaacgagatgaaccttcgtgttgttgatgcaaccacggttcgctttctgttgacattttccgttctattgcaaccgagttagttgatgttgagtgttgagcattaaattcaagctgtgatgttgcagataaccgtggcctttgatgagaccacaaccttagaggatgtcgacaagctgttcaaggtgttcaatggtggcaagccagtaagtaatcattcaatcggcgcaaaatttgtgtgcttgatgtgaaattggatcatgatattaaaacatcgtgtcgttataatcatttttaggtgaacttcactgctgaatccctcgcatcagaggtgtcaagctcaattccgagtagccttgtgcgcaagagcccctacttaacacacccgatctttaacatgtatgtgatgttaaaaggcatgctgcttttcttcactgatttcttgcggtgttaagattaaactgaacttatgttgtgggcttccaggtaccatacagagcacgagcttctccgatacctgcacaagttgcaatccaaggatctttcactgtgccacagtatgatccctcttggttcttgcactatgaaactaaatgctacagtggagatgatgcccgtcacctaccccagctttgcaaacatgcacccatttgcacctactgaacaagccgcaggatatcatgtgagggaattcaccatttatttagtttctaaatgcaaactgttcatcagatgatctgaaatggcttgttttgtcatgaaggaaatgtttgatgacttgggcgatctgctgtgcaagatcactggctttgattctttctctttgcaaccaaatgctggtgcatcaggggagtatgccggattgatggttatccgtgcttaccacagggtaagtcatcataaataagctggcatagctctcctgttttgtttcacattttatatttacaaaccatgttataaaaactgcaggcaagaggagactaccaccgggacgtctgtatcattcctgtgtcagcccatggtacaaatcctgcaagtgctgctatgtgtggaatgaagatcgttgctgttggaactgattccaaaggtaacattaacatcgaggagttgaggaaagctgctgaagcaaacaaggacaacttggctgctcttatggtactgttccttttgctctgtaaatgttatcatttatcaggtcttcaggtagtaatgtggaatgcctatggtctttctggtcaactattcactgttaaatttagagctagttttctaatactatactatcactgcatcaccttttcgctatatttagtgtgttgcttaaagtcataaggctatttctgtactttttgttgcttctaatatatattaagatagaaaccagatagctgctccataacatggtccctaaagtggctgtgtacattcaataatttgaagttaattgacatatataatagaaacaaatccccggttagtttagtttatctatttccatataggctagagcccgcaggtgatttgtgaataagatttttattatgggcatagaaacataatagttcactcaggatgatttgatttataaaacaagtttttgaaatatgttggccttgtgcgtagagtaacagaatgttgcgtggttgctctgttcgtcaggttacctatccttcgacccatggagtctatgaagaaggcattgatgagatatgcaggataattcatgagaacggtgggcaggtatacatggatggggctaacatgaatgctcaggttagttctttgcagtttatcatgtcatcagactagcacgctctttctgaaattgctctcttcaagtctttttacaattttgatggattggaacgcattgtggtgaggctatataaattgtatagatggctttttgacatggtgttgattaaaaaaaaccaattagttgtgcctatgaattatactaaacatgtttagtaacaagtctattttaattcagttccaaacacaagtataccttgttttgaaacaaacacataagtaccaactttcattttcatgtttatctttcaatgatggtgattgaatgacccttatccaattaattatgctgagctatgttatcttcaataaaatatgataagctttctccaagttcatctgatcccaattgagaacttctgttatagtaatttcaaacaaccccatctgtcgagccaaaaatattcaatacactccctaactaacagaagttgtctttttacaggtcggattgacaagccctggctttattggagcagatgtttgccaccttaaccttcacaagacattctgcattccacatggtgggggtggtcctggaatgggtcctattggtgttaagaagcacttagcaccatttttaccatctcatccagtggtaggtgctctgaattcaatctgctgataatctaaacagactaatgatcaatgcccaactcttaccttgaaatattagacaagattgatatagcacataatgccaggcgaccttagaaaatttccatctttactttcttacagaattaggcaaattatacgtaatcatgttacactcaacaacgagtcttttatatttttcagaggattccacacaaacatacatttccctatgtcatcaacaatgctgtgttgatctttaaaaactagtttctttgtaatcctaactcctgcaactcgagaactattgctggttttattttcttgctttcttggtgccacattagcttagatgggtatgctaagtgccaccttattttcatttcatattaacctaaactcctgaagcaagagttgcctgcatcatttttcatatcaaaagcatagtagggtgatattatgtaaaaactgctgtagaagtttttgttgatgataaaactacaaaaccacatttggtactaaaaccagaagagttcgttcataattccatcattctttttaaccaaaaaagcagatgctgcttcattaaccagactaattctgtaattatcagatcaccactggtggcttccctctccctgagaaaaccgaccctcttggtaccatttctgctgccccatggggatcagcgttgattctgccaatttcctacacatacatagccatgatgggttctaagggtctcactgatgcttcaaagattgcaatcttgaatgcaaactacatggcaaagcgtctggaggtatatttgttactcgtgatcacttacccattgctacctagtttgattgtgtttgaactagttttctaagttttaccatgttacttgtacagaaacactacccagttcttttccgtggagtcaatggaactgttgcccatgaattcatcattgatttaagaggatttaaggtatccaacataggtattttggcatttggacattgagttatgcatttccattttgttaattggatattggaactttttgcagacgactgctggtatagagccagaggatgttgcaaagcgtttgatggactatggattccatgcacctactatgtcatggcctgttccaggcacacttatgattgaacccactgaaagtgaaagcaaggtaaaacactaaaacacctactatattccttgccattgtaccaaccattcttttatatgaacttaatgtcacattatttatttcgcaggccgaactagacaggttctgtgatgctctaatctcaatcagggaagaaattgcagaaatcgaaagtggcaaagcagatgtgaacaacaatgtcctcaaggtaaaataccagtatattgctatctgttttcttatattagattgcaagttcgtaacacctatctatctatatacgggcaattgtattcttacccccaattcttataggttatataagatgttagtagaccctgttcaatcctagtcctcatgctgtttgcaattttggagatgcatacattagcatggtctaaactcaacttcaggtggctgcatagctcttgcatcaccaggatgttgacatgtgattcttgttttgtttcgttgttttgcagagtgctcctcacccgccccaacttctgatgagcgactcatggactaagccgtactccagggagtacgctgcgttccctgcagcgtggcttcggggcgccaagttctggccaacaacatgtacttgcttgcttctgtgtctccaaaagattgctctttgctcaacacaatttgacaccaacctaatctctattctgccgtgtctgtgctcttaccaggtcgcgtggacaatgtgtatggggatcgcaacctcatctgcactctgcaacagggatcccaagtcgcagaagaagctgcagctgctaccgcatgatcttccaataatcacccagatttgtaaaacagcaccaagaagtcataatgcttcctgtaggagggaagcatgctctcttctcgttcagcttctgaacttgtatatagctttgtgagttgtgacagctcctgattctctcctcagctgccaccttctcctgtaattctgtacttcattgcttccccattcccgttcaaaggtgaaattagctttattgactagcattgctacactgctgaatacaagaaaaaaagttatgatccatcttgcgcatgcgctctatccatatagggaaataaaaagaaaaataggaaagaaaatggtggctattactctattagcttttgtatccatccataagaatatttatgaatatttagggatgagtgatgacatttcctattgaacggagaatgagtggcaccagttgaggcagttctgtcatatgggcctacttatgcttcatctttacagaagaagcagaagtgttaaagtactaaacagcaggattgtattactcatcaagatgctactgaatagtcgtgttacagagatagtactgaatagttgtgttacagagatagcactagacgtctcctatcgcctcctacaatctgatttatgcacaactactcgtttgtacttgattccatctgtttcacagtataaatacaagtctaccaaaccagaaattaagaatacaagaatgactctcatttgatgatttctttaagatgttcatatgttttgagacttaaacttggtcatacttgaaaatcgatcagctctacgcattagtactgtttgatccttatttgaaaatattttcatggcagtttttttagacatactaactttgtactccttccaactaagaaaaaagtagttcttccgacatcaaatatatttgactagagggaatagttagtaccaacatattgagaaaacaacaacaacaacaaaaacaaacaaaccctccaaatttgaagtaggaatttctaacggcaatgtgatttatacaaacgctcaaatatttgaaaggaaagaaatatgattctccaaaacgaagtccggataggatgggatacattgggccattttggtttgctactttaccaaattattgatagcgataaatcttggacaaattttggtgctatcaaattttgataggataatgttgtcttatctcaattgatttggcaaatgttggctttaatccaaacaattagaagctattaaggcaagttttggtataaatccaaactggcttcatgtttatctccgggcctgttcactttgatgtcattttcaaccataccatttttcgataaagttgccaaaaaaatatctacgtttagtttgtagctaaatttggtcaatacataagaaattctgccaaaattttgataatattgctatgttgccaaaattttggcattgtcaaaacttggcaagatttattttggcagggccctccattttctcttagttttggccatttgccattgactctgtccttttctagtcttcttaatgcattgatcccctgtcctcttgccaaaaagatggcagtactcccagagtatatttccaaaaagatggcagtactcccagagtatatttattaagagtagatataatagcagactacaaaccagctataaacatattttaatgatataaaataggagagagaagagcaacatgatgtagatttgtagctagctatagcacagactccaagatacatgtgtatgacatgtgggaccagatactaattatgtagtacatgtgtataggtaactattgtataaattagctataaaattgactataaatgatttggagccggtagttggctatactattaaacttgttttaaggctgtgtttagttcacaccaaaattaaaagtttgtaagtagaaaagttttgatgtgatgaaaaagttgaaagtttgaagaaaaactttggaactaaacacggtgtaggcaggtcatgcgtagaccaaccaaccaaattaaaaccggtgagccaatcattttgcagcgaggccggcgtgttgccacggtggatctgtgaatgattgattggatgacgccaagcggcaaatcgtatcgaacccactcacgcatctgcccgaacttgatccatccacagcaatttcacggacaccccagacccgccaatccggaaattccccacttcgacggcattaccgcgcccgccgcgagctgcaacgacgtacgccgaggaggcaggcccccgccactcgatggttcgccgccggcggcacggccgatggactcctcccgctcctccaactctctcgtaagtcgtagtagcgcgccccccgcggcttgccgccgctgcatttcatctgggtcttctgttttcccctcttgtgggtctcgtgctcgttctgacttctgatctgtttacgtcgtcgtctgcggaattgcgggatttggtaggattcggggagctctctgacgctgggggagctcgcgtgcgcggcgctgattccggtgctcgccctggtggacgcggtcgtgttcgcggcggcgcaatgcttccagaagcgcccgccggggctgctgcccgctacactcgccgcccgcgcgcgccgccgcgccggtggccgcctcaccttccgtgagctcgccgacctcgccgacgagtcccgctgctgtaagtacagagccgcccacccctgttcagcttctgcgtttcgtccgtggccttaaatggtaatatggtatcatcgggttgtgatcgccggcagtctcggtgaacgaggtggaggcactgtacgagctctacaagaagatcagctgctccatcgtcgatgacggcctgatccataaggttaatgataaactattcttcttcttcttttacagcacatttggtgagacgtgtactcctttgattctttttagcccattggttcagtttggtcgatccatactgcagaattggaactatggttacgatgctagtagatttcggtttactaaactctgtaactcttctacttgcaaaaaggaaaaggacactggaattcttcattttagttattcaacaaggaaaaaaaataaactaacaagtcttttgaaccaattaggacgggttaaccaggttgcaatccagtagtttagtatggtgccctcatgcatgttgaaaaggacttgctagttagtaatttacggagagcagaaaaggaaaaaatgaccgaaatgtcaaatgtttacatggagagtagacatgtaaacatcagagatagaaagatatgctgcgactagccccaatagaatttctataattgtacgcttgtaactggatgatatcttccaggtgaagattttacagtggaaaatgttatagtgttacctttttttggtcactaactgtgaatgtttgtacttgttttttcaggaagagctgcaattagccttgtttagaacaccggctggaaagaatctttttctagatagagtaagtgaaaaaggcttattctcgaactcctctccgctcaaataccgccgttacctatttgggcatttggccactgaagcattttaagagttgttttgttttgagtttcctaggatgaccaactaattgacagactctcatagtttcatcattttacttgctttgaacacatactttgagctctacgtatgatgcaaagaattaaatagggaatgatgttccttgcaaagtaaagatcttaattcaaacccgttgttcttgttacctactgtattatttgttaggcaatgctttgtggtaatgtcaagacacaagctctgattacatattatgattaaaacaaattcaatttttgattttttttttgctaccatttgagttagcttttcttctccatttaggtttttgatctgtttgatgaaaagaaaaattctgttattgaatttgaagagtttattcacgcaataagtgtatttcatcctaatactcctcttgaagacaaaattgattgtaagtgtgcttcatctcggtgatcatcaagaatttctttatatgttgaattatatatcaaccattaattcttttgggggttttgtgcttctttcagtttcattcagattatatgatttgaggcaaaccggtttcattgaacgtgaagaggtatgctctattgttttgcaaatacatcagtttgacttttgaacagatatgttaagccattgattaatcttgtatgaagtttattgtgtgagaacttttggtactcaagactttgccatatcagtgtcagtctttctatcccccagcttcgaggcagcatcatttgatcatttctgttcgcatgtttgccaattgctaaataattggaatccttcgagtttcttattgaaccttttcacgaattactgaaactggtgacagcttttgtcatcttcaggaaccacgctatcatcttgtaattcttgtagtttccttgtgaaacttgatgagtaaactatataaagtcacgacatgaaataaatcataataagtcttgactcttaaatgtaaggaattctgaaatgtagacaagccagctctgcagcatatgcttccagtgtgaagttaaaactaaccacaaagctccttttttttttctcgttcaggtaaaacaaatggttgttgctaccttattggagtcagaggtgcagctgtctgatgatcttgtggaagccatactagacaaggtattaacattttcttctccttgagcccttttttgtttattcacctagcactaggaatctctaattgagttattctgcagacatttgaggatgctgacactgacaaggataacaggattagcaaagaggagtggaaagcttttgtactgaagcacccgtctgttataaagaagatgaccctgcccaccctgaagtaaggatactgtttttgattcctgctttttcatcaatttatcttattttcatgcaatatggtttgccttgcactattctaaaatagccaacgatgcatcgccatggtataaagaagcattctgatttagttttgcctggcagggacactacagcggcgttccccagcttcattttcaatacacaagttgaagactaggggtgaataaggtgacacacgttggttgttcagcaatactacctc

SEQ ID NO: 86607 - DNA, 3183 bp, Oryza sativa
gccgccggggacgcctcctcctcttcctcctcggggaggctcgaaccggaggtgatccggagcaacaaggccatcacggcgcacatgcgcgccggccgcgtcgccgacgccgagcgcctcttcgccgcgatgccccggcgctccacctccacctacaacgccatgctcgccgggtactccgccaacggccgcctcccgctggcggcgtccctcttccgcgccatcccgcggccggacaactactcctacaacaccctcctccacgcgctggcggtctcctcgtccctcgccgacgcgcgcggcctgttcgacgaaatgcccgtgagggattcggtcacctacaacgtcatgatctcgtcccatgccaaccacggacttgtgtcgctcgcgcggcactactttgatcttgcccccgagaaggacgccgtctcatggaatgggatgcttgcggcgtatgtcaggaatggacgggttgaggaagcgaggggtttgtttaattcgaggacagagtgggatgtgatctcttggaacgcactgatgtcggggtatgtgcagtggggtaagatgtcagaggcaagggagctatttgataggatgcctgggagggatgtcgtatcctggaatattatggtctcgggttatgcaagaagaggggatatggtggaggcaagaaggttgtttgatgcagctccagtgagggatgtattcacatggacagcagtcgtgtctgggtatgcacaaaatggaatgttggaggaggccaggagggtgtttgatgccatgccagagaggaatgcggtgtcttggaatgcaatggtggcagcctacattcagcggaggatgatggatgaagcaaaggaactgttcaatatgatgccctgcaggaatgtggcatcatggaacacaatgttgacagggtatgctcaggcagggatgttggaggaggcaaaggcagtttttgacacgatgccacaaaaagatgcagtctcctgggctgcaatgctggctgcatattctcagggtggttgcagtgaggaaaccctgcagttgttcattgaaatggggaggtgtggtgaatgggtgaatagatcagcattcgcttgtgtgttgagcacatgtgctgacattgctgcacttgaatgtggaatgcagcttcatgggagattgattagggctggttatggggtgggatgttttgttgggaatgcactcctagctatgtactttaaatgtgggaacatggaggatgctcggaatgcattcgaggaaatggaagagagggatgtagtttcatggaatactatgattgctggttacgcacgacatggttttggaaaggaagcacttgaaatttttgacatgatgaggacaacatccaccaagccagatgatattactctggtaagaatttgtttcttggaacataccacatacaattagtgctagcacaccaatttgccgataactaaattcagtttatctcctataaatggttgattaaatctgtagaaagttcacccactttcgataaaatatttattataaatgctaacagtgagaactgtcccagtttagtaaaaagcaatagtaaaaagaactccctggttttttaaaggtaatggagatttcattaagcaaatgaaagcatctagcttctgcacaaaagtgtactcagccagcctgttttcttttttagtagtaataaacaagaagatttgttcccttattctatactcatggttttggggtaactttaactttcaggtcggagtgcttgcagcatgtagtcattctggcttagttgagaaaggcatttcatacttctactcaatgcaccacgattttggtgtgacggcaaaacctgagcactatacgtgtatgatagacctccttgggcgcgctggacgattggctgaagcacatgatcttatgaaggacatgccatttgagccagattctaccatgtggggtgcattgctcggtgcaagtcggatccaccgcaatcctgaacttggcaggagtgcagctgagaaaatatttgagttggagcctgaaaatgctggcatgtatgtcttgctttcaaatatatatgcatcttctgggaaatggcgagatgcgaggaaaatgagagttatgatggaagagcggggtgtgaagaaggtgcctggattcagttggattgaagtacagaataaagtccacactttctcagctggtgattgtgtgcatcctgagaaagaaaagatatatgctttcttagaagaccttgacatgagaatgaagaaagctggctatgtatcagctacagatatggttttgcatgatgtggaggaggaagagaaggagcacatgctcaagtaccacagcgaaaagcttgctgttgcttatggaattttaaatattcctcctgggaggcctatccgagttataaaaaacctcagggtatgtggagactgtcacaatgctttcaagtatatctccgcaattgagggcaggctgatcctattgcgtgattctaaccgatttcaccactttagaggagggtcttgttcctgtggggattactggtgatggctaattagatttcttgtgcaatgaatccctgaagaatctgtagttgacaacgcaacaaagatggtgcaatgcaggctacaaacaaaatattataggcatcttgatgactcactcggtccacaggccttctactaggccaccatttcaaaaagattacatgagttggtgattgtttccatgctgagtgaagaggtgatacctagacaaaagcataatatacaagatcataattccagtgtcaagtgatagactgatggtaactcaggtgaacagtctcaaaggacaagtttgctgaggcaggtttagattggaagaagtttggacaacaaggtgttaatcctcccctgttagtgacatcttaaggtaccaattcaactgagatatactgaaaatcaaggggtcatagttgtttttaggccatcaacaaattatctttgtttctatgtgaccaggtatgctattaaaatcaaggatggtgtaaatatcagtgcaagtattctctgttgaactcaaatattggtgttacaatggatatttgttattccatttctgcgaaaataagcatgccagaaaatggagcgcctgacggtcttacacgagcagttgggg

SEQ ID NO: 86608 - DNA, 9063 bp, Oryza sativa
acatccacaaccgccatttcaagcgtcatatgaaggctataaaaggaggagttcaactcacttccgaaacacacatctcaagtggagtacaactcactttcatattttaggcatctctttagtgtgtggaattaggtaaagagtgaggtaaagctccggaaggagtgccccaaatatcggagttcttcttccactggagtttcggagaagtgatggagttatcggccttcttctctcgtttgtatcttaacggatgcttcttaagtaagtatttgagatctccttatggtatttaatttagttgcttgaatgacatatattcccatcgttgcgggttcgtcgcttagttgaattattaagtgctctagtactaggattctagataaagaaggaagttcctgcgtggggctagagtagtaatcaataacttaggtgtggtgtttaggttagcggttacctttttttgttgtgtgctccatagaaagtgaggtaggcggaaggtggtgatagccttgtccatcctttgtatccctccatgttcaggtacatcatagagccgtaggctggattcagcttggcagaccagcggagggctagtgccagaagcaatcgatagggttttacctttaactcaagtctagtaaattaatccataggaatcctctttagccttagcctaccattagttgttgtccttggatagaattatgttcctagatatatgcacatgttttctgtgattcgatacccttggaatactctgaggtgaagtgctacagcggtattcgtgcgcttgcggatttatctgtgaccgtatcaaataccaacagcgagctcaaagagatcgtgatgcaccaacaacttcatcaacatcatcctatgtaatgtcacatccacgaaaaccttcaactggttcatgtaaggaattatcccactcattgttccaatcaaactcctcaatgacttaaggatctggccttttcctgctttctcacgcctaagctgaaacctagtttccatcttccagttataggcaacaaaaacaacatcattcaatctcttgtgtactaactggttcattttctttgtatggatctgcagggatgcaaataacaagggaagaaaaaaaaggataaataacttgctgatatagtaaagaaatttaaagcaaaactacagataaactgactcgcaaatccaaatgttctccaattgagctcacaactggataaaaaagctcaattggaatgcatgctgattggtatgctggataaaaaagctcaatttatttggatttatttttatctattataaatcaggaatgcatgctgattggtatgctggataagtcaccaaaatattttggtagaaacactatttgatattttatctgcaaacaaaattcgtgtttttaataaaattttccaatgattgaaccacctgtacattgtgatgtacttgatgggtatatcctttgaaggagcatcctaagtaatatgcactggggatattatttcctgaaaatgtagtgtattgtgattccacaaagctcaaatatctcaactgaatcattccaatatgcttagttatgatcaagaaactttagtagcataaaatggtcggtgaagcactttgtccagacatctgactaactgaagtgatgtactgcattaaataaagtttattttatatatcatacttgcattttcaatgttccatggccatattactggatatggatgaatatatctgtgtttttgtgtacctcactactataacttgcactgtccacacattttcctagctgaagtgatgcaccacattaattaattatagcttgcattgtccacatattttcctagctgaagtgatgcaccgcattagttaagagtttattttgcatatcaagctagtggttccttattttctacttgactgaaacttttgtataatacagggtttagtatgataattgataatgaagtgagatattgagatgtaacatctttgttccccactagttttatgttgtaatttcaggaaatattttaaaaaaataatcaaaatttgacatcagaagtttagacgagtatgcagagaattactgccaagattggatgaccatcactggcttaactattaaggaattagtttatttattactatcataataatgcaatcagttatctttttaataacagaatccaaactatcagttctgatgttttcactgttgatctaaaggtgctatacaaatgtttcaagaatcaagattatataggttacaaaaaaattgccatgtatgttgacatgctgaagtttcatcttgtccttgtgatgaatgcaatgatacttgttgctcattgattaaaactaacgtattagcatattctacttccaacttctgaaatagcatatcagtaacttgttatcgctttcctcaattggcaatgttttaatacctaatattgctttcaataactttctctctttactcttatatcagatcacacaagctaactaagttcactttgtttttgtcaactccatgaatagtagaaattgtctttgtcgacacagtttgtcactgatctgacatgtgattttaactggtaatacaggcctaaacgcagggggagaaaagctgcacaatagtctactgatcatactctctaggttcctcacctggctgaaggtacccttttaattcagcacaccccttttcatttctttagtttattattaccattttgagtttagttttgtatgggtcctgcatctagactacgctaggagttcccatatcattttgtttatgtgacactgcctacatcaatcttcttacttttacatgttatcaatcggatagttgtatttttgttgatttaattttgagtagataatttggaatgcgatacatgctatgatctatgatttggtattttgctactttttacggaatttgtagcctgctagatgttcttacaaagatatgagaatccatgtgaggacatgccctcatggatactcaactaattaacatgagtttagttgcggttattaatatgatcattttttaaccagtcataacaattgataaatgtaccatgagcttgttattgtgttgaagtggtatcactattttgttaggacttgaaactgtgaaataatatttctgttcttttttggcaggtgggtggactatgctagttgagataaggcaacctctgttgaggccagaagggccattttttgctacagaaaatttgcgcaattacagaagaaccaagaattgttggatcattcacagaaattgaatcagaagcttgaacaagttttgtccagatggcaaagccggcaacttttgtaacacctttgcagtttcctagatgatactgacggaaaatgtttcagtatgatcgcgttatactgaaatgttgcactatagcaagagtttgctatagtcagtcaacccccgttaccgtggtgtggttaaagttaaactgttgtgtgtaacatgtgactgtcgataatgactatccatccattcagttcagtgctttagatgcctttgatttttccccccttcagggctttactgggttatctgtgttagctcacttgcagcacgggtgactttcacaaacaagtgacaatggcaattccttgccttgtcacaattggagaaattgacatgattttccagatggtccggatattattatgctccaattattcttgattggtttagtgatttgccctttccagattgcggactaggggttaggattacatgagtactcataggaaaaagtaaggggcaaaacctacgtgaagtctagcgtcagcttggtatagtttggttctgataatttgttgttggtcactatggtctctacagatagtattctactgtagaaaagtaccattggtttatgtatttgattagtagaaaattccactgccatatttgaggtagtagtagtatggatagatatagcctattggacgaggaaagatagaaagtctagacttaataaattttggtccaaaactttcttctgtattaggtaaggcatcttccatcattttggttttgtgtttttttttatgaagcacacaaactatgtttgttttaactctctaggattccatgaacatgtggtccaaagattctatcatacttttgtcaagtcaaaaaaagttgctagttttgtagcggcctgcaccacacctccacagtgtggccaaagaagaaaaatctatggacaaactcctattatcttcacccataggatgtactaaatcaccccctaagaatgcctttagagtctagggggtcactagtaaacacctacatactggtggatcgaaatgggcatcacttctagtttggaaccagtggtgagaaagaaatagtgatgttttacggtaataaaattgaaggaaaaaaaatagcacctaggccagctccagttcatactctgagttaccttctagttccttgcacgacaccttgtgcgcacggtggccccttgaggtgcttgcgggtcccgtcttcattggaccctatttgtcgttgtcaaccccatatcttacaagaactgactagatctagtagcctcaagtttggagcaaccaaatctgacactacaatgcctctcgctttgccactcatccttgtcacccaagaccatggttgttttgttgcttgttcctaggccaatcgccatcatcaccatcacctgcgctcagagcacccagatctggcaattagatctagcagccgtaatattgcaacaatcaaatcaatcaacccggagctctggctagatagatttgattgttcaagggcaagtgtgggtggagagaaagagagggggcggagggtaggggagggagatcaagggcgagtgtggatggagagaaagagagggggcggcgggcagggaagagaggggatgtgaatcagtaagggttgagggagactaggtatttaacgatagtgtaggaaagtggctcaatttggccttactcggctgttactatcacttcttgtttctatcttgaacatgtggtgataaattttgttattagtggatcaaaatgaattaatacttatagaaggttaggctatgtgtttgctcacaagtgggtcatagatcaatctattgttatgccaaccataacattctaaggtatggtgacaaaagtgctagcagactgagcttttaagaaccaaagtagacggacacacatccttttgttatactacgagcacctttaatttgtaggaaaatataggaattttggaggattataatcctattggaaaatttccaattcctctctcatccaattatatctctttcatccaatttctacgtttttccagcggtctaatcaaacagtcattcttatattttttctacgttttacaatcctctgtttgtttgcacttgtattcctattagaattctgtgttttttctattctttcgttttttccattcctatgattcaaaaatgcccgacatatgcataaggtgtcattgatagatggatcccacttgctctaggaccatatgtcagtaacacatactgcatatgcagtacaagcaaaggatctcatttaaggccttgtttagttcgcgaaaagaaaatttttgtgtcacatcggacgtttgaccggatgtcggaaggagttttcggacacgaatgaaaaaactaatttcataactcgcctggaaaccacgagatgaatttattaagcctaattaatccatcattagtacatgtgggttactgtagcacttatggctaatcatggactaattaggctcaaaagattcgtctcacgatttccatgcaaactgtgcaagtaaatttttttgtttatctatatttaatacttcatgcatgcgtccaaagattcgatataacgtttttgagaaaaaaaatttggaaactaaacaaggcctaaattagatctggtagtagcagaccctagtgcaaaagtgcacccaataacatgtatcagtagtactcacggttatgtgctaaaaggtagaatttcactgattgtgtattttgccacatgttacaaatttccgttttttcttgttatttttcttgcaaatgcaggtgcatactgtcaatattgtaatttattaaagaatttttcataacttctaatgtggggtttctgggcatgggaccaccgatagtaatgtttacctagtacgtactcccttcgtcccaaaatataaaggattttgaatggatgaatatttcctagtattacgaatctggataggctaggaaatatccaatccgtccaaaatcccttatattttgggacggagggagtatattatgggccatataattgacaataaggatacattacttttgagctaggcaggtgaagagggagatgagaccaagaagagagagaatattattttaaacaacatgtgttgtaggcctacggatttgtgcatggaattaacgaatatgcaatactacacaaatggcttttgttaaaaccacctcatcacaaggtctggatcatcctgcctattgagtgttgaactggtaattatagtttttttaataaaaaagttagataatttttcatataaagtcagataaaaataaactttatatccataagtattgttgtagaacttaagaatatttacaatctatagttgacaacctttatatttaagatcattcatatgtctgtatacgtgttagaaggtctagagactattttgttgaggccaaaatttgactttactacacggctttgtatggtgattggagacaaactttatatcatggtttttaaggtggtaaggtgaccccggactaccttacaggtaaggcttaaggcgagatgacgtcttaggcacatcaaagctgcattttaagagcagtacgacacacatatataccttgttcttggcaactcttaagcccatgtagcatccaatacctacatggcagcatccacccccttagaagcatcaccattttttgtgttatgaagataataatagatgcataattgtaaacaatagttaataaattgcttccatttacttgagtagcataccttgttgatgacctgaaagcagcaaggcacattattgatgagcaagatgataatataaagccataaattcaaagacaacaaagtaagcatttgagcacgagtaaattgcatattggaccactatattttacaactctatcagcttggactattggtagatctacatttccctattggactgggtaaatttacaaaggtttcagtttggggctgttcttgtacctgtagctccctctctcctctctttgtgtactctctctctctctcgcctctctctctctctctcttcctttgtgggcaagaaaagaaccactgggtgggctcaagactgtagcatggagctgccggccgagctcaacttaagtgcaatgccggagctgttggggctaaggccgagagctgagctggctgctgactgggctcaaggctgagcatgacactgagccaccaatgactctcgaggccgagcatggtgtaagccctgacagggctcgaggtcatggtcaagtgcgtagtctgcttcgagcggatgccaacagtggacgtgctactagtggagaggggtggaggggctaccataggttgttgcttcgctaaagcatggctactacagggaaatcatcatcatcatgggtggtgttatccaatttgccacaacaacttgcgtgatggctctcaccgtggtcagcggcgctcggcctcttgcctccacttgccaacgcatggcatgaagtacgtctctgacatgtcacagtccacacaacaaacaaaccaaattatacaatcggtatgcactgacggactaaccatccatttattcgcctcggccacattgatctccacattgttgggtaaaggaccggcttgctggtcatcttcgtgatggagagggtcagaccatttactagcggtcaccaggttcatcaccttcttgatggggtggtgtagttcggtgatggctctgagatatggagaagagggaggagcgctagaggttgaagaactagcccaagctgaagcaactggtaaagataaagtggtctaaagtgaaaaagtttgtttgtccttagtccaatttgcaacaatggtaaaaaagagcggctcaaggtgcaatttactctaaacataataaactatcaagcaggctaacctagcaggcaagtaaacataataacaaagcaaaatagtgggagctatcatatacctaatggcgtataaagataatagtggtccataactccacactccacactccacactctaaacaaatatactataagtccaactccttgtctcttagtattcatcatcaaactcatcgaaattgccattggcatccaaattctcttagccatcttcaatacctgcgtgagcttcatcacaattgctcacatttgcatcattaggtggatcttcctccttatcttcttcttggtcagattgcatatcttcctcatcttcttcaaacattgttgtattccttgggtgcctttgaaaggttattggaacaacaaggttgtgaactctccttagaacatgcgattgttgtcggtagataagtgcaaactttcaccgtcaactcctgcataaaagaatacaaaatataatatcaaacttagtggtaggggtttattactaaccatttccactagtctttgtaaatattggtatgcaggtgatttttgaaagaaaatgcactcgccatgagactaaatgtacctccgaccaaccatacgcaagcacaaggatcggagagcccacatgtcagtcaaaactaactgaatttgagctaatccaccgtcaactgccaaaggggtccactgtcatacaccggagaatgtcggtggccaatggcggtgtgcctggttcggctgatccaaggttggcgcccccagccacctccttgcacgtggcgaccccctattggttggtgatggcggt

SEQ ID NO: 86609 - DNA, 1026 bp, Oryza sativa
tgtgtgttatatgccttgcgcacaaactgtagatttccaaactgaaaaatgagaatgatcatgtgatagcgtgtatcatgctaatggatgatcatgtttatagttttgtttcttgtgcctgaccttgataacttgatgataattaatggtttcactttgcttacatgattgaaaacacattcttacaaccagtgatattttccacattaggttaataagtgttaagttaaagttggcacaatatccattgagtacttcaagtaatttggagacttaagttattattaagttttattttatacttgctgcattttgttgtgtaataatttattactagcttctaatagttttaatctggtacaactggtcaactgcattgaaatcaggcaccacatcagccaaaagcacaaccatcagttcccaaggtttcacctcctcaacccgagaaatcacctcctaatgcaacaccaccaaaggttgagaggccatcagttgcaccacctcctaaggttgactatgcaactgatctcttcaacatgttatcaatggatggaacaaccgagaaagaagcagagtcatcttctaatgatgatagtgcatgggagggcttccagtgtaagatattatgacttaacatttctattgaggaattattcttgttatatgagcatctttttatgaaatgttctgcgagtgcttcaccatattccttacttgcatactgtggagtatcttttaatttgggctcctgtgttctctttctcaattgttcagctgcagagccagtacctagctcagacaaaaaggattctgctaagccagtagaaagtaagccccagtctacatcaggcatagaggacttgtttaaagattcaccagctgtgacagtatcctcagctccagctgccccacaagtaaatgtgaagaatgatatcatgagtctgtttgagaaggtcagcgccagcattacttttactaatgcttttgtgaaatggctctgtcatttaaaagaaagagcacatctat

SEQ ID NO: 86610 - DNA, 1230 bp, Oryza sativa
tgttgggcgtctatgactttaccgccggcctgcctccgtcgccgccgactggtgcctccgcctatacggttggttggtcacaccaccgttcatgggcgtccacgtcttcaccgccggcctgcctccgtcgccgccgattggtgcctccgcttacacggctggcctattatgccgccgctgttgggcgtctatgacttcaccgccggcctgcctccgtcgccgccgactggtgcctccgcctacacggctggcctattatgccgccgttgttgggcgtctacgacttcaccgccggcctgcctccgtcgccgccgagtggtgcctccgcctacacggttggcctattatgccgccgctgttgggcgtccacgtcttcaccgccggcctgcctccgtcgccgccgagtggtgcctccgcctacacggttggcctattatgccgccgctgttgggcgtctacgacttcaccgccggcctgcctccgtcgccgccgactggtgtcctcgcctatacggttggttggtcacaccaccgttcatgggcgtccacgtcttcgccgaccggctggccttcgccgccgccgactggtgtttctgcctacacggctagcctattatgccgctgctgttgggcgtctacgacttcaccgccggcctgcctccgtcgccgccgactggtgtcctcgcctatacggttggttggtcacaccaccgttcatgggcgtccacgtcttcgccgaccggctggccttcgccgccgccgactggtgtttttgcctatacggttggcagacttcgccgccgttaatgggcttcatcatctacaccactggcttggttccactggcgccgactggtgtttttgtcaccatcgatggactgcttcgttcccacatcggctacttttgctgtcaccgagggaatattacaaagctaagtcatcatttattttattctttatatgatattttgtcttttcctttgcctcactacatcaactggttcgccgttgactagtgagtcgggggctatagatgttatatcgtattttttaaacaattttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtg

SEQ ID NO: 86611 - DNA, 1396 bp, Oryza sativa
attattgttttgatttatgtttaggttcttcctgatgacatccgtcaagcattgctcgttattgttgaatgctgcatgaagcgtgattatttagcagcaatggaccaatacatcaagctggccattggcaatgcaccatggcctattggtgtcactatggttggtatccacgagcgttcggcccgagaaaagatctacacaaacagtgtggcgcacattatgaacgatgagaccactcgcaagtaccttcagtcaatcaagaggcttatgaccctttgccagcgacgttatcctgctctgccctcaaaatcggtggagttcaacagcctggcaaatgggagtgacctgcaggcccttttgtcagaggagaaagatccaggaaaccctcctagcgaggataggcttcgactcatgccagcgtcaaaagagtgatgcttcaacgcacaagcttggatcacaaatagaatatttgtaatctgtgtaatgtgtaaaccaaattttcctgctcttattttcatttttgtactcttgcaagaatctgagaatattgcctgctaatcaaattactgaagaaagcaatatactgtctgcttctctcctagaagagttcactggctaaggttccatgtgtaagtttggttgaataaaaccattctaatgtctttgctgtgcaacaaaggtgtatgctggcaaacttattagattcatcaggttggttaagaaccgagtagtcgaaaaaaaaacttgctgtatttatcacatgaaagagaagaattcaggaagcacgtgcttgagatgtgcaacaagattatctggacagctacaacttggatttttcctgaacctgcctagtagctcactgctgcctggtactcgtgcccattaatttcgtttgccttgttttgcaggtgtagttcagcagctatccctgcctcgcttctgctggattctgggtaagtgagcccactgcatcagcaacaaatgatattttgcttatcatatgaagggatttttggcgcgaatggattgttttgcctaattcttacgtttttagcagctgtgctgaatgcttgtttgtgggtgatgttaggctccatgcttttgatcctctttatctcttccctgacaacaaaaaggaatgttaatacttccatcacctctcaagtctcacctgaatatcgaggggggacatttatataagaatattcagagccatgtatgctctaggtgatgctctgcaattggccctcagtctagctatgatcacagtatatactcattttgtttttctgggctattacttgacgaaacagttgtaggcagacggcgtccgctgctttcttcctggcgctgcagaaatgtttcaagaacatgcttaattagcccatcatgatcg

SEQ ID NO: 86612 - DNA, 4359 bp, Oryza sativa
tttgtcatacaagcctcacatgatacttccagatttttgatctcctgaaatttgcaaatacaaataataacaacagtaatttaataaaagatatcaaacagcataatatttcattgcacgaatccctgggaacacactgaaaaaaaaatgtggttctagccctactacatgggggctcctattttgcagatctgaagtgggtaggttcaaacttttacagcagcagtagtggtagtactatcatattctcttggcatgcactgtacacaagccttgtgcttccatacatttgtatagatgcagcatcaagttactgtagcatatcacacaaggggtgaaaaggacaattgcaccttgggctagcagcagtagagacagtgtaggaaaatagcattgtccgcaggataggcctgggccgtgcatttatcagttactcctaccacattttgcaacttcctttgctcattcaggtgatactcgatctcctacttgtagcattgcatggttgtacatgtggttaatttgaatttaaaccaatctaaagttagaaatccctgaaaaaaataatactctatccaaaatataattatttctggtgcatagtcataaatgtttatattttagaacggatggaattatatatagttataagttttcagcggaatatttgtggacatacttgtgcacttactaaagtgaagtactgaagatgatgtgtctgattcaattcatcatgccataatcacatttccttgctggaggagtatccatcaagcgttcagtagtaaaacctatgtttattattattttttacctaattgttaattttcaagataagatgaggatctttcctctaagaaagagtggaaaattcagagaaaaacacacctcgttgcaacctgcaagtaaactgacctacaaggactgaaagttcagttattagcctaatgtagaggttagcgttgggatgttccaatttacgagctgttgttattcctagaagcctaaaaagccactaatattgattttaaaacagacttgacttaggagtgcattagctaaaactgcaagtaagcgcaattctttctgtcaacttggaagagttaaaagcacgcttcaaatcatcagcacaacacttccgagttcatctggaactcttgcagtcatcatgcccatccttttcctcactttctttttaatgtgacaattaaattaatatcggcgacctgtatctgtcaaaccgaaattctacgggcaaagaacaccaattattttcctccactgaagttacgtcagaaaatggagtctttggtagcaaaagcagtacaaggcgatgcaaacttcacggaggaaaaggcacagtgcagctgataaagatgcaaccctttttttcgcctaaccatctgtcatgtgttgtgcatggacaggaacagagatctcatctcatctcatcaggtagccatcaccaaacaaaggacaaataatacctcgacagggaggaaatcattgccagtgcagggacaaaatcaactgagcaggatagtagataggagggcatcaggggcatgaatagctttgattccctgtgtaattgatactaccttggttttactatgtacaaatgggccccagaaattgtagctggggaggcattacattggagagctagtcatgcatttcctttttgtgcctttcaattaagtacagcaataagtagcgctccacaataatgcaggggccctaattctcctgtaatggcttgatgggacaggttatgtacaatgttttttttttctttttggaaagcgcaggactgtacaatgtgacaactatatcaatgtaaattcttgaagaataccggttttccagctcgttgtaacttctaaattaaccatatttggaattgccaagtcaattgtatcctcctcaggtgtgggaagaaattgatggcatgaatgtgaaatttgtatattagaaagaatgatctggctgaattaatttgataagccagtagtttcagaaacagtttgtatcgtcgctgacaacttcttccggatctctagctcttgttgtctcttgagataactttgtgctgtagaagtaattatctgaacgatgaagttcatgatcaaaagccacaccacggtattccagatcaaagagaatgatagattccacttcgtttcctacacatacataattaagatatttaggaaaaataacaaagaacaagaaagcaaatgatagcaggttaagaaaaaaaacagcagtaaatcagaagagagagatgctatcatgatcatttttgtaattatattactctgtaatttatgttaaaataattgtcaaccataaggataaattttacaaagtgtgatcttaagagtatgtaattttgttacaaaagttatggaagaatataaattattgttgctagaccatcagctgctttgtcattcagaagttggaagttagaacacatcctttcatgaaaaacagtgacatacattacaatgaaatcaacagaatcaataaattttgaaaacaacacataaccacataatgatgatcaaactaaaagttttgaaacaagtacgcctgatgtttgagatttgaagtgttcaaaacttccccaaaattaaaagaaatctgtaccttcacaacacttgatgctgatgcagcaacactggatgataaaaacttgctcttggctgtcttcaacttggcaactaaagagggaaggacggatgataccataggaacattgccaaatacccacataattcttttctccaccaaatcaagaagttggttattgcagagagtaattactaatgttgtctacagaagttatttgtgaagtatggttagataacttaacaaagatgttacaatgcatggaagatactgaaaagaaaatgctctgcaagagaatttttaagtagcaaacctggatataaaccttaataacagcctttccaattaaagttgctagaaagaacttccagaatgggatgttaaattgcccacacaaaatgccagcaagatcgaagagggggtttggcacctaatggaaggaaaagttaagtttcttcacatgtcatatctaacaagagaagaataatatgcaaaacataactgctctacattgtgacgaagcaaatctatttcttttgggaaatctcgtttgtgtgtgaatataatgagttcctcaagcatttcgagtggagttcacctaacaagttaaagtgtttaggagctacaacctacaaggcaactggaagtttggtaaataacaaattatgactgaaaacaaataaatgtacacaagaaaggaactaaccgaagcaagtaataagatggtagggaagttaagatactgtgagtgagacataagccatcttttagcccgatgcagagttgaggatagaaaaccttctcctgaaacggaagcatccaactcttccagctcatctagtttgcgtcctgacatgctagctggggttcatttatagtgagtcagttgcatcaagaatttcttctgacccaagattaaaaaataaactaggaaaaagtagtgaaaatactgcatcttagcattactgtattagaacttcaagatggaaccttatggtgcagaacttagcagaatattaagaaccatatatcactaatgtatcctacacggcatagtatttataatcagcattgcatcaaggtttttgcaggagtcacttctgcactggctggctagaaacaaagcctgaaaatgactcttggttctggctgagaagtgcaacacaaaaacttcccgctgtcttgataaaaacttcaattttatttaactctgtcagggagtcagagtttttgtattcctctcccctttcctttcctcggattgtaaataactaaagcttcatgtttattaatatgcagtagtcaacattccagaagtttcttgctcacaaaacaatatacataaattgctctgctgcataattcgacacatatcaatcttatcacatgttcatgtacgtttggaaaggttgaaagattataccaaattttaggttattcaaaactgtcatgttctctagtgattaatattgaagataaaaagggacatagtgtgaggctgtgagcatgtgaaaagcatataatcaagtggtgctatagcagcaaagcagtaagacgcaacctgctctcgagaggaaatatggaggaagttctccaagtgcagttccaatgccccagagaacagcttcaaggtgaacttcatgcagtattttgctaaatggaattgtttcctggtacattggcggtccaaattctagacagtctttctccaaccatgaaggt

SEQ ID NO: 86613 - DNA, 1688 bp, Oryza sativa
cacccgtcagcgagggtggcgggcgggcccgcctgtcagcggcgcgcgcgcgcgggggaggccgatgggccgcgggggaagagagagagagagggagggactgggccgagccggcccaagaagggaaaaggggagggggaaaagacttttagggatttttttctttttataaaacccttttaactttgtttatttcttttcacttattatttgtgctctgaaaattccactaaaatttatttacacattttaggcttttaggaaatatacaaaaatcctccaagcctcatttgacttttatctttgcacattttaattgttggaggctttcacatgaattttaattattctttgcacaatttcgaggatgagttttagagtcgttttgggacgcgacaaacctaccccccttaaacggaatctcgaccccgagattcggaagaactggcgaagagatcgggatgggctgccttcagctcgtcttcacgctcccaagtagcttcttcttcggcgtggttgctccactggaccttgcaaaaacggattacccggttcctggtcctgcgctccatggtgtccaggattttcactggcctctccacgtaggtcaagtcttcgcgaacttcaatttgctctgagtcggcctgctcggatggcactcgaagacatttcttgagttgagacacatgaaacacatcatgcacgttgcccaaggaggcgggcagctccaactggtaagcgacttctccgcgtcgagcaatgatacggaaaggacccacataccgaggtgcgagcttccctttcgtctgaaacctgtgtacacctcgcaatggtgtgacccgaaggtacacaaagtcatccactgcgaattccaggtcacggcgacggttatctgcataacttttctgccgggactgtgccacctttagattatcccgaatgattctgactttagcttcagcttctctcaggatatcagtcccgaacacttggctttctccaacttggtcccacaaaagcggtgtccggcatttgcgcccgtacaacgcttcataaggtgccatttgtatgctggcttgatagctgttattgtaggagaactcggcataggggagactcttatcccaggtcttcccgaaatctagtacacatgcgcgaagcatatcttctaggatctggtttagacgctcggtctgtccatctgtctgcgggtgataggcggtgctgaaatttaatcgggtacccagctcttcttggagcttcttccaaaagtgagaggtgaattggcttcccctatcagatacgattttcttgggaacgccatggagactcacgatcctagcgaagtagagctcggctagtttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacacagagccacgaactctgcaatttcccgcttcatgctaacccaccagtatttctccttcaaatctaagtacatctttgtactgcccgggtgaatggaataaggactttc

SEQ ID NO: 86614 - DNA, 5168 bp, Oryza sativa
  unsure (1)..(5168): unsure at all n locations
ttttccctttccttttcagttcaatcgcaaaccagcaagggggattgagtatttgttattaaataagttgatcgaaaataatgcaacatctgtagctcactttctcaagagcaattctcgttggtaaggtgattcaagaaacataatgagcttcttgcagtttttctcaagtgtaaaagaaggattagtttactgttattgctaggtgggactaaccactagtttttgtgaactgtaactntgcaggctatgattggtgaatatttgggacaacatgaggagttccctcttgctgtgatgcatgcttatgttgattcaatgaaattttcgggattgaagtttgatgctgcaattcgtgagttcttgaaagggtttcgccttcctggggaggcacaaaagattgatcgcataatggaaaagtttgctgagcggtatgtgtataaagtcttaatgctacttttatttgacatgtcaaccactggtctcaaatggtatattatgacttgcaggtactgtgctgataaccctggacttttcaaaaatgcagatactgcttatgttcttgcttatgctgttataatgttgaatactgacgcccacaacccaatggtgtggcctaaaatgtcaaaatcagatttcgtacgaatgaacactgcgagtgatgcagaggaatgtgccccaaaggagctcttggaggaaatttatgattccattgtccaggaagagataaagatgaaagacgatttccctgattcagcaaaaactaataaacccagacgagaaacagaagaaaggggtgttgtcaatatcctcaatttagctcttccaagactgaagtcagcaagtgataccaaagcagaaagtgagaaaatcattaagcagactcaagcacttttcaaaaatcagggacagaagagaggtgtttttcatgttgctcagcaggtcgagcttgttaggccaatgcttgaagctgtaggatggcctttgcttgcaacattttctgttaccatggaggaaggtgacagcaagcctagggttgtgctatgcatggaagggtttagggctggcatccatcttactcgtgttcttgggatggacaccatgcgctatgctttcttgacatccttagtgcggtaagcaaattattttttctatttatggatatacactggttgttcttgggcaaacttctatatgtaaattcatttattgtctttttaattttatgaatgtaatgcgctaagttatatgaatgcaatatcttatgtttctttcttaaccttttgcaggtttacatttttgcatgctcctaaggaaatgcgtagtaaaaatgttgaggctttacggaccctccttggcttagctgacacagatatggatgctttgcaagatacttggaatgctgttttagaatgtgtctccaggcttgaatatatcacttcaaatccttcaattgctgcaactgttatgcagggatcaaatcaaatatcgagagaatctgttgtccagtcactgaaagagttgtctgggaagcctgctgaacaagtctttgtaaacagtgtaaaactaccaagtgattccattgttgaattcttcactgctctttgtggtgtttctgcagaagaactgaaacagacacctgctcgtgtctttagcttacaaaagcttgtcgagataagctactataatatggctcggatacgtttggtatgtcctgtctcttattgtttgtttggtattcctgttacattggagttcgattcaccacatctttgcagaagtgcaaaactagttggtcaaatgtgtttccatgttcttaaagaaaacctagagtagtatacctgtacttctggagccattttgatttgtgtaactgaacaccagcctgtcatctgtttgaagtgcaagtgcaatgcacatcaacatcaggatctttttataactgggaggcatcccaatattaaattttagctgtgatatacaatgtcttgaactcatgactaaatattttgttttttcatctgagctagtaacttacatttatgcatgtgcatgtaggtgtgggcgagaatatggtctgtcttgtcacagcattttattgccgctgggagccaccacgaggagaaagttgccatgtatgcaattgactcattgaggcagcttggtatgaagtacttggaacgtgcagaattgaacaaattcacatttcagaatgacatattgaagccttttgttattttaatgagaaatagtcacagtgaaaaaatccgtggtctaattgttgattgcattgttcaggtaggccttcataagtcttatcaaacaattgaaatctgatgatctggtgcttttatataaaatgatgttgtaatgaaaaatcttgccatatgaacatgcagttgatcaaatcaaaagttggcagcataaagtcaggttggcgttgtgtgttcatgatattcaccgcggcagctgatgatgagaatgaacatattgttgaaagtgcttttgaaaatgtagaacaaggtaagtttaaaggaatataattgctagcattagaagtgtttcttactttctccaaaaatgttagattccattatcatcattgttttttgattaaatggatgtgtttggcagttatcttggagcattttgatcaagttgttggtgattgcttcatggactgcgtcaactgtcttattggtttcgcaaataataaatgcacacctcgaattagtttaaaggctatcgctctcctacgcatatgtgaagaccgtttggcagaggttaggatggtgaccacccttatattcacatctggacacttgatctttttggcctgatctttttggcctcattcttttcatttgcagggttgcattcctggtggtgctgttaaacctgttgatgatgttccagaggcccattttgatgttactgagcattattggtttcctatgctagctggcctatcagatttaactttagaccccagaccagaagttagacactgtgcacttgaagtgttgtttgatcttctgaatgagagaggtcataaattctcctcacctttttgggagagcatttttcatcgtgtattatttcccatatttgatcatgtaaggcatgctggaagggatggcctttcttctggggatgactggcttcgtgataccagcattcattctctgcagttaatctgcaaccttttcaatactttctacaaggtaatgtatgttgttctcccctgctgattttagttgcttcctagaaattgtgtgggtctattagaatgtcaactgtgctgaaacattttattttctagttatttcctttatctttaaggcaatacaattcaatcgtcctgcacataaatcaagtgatccaattggaaagttgtttgttggttcttattgtggtctttgcaggaggtgtcatttatgcttccacctcttttgggcttgctgcttgagtgtgccaagaaaacagaccagactgttgtttcaattgctcttggagctttagttcatctcatagaggttggtggtcaccaattcagtgacagcgactgggaaacacttctaaagagcattaggtatctcctcaagttctattttcccattaaaattaattgtgcttttgttgttcacatattaatgttaatatcacttgtcagagatgcatcatacacaacccaacctctcgaactcctcaattcagtaggatttcagaaaccaaacaatcagcaatcactttcaagagaagcagagaccaacggtcttggtagtagttaccatgatagcagggaaggaggagcttcaataagtcatattgatgaacaggatggtcatcaggaaacaaatgcacagactagcctagacaattcagaaggtgtggtagtcctgaaatatccattaattgttttatacaatgacaagtgcttccatatgaactggaatactgataattaacctaattctgtctttctctaggtttgccatctccatcagggagagcacaacctgcagtttccccacggggtcagacctttggacaaagaattatggggaatatgatggacaatcttttggtcaggagtcttacttccaaatcaaaaggtcgtacagacgatattgtgccaccctcacctgtgaaggtacatgttttttcctcttgcacatattgattaggtattgatgaatattatgatttgaacattagcagatcgtactgtcattggtacctttccttgctatatcaatacatatgcaattgcatatccttataaaaatcactagtaatatttttttcctgttttggttcctatatatctggcaaaaatatggaaccgtgcagtaatttctggacacctgagttcattgtgtgtgaacagagctagctggaatgtttgaaatcagtaaatctgtagacacagttataaacttttgaaatggtattacttcgttgatatgctagccaattttgtttgcatattataagtagtaatcaacgcataattttgaatatatgtattctcttctgacatgttggctgttgtccattgttaatactatactatttgctgaaagtcatgttctagctcatctggcgtgacattcatgcacctttgaacttaataatatcagcaacataccatcattacacttggtactgaagtactgagtgggattttctccatagttggcttgtttttcatatgtatttaattttcctgtttgttgatcgaaggcacctgatgctgacggggctgacaaaactgacgatgaagagaatcctatgatggagactgttaggagtaatgtatcactcaattactgctacttggggccattgacagcatacaggtactccatatgatggttattagtctgatgtatgaacaaattctgcttgtgaacatgtactaacttgtgcttcttgatggactttgcagaagaggtactggagcaggctaaaaaccacacagcagactgcaataatggatattttgctatcactcctagaatttgcttcttcctataactcaacttcaaatcttcgaaccaggatgcaccatatacccccagaaaggtaattcttaaagactacatgcaatttaactttccaaaaggagttctctaacagttgaaatttaattgtgtaggcctcca

SEQ ID NO: 86615 - DNA, 7371 bp, Oryza sativa
ggtagcagatgccttgagcaggaagagttactgcaacgtcgcatgggtagaggaactatgctgtgaggttcaacgtgatttggaacatttgaaccttggtatagttgagcacggattcgtggctgccctagaggcacagcccacactggtggagcaggttcgcatagctcaagcaagtgatcctgaaatagcagagctcaaaaagaacatgagggttggaaaagcccgaggttttgttgaggacgaacaaggaacaatctggatgggagaaagattgtgtgtacccgaaaacaaggaattaaaagaccgaatactaaccgaggctcatcaaactcaatattccattcatcccggcagtaccaaaatgtaccaagacctcaaagaaaagttctggtgggtcagcatgagaagggaaatagctgagttcgtagcactctgtgacgtctgttaacgagtaaaggcagaacaccaaaggccagcaggtttgctacagccacttcagattccagaatgaaagtgggaagaaatcggaatggatttcatcaccggtttgcccaggacgtcatcggggcatgattctatttggatagtcgttgaccgactcaccaaagtggctcacttcattccggtgcacactacctactcagggaagaaattagcagaaccctatctggcaagaattatgtgtttacatggtgtacctaagaagatcgtgtctgatcgaggaagccaattcacttcaaagttctggcagaaattacaagaagaattgggaacccggttgaatttcagcactgcttaccatccacaaacagatggccagactgagcgagtcaatcaaatactagaggatatgttgagagcatgtgcgcttgactttggtggagcatgggacaaaagcttaccgtatgctgagttctcgtacaacaacagttaccaagctagtctgcagatggcaccatttgaagcactgtatggacgaaaatgtcgtactccgctcttctgggatcagacaggggaacgccaattgtttggtacagaagttttaaatgaggcagaagagaaagtcagagctgttagggaaagattgagaatcgcgcagtctcggcagaaaagctatgcagacaaccgccgaagggagctcgctttcgaaacaggggattatgtgtatctccgtgtcactccgctcaggggagtacatcgcttccaaaccaaaggaaagttggcaccacgctttgtgggaccatacaggatcttggaacgtagaggtgaagttgcttaccagctcgagcttccctccaacatgcttggcatccacaacgtgttccacgtctctcagttgaagaaatgtttgagagttcctgaggaacaggcaagtccggatcacatcgaaattcaggaagatctgacgtatgtggagaagccgactcgtatcctcgaaaccagcgagagaaggaccagaaacaaagtaataagattctgcaaggttcagtggagccaccactcagaggaagaggccacttgggaaagagaagatgagttgaaggccacccacccgcacctcttcgccagctcttccgaatctcggggtcgagattccgtttaaggggggtaggtttgtcacgctcggaagtttcccctttttcttgctttaaaaaaattggttaaataatttgtccgaagaaattatcttaattaacctagagctaattccataattaataaatgcaattaataattggaattggcattgtgggatttttttcttgggttccacatgtcacaatatattaacaggatttttagtggaattttcagagccttggaaataatttttaccaattaaaaatcaccaaggtgcaattttaatcccaggaaaatcctttttcttttttttcttttccctccttttcctttgttgggccgtcggcccatccctctcccgctcggccttccccttgtgggccggcccgttctccttccccctctctccgggacgctgacaggtggggcccacctgtcaggtcgtccccttcctccagccacccgcctccgacggcaaccgccgccgaatccgccacgccaccgcctcctccgctcttcccgcgcccacgccgcgccgctcccgcgtcctccccacgtcgccgcctcttcccccgcatctcccggcccgcgcgcgcttgagagggcgggattcgatttcgaatcccacccctctctctctctctcctccccacgtcgccggccaaatcgggagggttcccggccacgtcctcccctcccttgcccataaaagcactctcccgagccccctctttcgttttccctcattcgccgcgctctcccgtgcctcctatcgcgctcgcgccgcttgttgctagcgccgccgcttgccgtcgccttcggccgcgcgtcactgccgctagggtcgccgccgcgccaacccaccaccgccgttagcttcgccgccgcgagagctacctcggccgccgcttcgttgccgcgaatcaccgccggagctccgatttccccgcgtcgccggtgtgctcgccattgtttccatctccggccggccattttggtcgtcgcggtcgctttctccatccctaacgcctctccatcttctcctagggtgtcgccgccgcccgtccgtgcctccgcatcaccggtcgtcgccgccgctttcttccttcgcgccggccgccgtgctcgaaggtgaggaatcccctctcctccttcctttcctctctctcccatgagcgccgccgccctccgcgcgtgcgccgtcgtcttcggccgccgccccatggctggccggccggcttgagccgtgccgagcatgccgccgccacctccctcccttgtgccgctgccaatggggcccacgtgccggcgcccccttcctctctcttgaaccgctgacatgcgggccccacctgtcggcgccgccccccccttggatgacgtcagccctgggctttattgcgcaataaagtgattaaggacttttctttattagtaaaaacacagtttatcttctaaaattcataagtaattcatccgagctccgtttaagtccattcaagtctcagtaaatcaagaaaaatgcaaagaatccattaaaaatggttttgtttcctgtttctgtagtcttatagcatgtttgcttgtgtgctctgtttgtcgcgtaggtttcggccgtttcgtcgttccgcggtttctcgaagacgttgctgaggtctcatcagtgcgagagcaaggcaagtcattcaatacgtttgatcatattgtacccaatttacaaatatcccgcatttctattaaatgttgcatccttttacaatgtaatgtgggatgggtcctattactcagccatttattgtttaccatatgccattgataacttgggtatcaaaatgactagatgttggcctaggaaatgcttagccatgcttagttcaactagcacacaaatggggatcacattattacatagactttgactatgagcatagctttagattggtgccaccgcatgggtgtcagttaattaaaatacactgaatggtgggctgtgggtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgattggttaatattgattaattactgcaactgttttactgccttcaactactgcttttaaatgctagctttatgcaaaagaacctctagcctcctttggttatatcctgcatcatacctcctcttccggtatgacttgctgagtacagtgggtagtactcagtcttgctctcttttccccccacaccagagctgaagatcttccttgttggagctgttttgccaaagtttgtttcgtcgctgccatcaaggtttgcctgtggagtggagtcgctcgctgctgaagtcaagcttcccggtttagctcgcttttatctttcccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaagggagagagcaactcaggcacaggggagaaactaacaccggggaagcagctaagaaatcggatcagactcgcggcctccttttctatcaggagaaagaacgtggacgcgctgttgcggagggaatcgtgggaacgtgggttagtggctgcaaaaggatagcgacgtgacgtgacgtgacgcacgcacgccgccagccagccacgcctcgcccacgcccacggcccggcccggcccggcgcgcgcgcgcgcgcgcgtgtggcattccgacccccacctcaactggtcaacagggagcctctaataactccctatttaggttgagatatttctcgcttaaatcctgaggtggtattattatccttaacatttattatgggcctttgagatttaatagaataaattgggcctagcccaattattctaacaatccccaccaaatttcaaggctcataagaaatgttctcaatgttgtgcctgtttgatataccagggttttggtggagactgttaagttgaacttccacctaggaaatgagctacaccagaccacaacttaacaatggactatgccttgaattgtaagttttgtgtgatcaggtttcactcagaaccttgactggtactgggctgccgttcgcatcccctctgtttggagcatataagttaagctccaggcctttcatgagtatctagagattgcccaaatctcatagactgtgactagcagtcgaactcatataggtgtgttccttctgagatgttctgcaggtcaacatctctgcttggaaaagccactcggatcacattaagacataagccatcctaccatgcaggaaagaagagaagcacatcatggaaatgagcccttttcaggggtctcttctctcagtcacacaatagtttgtttcaccatccaaattcacgggatctccgatcacaatggacaggtttccactattatgcaaccttaggtgggtatcaagcccatttccctcgatgcactgtctatcacattacgtggtagccccttggtaaactgatctgccagatttctagccgtttggacatagtccaatgctatcactccggagtttttctgctttctgacagatttcagtcttctcttgatgtgtctagatgacttcatgttgtcctttgaactgttcactttaataatcactgtttgattatcgcagttcattaggatagctggcactggtttttcaaccaccggcaaatccatcaggagttcacgaagccactcggcctcaactgtcgcagtatctagtgctgtaagttctgcttccattgttgacctcgttaagatggtctgcttgcaagacttccaggaaacagcgccacctccaagtgtgaacacatatccacttgtggcttttatctcatcagcatcagatatccagtttgagtcactatacccttctagtacttttggatacccggtatagtgaattccatagctcatagtgccctttagataacgcattactctttccagagcctgccaatgatcatctcccggatttgagacaaaccggctcagcttgcttacagcaaatgagatgtcaggcctcgttgcgctagccaagtatatcaatgagccaatgatttgagagtatctcagttgatcccttgctattcttcggtttttccttaatagcacgctgggatcataaggagtaggagctggcttgcagtcaccatatccaaagcgactcaaaaccttgtccacatagtgggattgcacaagtgtaatcccaccctcatctcctctttgtagtttgatgttaagaataacatcagcctctcccaaatccttcatttcaaaattcttagacagatagtctttgacctcctcaatcacattaaggctggtcccaaagatcagtatgtcatcgacatacaagcacaagatcaccccttctcccccaccatagcgatagtatacacatttgtcagcttcgttcacaacaaagcctgcagatgtaagcgtgatgtcaagcttctcatgccattgcttaggtgcttgcttgaggccatacaaggatttcaatagtttacacaccattccctcctgaccttctagtacatacccgtctggttgatccatatagatctcctcctccagctctccgtttaggaaagctgtcttaacgtccatctgatggacgagaagaccatgagaggctgccagagcaagtagtactcgaatcgtagtcaagcgagcaactggtgaatatgtgtcgaagaaatcctcgccttccttttgggtataacccttggccacaagccttgccttgtacttttcgattgtaccatcaggcctaagctttttcttgaaaacccatttgcatcctacgggcttgcacccatatggacgctcaacgacttcccaagtaccattagacataatcgagtccatttcactgcgtactgcttccttccagtagtcagcgtcaggagatgaatatgcctcttctatggttcttggggtgtcatccacgaggtatacaatgtagtcatctccaaaggattttgcaaccctttgtctcttactcttgcgagtatttacaatggtgccctcctcaggattttcctcaggcgtttcatcattgtgttctatcggggcaaagtgctcatggggcatgacagtttctttactataaatgctaggtgtatatttcataagaaattcattctcaaagaatgtaacatctctggactcaaaaaatgtaccaacatgcatgtcaggtactcc

SEQ ID NO: 86616 - DNA, 2009 bp, Oryza sativa
ataccatgaccccaatctccaaacatcacagcaaaaagaaatgggaatgtgatgacagaatagacagctggattagcttcctcatatcgagcaatactgcaagaagttcatgattagcacactaccaaagttgcatgactaaaatatcattaaaaagtagggcctaaggattaaaaatagatcacatcataaagcaagtatgtcaaagtatcagacaaccttccaatgtttaatgaatcaatctgttttttatggtcaggttgtctagttacaaaggcaaacagagctagcaaaatgtgcacactaaagaagtcaacattattaattactacctctgtccctaaaactaatattttagctcttgctcaccaacctcaaaatcaaacccaaaagtgaagaacttcaaaatatagcagcaaaatatttgtgtcggatagctgaaacctggatcaagtagctagtagtacacatgatttaacaactgctttgctcaagaaatttaacatttgaaaaacatatacccacgaatactcagttcatgaatcataaaaacagaaagcatatgaatttcatttattcaagttgacacttgcaacaaagtgcatacccatatgcgtcaactatctcctggaaagcgttagtgaacttatcggtttggaaatatgtaggcggtgaatcaatagtgtccatctcatgaaatattattccaacttgtgaattactgtgaagcgttgcacgctgcaaaacatccttgatctgaagtacaaagtagagataagatatatatccttaaaagtatcctaaacagaatgagcacaatgaatagaccttcaaatgaatgtaatatttctgacctgtgatttagcaaatataggacaccatccttccccaacaaggcatttcttcgtgacatcaaaattcagcatgttcaatgtatcatatacagctttctcttttttcacctaacacaaaagggggttatggttcagaaatccatgtatcagaacagacataaataagagattttagggattacaacgcacaaatagaaaatgaaaattttatattacttcattaccatgattgtccacctccataattgtgaacctactgactctagtgctttgtttctgtgctggattccagcatccaaagtggcttccagatcagcaaggcgtccagatacctaacacattttcataaaccgttactactacataatatctcagcagataacatattaacattatgacacaaaataacgagaacaataagtcagataagtataacactcaagcttcttccaataaaattctaacaagcacggtcaaatcaagcagtgaatttgtgtgccaaatatgcaaattaaagtacctcgcgaaaaatctgtctctgcttaaccatctcctcgggaacagggtagcaacttgctccaaatgaaccgcaaatctttaatatttttgctttagcctgatccccagaaaagaaaactacgaaaacagttttctctacctggcaaagtaaaattgaatgttgaaactattgagaaactttaaggcttcaaggtattggatgaaattgtcacatgcaaggttggatttcagtactgcaataagcattaattttgttcataaatccagctttcaaggacaaaaaaacaataagcatataattggagacaaacaatagatttcatttaacacgagaatcaccaagagcaaaccatgacaatcagacctcttcaccagaaatgggatcagtaacaggttcccctgcaggcgcctgattgaaaaacatattcccccttgtagctcggaatagcatcctctcaaaagccattgccttggactttaaaataatcccactaacaaacttcactccagaattctccgaagcccctagatgcacaccctgtgagcattttttttttgtgttacagttttcaatcaaataaggtcaagtgtttaagtacgaaaattaaatataagacctgttcaagggctgcagga

SEQ ID NO: 86617 - DNA, 2348 bp, Oryza sativa
tggaaaaacgaaaagggtggaaaatatacaaattagaggagacgatagagagagagagaaagaaatacggagtatagaaagtagtagatcaatcatgcattcatgcctgtatgtaagagacaagatttgaatgcattggagcgagcaccatgccggaagagaggacgacgggcgcgtgcgagcaacaggccctgcatgaggtggtcattgactgactgactgactgactgaccgacctgcagagattgagtggcgattgatcgatcgagcgagggagtgagtgcgcagagcggagtacaagcacgcccacacacacgcacactggccagcatgggtcactagttcactggccatgcagacgcgggagggtagctagaccatgaagcaagctgcacctgggaagaagatagaaagagagggcgcggcagcttggctgcgtgacagtgagggagtgtgcacgtgcggtcagagagacagatcacacgggaggtagcgagctagcgctagcgagggcgcctgccctgccatgccacgggcggccgttgctctctcgatccccatccgtagcctacagtaaccaatcgattcattccgccggggaccagtgtgattgctgatcatatatcgatcccctcactctcctcctcctcctccaccccccgctctttactatttaaagccgcccacgacaaacccctcccgccttcatgcctgcctagccctatctctcctcttcttcctcctcctctctctctctgtccactcaccattagaaaagcttcaagaacagatcgatgcctggagactggagcatccgcatttcaagaacagatcgatctctccctgcagatgtggctatgagcctgtgagtggaaacggatcgaaaaaggtgggagcaaaaggtgggagatgggctggccggacggctggggaagaaggccgcagctggccggagtactgtagggagcgtgaggggcttagggccgtgcgggagtacgttggggagcaccgccatcaatgcaggggcctagctagctagcttgtgcctgtgtcgctctcctcctgcacagttcatcctcctaggagagaaaaaggagatatgcaatttcatcggatgctgcaaaaatatgtttttagacaaggagtgttcccgggtcagatgctgcagatattgaagcaacagggacggagccattctattcttggtgtactatttgtgcccctaaatccaagaaaatatcgaggaattgcagatttgcagtggatgcatgtgagtgagagcttgagatcaatcttacggtgcatcgctagtaagttagtgacaaagctttgcgacggtgatgaaaggaaagggctaagctaggaagccattaatattacctggaatctccatttcttatcagaatatgtatgggatcatgagcaaatagtagcagcgacagcgattagtttattttcccctacaattccttgccatgtactaaacctaattaatttgatcaaggaaaaagaggggaaagaagaaaaaatataaagtggaggagatcaacgaaggaacaagcaaattaaactaaaatataccaaaaaaactcagatcttgcgatgttggatgcgataaacaaattaatggacaaggtttgcaggtttactatactgatcaggaggcgcttggtgcagtgccactccctccaggttgagctgtggtagtagcagctgcaccgccaccgctgcccgcgtctccaccaccggcagctgcagctgcagcagaagacgagccggacggctcgacgccggcgggctgcgccgcctgcgagcgcttgcgcttcttcttctcgtacgggatgccgcgcgccttggcctgcgagtcccgcacctcgcggaggtagatccggacggcgcgcgcggcgaacgggttggactcgggcgtgccgccgctctcctcgtacgcggcgcggaggcggccgatgagcgcgtcgagggatccccacgcctgacgcagcgggcacgggcacggccccggcgggctgggctggccgtagaaggcgcaccccgacgcgtgcaccttggtcttcccgaactggtccaggtacctcaggaactcgatcacgtgcgcgccgctgcaccgcgccagcgtcagcggcggccggtggttccgcaggtactgcaggaacgtgttccagtccctccgcttctgcgactcgtacctgctcagctgcgccgcggctgcggcgccgccccacggccggcgcgccgccagccgccgcagaggacggaccggggccagacggatccatatacccaagcaagaaatcaagctagctgatgacggccacagcgacgacgaccaa

SEQ ID NO: 86618 - DNA, 2713 bp, Oryza sativa
cattagggcaagagctgttggaaagagcatcacgcgatttccatcaacaagaagcacatcccaaactcgaaggactgaaatgttcaaatagcaattaagtattaagcatatttcgagataatataatagctagatatattattagatcaagtacaaaaaaaaagagattgtaacatatagtcttgcagttgacaaaaatctttctcagaatgataacatttaaaatagagtaaatttcagaaaaccccatattttatggtcgaagttgcacaaaaccctagatataatgacttgtagtagataacctcaggtactacggtcctatggtttcacaaaaccctaaaccctatttatattccaaacaatataacatattgtcatcttggacacatatttactcaaactttcgtttcagaaagtatctacagaattctgaattatttatttattggttaaggtgattggtttaactcttcattactttgaataatattgtttcagatatgctaaaattaattgagatatgaatgaatgtagggatgtataccacaagccaaaatacccatggttttctacgacttcgaccataaaacctttccgaaattactctttcaaataaagaaaaataagacttaccactttcccatggtagcatgttcatgaatatagatagaaaccatggtccagtaacccatgcaacttgaacgccgaggtaatccaggtgatttactgcaaaaaaccatgcataaaagtagtcaaaattgtcggttaacatatatgccaagtcatgatatacagatattttaatacaaacaagaataatgcgcaaacctagttttggaaatttctcccggactaactcctctaaaacaagctgatcaacctaaagaaaaaacgaagtgtagcttatttaatgatgaatagtgaagtttggagctataagcacataatggcacatgcaaacactaacagaacaaaagataatacttaagaatacctgacattctatcatttcttcagaaaagtagccatcaaaataatcatccataatgcctgtcaatgccctgcgaacagataatagatttaacaaactttttagttcagctctaatacaatgcaacaagagatgtaacttgagagaacacagaaattccatgggtgttcttctgcaaaacctaccaaaatgcattctcctctggcattaggagaagtaacagaccagcaaagaaattcattgcctgcatatccagatgattgatcttagctgagaccagcattagtggcataaagtcaaaatttttggggaccatataattgtgcaaatagaatagtggttattgaataacaagagaagatctctctgtgagtaaattttaccattaaaaagtttttttaaaaaaatacatacatagaaacaatatttgacctctagattcctttttatatgacacttggtgattttcagaaatttacaagatattttgataatatttcaaaaagatttcaactaacatcggggaataaaagtaaaacagcactgagcagtgtgtgcaagtttgggaactgctaatgtcaaatcgtaaaggaagaaggtacaagtcaaataacataatggaccttcaagcggggaataaaaaggaattcagtaaatgaataatgaattcttgatcagcagaagctacactttgaaaagagttggcatgactatgcataatgctccatgagcattggttcgcacctaccatcaataaaaacaactggagtgcaggtatatcaataagcaaaacaactgtagatgtgcattttagttttatctgaagtttctatctactaatagtacactcatgtagcttgcaaattatacaaagggtttatcagtatcatccagtacttcaccttgaaaaagacgttcagaagaatcatatacaaagaagagtacttcctctgtttcacaatataagtcattttagcatttcccacattcatattgatgttaatgaatctagataaatatatatgtctagattcattaatattaatatgaatgtgggaaatgctaaaatgacttgcattgtgaaacggagggagtaagaaatactatgctcagaacttcagttttatggtgaaataagaaatatgtgttttggtgttgccctgttggtgcatgttttcagtcttatcaatattcaaatagccagcattcaccaaggcgctagttgtgtggcagattgttacctagctgcacctaatcgctgattaggccggctaaaaggtgcccatcggttggcttgttggaggaataagccaaacagcatatttgcaaacgaaaaataatttgtgaacaaaacttttatatatgtgttcttagtgatctaaaagcaaaggctgaaaaataaacttcgatgaaaaaacttcaaattcaaggttgaaaattcaaattttggctgataagcataagcataagcgaaaagatgaggctacatcttgggcaacagtgcaaacagaattacatgtgcaacagattggtcttgcaatatgcaaggtttcccaaagaagctacatcaatccagtgacaagaaaagtgacatgagtcagaagtaagggaaagccatacctgacagtaaccaactgatgggttatgtctcgcataagctgtgagcaagcgtcttaaagcatttctgccatcctcatctagtgcgggatgacctgggaa

SEQ ID NO: 86619 - DNA, 14435 bp, Oryza sativa
tgtggactcacagtgcttgtacaacagttgatcgttgttctttgtatacagacaaaactcctagttccatccagtccttatgtgattgttatgttcttttaggtgagaagttttctgaaattgtgggaagcccatattacatggctccagaggtattgaagagaaactatggtccggaaatagatatttggagtgcaggagttatcttgtatattttgttatgtggagttcctccattttgggctggtatgttgcttttcttttaaaaccttcgctatcattggctgtcatctccctcaaacaatctcgcctggaattttttcagagactgagcaaggggtggcacaagccattcttcgtggaaatatcgatttcaaacgcgaaccctggccaaatgtttcagaaaatgctaaagatttggttcgacgcatgttggagcctgatccaaaactcaggttaactgcaaagcaagttcttggtacgttttacatagcactacaaaaaaatagacacctgatattctacttgcgtgcatcataccataaaatatcaaattcaatgatcattcaaacttgattatattttctgttctttccagcattatagcattgtgatggaatctgattcgatattactagttctccatttcttgggatcactagccatacataaattaatcattgtctaatataggcaacatataccatatattgtcttttaacgacatggtattttcgtttgtgaattaggatctagagcattaaaaaggtcactacttacattaattagtataaataacttgttaacttttgttattttcctttttttcttggggaatcttgatatcctttcttttttaccacagaacatccatggcttcaaaatgctaagaaagctccaaatgttcctcttggagatattgtgaagtcaaggctcaaacaattttctagaatgaatagattcaaaagaagagcactaagggtctgtatcttgctctcttaacctttccatcttgttccgatgctttccaccaagtatctaccatgtcaatctactgttgagtgacaaaaacttatgttgggtatctgactaggtcattgccgatcatttatctgctgaggaagttgaggacataaaggagatgttcaaggctatggacactgataacgatggcattgtatcttatgaagaattaaagagcgggatagcaaaatttggttctcatctggcagaatcggaagtgcagatgcttatcgaagctgtaagtgttttcagatattcagccacaaatttgtggattttcaaagtcactgatctgtgcatccttcatttagtaggccatgatataggcccctctgatatcccacaatagcacaagtacccatctgagtcaaacatgctctgggaggtctatatgactatatatgtctatatggtccaattccttcacatatagcagtttcaaggatgcacacgggactatataggaggaactagatgttagggggcttctaacttagaaacctcaactgctgcatctatttgttttatatacatggtacacatgatcttttcaatgagatcgacaatttttgcatgaccatgttttctgtcggtccattgccccagttttcatgctaacctattgcttacgtgtaaaatatgtattgattttgttctgttattcacgatatatttttagaattagagtacatgtcaatggccaatggagtattgcatcaatgtgtttccttccagaataagactgaaaatttgcaatggatatttattctagttcaccacttgttctaggttcatgtaactggtatccttctagctgacaaaagctaggataaaagcatttggggtgcatgatttctacatcatattcgagtattttgtctgttccatcttcactagtgttattaatggcttgttagtgttgcttaggtgtaggagctgaacctgcacttgtagattgtaggactaggaaactagctggtacgatttgattgtagtacaattatttgctgggataaatatatttttcttctcattttttaagcaataggagtggttttacttttcaccatatgtgtatcaagaaacttatgtgtagtaagtagccttgtgaagtaacagaacggtagggcaaatagaatgaagtattgcatcttgttttgatgtgcacaatgaaagttacctaaccttcatatagaaccaccattctggcagttccatttcggggcttaagaccctttggaaccatatcatcacttgagttatgtgtttcctttggtggatcgtgtttgatgatggatccgcatggtccacggcatcacctgtggagctgtcttgatcgagtaaatggttaatatattactactacaatataacgcaaggaacaaagtagtgtgcagggagaagcatattcatagaagtgggatagattactgaattcacgactaacactcacttttgtagatgtattatggttatcgttaatcagatagttcgtatagtactagactactttgcaagtctttaattgatcatgtgttttgcaaataggtggatacaaatggtaaggatgctctagattatggtgaatttttggctgtctctcttcatttgcaaaggatggcaaatgatgagcacctccggcgagccttcctattttttgacaaggatggcaatggctacatagagcctgaagagcttcgagaggctctagtggacgatggagcaggtgacagcatggaagtggtgaacgacatattgcaagaagttgacactgataaggtgatgatatttctgaatacaaccattcttttggtaatatcgttcaaaacttttttttatctaaataacatatgttttcttttcactgcaggatggcaagattagctatgacgaatttgtagcaatgatgaagacgggcacagattggagaaaggcgtcccggcattactctagaggaagattcaacagccttagcatgaagcttataaaggatgggtccgtaaaactggtcaatgagtgaaggcctaagggtgataattttatgcgtgtagtttaggcctttgggctcgctaagcagaaaccctttctccttttcttctcatgattattttgcgtggaaatttagataggtggaacctcccgattggcttacctgtgtaattagctcatctgacaagcacgcgccgaatgatataccaaatgctgtgcgcctgcttagccctcgtggccttgttcctatggggtacctgatgccaagtgttgtacaatgttttgccgtgttcaaatgcaatttgttcatttggggtgctatctagcctgtcgcaaaattcaatgtgctcgtggaggcatcgagtgcgtgctatcgactgaacgaaagttacgaggcagtgttcatctagtacaccaggtactaatatcgaattctgttctatctgcccccaagttgttctgacccgcgatgctttcgtaatcaagaagtctgagatcgatgccgctcgaattcaaccacgcgccggaatttttcccgtggtaatgctacatcatcagaaatgcatcactgctggagagcaccaccgggcgcatcaaccgtggagcataattaagataaggttaatgctgccaaattcagggaacaagattaaaccaggacgaacacggctctattattttaataggcaccctctaaaccccacggtcaaacctagcaacaggtgatgacgcatcgatcccaaattcccaattcgatctcttgctgctccatccgccggaataaaaacgcaaaatcctcgtgcgcgggtggcccttcctttccaccagggcataacgtgtcttcgttttcgcttctcccaaacaaaagcgaaatcaaatcaactgcctgcattgccttgtggcgctggttccgccgcctaattgcacagtcgcaccgcatcccatgccaagtatcgtggaatgcccgcgcagcacatacgccgtcgtcagaaaagcggccgcgaagccgtcaattcggtcgctgtaggctgtagcagtggcacggtcagcccccatcacgacgaacccacagtcccacacgcgggccactgtcacagtcactccactgcactccactccgccgagcagcgcgggccgatgtcacggtcgaatcatcagcgggaaagcgggagcccgcgacgtgcacgtagcacgaccggggcctcggccgtggcccaacaacgcaagcgcggaagcgggtggcgccgagaccgacacgcgaggagaggaggccgagagatcgacagccgtccatgcggcgggccgtcaaatctgtccgttgcacgcagctaggagtactagcatactatacctgtcggcagatatcgcgctcgtgcgcatttccgttcccacccgcggctggctgcgccgcaatcgcgccgtgccgccgcacaccctgctgcccctcggtgtgctctgcaccacccgtgaagccaaaaaggccaaagccaaagccaaagccacggggcgcagcgaatatctaatacacgtttcggcgtttcgctcgatcggtactagtaccggggggaatattatatctgattacgtttcggcgcgtttcgctctggtcgagctgcggcggaggcggacgtctgacggcctccggatgtgacgtgataaaacgaaggcgtactccgtggtggaaagccgtggtggaggttaacccgtgggcatgcatgccgacaacgagcggtttcgattggacaccatgtggcggcacggccgggccggcctgatcctcccctgtgcgatgtgcaagcggccgggcggtgtttttgcccgggcgggtgtctatccgaatactacatttacgtattgattgatgggggacacgcagtcgaaacgtggtaggccaggacgacggtcgctggctacgcccctttaaatcatatgattattgagaaaacgtaggatgattttgatgagaatatagatgtaaaatagaagattgtagaacgcagaaaaacacaagaataaccgtttgattgaaccgttgaaaaaacacaagaattgaataagagatagatgcaggaattggttgaagttcttgctaaatttcctctaaaatttctataggacagtctattccatatgaatattaaaggattggatatggttcaatcctttgttttaaatggcttcataggaaattttcctatatgattaaaatcctctaaaatttctatatttttcctccaaatcaaatgggccctacaatttgtagtaaaatttaatacaaaaaattcaaaatttatataactagttagatacagtaaaaccgttcactaccgaagaaaaaaaattgtaatcgagacattattttattatttctaagaaaaagggaaagagaaattttgaaacaacaagattaccgatagtgtgagccgcatctaaccctcatttcccaagcgcagctcaccagcgaggcgatgcacaatctatgaggaagaagatccattcaccttcactccacaatggctcaatcgatgctttttattaaactcgtgtacttgaatccaccctcttgcactgtcgattgtgctcagtaccatcgaaaccgccgttgtcacctcctatagctaggcttagcactttggatgcggatccaggggagatagtgtggctaggtccaattcaaaccagactcaaacggggtagatgcaactggcaccagaggcaatattactttatttagagtgaaatgtaatttggactatattttatcgtccaattttcactttggatcacccttgaatcaatcttttcactttggattggataactttgtaattttgtttttggtttggaccactccaaacaacttcaacattcatcagcatcctcaatcaaatcggttttgatacactagtaaacttcctgtcaatatgcaggccatatcttcaccagaataaagggtatgtgtgaatagtaaagagagttagatgatccaaactgaaaaaaataacaaagttatccggtctaaagtaaaaagattggtttaaggttgatccaaagcgaaactttgacaataaaaggtgacacaaactgtagtttactctcctttttaaattctcccccctttttacccaaaacgatacaataatatcttcattttcttcaatcaatcacatattttttttaagtgtccttcaatattgacacgttcttgcggtattctccagccaattacacatatttttaatatcaagtagcaaccttaccaaaaaaaaacaaagtaagcgagaccagcttaggcggcgttcgacttgctcaataggtttggctgacctggacacgcaaaaggaggcgatcattatctagtgattaattaaatattagcttaaaagatagatttatttattttataaagaaacttatgtataaaaaaaatttatacgaaatacatcgttcgacagttcggatcggaatcgtgcttaccgcaaatacaaagtagcacaatccttaagttagtagcctttggtctgagtgtccaatggatatcaccacgagattgatttccgaccgtaggattgccaagatctattcgatggtatgccactatgcaacaatctttcttcgtaggaacacaatttagcggcggagccagggcccggctagctagcctcggcaggtgcccgggctccgcaggatgtagccgtactatgaagtagttctaatggatgtgagatcagtggatcagcacatttactagcaaaatgactagctataagtacatataatgtctagtactccctccgtcccataatataatggattttgggtggatgtggaatggaggaagtattcaacattaacaattaacgagtttcatttcatcgatataatttcgcacatttgttatcttcttcataaattagaattcgatctatgctaaatcgtgcacgtgtttgtatgaatttaattgtagtttttctctattattagatttgctcaggttagaaaaatttagggataattgcaaatatgccactgatttcaacccctaactcggaaaagccattataaatacccaaactgcaaattagccaccaaagttagttcccgttactttcgtttgccatcgccacctgaattggtacaattaaaaggccaaaaataattcataaaactaacttaaaagataagaagcatgacaagaccatcttgcccctaaccggaaaagatcctcgctggctcgccgccctctcacttgcaggcatgtgggcgaatggggatggacaatcgatgggagggcgcgctgacgggcggcgtgtcggcggacgacgggaggacatgtggccaggcggacagcggacggcgaccagcgtgcatgtcggcggtggttggagtccttgcgacgacgggcaacggggtagggaaaatctcaccttttttgggtaatcttgccggaggtgcgaggaagtcgacggcagccgccgcaatagcagcagcagcacgttgcaacggaagcagcaacgctcgcggctgcagcacgagcacgcggcagcagcagctcactacaggcctgcagcgagagcagcagctgcaacaactccctacgatagcagcagcaagccagcaaggtggtagggctgcagcaagagcagcaacaatggcgggcgcccagagacggcagcagcagggaggggcatccttgtcctattttttgtgagaacccatcttttaacggtgttattcccagccgtgaatctaatggcaagtatcatgggttccaatcgttttttatggcaagcatgcaattacgttttttataatggcaaattcacaataccgattcaaatcagtggcaaatatgcaattggcccaaaaatttatagatctgccactaaacacaacaatacactcgtacgtaccaaaagtacgacaagcattcttctccagctgctgcctgcctcacacattgcctgccgctgcttttctgtttcacgctttatcccccaaaccttttgtccttctcatcatcgttcattaagagcccacacctcattgcggccatgcatcatgcatgcatatgaagttgccccatgcagtgaccaccatataatataagtcggcacttggcacttgcagttggctgtccaaattaagctccctaccacacatgtacacatcaccatcagcgacggaaagctacaccacatcaattaattaatgtaactttcacttgtcccatgcggggatgtgatatagacgacgaccgacaaagaacacgacacgagccgaactagctaatcatcattttaacagattggaggtagcaaatgggcttagattaagggcgccgcatgcatatcctcagcaagtgctcctccggctataaaatatctaacgtttagaacaatatttatctaaaaattaacaatatttctcaaataccctagtttattcaaaacaaagaaaacaatatatagatttatcatgtagttattaaatttattaattaaactcattcaaatataaattaattgtcaaaactgattattatcttaagagtcatatttgtgatgggagggagtaggactaaaacgtactactgctgtgtaacaatgacaatgtttactggcatgaccatgcatcaatgggcaatcaatcacacacactgacactgtgacacacaagtgaatcagacacctggagtatgttctttgcacagaaacgtttactcttttcttcagagtaaatgtacgtcatttgactttcgtcttcagagtgtgactgatcacaatttcttttattaaaacaagtttaccaaatctgataaacagtagtatatggtgtaataaaatcacattatttgtcaagacatatctatgtatgccgtgtttatgttttcaaattaattgttttaatttttaaatttttagtgattagagttttaaaagtttgaagggagaaaagtcagaacatttatttatcaccaagagagtaatatctctatcgaggacgtatattatttctagcaagttttaaaatcctaattaaaactagaaaaatacttatttcataaaaccacccttattaggaaaccatgtacgtgatgtcccaatatagggcatgtgcgacgactagcccgattttaaagtgttctagtagattatagatgaaactgtgaattgatgaaaaatatcgaggacacgaacaaatgaattaaatattaaaacttggacaagttaattttaacatttttttctaagaaatatcggtgaagaaagtcttcgcatacattgtactcccaccattttatagtgtaaagtgttttgttttttttttcagaattatttttttatctttgaccatatttatataaaaaagcaacatatacattatctgattagttttaaatatactattaaagatgtcttgatagtgtatttatttgatattatatgttaattatcttttaaaaagtttaacttctgataaaactaaaacaccttacgatatgcgatatggaaaggatggagtataatttaggaatatgaaaaatgttcccacaataatccataatccgttagttcaaaagaaatgaagaaatgcccctaaattaatgagatagtttaaggagtactctgcattcatagccatgggcagacccaagcatggtccgagactaaaggagcattgagtctatgtaaatttccaccatactagcacaaatacaatctaaacaatgatggtgacctagacaatggtccgcgcgccccatccacaacaattgttctacaatgaccttgtcttgttgcaatattttgatctttctacaacaaaaggacgaataataccttatgctaaaagcgaatcaagatgaactactttcaaaatatcaggcgtgcatgcattccctaattgaaaacacacacacacatgtgtacaatccacatgcgtttggtagcccctcttcccaacccatcttcctcgttttccgcgcgcacgctttttaaactgctaaacggtccattttttacaaaaagtttctatacgaaagttgctttaaaaaaattaaattaatctatttttgaaaaaaagcaaatacttaattaatcaccctctaatcgctactccgttttctgtgcgggcacttagtgttgggaaccagggttccgaacacacagttctgaactccacgactgagataacatgtcgagctccctcattctgttgatacagtgtgtgacttacccctcaatcctttatcatccatcaattcgcacacctccttagtcctaactatttagggtcaaatcttgccacaaaccagccaacacttgcattactactgatctttcatatccaagtccttatcttcccaaatcacatggataatatctaataaaagggtaaacagtacaaactttccgaaatttactcataactatagtaaattagttgatatttttttttcaaattgggtccccctattgccagatgcatgccacacatgagcttcacagttgagtatatatttttcacaggtaaatatggtgatttggatacatcgagagtgagcataatgcaacttttcttaaaatttattccccttatttttttagtatatgttacaaaacttaagatatttttttataaaattatcatgaaaacaacaaagataaattatattatcataatactacacatcttgcttcaaatatatcagaaaactctagatatacttgaagtgagtgtatgaccacaaatatagtaccaattttatggaactacatgattaaatgttaagaaattctacacattgctaccaacaaataaatgattctacaaattgtcttagacgaatgcaagttctacaaaatattaccatacaagtgttgttatccccttttggcactacctttaggttttcatccatagatctacgttatgtctccccaaaagatctttttgcccttttaaaggcctccattaagataattatgtagaatctccatatgaaaatatgcacatatttttgctattcaattatttatgatattcttaagggtaatttgggaatttattattatggaatttaccaaattctaggggtaaaacgatcctcttagacgacctaacaaagatctatggatggtagttgcaaaaagaaaagaatgcttgtacaatggtattttattgaacttgtgttcattgatggcagttttaagaactggtcgcttatcaatgtcaaaatttagaatttgcctgaaatgttccattagaaaagaagcactaggaaactactcttaaatacttataatggctttgtggaagtctccacggttaatttgatgtccactccctccgtcctcaaatgtaagtattttttaaaagtattttaaaaataaagaaaataattaaattaaatagtagaagattgtgattagtcgagaaattaaacatgagatggtttgattggttgagatggggggaggtttagagtgtcagtgccatggataagacctacataacatacctgtattaggctcgacagaacctaccgtatatgaagtcttatacggaatcaagccacatatacggaaagtgtttcagataaggaaagagaagcaaactcctacttgagcaagacaaggactatttggatcgtatccatatttggttccctagatctacttggacaagggacatctgagagtataaatacaagactccttaggaggagagcggatatataggctaggacagatcaagacaggccaacaacatatgcgagggaaagcctagacaaacccactatggagccacagataccgacaagaggaacctagcgctgcctccaaatatcgccgagttcatattcgtggaagctgactacgctagccgtcgattacatgtgagagctccatgccgctaaaccgacaaagactatattaggttgtcccaaatattgtgctcatgcgatattgatatataaaggcaacatcggattcggtcaacaggagtaaggctattacctgttagttaaagggttaaagggtccgaatctgcataaaaatcgccgtctctcatctctttacctcaatctcgcgtataccattatatcaactattcctatactctacaaataacataggcgggtatagtccgtcaacaatgagatatgtatattttaggataatttgaactctagaaatacgtatattttgggatagatggagtacactatttagggtttatttttcaatggaatatttacgcttaaatatgtagattgtgatatattagtagttttatgatattgtcacttaatgtgtagttttatcgaagttgttaattttactccatgcattttttgtgttaccattctctctttatttagaaacacaaaatattttccaattcctgccggccgccggccaccggccacaagcatagattactacatggttttatccatatatatagactttgaaaatgttgtttgtgctgaataattgtgcgacacgactctttaaaaccaaaaacgcgtacatatattcaacgcagtcctgtgcatcgtgcacatattcatcaggaaactaattaattgctacaccgtttgacttcacttcttaaactaataaaaagatggcggcagaaatgtttgcctcgcacgacactatgggtgtgtttagataaaaaaaaattggctaaaaatatcacatcaaatatttagacacatgcatagagcattaaatgtggacgaaaaaaaccaattgcacagtttgcatgtaaattgtgagacaaatcttttgagctaattacgctatgatttaacaatgtgatgctatagtaaaaatttcttaataacggattaattaggcttaataaatttatctcgcagtttacagatggaatctgtaatttgttttgttattagtctacgtttaatactttaaacgtgtgcatgtatacttaaaaaatttttggctaaaaactaaacacggcctatgatttgagctgggaattttttttttaaggaactatagtaagctactgagtttccgtgcctaactttgatcatccgtcttatttgaaacttttaaaaaaatttaaaaacataagtcacgtataaagtactattcatgttttatcatctcataataacaaaaatattaattaaaaaaatttaaataagacgaacaattaaagttgggtatagaaacttatggttgcatttaaaatgggatggagggagtagctgaaaaatgataggagcacgtatatcaaatcaatcgcttcatgatgccccgacctgtaaaacaacatctgaccactacacagctcccgtggacggtggaccttcccactaaccccaattcactcatgttgtagtatccgtatgtgctcgccacatccgatccatcgattcgtggaattctcgagcgccggagagagacggctcttcttcgtggtagtgccagtacgtctcacagcccagtccagcttcgctgtctccccactgttcagcgtcaaagcacacacacaaaagatcccgatcgatttatctcaccaaaaaacacgttttgttttaattcagtagctacacgtactactagcttttgtatggcccagcatggtatcctgcccacggccaaaccccagatcgatcgaccatctgaatgacgaattgttattgtcctctggaagagacaaaattaagctaagcaacaacatcaacgaccttccaaatagaattaattcacttgaccctttttgtatatctcctctctctcttggtctccccgaccttatctggctctatatatacccccatctctgcaacaaagtctccaactccaacaaggcaaggaggaagagctgaggcatactccgaacccagccagagagctagctcagtgagcagtacacagtacactccccgggttatctctcccagcacgtatgtttatgtttaattcatttcctccatttatactctgtgcgcgctgcaaacgtagtacgtgtatgttctagctatagctcttgtcttgtgcgtgcgtgctgctcgtgttctcgtacgtgcgcccgcgtggttcaatagcgcctaattgatgggtgaacactggtatagtacgtacactagcgtggggcgtgacggcgtgtgccgatgtgcgcgcgcgtccatgcttggacgagtcgtcgtactctgccattaatcccgcccggccatctcgtgctagatctccgcgttcccgatcgatttcacgttcccgtgtttttgaggcgcggagcgcaccggagcgcgcgcgtcgtgcatgcatgtgcatgtgtacgcgcggcggccggcagggccggccgccttcttcgtagtaagcacacgtttgcttatcttgtgttctctttactgttgcataggccagggctgcaggaat

SEQ ID NO: 86620 - DNA, 954 bp, Oryza sativa
tggtgtttccgcctgcacggttggcttttatgccgccgttgttgggagtatatgtcttcaccgaccggccgcctcgtccgccgcagactggtgcttccgcctgcacggctggcctttatgcccgccgttgttgggcgtctacgtcttcaccgaccggcttgccttcgccgctgccgactggtgtttccgcctgcacggctggcctttatgccgccgttgttgggcgtctacgtcttcaccgaccggccgcctcgtccgccgccgactggtgcttccgcctgcacggctggcctttatgccaccgttgttgggcgtctacgtcttcaccgaccggccgccttcgccgccgccgactggtgtttccgcctgcacggctggcctttatgccgccgttgttgggcgtctacgtcttcaccgaccggcttgccttcgccgctgccgactggtgtttccgcctgcacggctggcctttatgccgccgttgttgggcgtctacgtcttcaccgaccggcttgccttcgccgctgccgactggtgtttccgcctgcacggctggcctttatgccgccgttgttgggcgtctacgtcttcaccgaccggccgccttcgccgccgccgactggtgtttccgcctgcacggctggcctattatgccgccgttgttgggcgtctacgtcttcaccgaccggcttgccttcgccgctgccgactggtgtttccgcctgcacggctggcctttatgccgccgttgttgggtgtctatgtcttcaccgaccgacttgccttcgccgccgccgactggtgcttccgcctgcacggctggcctattatgccgccgttgttgggcgtctatgtcttcaccgaccggcttgccttcgccgctgcctactagtgtttccgcctgcacggctggcctttatgctgccgttgttgggcgtctacgtcttcaccgac

SEQ ID NO: 86621 - DNA, 7959 bp, Oryza sativa
acagtacaatggctgtgcggctctgctgctgctgcttcctcctcttcgtcaccatcgctgccgccggtggctccctgacgcggacgaacgtcgcgacgctgccggggttcgacggcgcgctgccttcacgcctcgagaccgggtgagacaactcaagaatcattcccccatctgctctgacgattttccatgctccctgcatcagtataggtgagaggtcctgtggtgtcactctgtacaggtacgtgacggtcgacgaggagaacggcgccgagctgttctactacttcatcgagtcggagggcgaccccagcaccgaccccgtcctcctctggatcaccggcggcgaccgctgctccgtcctcagcgccctcttcttcgagattggtcagcaacccaacaacaacaagcctccttgtctagagtgtcaggcgtggttcatcccgttgcaattattaccacgcagggccgttgaagctggtcatcgagccctacaacggcagcttgccgcggctgcactaccacccttactcgtggacaaaggtcgccagcatcctcttcgtcgactcgccggtcggcgccggcttctccttctcaagggaccctaaggggtacgacgtcggcgacgtctctgcttcgatgcagctcatcaagcttctcagggaggtaattcattactacctggttttttttggtccattggttccaggttttcagcgtacttggttcttgctagctcttggtttaatatctcgtttgactctgattcagtggttcactgagtatccgcactacctctcaaatccgttctacgttggaggagactcctatgccggaaagatcgtcccgtttatcgtgcagaagatctcggaaggtgctgcaataatgttaccttggttactctttaaatctcaaaggaatatgctcttgttttcttatgtgtgatctaaatagttatataaaaaaatcattttataccactgaatttattcaacgatttattattgacttcatctccatctatggtatatatatctccaactttactttttctataatatatcattggggctgatacttttcaaaaatgatgcttaaaatgccttaagacttacaagagtgactattgattaagcaacatgaagatatatatacatatatatatatatatatatatatatatatatatatatatatatatatatatatatttacttacatagtcttcttacataatataatatagaagtttttttataactaatatagaagtgatatattatagagaaagacaaattcgatgaccaactgttgaactataataaatttaatggcatagaatagattttctctgaaaaaaaaactattttgacaagttagattaatgtcataaaattttaaatttgattttacaaattagcgaaacaaatatgacgtgagcacacgtatacgtaatccattctttttggtatgagttactgatactgaatttgaactcccacatatttgtggataaatatattactagtagtgtgcctgtgctaatatatcctctaattctttttcaaattctttcacaactatttaaatacaagcaacaacgaggggaaattgcctaggattaaaattccatttccagatttctacaggatctcttttcaagatcgatcagttcgcgcaccaaaaagcttgacaattttgtgctctgttttcagatattgaagctggcgtcagaccgacgtttaatctgaaggtagagctcatgtctttttctataaagctacaactcccggttaatatatatatttgaggtgttagtgataactagggtgtccatcgaacattaaaaaaaaacaaaagtatatttcctatatcaagatatagttgattatcaacttgagaccaagagatagtttaaaacccctcatttagcaatggatagacaacctgtatcatgatctgtaaatactgcaattttactaacatgttataatatatacaatataggatcatgtccaacattttctcttaaaaaaacatatacttcatccctccttaaaaaacctagaaacggataaaacctagaaacggatggtatattttctagcactacgaatatagataggcagtctgtccagattcatactattaggaaatatcttatccaattctaagttctcatattttaggacggtagagtagttgattaatgatctagcggcaattaattttatgtttgggagattgtcagggctatctggtaggtaatccgagtacaggggaacgcattgacctcgaatcaagagtgccgtacagccatggagtcggaatcatttcagatcagttatatgaggtgaacagtcgaacacgcggctcacaaaatttaattatgtcctaaatgattcctgcgtgatctttgttaactctgattgcacatgcattcacgtggtttgtctgaagatgataatggagcactgcgaaggtgaggattatgacaatcccagcaacgtgatttgccaacaagctttggctaggtttgacagcgtaaggagacaagtacactctttttttttcctcgattgtattagttgaattttcatattatcgaaaaaactatttagttgcatttttatattatcgagaaaaagaatttcttggataattctgtctgaattaacttattaactacgaatgtctaaaaaaatggcgttttctgtgtttctcaagaatatctagtccttttagtgtaatttattctttttgcagacagtagtaacatatatacagtagtaacatgtattactcacacgacagcaaatacatatccacgtgtccatcctgtatgtaggactaacacttttgcccctttggagcaaaatatgcacctgctgttataaacatacataggccctgtttggatccggagagctattaaatagcctttcggaatcttgctatttaggagtattaaacgtagattactgataaaacccattccataacccctaggctattttgtgagacaaatctaacgaggtatattaatccatgatttgctacagtgacgctacagtaattagccgctaattatggattaatatacataattaaattcgtctagcaaaatagcctaggggttatggaatcgattttgtcgttaatctacgtttttaattaatacttctaaatagcaagatttcagagggatatttaatagcccagaggatccaaacaaggccataacagagatttgctaaccagctgaatgcccgtattttgatagaaaagaaaatatgtgcccgtattaatgtgttatcttgctatagagaatattgaccttaatctaattttatatgtgtagacttgattgtttgtaacttaaactttgtatgatttggaccctagttttcgggcacattatatataggtagtcccaaataaatagcattcacgtgtagttctcaaattgatgaattttaatatttaaactaagaaggtggccagcgcgtatgcacgggcatccatattatttaaatgtaatattatattttgatatgtattataattaagggcaactcaaagtcacacgtatcttaaaaaccattcatcgaaatttaaataaatgatggattaaggtcacatgacttttgaatcgatttaatgataaactgccgtagctaattatctgtggacccctgtttttataacaggaatcattcgtgtaaacagtaccatttccctggatcaagtagtctggtacacgagttcatagctgaaataccaaaagcacatacacgagagtctagtgctaattattacatcataagcccgtaggcattgtcttaaatcatcggaccgagcggtccggaatacatccaaaagcaaaaatagataaggcagcggaattcaggcagcggcataccattgccacaggcaacgaccgtactaagacctactgagcgccattgtcttcatctccctcctggtagtaggcatagggatcctcggaagcttcatctaccgcttctgattaattttatatttgtaagggtgagtaccaaccgtactcagcaagttaccacagcaacaatgcatatgaaaggggtatttcaaaggatggctatggctcttttgcgctaagccagttttgtaattcttttcacaaacctaagacctagcattgactgatcaaattttagtaccagtgtttgtatttaaacaacgacggttctgtccaccatccattgtgatcccaaggatagcttcccgccattgagtcgttatggttttctgaggacgcccaccttcccccttctcaggaagtggctccaacagcataaaaattcgtcatgcaacaacccatcccacataagttaagaatttagagactagccaagtgtaatacatgtcccggtgctcaataaccgcgagcacggctattcgaatagatttggttcactcacactgcagtggatgtacactttactcgcactccgcgactgcccaacacatgagcctcgtctcaacacatgaggcgcgtcacggcaaagcttttcgataacctcgcattggcagtatccgctctatgaacttaaatcctcatgcactctaggcgtccatgtttctagcagtgtgaggagttctggcggtcccgggaaagagaagtctcacacatattaaattatggttcaagttaagttctctctctcacacactcatggcagttctaccaacggcgacaccgatgtagggcacgcctctcggctctacctcaacggttgtcccatcgtagcgcacctgcctcactcaggggtgaaccatctatgcagggatactgcctccgctcggctatctaatccgctaggtctatacccattcgagaagtacggttgtacgggggtcgtttcatgcttaactttatggctcggtccttaattgaccggggacggtactagcctttcccagataccacccaaatcatccgtccgccccagttgaaaacagttgttttcgctttattttcctttcacaaatcatgttatcaatttcatggcaatgtggtgctcatgtctccacatgccgcatctcaattaccttcccaaaggtaattgcccaagcatttagcatttgataaatatgagtatgcatgatcctagaatagcatttctaagcaattgtcataattgactagggactcatacgtaaacatggataaacaataatcaaggcatggcataatcacaagtaggatgtgcatcattgcatgcaattttatttataaacaaaataatttcgcaattaggatcaacatgttcaaggaatagtgatgacttgccttgctcaaggtcttgggggtcttggccttcacttggatccgcaactccctcgggctctatagttacctgcgaaaattgatttggattcgattagaattcaaataaaaatccaaataaatccaaatggaagtcgaacgcgaaagtcgattcttttatattaactttactattcgcgtactagggcaaacccaatttctttttgtatatcctaactattttgtgggtataaatattttgttatcataagtttttaatttaatctacccgagcgttatatccatataataggttggaaatttctatcgcaagctaaatatcgaacggaatccaaaaattatcttataatattatacgatttaattttagtctaggactaaacgactaaatataataaacgtctaaaattcctagtgattaagtccgaatttctaccgtgaatcaattacttatagagattacccaaaataatctataatagtctataagaattcatctaatcgtttagttcttaattacatttaaactactaccgcgaattgatttcttgtagaaattaccaagaataatccataatttatattaaatttcgcaattctacgactataactaatctataactaaattctaattattttaaattttcaaaacttccctaatctccctctaatttcctatttatttcccttttctttttcttcccttctttttctttttccttcctttctttttcttttctttttttttctttctctctctcctttcttttcttttttccttctcactatcccttttcttttctttttccttctctctctccctcccggtttctctcctcgttccttcttctttctctccctcggcttctcccttcctccctctccctcggctctctctctacccggcggcacggcgacaaacagggggggaaggcagcgactcaccgacggcggcggcggcgacgacggcggcggcgacgacggcgcacggcgcggcacagcgcggcggcttcgtggcggcggcgcggcggctcgaaggcggcggagcggcgggacaacaacggcgacgcgtggagatggggagggaaaagggagaggaggaggggatggagtggggagaggggagattggtgggcttttataggggaaagagaggataagggggagagggaagagaagggaagggcggtggaggggggtgaggcgacggcggcgatgtgacggcgcgcggcgcgcgggcggagatgacgacggcgcggcgcggctcagggcgcaaggcggcgcggcacgtggcagcggcgctgggcgcgaggcagcggatgcgcggcgcgaggcgacgggacggcgcacggcgcggcagcggcacggctcgaggcggcgatggaacgcgcacgcggcgacgggatggcgacggcgacggcgcggcagtggtggcgcgcggcgcgaggcggcgatggtacgcacgcgcggcgcgaggcgggacgcgacggcgacggcgcggcaacggcaatgagatggcgacggcgacaggcggcgatggcgacggtggcgcggcggcaggcgacgatggcgacggcgcgcggtggctctgggcgcgaggcggtgatgggacgcacgcgcggcgcgaggcgggacgcgacggcgacggcgcggcagcggcgatgggatggcgacggcgacaggcggcgatggcgacggcggcgcggcggcaggcgacgatggcgacggcgcgcggtggctcggggcgcgaggcggcggcgcgtggtgaaggtggcgagagagagagagggggaaagaggaggagctgggttaggggaccacgtcgaacacctggcggccgatgaatagtgactttttctatttgtcccgattttagtgtattttccatataaattttattccacaattcctaattttgcatatatgcattttactcaatatttgtgttatcttaactaatgaattcaccctagattaatattactcatattttatttttatataatttatttgagttttaattagggttaattcttattccatcgtatttaaatttaattgatccaaatatggtcgcgataatattttatttatttctatccacacctaatctttattttaatttgtatttattttaccaatttgtttttaaggtttattcctaattaactattctttactcacgattaataatcttcgagatcaaatccagataaaatagacgaataagatccgcatgatgcaattaatttaaaaagtttttgaaaatccgtatttttagagttttgattttgtcggtcgaattttcagggtgttacaaacctacccccttaaataaatctcgtcccgagatttcttaccagttttcgaatagatgcgggtactccgtcctcaagaattcttcgctttcccaggtggcttcatcctcagtgtgattactccattgtaccttgtacatacgccacactttgctcctagtcctcttttctacttcatccaatatccggatcgggtgttctggatacgtgagatcgttgctaatgtgaatctcttccagcggagcttgttcttccggcactggtaagcatttctttaattgggacacatggaagactgggtgcacatca

SEQ ID NO: 86622 - DNA, 754 bp, Oryza sativa
tgtccatcagtagtggtagctgtataaaccagacgtagaggtaagggcactagtcagcagcagacgagacgaccggcgatgaatatgtagatgcccaacaacagcggcataatacgccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgctagcggtgacatcagtcagtggcggatgcggcggccggccggtgaagacgtagacgcccaacaacggcagcataataggccagccgtgcaggcggaaacaccagtcggcggcggtcgaggtggccggtcggtgacgacgtagacgcccaacaacggcggcataataggccagccgtgtaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaatggcggcataaaggccagccgtgcaggcggaaacaccagtcggcagcggcgaaggcaagccagtcggtgaagacgtagacgcccaacaacggcggcataaaggccaaccgttcaagcggaaacaccagtcggcggc

SEQ ID NO: 86623 - DNA, 3570 bp, Oryza sativa
tcgagctcacgctcgagccgttcacctacgagctcctcgtggtggcgcccgtgcgggccatcgtctcgccggagctggggatcggcttcgcgcccatcgggctcgccaacatgctgaacgccggcggcgccgtgcagggcttcgaggcggcgaggaaggacggcgacgtggcggcggaggtggcggtgaagggcgccggggagatggtggcgtactcgtcggcgaggcctaggctgtgcaaggtgaacggccaggatgcggagttcaagtacgaggacggcatcgtcaccgtcgatgtgccgtggaccgggtcgtcgaagaagctgtcgcgtgtcgagtacttttactagtgtggttcaatgctggaaagagactaagacaaaattttcggtctttttattttttattttacttaggtcggaaaataatttgagtgtgtgagagctttgtaagttgcttagctctggttggtttcggttggattatcattgttacgggttttaaacgctggttaatgtgaattaatgcaactatgcaagtgttactttatcaatctcctcgtttgcgcggatgggcttgttttgctttctctgaattcatattgtctttggctttttgcactatacagactacagaacctttgcaaaattgtttcccccttgaaattagaaaaaaaaatggttcgatacaagtcctgtttggtctgtggtcaaatgcaatctttaccaaagcttttgcattggcaagatataggtgttgccaacattttggtgaagttgagtatttggtttgttgctatctttttgaattgttggtgctttacttggttctggttgccaaaatttttgcaatgccaattttttcgagaataaaccaaatggaaacatgaagtatcattcaccaaagaattccacaatagtgttgtagtaattcgaaacttcatcccctttacgtgttaaaacaagcaagaaaaatctctcccggataataggggaaatgagaagcttcttacgatgaaacatgctgctcattcacattcagacttgatatagatacttgtatttatctatttattttttttggtgggcttcatcgatcgtctatttattttttgtggtgggcttcatcgataacgtctacagtgattttgttaatattaagatttgtaaacacccgcgccgtgtgtctaaaaataaaggaataagttcacttcgtgaccctcaaaagtgatcgaaatctaatccgtgaccctaaaccacaaaaccggatatctcgacccccaactcttaaaaccagtgcaatttaactccctcggcggttttggagggtggtttcgctgacgtggcgcctacgtgacattattgactcggtcttctgtccacgtggcgttgacgtggcacttacgtgtcattagaaataaaaaatatgggtgggacccactgacatgtggggcccacataaatcatatcatccccctctctttctcttcgcgagcgttggacgggagccagcggcagtggctaacgcctcctccaaccccatccacagcctcctccccccttcccgcggcggcggtgcggcggcccgcaagcggtggagacccgggagtggcactggagcggcgacagcgacgtgcgcgcaaaggccagagcggcagcggtggcggagatcgaggccgccgtggaaggttggccgtcggaaggaagaaaacaggccacgagaacgaccgcgttctcgccatcctcggcaccgccaccgcactatccaccgctgcgctccacgccctctctgccggccacgatgcacctgcctccgcagttctcccgctgcgcccacgaacacgtaagggccacctgcatctcgccaccgcgactcacgtcggcatcctctcgaagatggcggcatccggcggtggcttcttctgcacctacggcggcggcgttgaaggagggaggagcagcacgggcggggaaggcggtggtaccaccgatgggcgtggttagcatgccgagccagccgacaacggcatgaccacataggagttaggaggcatctgcgtcaagcattctcctgctggttgccgagacaatcggcaaggggcgagatatgagggctacggctagcaagcggtagcaacaagcagtgcatgtgtgtactaacatcaagcgacaagccaacaagcaaagggatgaccgaccgagcaaagctgcagataggcaagcagagcagcagattcgcttggacgatggcgcggccatggaggagggggacgcgagggacgggagcctcgcgcgagcctccagtgctccccaccgccggccctcgagcgctcccctccaccggcgctccagctcccatccctgcagatgtgcgaagggaagggaagagagagaagggagagaaagggaggaggatgaagaggagagaggataatatgtgggccccacatgtcagtgggtcccacccgtacttttggtgaatgacaaataggtcccacccatattttttatttctaatgacacgtaagtgccacgtcaacgctacctggacagaagaccgagtcaatactgccacgtagcgcgccacgtcagcgaaaccgccctccaaacccgccgagggagtcaaattgtaccggttttaagagttagggggtcgagatatccggttttgtggtttagggtcacggattagatttcgatcacttttgagaatcacgaaatgaacttattccaaataaaaataaattcaggtataggatgggccttgaattgagcccgctaattccgggcccatcaaggcccactcagatcaggcccaattaagaggaggcaggcaaacccaaccgactcgcactcgtcgtcgtcgtccccatctggatccctccctcttctcctccaacctcgccatcatttcccagctcgcttcccttcccaagctccaccaaccaaccgccgccccacctcgccgcccgccgccgaggcggagctgcgccgatgaacacgtcgcagttcatggacaagcagatcctcggcctcgcggcctccgcctccacctcctccggcgtcggcgtcggtggcgggggaccggagctcctcgatctgatgagccccaacccgcaggaggagggcgaggaccgcctccgccgccgccacagctcctccaacggcagcgccgacgacgtgctgcccagctacgacttccagcccatccgcaccaccgccccctccgccgccgcctccgcctccgccgcgccggcctcgtgggggtccctcgactccggctccaaggccgcctccgcgtcctacaacttgaaggtatacttaattattgtttcgatcgtggtatggtctccccaccgctagatctgtcgatctatctgcgtttcatgattttgcatcagtaaatctatcgcgaaaacctttttcgtgtagatgagcatctacaactcaaccctacattagtaagaagaagaattttgtttgcgaactgggcttgtgcaccgtgctgagacgcataatcacttggtaataataagctacaagagaattttgtcgatggggctgcaggaat

SEQ ID NO: 86624 - DNA, 1499 bp, Oryza sativa
ttgtaggataggtttagcatttcgaggaagtctaaggatgctaattcttgtggaatgactcctgaaagctgatttgaagatagatccaaagcttccagctgcttcagcccaccaagttgagatggaattggcccagtgaggaagttatgtgacatatttatcccatgagttaaaacaagttccccaacaatttctgggatgctaccattgaatgcattattggagaaatcaatgaatacaagggttcttagtatttgagcaagtgtggtgtcatgacctttgtatgtgagtgaggctttatatctatatactagtcctacacttggcacagcatgatccatgaccaatgatgtatttgtgtctatatgtagcatcgactccaacttcttaaaccacttgtctttgggcaacggaccagagaagttatttgaggatatgtcaataattattgcatttggaaatgcacatgtgctttcttcatcggtgagagattgaacgacatgtccaaatagcttattggatttcagtacaagcacttggagtctacgaagtttactcatccagcatgggaaaatgtcatttatttgattgttcccagcatcaaggatctccaaattttgacaagcaagtagggatctgggtagctgtccttcaatcctattgccactaaaatatagtgcatgaaatgagcagccttcctttatagtatctgggatctccccatcgagttgatttgcatttagatttaatatttgtattccattaacgttctcgatcaaacaagatggtattgagccactaaagttgttgttagagagatcaaggtattgtaattcagttgcagtacagaaagatggtgggatttctccggagaagttgtttccaggggcattgaaaagtgtgacatgactaagatgggcagtgaaattaaaaggaatcgatgagaacatgttgtttgagtaatctagcaatcttgcagaaccttgaggtataggtatagtcccctcaaacatgttgttgctaagatcaagccaatcaatttgtaaaggaataaaagggttagatccaacactagtaaatttattatgtgctaaaatcaaactagcaacgccagaatcattccaagactcccatgcccacgatggtatagccccatggatttggttttttgaaaggtcgagccaaaggagttcatcttgactcctcaagaaatcagggaatttagtgatgttgcaacccgataaagctaatatttgtagtttagggatgtgtgttgatgaagaatcgacttttccatccaccaccacaagattattatcagatatatccaagtaacggaggtgttgtagtccccataatgatgcaagtttcattgtaccgacaagattgtttgaattaaggaagagtgtgctcagattggtgaagtttgagatattttgtggtagttttcctgaaaagttgcattcatacaacactaattttctcaatttcgttaactt

SEQ ID NO: 86625 - DNA, 2549 bp, Oryza sativa
tccgctccctctcgaacctgccattgttgttcaaggttggtatgaggttgaaagcattaagcatgagatcggtaaaagatgcacgaggaaattaagaaattttcagtggctagaagaagagggtgcaagatacatgtacttaccattcagagacacaatcctcgcaaaagatatgcttacagcgcaaaagaatgggagtatgcatcttttcctggcatatagcacacatatctccagtagcactaacctgaacagacacacaagagtcaagtcaagaaaaatagaaaatagagtgtgccaaaagtccactatgcaatgtccatgcaatcttatttcacaggtcatcattactctagacattcagtgacagtgatagccaacaactacttagtgcttcaagcatataatagattacctgttcactagttgcgtatgaaccgtaatggaagtctttatgagataacgctctcaatgctgtcaaaaatgattgaacctgacaaggaaacagctggagttttaggaggcactaagtatcccttacgaaactaaataagggaagttacagtaccttttccacaactgatgtcaacttgaaagtaaggtataatccagtggttagagacgaaaataggcttccatactccttgttcaggaaaaatcggtaccatacaggagcaggcaataatgctcggtacagaagtagaaaatattccacaactgttaacatttggccctgagcaaaaaggaatgattgattactggttgtcagaaacaaataacactgcacctgaagctatcaggaaacggcacacaatgatagatcacagaaaatatagtattcaaatgcataaacagcatacctgcctacgatagctacgccctttgctgttcttgtagtacataagtaacatgcacttgatgatcatagcagtttggcgcaccattgtatctgcataaaattggaaggaacccacatgatcaaaaaccttatgaagttaagtatcatttctaaattctaaatacaacatgactgatttgacttaaggcatcctgtaaatacaaataaccatgcttcaggtataaggacatgatagccacttacaacataaaaaaaatataatttatttgtatgagagtggacatttgagcccagttcacaaaatgaaagggctcacgtgccaaaaacttaaaggccttcagggtttacaaacctttctagctctaaaacataaatgtgttcaagcatcatatgaggagaaaacatgcgatctaaaacataaatgtgttcaagcatcatatgaggagaaaacataccattcaccaaaatgatgaatattgcatgccaaaacggtggaatttcttttggagcaagagccaccagaggtcgtacgaggtcaccattcttgtaacaccagtaaactccaaatacatgaacaacgaataatattgtgatcccaacaaggactgacatttttctctccccctgaaccaaaaagacaaatatcaatgtatcatatgtaagtaccacattgtttatataaacaaattgaaagcaattaaatccacataataatgtaacttctgatcatgatgggaaagccaggaatataaagatacttgcaattctctatataaatagcattgtcaacaaatctcaaaaatcgattagatggtgcagtaaacactcaaaaacaaggaatatctgatttgtatatgtaaataaccattgtgatttcttgacagtataacagaggttacaaaccagtaaacaagtcaacgtcatatccttggacagcagcacaaatataagtacaagcacagcatgacattagtgacagattgatgattggtaatacacaaacgtgaaatgagaacgtgttcggatatagaaaatccatgaaaatgccaaataaaacttagtggccaaaaagctgtaagccatattaccatgaaaatgccaataaaactatgagcggccaaaaaacgtcatattaccatcactgcatcacattatttagagatgatctgcaccccggatattttcattaaaacgaactaaatctaagggagtgctttagacatccaagtgtcacaattaatctatttgtcacttaatattccagcagaaatctacaggtaaattgatccaaatgttcaacaaacatgatggtaagtttaccttcaaagcagtttgcttgcgcaggatatcattagacttgaacatcacggcggcaatccaaatcgtcacgaagaaacctgcacgacacaatccaaagcaaaattagcccaacatttcacaaatagattaatgcaaccctacattcagcaaacacatggtgacgtatatttcacagatagacgaatgcaaatcatacatgcagcaaaacacatgatggcatatcaatttgtgcttgtggatgaggtaaattaaagggggggggggggggaatgaccttgcaagtgctgcctgatgaagacgacgagcagcagaagggagaaggggagtatctgctccacccacctcgccacctgctgtatgtcgtacctct

SEQ ID NO: 86626 - DNA, 5759 bp, Oryza sativa
ccatgccgtgtcattgcacctgtatatgctgagatgtcacagacatacccccagttcatgttcttgactatagatgtcgacgagttaatggtaaaaccaatgtttttttttcctcctctcccccctctgttatatccataagaacaggtgatagtctctaatgctcttctcagtctcatctgttctgttcttcaaccgattttctttaggacttcagctcatcatgggacatccgagcgacaccgacgttcttcttcctaaagaacggggagcaggtggacaagctcgtcggcgccaacaagccggagctggagaagaaagtggccgcgcttgctgacagcgcctgaggcaaattaagccagtgacaatcagacattattgtcaggaaccccaaagttcagttcagagttcagacgttgccagcaaatatcaattatcatcagaggctgtatgttctgctgaggtgtttcttcagacttggttctgtatatccgtcatgagactgtacagtccccgggtataaagtatctttttttctcctgttaaaatcacacttttgacatgccattttggcactattattgcctgattttaccctggtgattagtgatccgatgtatgttgagtgtgaactgatacagaacaatagggaaatatttttactgtaatattgacaaatgccaggaatggctaccaatctgccatgaatccatgatttatggagttcatgattctagtatctgatgggcctttttagcgagtgggccgaatgtatcaccgcacagctgctctttggatatgatgtgggcttggtcggccagtaaccatttgtgacgaacctcatgggtccatgacactgaatttcaggaaatcacaaggaccggccgcagccaaactttgatttttcaaacttaactttgaattactctaggtgtttttttcaaccttagcttttaaaccattagtagtagaaatataaaagtccttcaatagaatcattttttgttgacttacagtttttcttctaatgttttgtcagcttttagccaaccaatgaaattcttcaagacgtcagaattctaatgccatcaatgatatacagagacacataaaacagtacatgttgagatgcagagcgtcgtcattcttgtagccaaccttgccggcacggccagccgctaattaaccactccaatgaatgcatcacagcatcggactatacagtacgtgtggctctgtgctcctgacatgtagttgtacgtgccctacttgtcaccagccaggaccagcttgcacagtgcaagtgtcatggatgattaagatatgatggctaatcctgaattactcgaggatttcacacgcaccattagacaggattgagtttgttttttggtttggagtatgtcgtttgggctctgttataaagccggatcgatcatttgattgatatatgtggtgttaagaatgaaaataaacgaatggattctgattggcgttgggaattgagaaagattaatagcgaaacagacggagaacaacttatatattggtggcggatctagaaagagatagaggagatctgaataaactagataaagctaaacctcttcccatctacatatagcaaaaaaaaatttagcgggggctctgtggggactcccatagtacttgcgccagtagtggtgggctcgagattttgcccagccggccccgtgctggatccgccctcgactatatggatgctaatagctttcaacacgccgtaggggatttacgactttaagtgtccccgacgttcaatgaaaatacatctcaactgattagttttcttatgataaaaataactcatcgggatttaatttttatatttgacaaatgtacttatgtttacggctaattacttttcagtggtagacgatgtacacctcaacaacgaggtgttcgtggtaactttgacaatcttaagatataccgattcagtcttctgaagatgctcataggctcatagggtaaggtgtacgtgtgtgtttataaggatgtatgcacgcgtgttgtgagcacctacaattctataaatttttgaataagacgaatgttcaatcgttataaaaaaactcaaagcgacgagtattttgggagttgggacggagatagtgctgtgtgtcttatctttaataaaaattaaagcacaaagaccacactaccgttattaatacagagtactacagtagtaattatagtttgcctgccttgtcaaccgtggcgatccagcggcgcgcggcatgggcgacgctctctggcgtggcgtcgcgccgcgcccgcgctctctcgacgcgcacgcggcgtggcgtggcgcgacgtcgcggcgtctcccgccacgggtttcgactttcgaacaaaaaaaggaatccctcctctcccgcgcgcgcgcgcgctctctcgcaaacgcggctgtctcgtggggccccactcgctggcgatggattcctggacgtgggccccgcggaccagtgagagataacgaggcttcgtgaaacacaccagtacaccagtacaccacgactagtccaacagaggacgacctgggcccgcgtgcccggcccaacaggagtctcatttgttcccagtgtccagcccaaggtgaatttcccaaactgccctcggcttgctgctggtggtgttaattgattgattgcttctccagctataagctcgcgaagcaaatggacacgctcttctttttgtcatctactgcatggcgcgcgcatgtctccttccttcgtttgaacgccacaagcttcgcgtgcgctttctaatactgataattaatactccctccttcatctcaaattatagaacatactttctccgtctcaaaatataaatctaaaattgaactgaatgagacgtttctataacgtgtctggacatatagtccatctatctggtccgaaagagtatatttttcacacggtttttaatgacatatttgaattgttaatttattttatattgcgtttacaatttatataaaattaacatcacatgaaactattttaaaatatgaatctagtgatagaacatacataatacttacttagtatagatatagttagtatatatattagtcaaaatttaccaagtttaatttttctttaaaaaataccctataatttagaacgggagcactatgtttcttaatatataatgtcattgatttttaacataatgtttgtttgagtatctctcttgtaaaagaattatataaatgttattattttgttgtgactttttgtctaaaaaactctaccttaacttatatatttatatatttatattaaaatttattaataagacaaattatcaaacgttacacgaaaagtcaacagtgtcttatataaaaatatatatatatgaggtggtatatagttattctcaataggaaaatcatttctttgtcattacccttcaagactgttattttttaatggcaggaccgtgttattggttgcaccgtgacaaataagaaatggtggagcctgatctgcccaagaactgcctaatgttttctttttccgaacacgcaaaaggattgcacgtcaatatattagaaggaaaaaagtttttgttatacaaagcaatcagccagactggcttatgcctaagggggaggggagaaaaggcaaaataaaaaaaacttgaagataggaactactacgacgttaaaaacgcaactccaaacagcaggagggggcagaaccacgctacactcccaataaatccccaaaaaagcaacgccggctaaagaccacaactggccctccaagcggatggactccagaaccattgcgactgaagcgagcgcagagtcgaaaaccctaaagtttcgttccttctatagctgccaggaaactaggagtaccaaggagtcgaagccgctacggaggtgcttaggtaaacaaaccctggaggatgatcaccaatcctggagccagctgccacgagggagagagagggcagcccaggaggggtcatcacacggagccagacctgccgtcctgaactgcctaatgcaaaaaataaggaatactttgtaaaagaaaaatagtgtattaataagcgatttaggacactaaaaacgcccatgtgtacgctcgagccgtatcttgttatcttgttggaattcaataataatctgtcaattttttggtaggccaccctcctatcacgcacttaaacagttgaaataaaaacgtgatgagttgtgaagcatcagggtggtggttgatgtgagctgtttgctccgcgtgctgcatgcagatggcttcaattttgctcagtcaaacactagtattatacactaactaatacttcatccgtcccaaaataaatacagttttagtactattcatatccaatgtttgaccgttcgtcttatttgaaaaaatattatgatcagtacttttattttattgttattaaatgataaaacatgaatggcactctatgtgtgactaatttttttaaatatttttttataaattttttaaataagacggatggtcaaaacgctgagcacgtatatctatggctatacttattttgggacggaggtgtactacacatcatgtggagccaatgaaaaataatatcggagcataaaaaaaaattagcatactatgaaatacacagtactgcaggtttgagcatacaaatgcatgggatgatgggaatatcgggtgaacccaactgaggggttgttcggtttttaggaattacaatcataaaaaagaaaaggtgaaggcatagaaatacctatacaattcaaatcatataggatttttacaacagatttaattaatgaatacaaaatttcctactgtctcaccctctacaattggtagggaagagaagaatttcttttttacttcatcatccttgcaaattgaatggtactgaaaaaaatatttcattttattttcagcaaaccgaacaagacctgaaaattcaaaacactcaaatcttcttcctctaagcctctgccgctgggcccctttagctgtcctcgccgtgtgggtccctcacccctctgccaggtgggcaccacccctcgaattgattattcctaacaacattccgcggattaattttcttaccactaataatctcactcctaataaatcctatctcatcgtttagtctaataagtcaaaaatctaaattttcaaacttaattttaaaatgtttttaacctaatttttttacttttaagtcgctacgaacaaatatataatagttttattaataaagttaataaactaaattctattatctaataaccgttttgatctaatccacctgctcccgtcgcgtaaacgcgtccagctcatcgtcgccggcgcctcgtttcaccagtcacgccatctaccccaccgagggcaatcttgtcatttcactcacaaccatctcctcctctttaataacagcgcactccactctctctctctctcacctccctgacactaaactggtttcattaaggccgttttgatctcctctccttctccaggttgggagaaggaaggaaggaaggaaggaaggaaggaggctttgcctcgatctcgctctctccggtaatctcttctccttctccagcccttgctcgcttgcttgtttgtttcctggcgctgtgttgcgatttaggaactggagtttttttttttcgttttctttttctggatggtgttcttggcctgaga

SEQ ID NO: 86627 - DNA, 836 bp, Oryza sativa
acctccgcccccaccgccccgaggcagcggattgtcacatgcgccgaggtcccggtcaaggaggttgccctgggcgacggcccatccaagaccacacggatcggtggtcttctggatggcaaataggaagacgcgctcgtctccttcctgcgggcaaacgctgacgtcttcgcatggagaccagcggatatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggagaaaactgcgttcattacccccgtaggaacctattgttatacatcaatgcccttcgggttaaagaatgcaggtcctacttttcaacgtactactcgaatttctttgggtagccaaataggacgtaatgttgaggcttatgttgatgacttggttgtaaaaacgcgcaaccaagaaactttactttcagatctagcggaaactttgagaacctccgctccgcccgcataaagctgagggggatccactagtggagattcggccgc

SEQ ID NO: 86628 - DNA, 801 bp, Oryza sativa
gcggccgctctccactagtggatccccccaggattttattggccgacagctctcaatgacgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctctcaaattcattaagggcatcacggcccgttttggagtacctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgcagagatgacctctactacttagaagacgagggcgggcgcgcgggcccttcgagccgcgcgctaccagcagagcttgcggcgctaccatca

SEQ ID NO: 86629 - DNA, 1283 bp, Oryza sativa
cgacgtttgatgtcgcaattctggtatttgcatagtatggggatcgtcggtgctagggtatacgcgagactgaggtaaaagagatggagatgaggatttttatacaggttcgggcccctgagcggtcaggtaataaccctacattctgttggccgaagccggtattgctcttattcatgataatcacaccagtacaatgtttggggtagcctatctaactgttgtcgacatggcggtctaacgatctgactcgtagtcgacaacagggtagccttccacctcgaatccgtgcccggcgagaacagagatagcgctttcgtctctcctgacagtatccgaagacaccgtagggtactagccgtgcttatccctgaagtcgatatccggcggcgtgtcttggcgtatgtaggcttctgtgttgattgtgttaggtgttgatcctgtcaggtgttaatcccgttgggtgttgattgtcttgtcccccatggtggttgttgatcgtgttgatcgtctcatatcatgggtgtccccctgtcctcctaggggggcttgtatttatacccacaggtgtccccttgtccaagtagaactagggaaactagtatggatacaatccgagtagtccttgtcgtttccatgtagaactctggttgtctttccttatccagaactccctccatatctgaagtcagtttccgtattagatatggtatgtggtggatcctgccaagatttagtcaactactattaggtatgtggtatccataaccctaacacacatatatatttttatgaatatatttcaatgcataaaaatatattcacacagacacaaagtttgtatacgcactaaaaaataaaaaaataaaaaaaaacatcacatatagaaagtttgtatacgcacatataaactttgtatatgtgtatacaaactttgtatacgtgtatagaaagtttgtatacgcgtatgaaaagtttgtacgcgcgtatagaaagttctatacgtacgaatacaaacttggtatacatacgaatacaaattttgtatttatacattaaaaaagaaaaaaaccaaacagaagagaaaccagaaaaaaacaaaccgaacgaaaaaaccggagaaaaaaccaaatagaaagaaaaaaccaaagaaaaaaaaccaaccgaacagaaacgataaaaaaggaaaagacaaaaaaaaaaaaagaagaagaaactcgctcctccctcgcggcgtgtccgccgccccctctccgcgcgagacaagtgcccaatcgtgtgcg

SEQ ID NO: 86630 - DNA, 7671 bp, Oryza sativa
  unsure (1)..(7671): unsure at all n locations
tggccaggtcattggtaagaaaagtccagttgcacttgttgatcccccgagatattcatcaaattttgttttgccgctgatcccggaccaattttgaacccccatagctctcttcctcaagattttttcttcttatgataagacctttcttgttatccgctgtttttccctcccatggtccattatgttgtatacatgcgagaatttgttccacttaaattgtagataccggggtcaggtccgaccaatcaatcagtttcatcctttcaaaagtttgaggctttaagttccatcttcagtgaaacgatcatcctttcatttgggccttttttgaacataaaagagnccccctcctcccgaacgcagccttagggatgttttcatcatccaaactaatggtatggtcttcaacagtagtttatggcttatgatctgctatccactacatataaggatccaacatcaaagatggcttgttctagcattgatgggttttatgtattaatcttggaatctcatgtatttgttgcttgatacgttttggcaacttttatcttcctgtccattttgtactctgaaattcctccatgtatctaatgtagggggtctcttggagattcgagttgcatcgtgctggtcaaaaattagttatcccagtaagtatctgttctactcctgagtcctatctggttctaatattttttgtttatcaaatattataatgcaggtacaggataaaagcatcaccgtgatacaaatctattttatttttcactgttgttgataattttaccccttcaataacatatgattccatgtataatttctttttttaggtttcactgacttattaaataattgtgcaggttttgctttcaactgatttcaatgcattacttgctaccagcgtttttgctattccttcaacactatattttctacttcaggttatcaattagtcctatcctatgttcattcttacccctgatttttttttttttgttgggaggattttcctgactggaatgtgatatttgcaactcctagcattatctcacatttgttacctttgctgcatcatcagttcactaaatgcaaattgtgcctttttattgattcacagacgtattttgtaaagccatactgtcttaagcgggaaaagcagaaggaacttgaaaaaatggaaagtttgtcttcacaggtaaaccaaggttgtttgtgtcatttgtattcttacttgtattagacagcttatgtacaccagtgcaaagggcggactggaagtttactagctggaaccttcacatagttttattttggaattagtcacccaactttggttatcacatgccagttcagttaaatctatacagatagatactccttccatctcaaaatatatctactatatttgaaaatgtagttttgcggcggagattaaggaagtaagtggaattgaataggggatggttgtgattgattgagatgagtggtagttggagaagtagctatattttgagacaaaaattgaatgccgaaggtagctatgttttgacggagggaatacatgtattagaccttccattttttccatgatggaacatctatcttttttttttttttgaaagaagaggacaaactatcttgtggcttctctttatcatagctcctctgcaatctgcaactgcaatgtgtctcttaactgcatgcccatgttattttctttgttaaattttatttaaacaaattctatacataaataaggttatcaagtgcttagggttccttcttgtatagctaactgaagccagacgcgcagcgaaaaaagcacaaaagttactagaacctgtctcaaatcgtaagaagaatagacagctggaggatgatggcttggtgattacaaaagctctgtatgggaatcgcaaaaaagttaaagagagcagcgaatcaaatgagttgaatgatgatgtggcttcgcaagtattagacgtgaccatcccactgaacttcctcgtctctgaggcaggccagctaaaggtatgtgccaatcacatataagtttatctgttaatacaaagctgatggtaaacaaatgctataatatgtagtttattttttgcatcctatctatccttccttttctggctagtaattccactggaaaatcaacaatataatatggtacctgcgggctttaacttgcaaatagacagggattacctgttatatattcccaatactaggctatgtttaactctattttacctttgtagattgtttgttcattgtagtagctcaatacattcctccaaagttaattaggtttatacgtttgatcgaaatatggttgcctgacaacaaatttccaccacttgcagcttcatgaggggatcaagaagtctggaataatgggcttctacgatccttgccctggtgatccaaagctgttacttgtagaatacacatttcatggtcagaaatacaaggtagagaataatctgacatccctttgacataccatgtcgcaacgctaggtatgcggatttgtgcattcctacataaagtccttgactctctttctgttggcaggtcatggtagatgattacgctgcactgttgataccacaagatattcatcaaatttgatctgccgctgatcccgaacaattttgagccccatagctctcttctcatagtttttcttcttctgatgaggcttttctgtttttcgctgtttttccctcacatggtccattttgttgtatacatgcgtggatttgttccacctagattgtagatacgcggggtgagatcccgacagtcaataagtttcagtcaatcaaaagttcgcgacattagttcaatcttcactggacgaaacatgcactgaactgataatttctttatctacgaagatgcagctgtcgcctttccacttagatcacagccaaccctctaacacatgcatctgtttttccttgtctgcgagcgtgcgacaatgtgatactctgtttttgtcatattccagttttgatccgtcagctggtgttcaggttctttagccaccgccagcagtgattttcaagaattccctttcttcaccattctcacctgttactaatataaactcatcataatgtcggtgttttccttgttttcctatgttgtgttctactttgaaattgcactcctgtgttcaaatgcaatcacttcaatacagggtaaagcgttttcttgtgaatcatttattcatttggcccttcatttgtcaggtaataataataatttttagagtaaattgcactcattatacataaacttatgatgtgggtacaaataggtacaacaacttgtaaattactcgttttagtacaataacttgactaggttatgcgaacatgggtcaaaataatccacacagataacctttgcgcgctagtaattgttttgttttgaaaaataaaatccgtactctagtagtgcaaacagcctacaagagattgtaatatagtaattactgttgttgattgatatgttcaaaattaagctagtgtgcttgcgtctgcacaactacaaacaactgatagcgtgcatatgtctcacactggttatctggtactacacattagatcaattttgcatgtgtgtgttgttttgtactaggttcgcacaaactagacaagttattgtaccaaaacgagcaatttacaagttgttatacctatttgcacctaccaagcaaattcatgtaccgcgagcgcaatttactctaatttttatcatgtcgatcaccaaccacatgcttcatccgagattagaatagatgcagactggggagaaccaacaaaatgttcagcgtgtgcactcctcgatcaccaaccccactgctctctgaattgacacatgacaccacagtaccacacatgcaaatgcaagcgccttctgttgcgttgcagctgcctcagctgcctctgcctccgggcaccgaagcaattaacctgcaaacaaaaacatggtttaggtgaggccaacacatccatcttgctggatctgtctctgctcctgcttggttttcttttcacagggagtccatcaggattcaggaacacaacatcctctcctgttgcgagaccggtgaacacatcctgcattcctgctgttgcgtgctcgtgcaacagattagatgctgtcggcgacagccgaagttccatgggcttactttgatttgctagttgctactctactgaactccaatgaagtaaagttttttttttatgaggcagtaaattaaacactcaatcaaaaatactactccccccgtttcacaatgtaaatcattctatcattttctatattcatattgatgttaatgaatctagtcatatatatatctatctagatttattaacatcaatatgaatgtgaaaaatactataatgacttacattgtgaaatggaggaagtacagagccaaaattctaggacacacatctattgtttcgacttaggccgtatttagtttcaaagtttttcatcaaactttcaacttttccatcacatcaaaactttcctacacacacaaacttccaactttttcatcacatcgttctaatttcaaccaaacttctaattttggcgtgaactaaacaaagccttacctaatgcaattttagcatcaaatcaaacctgtccattttatagtgcttgagttgaagctaccatctttttttttcccgattcatgaaaaacagaggcatacatcacttcgcatgcacaacaggttcacacttttaaagtaaagatttttttgataagatagtaaactgaacacatcattaaaattattagtaccacagtgccaaaattctggtacagccatatgtttcaccttaccaaatgcaattttagcattaaaccaaacatatccattttatctcatctttatcaaaattttatagtgcttgagttgaacctaccaaaaaaatttattcatgaaaaacagagtcatacataccactacatacgtaaaacagatataatacgtctcttaacatacttccagagcgaacattaaaattttgaatagtcatacttatatacccacgactccaccaccctactaatgatttcttcaattctagtagggcaacaaacccaatatctaatctcgcgaaatatagattttttttatttctacggaaatatgctgcgtccgcccagctaatacattcctagattgttcagaccagatgaagacttgaggtctaagcaagttacgatatttaagtagactcccgatgcaggctacatcaaaagctactggatttagtacagtcagtagtagcagcgtgagtgacatatctttgttaattgatcatcttaatgtaaagtatcttcaaaaggcatcctttaaaccatagcttttgtttttctatttgccactccctactgtttccggatcattggagatacttgtatgttcttagtggggttcactccaactgattcggtactttgttcctgttcttgttaatagcatactcctgtcatagaacaaaaaatattttttactgtacctccaataccgatcgagtgctcacttgaaataccattaccactgcttgggtaaaaattatacagtttttacatgtcttaaataggctagaaactcaaggctagacttgtatggtaacggggaaaatcgtattttcagttatatgccacaatgtatatagactaagtagttcaatatagattgaatccacgtaagtgggttgttgttgttcgaaataggatactggattaagttaaaacccacaccttaaaataaatcgcattcaactgccaatgttccctcacgagagaggtgaaatataatgcatttttaattcatgtgggtggaccatatagctagagatggctatcacatttccttttctacttccagcttttacattgatataaattgctcgtctagagctataagggttatctttttttttcacattatggatgccctaatatgatctcttgttctcaaaattacttaaccatgactttgtttcttagtgaggctagagatttaatgttagtctctattcctctaaacacacactctatgcgcacgtgtctaccatataatcataaaagtgagagagagaaaaaaaacggaccacctcttttaaatacagctaaaacttttctagccatatacaaatacacccaaaccaaacaggaggccgctccccttcatcgcatgtgtgcagatctagtacgcacaatcaagccggaagcaaagcaaatgaagaggagagagacgcattgccacccaaaccaagggatctcgcagtcgcagcagcatacggaatgtccattgcgccgcaccaaacgcgcattctccagtgcagccagccatggagctatcgatggatggatggatggatggatccagctaagctaacctcccctcctctgctctgcctgtcgtcctctcctccagcagacacgcggccgctcgccttcatttctgctttgacaatggtcaaatgctggggtagcccgttgctgtcacacgcttgcagcgttcagtattccggaatgttgctatctaaaatatgatttagtttgtcttaagacaatagatctaggcaacgattctatccagactagttatctttcgttcagattcattgttttaggatgaaccaaattttatcttagatagtactatctctgtttcaagttataagactttctaacattaaccatatttatataggtattaatgaatctagacacatatatatctagatttattaacatatatatgaatattagtaatgctagaaaatcttataatatgaaacggaggaagtaatattttaggacagggagtagtgacaatcacaacctgtatgaatgtgtgtgattagattaactatggtttttacccatagtttagtggtaatggtcctgcatattaagtatatcacactatgtgctcttaaccttttatgataatactgaagtactagtagtttagtacaaccaaccactccaggtgaagaacatgagtcaaagaaggttgagaagcatccagccatgcacactcatgctaagctcagctcagctgtaaccagtgcagcatgcgtccgtcccactccaagccttccccgagcctctctccccccgatcccgacctcccctgatcgatctcctccctcctctactgtaaacagcacatcaattcagagcaggtctcactcttggaaatttcagttgctactactccacatcactgctcaaattcagaatcccaagttcccaaccaatctactatattctcgtctcaaaatagtttcatttttcacccatccagcacataaaaaaaactaaaatatccctactttatcaaattctaatggctaatgcaattattcctctatttcatttattctctatcgttataaattccgatacaatgactattaaaaaataagcttattttagaacaaatgaaacagataaaaaataaacgtattttagaacggagggagtacttcatcaatcccaaaataagcaaatttaggccaaaatataatattatctagtacaataaatttgaatagaaatctgtacagattcgtagtactaggtaatatcttatctaat

SEQ ID NO: 86631 - DNA, 4537 bp, Oryza sativa
ccatatggtatctgaacaagctgagaaatgtaacctctcaccttgccctttagcaacaaccaccacagcctcacattctcctgcaaaatccttggcatcaacatactgcttccccttcaggtacttcatcacctccgccttcggcgtcggcttcccgatctcctcatagtactacaaaaccatcaaaattttgcacaattcctcaagttactcatcagtgttccagtttcagggacacaaaaaaattcttgatacttgaacactgactgactgctgctaccttgacgatgtcggcccatcgctcgtcggagtagtcggtgccgtcgagcgcattgagccctccggtgaggatgtgagggccatcgctggagcgcagtatggcgttcatctgcttcatcctccagctctcatcaaggtggtcgagatgtgtgcagtggaagttgacctccccggctctcggaacctcaatggtggccctcagcacgttcctgcatgatttggaaaacaaaattaacgcttaataatcacgtggagggaccatggatgggaagcagaggcaagaggagttatgttcactgttcagatggccaggcacaatcagatatgttgctgtcatgaattcatggtgttttttttttttgctcccgttttataggctcatagctcgttgaaaggtgacggttttctgtttatgatagcaacatagagtgtaattgcagagcaaatttctctaaggcttctggtttttgtcaacatgaaaaaaagaactttttttttcaaaggagaaagaggaacgggttagtgttgaataattaagaagaaattgtgagtatattgggagtcgaacacatgacctcaaggtcagagtcaaaaccagccacacttgccactacgctagcaagcgcatctaagattttccttttcgaacaatataatcgaaaatgtttgtccaggagaatgatgggtaattcttaccacttttctgggtgaaacagaagttaagatgatgctacatgtaccatccaaaaacttctctcttctttttccctgaaatactagctatatagacctatggtaacatatgagtttgttctttgtttctcttcactagttacacaacacaaacaacaggatgattatcacaaggaagcagcagtcgttgttgtgcaattacttgccaaggcgccgctgcgtggccagatgttgctatccatcaaagccattgccccgctaattgtcttgccaagaaaggccctgcctagctactacttctactagtaccctttctcgatggcgactgctcggaggacgcacggatttcagattttcagatctctcagttctcacgagattatgtggcagcagcactttgcttttcattgaccacattatgtcagcattactgcattaggatagtataattaatattgcctatatcttttttgataatgaaaataaatctagtttctacatcaagatgtatgatcatggccgtgtttagttcacactgaagtttgaaaatttggttgaaattcgtacgatgtgatagaaaagttatgtgtatatgaaaggtttgatatgatggaaagttggaagttcggaaaaaaaaaactttagaactaaacagggcccatgtccgagacgagtgtgaccagggttcaccttttcttattgagatccgggatctctacccctgacggtacgacagttctggccaacttttggtcaaattttactgtttcgaatttgaattcttgaaaaccatttgaaatttaacaccggaatccgcttttctcctgcatctaaacctcgaaattccgcggttttcaattggaccctgagtatgatatatatatacatggagacctaccattccttgtcacacaacttccactgcccttcaactgcatctagctatcaactagtagtagtagttaattgagcacacctaaacctgtactccaatcacatgtgaacgcggtccttttcgcttaaacctaaccaaagcgtcacgcgtaacccattttataggtaataatcaagcaaaacaagccaaattaagctacaattggggtgcccattttggccttggattttatgggatccgtatgcatatgcatttcccagggttttgatctgccaaaggagcagctcacctaatcctcattattattattctacctttctaagaaaggagcattagttgctaaaaatctaaattaaactacgcatctgccatacttacccagtaatcatgttgcctcttgtcggattgtgtaacaaactcctaatcccaactgctactgtcaccgcaatctgctcgatcaattaattaactaatcaatcgctttgtattatagcaggagaccaggagctagctagtgatctgagaccttgactaaactccccatctttcttttcttaaaacatcttttaaaaattatactatcttcatctcaaaatataagcatttcttacttcatctcaaaatataagcatttcttactccgatcagacaagtgattgtctacattcaaaataaggccgtgtttagattctaccctaaaattttttgccctgacatatcgaacctttgagcacctgcatgaagtattaaatataggctaaaaaataactaattgcacagattgcgactaatttgcgagacaaatcttttaagcctaattgctccatgatttgacaatgtggtactacagtaaacatttgctaattatggattaattaggcttaataaattcgtctcgcagttcagttctgtaattagttttttatttttgcccgaacaccctatgcgacaccctatataatacccgatgtgacacgccaaaactttacatccctggatctaaacacccctaaaaaatacttatattttaaaagcggaggtattacttaattatataactaactcaatccatcattacaaggtagtaaaaggtggtcagcttcaggtaagctggacgacggcgacgctcaccgaaccgaccacctgcgtcgtcgtcgtcgctagtccctcgtcggattcctccggcgacgggacaaaacccaacggcaggcgtgcgtacggtacggcccaataattgggcggcgaccgcgacgcgtccaggaaattcgagacaacgggggcagctagataccaagctgaagaagaagcagaagcagcagcagcaaagctaagctagcggccggacgacatggtggttgcgcgtgcctgagtgcctgaccgacggcagctagcgccgacggccgacggggttacgaccgggtcactgcgcgaagtggggcccacgcgtgcatgcgtggggccccctgtacgcatgtgacatgtcacgagccacggttggacaaaggagtgtatagtacagtacagcagtatgagtgatgtacagatgtaatggtggtagcaatctgtctgctgttttacagtgttactcccttcgaaaacaatttaaaatagaatgagatgttttctagtataataaatctgaataagcttttatttaaatttattattgtagaaaacatcttattccacgtagattggtatttttagagacggaaagacaggatgttagagggtgagaatgtgagatgcaagcatagcttggcagctcatgcgcatctgaagcacaggatggaacattcagattcagagagtatggcgtggcgtggcctgccagctctgaatcccattattatggcagtagtctgtactggcaatttgcaagtgtgcaactagtaggagtactatctagtattgtcgtgtagaaaataagagatatatacatatactgaatccaatgaaaagcttttcttgctactcatcgagtgctcagttggtaggaattgtactgaattttctggaaatttacttaacctgtttctacacttttcaccctttggcttgttaaaatatcaaaatggttcaaaattttatattgaaaaaaattacggacccatcggcatatttgcaaataaatagtaatttgtgaataagacttttatatatgtatttcttagcgatataaaagtacatgctgaaaaataaactttgatgaaaaaacctcgaattcagctccaaatttaaagttaaaaatttaaaatttagttgataagcataagcataagaaaaaaaaaaagccccttaatcgtttgcaaccactgtacaccgtaaagtgaaaaatccatgcaagaaatgtgatggttgatgcgaggaaattaaattacggcgagggaaaaggagacgatcggactgaccggaagtcggactggtcggcgacgcgctgcgacttccagcgcttgataggccaccgggagagcacggcgttgccgtactccggcgcccagctctcggcgaacacgtaccgcatgccgagcccctcggcgagctccgacagcgggctcatcccgcgctcctcctccgcgcgcacgttctgcagcccgatgatgtcggcgcccacctcccggagcacctcttccacgctccgccgccgcccttccggggtaccgagctcga

SEQ ID NO: 86632 - DNA, 841 bp, Oryza sativa
aaaaacaccaaaaatttatggccatgcaatatcctattttattcccatatggtgaagaatgggtttccatgaatccatcatgtataaccaaacaacaagttcatctgccttgcggcatgacaaagcaacaatggttgaattctttgcttacataatgcatgatagagcgggccaattcaacactccattacgttgtgggaggttaacccaatcttatttggttgatggctattgttgtgttgaaggtgagcacatacaacactataggttgcctagttttcaacacaaatatagattggcaccattcaattctttagccagctctgtgtctagaggcattacagctggttcttcggctggccaacgggttatcttaccagcctctcatactggaagccctcggtatctatatcaaaactaccaagactgcattgctatttgtaggaagtatggttgcccagatctttttgtcacattcacatcaaatgcatcttggccagaaatcctacaagctctagcacctggacaacaacctttagatcgtccagatatcgttgaccgtgtgttcaaaatgaagctgaatatgttaatggatgacattaaaaaaaataatttttttggtcccatacatgcaggtaatttccaaaacaactttcaatcaaaattcttagatacatatattattcatcaaatccatataatagttaacccttttgtacagttgtctacacggtagaatttcaaaagcgtggactaccacatgtccatataatcatttggctttcaaaagaagaacctctagatgctgaaaaggttgacctacgtatttcagctcaattac

SEQ ID NO: 86633 - DNA, 1596 bp, Oryza sativa
tagcgacagaaaccatctttgcactcccgtcaacagcaataactctagaagcaccagccttagctgcaaaaagactatacagacagaaagcatacatcaacagctcattcaacattcattacttgttgtgttttgcatctcaacaatataatcattacacaagcaacttgtatcataaaatatactcatgaatcaacccaggattgcaacaacaatctacatggtaggaatcaaattcaccttctgaggcagaaggaagtcagaattcctcccagtaggctattacttgagtgcattagatctaaccaagcattctcaattttttattatgtactacaagtttatggctgttgctcattttcttacttgcggtacgtagcatatagacttttagtggattcaagattgagagcatcaagctcatgctaaaacaaagtaacccaaaagaattttacacatgcataccttagaattcccgtgccacaaccaacatcgagcacagttgcaccattcatgaggctaggattgcctaaaagggcatctctgtaagcttctgttcttacctgaaaaggtcagtcagaaatttattagccgttgggcattttggaaaacaaagagatagtatatgtttagaaaaacagtgtcagggtttaacctactttgtcaccaagcatctctctatggatgccaaatgaactatacgacccgaagtagctctcatccacacttttaattcccctagcagcagcactagcacgtgcaatttttaactgcttgtcacttggctcctgagcaagagacccactgcactccccatctgtactctcaatagtacatgttctctcaaatctatcaatgacatcagaaccatcattgataatagatttcagattgctctcacatgtttcagctaaactcccattgcctgctgaacaccctcccttttccattggcattccacagtcgtcctcgtcatcatcatcaaagacggacaaactgtgcaaaagagaatcatcctccaagaatggttttaagtatacatcatcaccccatggaacctttccctctagttggggaatctctaatgcatgcaaatggccgcatagttcgctgttgctagagaaaacttgcccacagctccaacatttattctccgccacctacaaatcaatcttaataagttcataaggttcataataatccatgaaatggagcaaaaaggcacagaaactaacgaaattgcaatcgaaatcaagtgaggtctagttcatgaccacgcaaacaattagcacaacaattaaattaactatatacggagtatacagctcgatttcaagctgctgaagctgaaaccctgacgcaccttggaccgaacgaagttgatgagcttgatgcacccgtagaaatccatccccgtctccttcacgaccctgtagaaatcaaaccggtgctcggaggcgcagtgcgagaagagcgagctctcggagtcgaaccgcgcgctgcagaacaggcagaggagcccgccgccgccgccgccgccgcccgcgtcgtcgccgtccgactcccagtcatcccacccctcctccccctcctcct

SEQ ID NO: 86634 - DNA, 6056 bp, Oryza sativa
ggcggcgccgccgccgccgacgcgccgacggcccagctcctcctccaccccgagggcgccgccagcgtccctagcctctgtagctccgaccgcgccgaggtcatcaccgacgacggcgccgtccctcgccgcgacgacgaccccgtcgccgccgagaccgagcgcatcaaggccatcctcctcaacgaccaagaaaaggtcctcctcctcctcctctctctctcaccatcctccacttctcgtactgaatctgttctgccatgttgatgcagtcggaggcgacgttgctcgagctgctccggcgactgcagcagctggagctcacggtggacaccttgacggtgagaccgccgccgccgccgccgcagccatgccaaaccaagctcatgtgttgactagtgtgttcatgcggattcgtctttgcaggttaccgagattgggaaggcggtgagcagctaccggaagcacaactccaagcagattcgtcaccttgttcgattgctcatcgagtatggccatgtgttcccatctcgtcttggattgttcatattcaaatcgaatttgtttttcttagccagttgcattcgttgacatgtttgtttgcgaatcgaatgcagaggttggaagcgcatagtcgatgagtggatgagcagccgcgacgccattgtaggtaggaagcaagcaagaacagttcatcgtttctaagtttcaacctctgtatcatgatttagtagagaattaagcattctgcaatgatatgatacacagatcatactcctcaatccatgcatccctctggcttggagcaggatgaacgggggctctcttctccttccatggatgagggcgctctcttcgctacgccgagcacttccatccgcctatctgaggtaattggaattgtcggcacatccatccgaaatcatatctggttggtatgatctgacacagctccctctgagttttcctcaggaaaaccaaggttccaagttcttcgatggtatggatgatgatggaagtgagtgatcagacccttgttcaatatttttttgtgatggttgttggcttcttagctggtgtttgacatcttgattgttttgtggattatctgtagacacgaggagcaatggcggcagggataatggccggctgtatacaaggaatcaagaaccagctagaaggccgctgccgccaatggcccagcaatatgatccagaccagagctggaagcaagaacaatctgcgatgaggcagtcgagaccacaggaactgagcaatgggcagacgagagagcaattcatcgcggcgatgcttgcaaggccctcaaacccagagtccggtcctgggcgacctcaaccgaggactaagcagcatcaagatgcctcgccagctcaaggcagatcgcaacctatgccatctgatgtgagcatattgctttatcgacaaaatatacatgcttatttgattgatgcaaatgcttgtttgaggtcttaattctttgccatggctgtagaaatcggcgagccatcacgatgaaaattcagttcgggcaaagctagaactcgcgaagaatgcaaagcttgaactcacgaatagtgcaaagctagaggtgacaaagagaaaacttcaggaaggctaccaagaatttgataacggtatgtgttccgccatgaaattgggtctattatcacttgttgcaacatcaactggatcatggaatttgtttacttgaaccacaatatcttgtcctctgtttggaatattatagtactactactattttttgctgatcagtaaatttcattgatttgagtttctatatgcgacgagtcatggttatatttttgtgtaaatgcagcaaagaagcagagaactatacaaatggtggatccacaaaatttgccgaaacaagcgaaccggaattggcagcctaatggcaggccgaggaataacagcaacttcaacaacaaccggaattggtcaagatgaggcaccaattccatcatccagcaccaagggatcatagactcccatctcccaattccatccaaatttttcttcttttttcggctaaagttagtccagccaagtacataaacagcaataaggctttccttcaaaacttgcttccagtgccacacacacacaccacaaacacttcttgagagctgtgttgctggtttgcactctcttttaaccttttgatcacgatggctggtttttttttcctagtggtttgtcaaaaaaacttgtaaagatagtgctactgccaatccgagatgagtttctgcaataccgatcctgatcttgagcccctaaatttgctgtttgtgttggtgtttcctcggttgaaatgcaaattgctttctaccctgccatcggaatgaggatgtttgctgcctactttgggtctctgcgccctgcttttcaggctcaaagaccttttggggtctgtcttttcgctgaattcagcgtagcttgtcccccctgcgaagacttggactggaacgccaacgtatcagactgtacatagcctcaagtgaaagtttcttggtaaattcaaaattctagttgatgccaggaaaaattaactatgaagttacctatggtcaagatcacactgtcaaaaatagtaggaccatactctccgtaagtctttttgtcttgttaaaaataaaaaataatttattgatttttttaatacatttgttcatagcgatttaaaagtcaatactgaaaacaaattacgttgaaaatatcttaaaattaacttcgaaaattcaaattttagcttttgctttgtcttattaggccaattgatgcggccctaaaatggttgaatatccaaaagattttgtaatgaccattcgagggcacttccttcgtactcgtaaaggaagtcgtctagaacaatatttaagctaaactttgggaatataaatcatgaataactattaggttgtcgagtttgaaaatataaaatttatataaatagatttgtcttgaaaaatactttcataaaaatatacatatataactttttaataaatatttttatagaaacaataagtcaaaattctgttgtgtccataacgactttctttacgagtacgaagggagtacaaataaatgaatcaataattataaagttgatataaaaaaattgacaagaaatttatacatggaaagttttttaaaaaatcacaccgtttattagcgcgggagtacctttgtgctgcttcttggaacttggaaggaaacttgagttccaccctttgggagttggggtccaaatgaatgaccttggacggctgaatttcggtggatagaagtcaatccggtccattcttgtggatggattccaaattcaagttcagagtaagaatgagcaggctttgtgtgaacactataaactatttttgcggctgttttgaccccccaaaaaataaatccaaacagatcatattcattcatttcattcatcggccatgattcactcatgcagcagttgtgctgttgcttcgaggagcttgctctacttgcgttagcactgtacgggtgactgccgggtgggccccagttctgcggcggttaggtatgggcccaccgtcagtgtcatgtgtgtaccacgtcggggggtgcgtttaaatatggagggaatggacagcattgggggggctctcttggctgcttcaaagttcgaagcactgcacttgtggcgttgaaagttcccagctatgatcatctgtgttcactatctctgtgtcccatgtgtggccatggaaaaaaatgcatcatcttatacttatcagctaaaatttaaattttcaactttaaatttgaaactgattttggggtttctttcatcgaagtttatttttcagcttttgcttttaaaatgttaaagaacacgtatataaaaattctattcataaattactttttgttcgcaaatataccgtttggcttattcaacgtataaacgaaatgatggtgccgaaagtgtatacacttgagcatatttgcatttatggagtacttgaaatctttcttaaaagttttttaaaaaagggagagtagtactggtacatttccattgcaattaatgaaagatctgatatattctctcccttcaggttcagcatatgcggcattttattgttcttttttcttccgaagcatttttgttgacgttgctcgatttaaatgccgaacgatttcttgaatatttcaactatagtagcatattgttgcggctgcaacttctctgcagccgctagaagatggttgtcgcaaaatagctgaagcaaacaacaaacccactatagtattagtacttgctccgtttaaaaatataataatttttatacgattacacgagtattaaaaagagtaaaaatacttatttgctttcttgaaacggcgaggtgtatgaccggactataataaagtcaaagaatagtacgtgtagtatgggtaatttagtggcaaaaataacatttacatcttgttatatttagaataaaatctgttttttttaaaagaaaagtttattatattttgaaaccgaggaaggaatatactgtactaatagtatgcataaattgatcatcatatatatttatgcaccaagactaaggataattaaatcatatcaattaaaacatcatgcacatattcttccacaatacatgcatcgattaaaacactatgctaattgtatcttagcatgcacatattctcccatcatgtattaattgtattttgataaaatctttgtccattcagttatatgacgatcaattggagaaattttaaattttattatgtaatgattaatttgggaagaacggagtattatgcttgccagaaagtaaacttttcgcagccagccgggcaccgaagagattgagatcctgcaggtcaggtcaatatcttcagctcgtgacggcggagcagaacgcactagttttgataatgatatcgtgttggaaacaccacacggctacgccaaacacaaacaaaaacaaaaaacaaaaatcaaatgacgctcgtttttcgccgcctaatgacgggatttgattttcttctcactttaattaacatagacgatacgcaatcgcatctagttaagaaaatgcatcggatgctgattgctgtcgctttcctttcggttttctgtttcgtgttttttcttggacgaaaaaagaaaattgcccttgttttttagtaacgggtgttctgctctaacaatccagctgatttttatatcacgacagctcgagtgagaactaaagctggacacggattggagaagaagcaaccgattataatcatatagaccaaaataatcgttagtttcatgtcgaaatcacacccaagtaataatatgttgggtcttcaattaaaaaaaagtttcaaaatgatacatgtcgctttgttggactgaagtgtactgtaaactagtgctactagtatttgatcctaattaaactggagaggcgaattctagtggcattttgggtctgattagttgccggtaacaacttgctacaatctgtcatgtcctatgttaatcaagtttaacgcatagaagcccttaattagtttgaaaaatataaaaaaaattggggatttcaatcctataaaaaaatctatgaaattctatgtgtcttttaaaattatatgaaataatttgatagagattttggaggaaaatttacatgaggtcaaacctcatgggaaatttttcttgagtctctcatctgattcatgcgtttatttgtcttcaatgaaacaatcttccttgtgtttttaatcatatcttttacacttgtatttctatcaaaattctatgtttttttatctattcctcagttttttatttttgcgattcaaaggacccttagagaaatatacctggttacaacatacaccattcatccaaaaagaataatgccaactatatacggagtacaaagacatgcctaacagtacaaagacaaatacatgcctaacttcatagctagaagcacttagactgtgttcgggaggag

SEQ ID NO: 86635 - DNA, 3237 bp, Oryza sativa
ggcaaggcggcttcggtgccgtgtacaggggatacctgagagagcagggcctcgccgtcgccattaagaggtttgctaaggattcctccaagcaagggaagaaagagtataggtcggagatcaaggtgataagccggttgcgccaccgcaatctggtgcagctcattggctggtgccatggccgcgacgagctcctactcatctatgaactcgtccccaaccgcagcctcgacattcacctccatggcaatggcaccttcctaacatggccgatgaggttagtacctgttctctttaacttcatctaaacttcctttgtgatgttaaattaattggcgtgttaaactcagctaacttggtcttaacttgtcacagggttaagattgttcttgggcttggatcagcactattctatctccatgaggagtgggaacagtgtgtcgtgcaccgtgacatcaagccgagcaatgtcatgctggatgagtaattcaatgccaagctaggcgacttcgggcttgcaaggttcatcgaccatgccgtggggatgcagacgatgaccgccgtctctgggacaccaggctatgttgatcctgaatgcgtgatcaccggtagagcaagcttagagtctgatgtttatagcttcggcattgtcttattggaagtggcatgcggaaggaggccaatgagcctacaagataaccagaagaatggcatcttccggttggtcgagtgggcctgggacctgtacggacaaggagatgttgtctcagcggctgatgagcggctcaacggtgattacgacgtgtcagagatggagcgtgtcatcgttgtggggctttggtgtgcgcatccagacccaagcgcatgaccatctatccgagcagccatggccatgctccagtctagtgggcaattaccggtgttacctgctaagatgcctgtgccaacatatgcgccgccagtggcctcagtggaggggctcttcacatcgtccactggaatgtcgtcctcaagtgcagcacaatcatcatcgacgaccagtggctacatcactcacacctcgagttcctctaacacatccacttcagctggttcaaaggactcgtcttcgttgctcaaacatcaatacttatgatgttcaattcatttgctttgttactaattttgacttgatgcttgaatgggatgtacaactcgtgagccattgattttccatttagagtagtctaattgccaatgtgagtaatgcatgtgcatttatgccatgatttaaattttactcccattttagtttttctagatagatttatcctgccattttctcttcaatgtctgactactataaagtgcataccttgcatgttttaagtgaatatcctagtccttagagggctgaattgtcgaagttggaagaactttaaaatgaaaaaaaaaaccaccaagagaagagaactcttacatacttcacatagtttgcatgttttcacttttcagtgaataacgcaaaggtgtaaacaacatgaactaaatataataagctaaattcaatagagatggaacatggcctctacagactatagacaatagtacaaagactgcttattttcagtagttcttatgcaattgtctcaaatcgtggatatttatgttggatacttcggtggtggaatcaagaacatccaagcaaaattgttaacactacaaaatagtaccagcatagtagttcactcactatgacctgtagattttcagctggttgttttgccctgtttttcagcttttcaaccaaaaggttgttctccccaaatcttaacgaaaattcgggcagcgctctttgtcagcctggcaaaacaaataataataaattagacattcatgcaagaaacatgtcatccaggattgacaactctgctacctcacggatcgatcaagtcaaatttggaaataaaagagttggttatgataggttcagcaatgggtttgctgctgcaaaattctcaacagaatctgatagaacaacccattggaccctactccttccagaagaaaggaaagatctggaaacattatatgatggcacagtagctagtgacccattctctttcacattatgtccttagccatgatcaaacgcgcttggtcaaaccaaccagtaccaggatgattgacagaagagtaacgagaacgaattttgacaaagagaaacagctccagtgatttacgcattcgaaattaaaaactacaatagttacagcaatttttcatctataaaagtccatgcatagcctcttttgaatgtccaagttagctattcaacattgatgcaggattgtgcttacctaaaattaagttgaagcccttacattcttttgttgaagggacatcagaaaacgttaagaggctaaactaataaatacgaagatacccaaccttagaggaaagttagtgttggacaccaaattgggcatttatcacatctaaattatctcacgaaaaaacaatttttttcacattggacaaaacaaaaaaacagcagtactattgtgaccaatcaaccacaagcatttttcacattaagttgaggttatgaggtaacggatgcaaaaccctcatctagtcacctattggaagaggaagctccggtagggacagtcggcggcgatgcactgtcgcagcctagcgtcctccgccgggcggtgcagcatcgtcagagaatccgctctcaccgccggcgtgaagtgcctgacaaggtcccgccattttggaattaggatagttcccttccagacctagctagcagcaacaacacctgcggaggcgggaggcgtggaggagctacaggatacttcgccaaccggaacttgctcatcaccggagatctcggtcggcgcgcggccgacgaccagagctatgcggcagcggcggcgacgcggtagaatacgcttcagttgcggaaagaagaaaaagcttaaaccgaggatggctatagttgggccgtgcaacgtccggataacattttattggggaataagtccaccggaggcgagactttttgagatcccttaaccacaaaaccagaaatgtgtatccctaaactcacacaaaccgtgcactcaaggtcctatggcagtatatatgggtggtttcgctgacgtggcatcctagtcagcaaaaaaaattaaaaaagtacgtggagcccacatgctagctacacatttttttttcttctcttttctt

SEQ ID NO: 86636 - DNA, 1082 bp, Oryza sativa
cccgtggccagccgtaccgagcccggccgggggacaccgatcactcgatacggaccctcccacattggtgagagtttgctcaatccagcacgcgtttggacgcggcgtaggacgaggtcgtcgacgcaaagtgatcgggcccggacgtggcgctgatggtagcgccgcaggctctgctggtagcgcgcagctcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgcgaagagctcactagtgaattgggtgccattatccgtaataatacggttaggcactccaaaacgggccgtgatgcccttaataaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggccggggccggctgatgaatttgcttggcgtggaactgacacgctctgcatcgccggaccagatcgactgcgtcattgagagctgtcggccaataaaatccttgacgaaaggccttgccaaccagggtgcgcgaggcagaatgggctccgcactcgccctcatggatgtcagcaagaagctcaacgccttgttcctgaggaatgcacttcaggaggattccattagccgcgcgccgatagagggtcccttctaccagcaca

SEQ ID NO: 86637 - DNA, 3018 bp, Oryza sativa
caacggctgcgtcgccctgtccatggccgagatctgctcggcgtacccgacctccggtggcctctactactggagcgccaagctggccggcaaggaatgggcgtccctggcttcttgggtcactggctggtacgtgagacatgtatgagctagtctgcatcaatttcccctgtctttatgcactggaactaatccaaaatggttaggtgcaattgttttcttgatatccttgaaaaaaaattgttgtcttgagatggtgccttcttgaagattatgtttgatcattactattttgaatatttgttgctgtggattatgcatgtatgctgttgttcaacttaatttgcgagcctgaatttgttattgtgttgtgtgttcgacaggttcaatatcgttggacaggtatactaccattgtctggtggatctagatactgtttttagctccagcttataacttcatttttcgagaaaaaaatttgcattgttgccctgtccttgtcttcaactgttgtggcagtgggcagctattgcgagcgtagacttctcgctggcgcagctgctacaggtgatcatcttgcttagcacgggaggagccaatggcggcggctacatggcttcaaagtatgtcgtgttggtgatttgcgccgtcatcctaatccttcatggcgtcatcaacagcctccctatccagtggctatctctgtttggccaaatcggggccatctggaatgctgcaggtgcatggtacacatggaggcaataatcaccagtccttatgaattgtggttcttggcatctgaagtctgaatattgaaccctgaacgaaatttatctgtctgaacaatcaacaatgataggtgtctttgttctggtgatcctgatcccggcagtagcaaaggacaggccaagtgttgagttcgtgtttacccatctcaacacggacaacggcatggggatccatagcaaggcttacatcctagccgtgggattgctgatgagccagtactccgtgctcggctacgatacatccgctcacatggtaaacgagtcctctactcctgtcaggctgcagatatctgaatgagcataactgaatatggatagaacacagtgtcacagtgacgagctgatgatgcgtgtatgcaggttgaggagacaaagaatgcagatcggagcgggccaattgggatcatcacgtcggttgtttgcgcgacggtgttcgggtggatctacctgttggctctgacgactgccgtgacggacatcccgtacctgctcagccccggcaacgacgccggcggctacgccatcgcgcaagctctgtacaccgccttccaccggaggttcggcagcggcgctggcgggatcgcctgcctgggagctgtcgccgtcgccatcttcctctgcggcatcgcgtgcgtcaccagcaactcaaggtgacgggctcacatcgcgtcgatcgatctgatgattccacagctagctgttcatcgaatcatcgtgtcgagttggtgatttacatgtcgggtttctgtaggatggcgtatgctttctccagggatggcgcgatgccgttgtcgcgcgtgtggtacagggtgaacaagcacgaggtgcctctcaacgtcgtctggctcgccgtcgccgtggccttcttcatggctctcacggtgagttgcatttgcattcgcattgctgctccggtgattcacggtgagtgcgcgtgatgacgacgccttctctgccttttgccggtgcagtcgctggggagccaggtggcgttccaggcgatgggttcgatcgcgacgctggggatgtacatcgcgtacgcgctgcccgtgttcttccgcgtgacgacggctcggagatcgttcgtgccagggccgttccacctcgggcgatacggggtcgtcgtcggctgggcgggtgtggtgtgggtggccaccgtcacggtgctcttctcgctgccggtggcgtacccggtggccaacaaggagacattcaactacactccggtggccgtcggcggcgtgttattgctcagtgttggtgcgtgggtgctacgtgcccgcttctggttccaagggcccatcacgaatgttgacacgcattgttgacaagtatggtatcgtgttgttagtcagcgagtcagtggaaatatggaaccacacttttatattgtgtaatctatacgtgcaattgtagtcgttcagcagttatccaccattccggttttctttttttatcctttttattttgaaaaaaatgttttttttaaaaaaaacttttttgaacggttgaagagcgcagcaacgtgcgatgcgaggggcctgtctagggaaatttcagtagctgtagcttctgctataatcttcagctgccagaaactccatcaaacaatttagattttcacatatattttgaaaagttgtagttgtagaatctagaaaataaactcgaaatcagaaactgggtttgccagcttctctagattatcactaactgcttataagaagcttaggactctatcgtttctcttattgacggaataagcgaaatgacatatttgcaaacagaaaataatttgtaaataaaacttttatataagtgttcttagcaatataaacaaagtctgaaaaataaactttgatgaaaaaccccaaaatctatctattatattattaagatagctcgaaaagaaggcactacgttcgctgtggaggctagaaattcccatattaatcgaagaaaaagaaaaggagagtccaagtaaaaatacaatctaaaaaataactgaaattcggaattaaaaataagcaatattaaaagaggtgtccatataagaacccaatacgagattaataaaaccattgattacaattctaaattttaacggtctagatttgtaggagaaaagataagtccatagatctgtattgtgtacgttacatactaggagtctttgtcctttctgtttctttagcggtgtacacagtacacgtataatctaattcaatta

SEQ ID NO: 86638 - DNA, 4791 bp, Oryza sativa
agatcagctcagcatgaaagagaaaaggaagggaaaaataagttctgaatatacctcccatttgatcaaatagctatgataactcgagctctgatctgcttgatcagtatctggagatggaattatgaatggcgcctcgatgctcgcgctcgctagctcgtgatcgtagctaggaaagaatgtccccccttatatactgcaagatggcgtgacttcttcctcttgtcaatgagacacttcaatcggttaaccagtaatcacgagatccggccgacggcggagatcacgaggtttgcctcgcgttgggattcgacttcggttatacttttgctttggaattgtgttcctttgctttattcctcctctagcatctgcccatacattccgtgtgatgaacactgcgaatcaaatgggacgtttaagatgttgttgttgtactgatagcgtgattgaattcatggcctctttctgccaagccgcatatggagttttttttggtgtttcagtttcaagtcgcggttggtgaatccgaaatcacgtgattaaaacagtaattatcgagcacggaaggaatggaatttttttaaaaaaaatgcagaacggagtaatttcttacagatcatcctgtttctgcttgatgcgatagctaatcgctgtcggtgctctattactgctccagctcaagctcgaacagcattccagcttgtcggccaaattggacatatctttcggcccaattggtttaatccccatctcttttagccgggccgcaagttatcccctcctcgtcacgctatctataggcccattattatctatctgtgttatgttttagaacaagctggaaatgctggttgagctcgagcagtagtagatagggatgaaaacagtccggaaagtttccgaattccggacgtgtttttggaaacgggaagtgtcggtcagaattttttcgaaacatttggaaacggaaacgaattccgaattctgaatttttttctcggaaacagaaacaaacatgataaggctgctattcgttggaaaccgtaatccgacggaaattttcaagaaatgaattcaaatttttttttcttagaatcgaaaagggagtatttctcatatacaactgattagtttcattcttctctactctttaatgtttaggtttatactagtattgatgtgcttaattaaatagaaatatttttagttccagtaatttagatttgtttgcatgattactttttaaatttttattagaccatgtcatactacttataattatagttatagatgaatatagttctttttctccaagaaagtaaagggtacaactagttattattattattattggtaaaaaaaaataaatatcggtttgttattttagaaaaaaatattgagctacatctctttcttaatttgaaaagttcaatttaagggctttttatattccgataagtatccgttaccgtattcgttccaaatcgtattcgttccgttttcgtatttgataaatatcctttgccgtattcccgttttcatcctagtagtagtagagcaccgacaccgattaggaaaacgtggaattgatctgagtgaaattactccgttctgcaatttttcttctaaaagattccatttcctccgcgtgcgaaataactacgaccgaatcatttttgtattaatcgagttgatatctgtttctgcgaggccgctgcccgctggaatctggagattgaagcagagaaagtgagaggaaaccaaaccgcgacttgaaacacctaacagactccatatgcggcttgtcagaaagagacaatgaattcatcaggctaccagtacaacaacatctcaaatgtcccatttgattcgcagtgttccatcacacggaatgtatagtatgagcagatgctggaggaggaagaaagcaaaggaacacaattccaaagcaaaagtataaccggagtcgaatacaaaagcgaggcaaacctcgtgatctcacgtgcgtccgaatcgaactctggtcgcctccaccgtcgtccggatcacgcagcctggccggccatccgcggcggcgggcttgcgccgccgtgctgctttggctggaagatcttggtggcagagggcagaggacccagaagtcgtcctcctcgccgtcgtcggtgtgcggcggtagcaccggggatcggtgatctcgtactcggccatcatccacccggtaacgaagggaattagtagcagcaagcgggagtagcttgagtggccataattaatccgagctggtggagcagtattctgcgttcatgatctgcatttgtgtcctctcttcaggaactgaaaagctggaaatgtttgtgtctatctgtttataggtgccatctgtttggcacaagatggtaccgatatatagtcacagcaggctgctgtcatcaaccgataaaaagatcctgaatttttttaaaaaaataaaataaaattggaattttttattcatgtagcattgtcacaaaaaaaaagggccatacagagtacatgcattaacgttcaaccaacattatttaatcatggattattcgtctctggaaatccttatttgcactggcatggtcagccgctagttcggaggaaacgtaatcgggtagaccggcgtcttgtcagggtagaagagcccaaaatgcctctcggtctcatccccgggcttctggttctcgttgaacatggcgaacacgtacgtctccagctgcccgggccgcttcggcgtcccgttcttgacgttgtcgatcacgccctggttgtgattcctcgcgttctccacgttcgccgcgaaccctcccgccgacggccacccgctctccgacacgacgacgcggacgccgggctcgccggccttctccagcgcggcgtacacggcgtccaccatggcgctgaagaggttggtgtaggtgaggccgctgtcgttgtccctcaccgtggtgcccggctggaacgtggcgtagttgagcgggatgtcgcgcgggttgtccctgtaggcaaagtaggggtacacgttggcgagcagcggcgacatggtgttggcgaggaactgcgcgatgggcacaatgaactgctgaaggtcggggcggaacacgccgtgcgacggagggaacgagttggtgatcacgtccatcttcaccgccgtcgacaccttgatgctgttcgagaggccggcggacacgagcgcgttgtacaagttctgcatggccgggaggatggtccccatgtcgccggggccgagctcgttgccgacggcgatgtaccggatgaagacgctcggccagtaggcctggacgttgttccggacccagtcggcggcggcggaggggttgttggcgaggttggccaccgcgccgctgtcgccgacgtcgacgatgacggcgacgccgctgccgcggagcgcggcgagggcctgctggtccgggctgtagatgcgcatagcaccgataccattggacttgtacagctgcacgacctcgctctgcgacgggaggttgtcgccgttcatgccgtagcaaacaccgtggacacctgcaaaaacataggagtgcatgtttatgccaaatcagacgatttaattgatgtgtaggaaaataaaatatatatatagagagagagatatcgaatctggatttttcacattttgatacttttgaaaaacttatttcacaaatagacccctaaaaaaacttatcctagaaatggtcttttttggggcgccagagtggctggcgccgtcatccaacgggatggcgccagcctctctggcgctgtcctcctgccaccgtggcgtacgcgaaccgacgtggctccattcctgtttctctgtatggagttgcaacggtgttatttttattttattttttcggatgtttttcacactcaggatcacgatacaaccaaccacaaaaaaaatttaaactcgaactaccacttagctaagtctgaaaatatctagcataccacttagtctactttacaccttcactaaaattagaccataactcatttagtaaaaccctttgatcagcatgttaaacataatgcactctaccactatatgaaattacttaatctaattcaaaatataaccacatgaaatgacatatataagttaaacagtatatagagatgcaattttttatttttattttatttttttgatattttttcacacttatgagaacataggaaccaaccgtataaaaaataaactcaaacggacaaaatatgtgacatgtagaattttccaaaattctaccgaaacggacaaaatatgccatctattaaaataggcgtaactttctcatacggactcggaatcaggcaaataatatatgcacggacatctacagaaaaagttacatccgattctcccccgctttgccgggttcggcgatattaaaacctccaaattccgcttgcaagattgtgttttcgaggagagaagtttttcggtggagctttggaaaattccacatgccacatatttcgtccgtttgagtttattttttacgtggttggttcttgtgagttcctaagtgtgaaaaaaatatcaaaaaaataaaataaaaataaaaaagttgcacatctctctcctctgcactagttcggagagaggagaggagaggaaaaattctacatgtcacatattacgtccatttgagttcaatttttttatggttggttcttgtgtgtccctaagcgtgaaaaaaattcaaacaaataaaacaaaaataaaaaatttccgggggg

SEQ ID NO: 86639 - DNA, 4694 bp, Oryza sativa
cgccgttgctcccgcgttccgccttcgtctcctccgcatcgttctcctccttttcgtccgtcgcctcgttctcctccacctcgtcgtcgttctccgacccggccgtcccgtcggatgtcgtcgaggcgttgccgatgtcgagggactcgttcaaggcgctcgccgtgctgagggaccaccagggctcggtgtcgtccctctcgctctgcggggagttcttgctcagcgcgtccaccggcgcagacatcgtcgcgtggcagcagccggatctccgccgcttcgcgaggttcgggcatggggaggggtccgtcaaggcgctcgccgccgcggggggcagggtgttctccgcgcaccaggacggccgcgtccgcgtctgcgggtgtcgcggcggtcggagaacgcgttcaagctcgtcgccgcgctgcccaccaccagggactacctgggcaagatcttccgccacgccagctacgtgcagacacgccgcaaccaccgccgcctctggatcgagcacgccgacagcatctcctgcctcgccgtgcacgacggcgtcgtctactcgggctcctgggacaagacgctcaaggtctggcgcatctccgacctcaagtgcctcgagtcgatccacgcccacgacgacgccatcaatgccgtcgccgccgacagcggcaccatctactccgcctccgccgacggccacgtcaaggcgtgggggaaaggcaaggcggcgcacttcctccagggcatcctcatctcccgggacggcgtgtcgtggaacgccctcgtggcgagcgccgacgccggggctcgccgcgtgtacgccgccgggtcggacgggcacgtcgtcgggtgggacagggtaggcggcaggggcagccgctggagcctctcctgcgacgtgaaggcgcacgacatggccgtgctctgcctgtgcgtcgccggcgaccttgtcttcacgggctccgccgacaagaccatcgggctgtggcgctggcagacgagcggcgacggcgacggcgccgccgccgccgccctcgccagggtgggcgtgatcagaggccatgagggccccgtgaaatgcatccaggcgagctggtgcagggtcagcaatggctgcatggtgtacagtggagggctcgacaagagcatccgagtttggtgggtgcccaatggctggaaggccaacgagcagaagcagcagcaagaaaatgacacgaaagatcacaagaactgcgtgttcttgaggtgaatcgtgtcaggtcaggtcaaaatgtgttcttgatttgtgttgtgtttgtagatcgtagtttggattgtttggtagcacactgccttggttgggttgatgatctactctgatggatatattggaggatatgaattaaggagtcatgaaggtattagttttagatttgggtgtaaatggctgtatacttttatacctaattcatacacattttgattaaatggaaatatcagtaataatggttatcataatctcatattgttagaaatgtgtttgattctcagtatcacggtgtgtctctgattactgattagtgtcaatacgcatctatccaaacgtaaaagctcaaaattcaagcatagcaggtcctttacactgatcctgcacatcgctcactgttttctttccgaggtacctcaacattatccttgattatctaaaaagcgttaaattccttgaattgtacttaaaaatgaaaattttaatgtcctaaaaaagtatggagatgtatagatggtcaaatgggccgcccgaagtggcacggcccaagcacggtcaggcctgagccgacacggctgggctcagcccacagaatatgaagattccggactgaagaactcatcgcacttacgatgggctccattcgatggcgagataaatactggtggtccggagaaagaactcacgaggaacacacacacccctacccgtctctgttcatctccacatcttgtcttctcgctgttgacttcgagcggagactagactagctactactcggaatggggaaggagatgaatctgatccgagaagacgagtacggcggcggcggcgtcgggttcgagccgacggaggacgagctgatgctccacttcctccgtccgcagctgcgcgggttcgcgccgcgcgtggcgggcgccgtggtggaggccgacccctgcggcgcggcgccgtgggagctcctggcgcggcacgggaggcggaaggaggggttcttcttctcggcgcgcgcgcggaggaagccctcggtgcggcggaccgtggcgggctgcggcggcggcggtggcggcggtggcgcgtggatgcacagctccaccaagaacggcaagtccgtgaccgacctcggcgtggtggtgcggtggtgcaggatcaactactgcttctacgtgcgcggcgagatgggccagcagcggagcaccgggtggatgatgcccgagtacgagatcaccgacccgcggtgctaccgccgcgccgacgacggcgaggaggacgacttctgggttctctgccatgtcaggaagagctcgaggccccaagccgccaagatctctccagccaagccagcacggcggcgcaagcccgccgccgccgccgccgcggatgtccgggctgcgtgatccggccgacggcggagatcacgaggtttgcctcgcgttgggattcgacttcggttatacttttgctttggaattgtgttcctttgctttattcctcctctagcatctgcccatacattccgtgtgatgaacactgcgaatcaaatgggacgtttaagatgttgttgttgtactgatagcgtgattgaattcatggcctctttctgccaagccgcatatggagttttttttggtgtttcagtttcaagtcgcggttggtgaatccgaaatcacgtgattaaaacagtaattatcgagcacggaaggaatggaatttttttaaaaaaaatgcagaacggagtaatttcttacagatcatcctgtttctgcttgatgcgatagctaatcgctgtcggtgctctattactgctccagctcaagctcgaacagcattccagcttgtcggccaaattggacatatctttcggcccaattggtttaatccccatctcttttagccgggccgcaagttatcccctcctcgtcacgctatctataggcccattattatctatctgtgttatgttttagaacaagctggaaatgctggttgagctcgagcagtagtagatagggatgaaaacagtccggaaagtttccgaattcccgacgtgtttttggaaacgggaagtgtcggtcagaattttttcgaaaaatttggaaacggaaacgaattccgaattccgaattttttttctcggaaacggaaacaaacatgataaggctgctattcgttggaaaccgtaatccgacggaaattttcaagaaatgaattcaaaaacagaaatgaattcgttggaaaccgtaatccggctgtgggagaacttcacggcgctgcaggaggaccccgcgctctcgccttgctacgccgaccagctgcgcctcgtgtacgaccccgtcgccggcgactaccgcaacgtgcccggcgtcgacacccgcgtcgtctccttcggctccacccgcggcttccgctccgacgatcctgctcgaaagtaagcgatatcatgtcgaatttatcgtactccactccacaaggagatgaacatgcaatgcatatagggacgtgtgcatggagaggctcgtggaggcgctggaagaggagggatacgcggagggagagaacctgttcggcgcgccgtacgacttcaggtacgcgccggccgctcccggcttgccgtccggggtgttctccgacttcacgtcgaggttaaggcgcctcgtggagcgcgcgagcgagaggaacggaggcaagccggtcatcctcgtgacgcacagcctcggcggcctcttcgccatggtgttcctcgaccggaccccgctgccgtggagaagcaggtacatcaagcacttcgtcatgctctgcctcggcgtcggcggctcgccgctgaacatgtggcccctcgccgcctcctccatcccgtcgtcgtcgtcgttggtgggcagcgtgctgacgtacgggaacaggagcttcgcgagcatgttctccctcctgccgtcgccggcggtgtacggcgacacgccactggtgatcacgcgagccaagaactactccgccgacgacatgccggagtttctctcggcggctggtttctccgacgacgaggtggcgctctaccgggcgagggcgctgccggtgaccctggatttccgggcgccgctcgtgccgctgacgtccatcaacggcgtcggtgtgccgacggtagataagctggtgttctgggacggcaacttcagcgcgaagcctcaggtggtgaacggcgacggcgatgggcagatcaacttggacaccgtgttggcattagaaaggttgatcggtgatgacccggatcagggttacttcaagtcaattttgatccccaacacgacgcacaagggtgtcatctccgatgaattagcgctcaagcgtgtggtcagcgaaattcttggagcaaattcaattaactaaggggaaactgttttaatccctcgaggggatatcccctcgttctttgcatgtcacttaaatggttata

SEQ ID NO: 86640 - DNA, 2883 bp, Oryza sativa
acctcatttactcacgtgattactcttgttctgcaccctcgctccctagcccgaacttacatggagaggagaggagggtctatcgattccgtgctcgaggtgatctttctgcgacaaattccattatctatccactttgcctataaccctggcgatggaagcgccggtgttgtcgacctcccatggtctgtcaccatggaggccatatccaagtgatccgagtcatcttcatcatggtggtggctagcttagctactgctactgaagaggagaacgtctaaagaaatggggatcatgattaggggtattttaatccataaaaatatacggtagaaaagacgattcaaagcatatctcatacgtataatgtgacgtggatctaattttagatttgtcacggtggtacggttttaattatgtgaatagcatagattttaaaagttatatgacatatctattttttttattaaaaagatcagccgtcctgtccatgtgagcaacaaaaaaaaaaaaaaacttcagcgcaaaggatgaacggccgagatttgacttgggctaaaccccagtagaaacacccccattttattgcttctctctttgctccgctaccgttttccctttcccggtgaccgccgccgtcgcggcgccaccccctcacccatggcgagcttgccggaggcacccgtaccaccggagagcgcacgcatgggttcacccccgccatcccattccccttctcctcctcctctccaaggagacccctccctaccaaccgacgctcctccaccggagccatccccccaaccccaccatgccaccccgatcccgccgccgtctccaggtcaggccaccgaggggtggcccagggcggaagaaccgcaacctccgatcggtgggacccccggtgcggcgggcccgccggcgccgccttcgttcttcccctcgctggagctgggtacctcggcggcgccacctgcgctcgaagccgcggcggcgggggcggggcagcccggctccccttcgccgtgtcctcccgctgagccggcggccgagttctaccccgggtcggcggcgtcatccccttcttcctcctcgtacgaaaccgcggaggatgactcgccggcgtcgccgccgcccactcctccgccactggtcttatgcgcctcgccggattcatcctacaccgagtcctcccctacgcgcgatcgcttcggcgacgaggagggctcgcacgccgcgcccgagccgccgccgccgccgacgccattggagggcgggccagatgcatcctccgccgagcccgcggcaatggcgtcccgtgcgcgcgaacccatgggctcgcgcaccgcacctgaaccgccgacgccgccattggagagcgggcaggaggggtttcagcagcagcagccgcatccaccgcctacaactcatccggagtgtgatagctcggagcctgcggagctgccgcttcctcccactagtccggctgaaatcgcatacacatcgccagattcagtcgaggtcgatgtagtagcggtgtcgccagaggaagctcctggttcaacggttgcaatggaggtaatgtacggggagactgatacctcagctgtcagtgtgtctccggtattggggagtgcggagacagatgcagccgagatcgatgtaatagcagggatgcaagaagaagctcctggttcaacggttgcaatggaggttatgtacagggagaatgataccgcagcagtcagcgtgtctccggtattggagagtagggaaccagatgtggccgagggcgatgtagtatcaggtgtgcaagaagctcatggttcaaagttttccatggaagtaatgtacagggaaactgatgccgcagcagtcagtgtgtctcctgtattggagagtggggaaccagataaagccgagaacgatgcagtagaagagatgcaagaagaagctcatggttcaaggtttgccatggaggcaacgtacggggagcctgatgcctcagcagttagtgtgtctccagtattggagagtgtggagccagatgtaactgagattgatgtagtatcagagatacaagaagaagctcctggttcagcgcttgccatgttggtaacttacggggagactgatacctcagcagtcagtgtatctccagtactggagagtggggagccagatgcagcccagattgatgtagtagcagggatgcaagaagaagctcctggttcaaagcttgccatggaggtaatgtacggggagactggtaccgcagcagtcagtgtgcctctggtattggagagtagggaagaggggtcacttcaagaatcaatgcagagaccatcttctcccacaatgaacattgagcaagagtcaatgcagagaccattttctcccacaattggcactgagacaagttcgccagagatggctcctgctggatctgagaactgtaaagtatcatggttgccgttgccccctcctacaccacttggcgaatcaatgccctccttgccagtcgcagctgcccccaaggttttattggtgatgccggaggaagcggttgagtcagtcccttcatcggaagctctggatgttgaaaaacctgcctccatcacacaggctgagcccagctcacctaatacgccaccgccaggatttgagaattttaagtcgtcatggttgccgctacccacgactcctcccccagttgaaaccactgatgtcttgccagatgtggtggttaccaaggcagtggaagcacccattgaggaagtgtctaggccattgccagctttggaggtgacaaacatggagtcagacactgtcctcagtatcttgcccacaacagtcttgccaacaggggatccactagtggag

SEQ ID NO: 86641 - DNA, 1505 bp, Oryza sativa
agcccgcgatgctgctcgagctcatggacgccgggtcgctcggccgcgtcctcgccgcccgccgcggcggcgaagggcggcgcggcctcccggagcccgcgctcgccgaggtggccgcgcggtgcctcgccgggctggcgcacctgcactcccgcggcgtcgtgcacctcgacctcaagccggacaacctcctcgccagcgcccgcggggacgtcaagatcggcgacttcagcgtgtcacgcatcttcctcggcggcgccggcgagcgcctccgggtcccggtcgccgccggatcgacggcctacctgagcccggagcggttcgagccgaacgcccacgccggtccgcgcggcgcgtgcgccgccgacgtctgggccctgggcgtgaccgtcctggagctcttcctgggtcgctgccccatcctgcccgtcggcgagaggccgtcctgggagaggctcaagaaggcgatatgcgacggcgaggcgccgtcgttgccggcgagcgcggcggcgtcggcggagctccgcgggttcgtggcgtcgtgcctgcacaaggacccgagacggcgcgccacggtggcgcagctgctcgcgcacccgttcgtcgctcgccgcgacggcgaggcgtgccggcgccagctacgggagatcatcgtggagaccatgtaggagtagagaagagaaaatctcatcatgtaaaattgtagatccttgtgcaaattcttgagtagagaagcgaaacatctcatcatcatgtaaaattgtagatccttgtgcaaattctcgagatcaattgcacttcaattgattttttgtattttatcctgtatactagcgtagtcttgtacgctgctaggggatgttgagatttgagaaggaaaatctaaaagtttccgtccacgttttaggtggtgttctttttttaattaagatatagattttatctcgattttcaattttcatcattaaattctaacggtaggaagcaacaaactataaccagatcaattatttttaccctccgtcctaaatatttgatgccgttgacttttttaaacatgtttgaccgttcgtcttattaaaaagggttaatttgatccatgccactgcaattttgcctatttagaaaaatgctattataatttgtgtattgataaccatgccactagaatttttcaaaattggtgatatgccactgccgtcgcgtttccatcctcccccctgccttttccgtcttctttcactgttgttcacttcggcaaggttagcgccaggagccggacgtatggcacgcggcgctcgctggcggcggcggggatctactcggcgccggcgttcttggcctacctggcggcggaggcgtcgcccgtccacccgctcgctgcgcggaacaaggcccgcgccgccgccacgctggtgcattgcatggcgcgcccgccgtcattctcaccatggccgtgcctaccatggctcccctccccgtgcccctgcccatctcccccatcc

SEQ ID NO: 86642 - DNA, 2256 bp, Oryza sativa
tggccccgggcccatcctgggggtccgggggcgctgtcccgttcgaccaagcgggcagagggccagctccggtcgtcgggggcctcgggccccccgttgggtcgggggcctcttctccctgctctctcccgggtcgaggcgacacagggcgctctttgtccgagagcccgcgcggggcacactcggcttctgtgccgacgacctcgggggtagagggcgacaaacgcggccttcccgcagtggccccggggccatcctgggggtcgggggcgcctggtaccgtcggacaagcgggcagagtgccagctccggtcgtcgggggcctcgggccgccgttcggctcggaggcctctcctccctgctctctcccgggtcgagtcgacacagggtgggggtgtgcggaacgagggtcgtcctcgtcgcgctccacgaccaacgccgagctgaccacctgcggggttgccgccaggtaaagtagcaacggttcatctggtttcggggcgactaggaccgggggagaactgaggtacgccttcaactgagtgagggcccgttcagcctcctccgtccaagtaaacggcccggaacgtttgaggagcttaaataggggtagcgccttctctcccagcctcaatatgaaccgaattagggcggccatgcaaccagtgacgcattgcacatccctaagtttgctggggggggcgcatccgctctatagcttgtatcttctcggggttggcctcgatgcctcgggcagtgaccaagaacccgagaagcttgcccgcaggcacgccgaacacgcacttgtcggggttcagctttatgcgcccccagcgaagactttcgaaagtttccgctagatcagagagtaaggtctcttggttgcgcgtcttctcaaccaagtcatcaacataagcctcaacgttgcgtcctaactggctacccaaaaaaattcgagtagtatgttgaaaagtaggacctgcatactttaacccgaacggcattgtcgtataacaataagttcctatgggggtgatgaatgcagttttttcctcatcctccctagccatgcgaatctgatgataaccagagtatgcatctagaaaacacaaaaggtcgcaccccgcggtggagtcgacaatctgatctatacgtggcaagggataagggtccttaggacatgccttgttaaggtcggtgtagtcaatgcacatccgaagcttgccgttcgccttgggaacgacgaccgggttcgccagccactccggatggatgacctcacggatgaatccggcttccagaagtcgcgccacctcctcgcggatgaaggcttgacgttccggggcctgccgccgtactttctgccggaccggccttgcgcccggccgcacggcgagacggtgctcaatcacctccctggggaccccgggcatgtccgccggtctccaggcgaagacgtcggcgtttgcccgcaggaaggagacgagcgcgtcttcctatttgtcgttcagaagaccaccgattcatgtggtcttagacaggccgtcacccagggcaaccttcttgaccgggacctcgtcgcacgtgatcatccgttgcctcggggcggccgggacggaggcgctgagcctctcgtcgccaccctcgggcttggacgccgcggcgagctggttcgcgcgctgctccatacaagcaagcgcgacttggaggtcgccatggacggtgatggggccaccagggcccggcatcttcatctggagataggcgtagtggactgccgccatgaacttcaccaacgcgggtctccccaggaccgcgttgtagggcagactgagatccgccacatcgaagttcacccgctccgtgcggaagttggcggaaccaccgaaggtgaccgggaggtcgatatgacctagcggccaagtgtgccccggcgtcacaccgatgatcggctgggatggctggagcaccatccctggggccttgatggcgtcaaaggctgcgggggaaaggatgttgagagctgcacccccgtatatgaggacatgccccaacttcacattgcaaatagtgggggaaacccccatcgcgatctgtcctccccgggcaacgcacggcgggtggtcggtctggtcgaaggtgagggccacctccgaccatcgcgcccgccgtgtcgcctcatgggtaggggccgcggccagaagctctcgcttcatggccttgaggctccggcgagaagcatgagcacacgctccc

SEQ ID NO: 86643 - DNA, 1707 bp, Oryza sativa
cgcaaaaggctgctgacaagatagccgctgatgtagttgagagattccaggacaacaatcttaagccgactgagtctgataattctgatgatgaaagaactgagtctaattgattgtgtattctgatgataatgatgatgatgatggaggcacaatttgtgcaatactgataaatttatgctgtgcttgatgatttaaacttagctccagatttcttaaaagtttttgtcaaaccttattgagcctagaacccgcaaaagtttttttaaaaacttccagtcctcattggctaagccaaaaaatcaaacaaggcaatgataaatcaagtaagcaaattgaattgataaaaatcacactccattattattatagtagcccccgactgataaatcaagggacaacttgatgttaacagtcaaagaggaagatacaaaagtaatgcctaagcataaaaacgacgaagatgttcaatattccaagagttgtcgatatgagtaccgtcttcacgcttgagtcggtaagaacttggccgagtgacttcaaaaattatgaacggtccttcccacaagggagataacttgtgccgatcctgtgtagtttgaatttttctcagaaccaggtcgcgactaaaaaagctcgagatcgaacattgcgattgtaataacggcgcatcccttgtaagtaccgagccgactgaattaaggctgcttcatgggcttcttctagtcggttgagatcatctactcggtattctccgtagcgctcctcgctgaagttacgaaatcgtagagattcaaattccacctcacttggcaacatcgcttctgctccatagactaggaataacggcgactggcccgtagcccgactcagagtggtgcgcagggaccaaagtacgaatgacagctgttctacccacttgccagcatacggatgcagtcggtcgaaaactcgtgcttttattccttgaagtaccataccattagcgcgttcgacttgtccattgctcatggggtgcgctacagaggcatatcaaattttgatgccgaagtcctcacagaaatctttaaatactccgcccgtgaattgagtgtcgttatcagtaatgatccgattgggtaccccaaactggtgcacaatgttgatgaagaaatctctagccttgtctgtcgtgattgtgataaccggtttggcttcaatccacttggaaaacttgtcaacagctacaaagagatgagtataaccaccgactacctttttaaacgggccgaccatgtcgagcccccaaaccgcgaacggccaagacaacgggatggtttgcaactcctgagccggtagatgagtttgtcaggcgaaaaattgacaaccctcacatgttcgcacaattttgtcagcgtcggacacggctgtgggccagaaaaaaccttgccggtaagccttgccaacgatggttcgtgcggtagcgtgattgccacagatgcctgaatgtatatcctttatcaattgtcttccctcctctaaagacacacagcgttgcaggattcctgatggacttttcttgtacagctcggtctcatgtatgacataaagtctgctgcacctggagatcctctcggcttcatctttatcttgagggagttcttgttttgtcaaaaatcttatgaggggctctctccagtcgacttcaatcatgcttatgtcttgagt

SEQ ID NO: 86644 - DNA, 2686 bp, Oryza sativa
tttgatgacttgctattccagctcggtaccccgctaggtgtttgatctaacgactttcgcgcttgcgctgtgcgacagggtggggatcgacatgccgacgatcgaggtgcggttcgagcacctggaggcggaggcggaggtccgcgtcggcaacagcggcctccccaccgtcctcaactccatcaccaacaccctcgaggaagccggcaacgcgctcggcattctgcccaaccggaagcagaccatgcccgtcctccacgacgtcagcggcatcatcaagccccgcaggtgaaacaccatcccccccccccccccaacacactcccacacccacatgttgttttcaccaaaaaaaaaaagaacatggattctcttgtcttctggagcaatttttatctctcgtgttggagactggattagttaaatccgggtctttttttttagaattcaatttcttcgccttcttcccacctcacgttcttttcgtttctacaggatgactctgctgttaggcccaccggggtcaggcaagaccaccttgctgctcgcgttggccggaaggctcggcaaagatctcaaggttcgttcatccaaaaccaacttcttgcaaataattcaattccagatgcctgtatcccactataggcgcagtgtttcagcttctcatctctactagtagtactgctccagtacgtactaatacgaagaatgagttagccaaagaagaaaacacagagtagtacggggagttctttatttgggaaaaagaaaataagagatggatactggagtacgaattatactgggcgttcacacgttgttgatgagtataacgagatgcaattgcaggcttcaggaaaagtgacctacaacgggcacggcatggaggaattcgtgccggagaggacggcggcttacatcagccagcacgacctccacatcggagagatgaccgtcagggagacacttgccttctcggcacgatgccagggtgttggcagtcgctttggtaaattctacacgattctcagcagtagtagttgccttttttactgcttgcggattatgcgggattgcatggttggacgggcatgctaaaccaagttttcctttttcctgttgttttttttttcagatatgttgactgagctgtcaaggcgagagaaggcagcgaacattaagcctgacgccgatatcgatgcattcatgaaggtaaaaggatttacgaatccgaaataaaatcaacaagattttggtgtcctcttacttttgttaatttttctttttgaaacgaggactaagcattggttttctggtcaacttgttcaggcggctgcaatgggaggacaggaggcaaacgtgaacactgactatatactgaaggtgcatccatctttgagctagtgattaaattttaggtagaattacccaagaatttcttgttcaatgcattggacgttacttgttgcagatattaggactagagatatgcgctgacacgatggttggggacgagatgctgaggggcatctcaggtgggcaaagaaagcgtgttacgactggtgaggattgaactccaacacaaattcagattgagactaacggctatgaatgaaccacggtgtgattattcctattttgatgcgttctgtaggtgagatgctggttgggccagccagggcgctcttcatggacgagatctcaactgggcttgacagctccactacattccagatagtgaattcgcttaggcaaactgtccacatcctcggtggcacagctgttatctccctgctgcagccggcgcctgagacttacaacttgtttgatgatatcatcctcctctcagacggtcagattgtgtaccagggcccccgagaggatgtgcttgaattcttcgagtccatggggtttaagtgtcctgacaggaagggtgttgccgacttcttgcaagaagtatgttcatatctcactgttcttttttctatgaacacataaagtacagtttttgataatatatgtctgtgcaaatgccgagcaggtgacttctaagaaagatcaaaggcagtactgggcgaggcatgacaagccctacaggtttgtgacggttaaggaatttgtgagtgcattccagtcgttccacacagggagagctatagcaaacgaacttgctgttccgtttgataagagtaagagccatcctgccgcactggctaccacaaggtacggtgctcctggcaaggagctgctgaaggcaaatattgacagggagattctcctcatgaagaggaactctttcgtctacatgttcagaaccttccaggtaactgtcattacttcaaaccaaaggggtggttgctatgtaagtaaagcaatagcagcatgactgactccatggtgttatgtcattacagttgatggtggtgtcactcattgcaatgacactcttcttccgtacgaaaatgaaacgtgattctgtgaccagcgggggcatctacatgggcgcactcttctttggtgtgcttatgatcatgttcaatggtttctcagagcttgcgctcactgtctttaagttgcctgttttcttcaagcagagggatctccttttttatcctgcatggtcgtacactataccctcatggattctcaagatcccaatcacgtttattgaggttggtgggtatgt

SEQ ID NO: 86645 - DNA, 1329 bp, Oryza sativa
tgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagttcaggtggatggctgggcctgtcgcaacgtgggttagcgttggacagcggatgtttaatactgcttaattattacaactgttttcgcattaaattcctgtttataaatgccagtatttatgcaaatgaaccactctagctcttctttgttaattccctgcatcatacccccatcccggtatgacttgctgagtacagtgggtagtacttagtcttgctctatttttcccaaccccagaggacgggtatgtgtcagatgaaggtttccccgaggagtaggcttcgtccgtgccgtcgaggatgcctgtggagtggtgttcccgctgcggtttagtcaaggcttaagctccagtttcttttgttttccgctgcatttttgtaagacctttataatgtttgtaagacgtggatctgtatgtcaacattgtcgtttgtgtaccccggctggtcctggacgggggttttaatacacattctgcttggaattctattcgggaatttctgggcgcgacatttgtacgccatatgccatgccatgtgcctcacatagagcccacatgcgccatatgcctgcacactgacccgtgcgtgcaatcgcgagggttagctctaataccatttgtaacagccctccctctagaaccgcgtagcccagcccaaccgacgagcgggctcacttacacataccacctcgcttacactttcgtcctcgcttcgtgtaaaagggttaacccgaaagtgacatggttggaggggagagaccatataagttggtttcactcatgctaaactagcaaggtggtactaaacatgcgcacacagctcacatgggccacacaggccttatcctaaatgggccaggatgtcacaaatatgcaacaagttttccttcttgtagcaaaacaccacccaatccaatcccactagcatcacattcaag

SEQ ID NO: 86646 - DNA, 3554 bp, Oryza sativa
gcttcgcctcacctgcccaccccagaagcaatggccaagtggagcgcgccaatgcagaaatcctcaaaggccttaaaaccaagaccttcaatattctcaagaagcatggcgattcatggatcgaggagttgccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgtagagatgacctcgactacttggaagagcgaaggcggcgcgcggctctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggtgtcccccggccgggctcggtacggctggccacgggcgatggcacggagctgccaaacccgtggaacatcgaacaccttcgtcgcttctacccctgaagggggggggtcgggtgtcaggttttggctcgggccaaccccgcacccccctcgggtgtgcaggattggccgggggctaccacacatgcgcatatattcctttttcctttatttcagcatttcaatagaagcagtttcaattttctaaaggttgtgtctgtgccgttttttccttttgaagaatcttgacttgaaataaggtcactcatgcttgaccttgccctcgggggttcggttcggtcagctaaaatcgccaaacggggcccagaaccgagccgtgccccggggcgtggtgaactccgggggggaatcggcaaaaacctacaatcgggtcacccatacccctcggtcaccacgttcccggcctggccagtctcgacatgtggatctccccaggcactagccccgacccgagccatccaagggcacgaacccttatttcaagctaagacgcaaaaggaccacggcacagatcatcctcatctcgtatgtatagcaaaataaaactaacacaaaaatttttttcatcatttctgattgcagattaagttaatttgtacaaaaaagaggcatgaaggccttagaagaaagaaaaagaaaaaagttaagattggcgggggcctgggggctcattctgacgcgcccaggtcgccggcctcgttgccaccgtcgcttgcactgctggcgttccccccctcgtcggagtcgggggcgaacgcgagccgaggggccgagccctcgaagccgttgacgatgtggtcggcagcaaccccgacccgtgcgcgcgcgtcgtcctcggtcccgggagggaactcctccagcgccatccatggagagaagttggggtcccgggcctggtaactcgccagcacgagttcgaccgctccccgcgcgaggtccctcgaggatgacttgatggtcttctcaagctcctcggggagttgttcgagaacccaggccatcctgttgaggtgcggagcgaggccttccagattggtggggggcaccgtcgtctggcctttccagagacccgcttgccgaccggcgcgcttcaggcgggagaccgcatcccaaagcatgtcgggcccaatctcgcccgccaagcgaagggcctcggcctccccggtggaggagtccagcgctcgctgcatatcggcgacggtgtgttcggcagctgcgaggcgggcggctaagtcgctttcgcccgcggccgccccaccgatatgcgccctcgcgtccagctccttttcccgcgcctcgaggtcagcagcccgctgctccagtgcggctctctcggcgcggacgcattcaagattgcggcgcgcctgctcctcctgcgccgcctcgcgaagggacaggctgtccgccagccgtttggtcgtggcctcagcctcctcgagagctcgctcccgctcagcgagtgcgtcctcgcggaggcggagcgcgcactcctcctcggcgcaggcggcctcgtgcgccgccagcgtcgcctcccggagagcagcggcggcctcgcggtccgtcaagcctttctccacggcgccggcgtgttcttccagcgccatagcacgggcctcaagggactcctcgcgccgccgggacgccgcctcagtctctgttacccgccgctctcgggcagcggcggagtcaaggactccctgggcggcgtcgagcttttctttcagctccgcctcccggctggcgttttgaaggcggagggcgtcttgcgcctcaatcatcgtggtggtagcgatgagggcggccgctcgctcctcctccacctcacgagcgatctccgtcagcgccgccttccgggcttcaagctccgagacgtgacggcggtgagctttacggcccacctccaccatggcgtccaccgagcgccgcccctcctcaacgcgtgcccatgcggcctcgagctccgctcgttccgcgcgcagggcctccacttgggcgctgaacccatctagcaccgcggtgtttgcggcggccaaggcctgcagaatgggctcggcgctcagcggggcgacggaagatgaggagaagagccgccttggagagaaggcgatgcggctcggccccccggaggacgtgctgggctcggggatgtcccccggacccgtttgatcctgggcgtcacccggggaggtgggcccaggcgatgtgcccgaggcctcgtcgcgagcctccccggaggctgtcgcctgagggttgcccgagggagtgggtgtcacgaccggaaataacccaacgggcattccttacgtgcgtgcattaatccttgtcccaggaggcaaggtacaccaaaagttgatacaattcagagtttaacaagcggaagcgtatataaaattattacacgggcaacaacggcccagcacactcaaagacaacgaaaaacagcggaagactagggcgacgaccacaggcgcttgacggcaggcacgagctagacaccaaagccttcatcttcaaggaactcctcatctgggcttgggaaaattgagcaagactgagtacaaccaccgtactcaacaagacacacccacaaatgcagaataaatgcaagggagtacaagggaattataatatagagggttagggttgcagtaaacagcatttaaagacatttagttgctcaaggccattttgtaaacacgatcctagaactatccaatattattaatcaaggccgtgaacccacacgaacctgccttaacccaaggcctacgatgattcggaccgaactggcaacccgaccctgggtcccagctcgtcccaggccaacccaggccaaccattccacattttagttgttgagcaaattttaagaattagaacactgacttgggtacattgctcggcttgcccatatccgagggctcggctattcgaatagatttactctgatcagaggtgtacatctttacccacaagacacatcttcctcacgtgttgcca

SEQ ID NO: 86647 - DNA, 1024 bp, Oryza sativa
gctggagaagtccggccggtcgttggtgctctgccttgacacgctggcacacatcacatagagccacaaactctgcaatttcccgcttcatgctgacccaccagtatttctccttcaagtctaagtacatcttggtactgcccgggtgaatggagtaaggactttcgtgagcttcctgaagtatcagctgtttaagttctctgctatctggaacgcatacccgctttccgttccatagggttccgtgttcatcctctgtgaaactagcggctttaccctgtttcatattcttgaggagtccatgcatgtccggatcattcttctgagcctcgcggatttgatcgagcaaggtgggcttggcttctaacgcagccaaaaatccgcgaccaactatgctgaggttcagggcttccatctgttgattaagttcgggtggaatgccacggacgttgagagtgttgcagtggctctttcgacttagagcgtcggcaaccacgttggccttaccaggatgatagtgaattcccacatcataatccttgatgagttctaaccatctcctttgccgaagattcaggtccgactgggtgaagatgtatttcaaactcttatgatcagtatatatttcacagcggttcccaatgagatagtgccgccagatttttagagcatgaaccaccgctgctaactccaagtcatgtgtagggtagttgccttcatgaggtcgtagctggcgtgaagcataggctaccacatgaccgtcctgcatgagcacgcaccccaatccttggcgcgaagcatcacagtacaccatgaagtccttgcgagtatccggcaagattaacactggcgaggaaaccaacttttccttgagagtttggaacgccttttcgcattgcgggctccacacaaacttctcttctttctcaacaactgtgtcatgggtcgagcgattttggagaagttctcgatgaacctcccgtagtatcctgccaacccaagaaactgcgaatctgagtgactg

SEQ ID NO: 86648 - DNA, 830 bp, Oryza sativa
acgaatccgagggagagagagaggggaaagagggggaaacgggggaggggattgcggggaataattcccccctcttgattgcatgcggggcggacgggagcggcgggattcgcggcggcggcggcgctagggcacgggcgctggcggcgggcgcggcgggaggagggcgatgacaggtgggacccacccgtcagcgggagtggcgggcgggcccgcctgtcagcggcgcgcgcgcgcgcgggaggccgatgggccgcgggagaggagagagagagggagagggaaatgggccgagccggcccaagagggaagggggggggaaaagaacttcttttagggttttctttttataaaaccttttcaactttgtttctttctttacaattattatttgtgctctgaaaattccactaaaatttatttaagcattttaggcttttaggaaatatacaaaaatcctccaagcctcatttgacttttatctttgcacattttaattgttggaggctttcacattgaattttaattattcttttgcacaattttgaggatagattttagagtcgatttgggacgcgacaaacctaccccccttaaacggaatctcgaccccgagattcggaagaactggcgaagagatcgggatgggctgccttcagctcgtcttcagcgctcccaagtagcttcttcttcggcgtggttgctccactggaccttgcaaaaacggattacccggttcctggtcctgcgctccatggcgtccaggatttttactggcttctccacgtaggtcaaatcttcgcgaacttcaatttgctctgagtcggcct

SEQ ID NO: 86649 - DNA, 1978 bp, Oryza sativa
ttttttttctttaaacattgtgaacaacgagatgctttatgggtctttctaccaagataaactgggaagagatgtttagagttcacttgtttgggaagcacataaacttagccctcatatgttctcttttgtgaatgactagaatgttgaagatgtacatgactagaaatctacagcagataaacacatttgagcaatgtacacaatttcaatattgaagaaagggatgctccacttgatgacttcttttttatgaaacgctagttggtgatattgccttacaacttgttgcagggttataccatccatctactgggaggtattatcagcaatttgtagacaagctctccattctggatcgcattatttggttaattggatctcgccgcagagaacgcaatgtaatacatctttgttgacatcattttttattgttgaaaaattccaatttaacttgaaaatacactggcaattgtatggtgtgacagattaaagaattagaggtgtgcggtatgccatgctactatcttttttgttgacattatttttgttattgaaaattttcaatttaacttaaaatgcactgtccattgtgctttgcaacaagtaagaaactggagacagcgttggcgtgccctggcaagcaaaattactgtttatgtttctattcttaaacactctaggtattatactgacttctacagtaattgttaattaacaataatttttgctaagcacaaacagagctcaattaaataactccccgtctggattcttgctggtttgcacaggcggtgcgctattggcgcgccgcgtcctctagtttatgtgaaatatcattttatgccatgcttaacatgcagagtagagataagaagacgcgtgcatcatttgtttcttttaagtggcattgttatttctttattttctgcaatgtgtgctatacctatgtggataatttatgattcttaaagagttcggctttccttgtctaggtggctaaagtgtgtcgatccattcattaatcataatatgtggactgctcgggaggagaagacgacttttaccaaccgtccaacaacaaggaatgtttaactggattaacattgcagttgcattgggtactcacaggacacctttccagtgcctcgctcgttatcagcaaagttttaatcattgtatattgagtaaggactgcgctaaagaagaagatcttcaacttaaagctgctgtcaacacctttggtatcaactggtaacttgtatcagctagtatggatggttgcactggcaatcagtgctctaataggtgaaaagtatttttgtgcctttacccttctcttgccgttgacttaattcatgtatcgttttgttctctgttattggttactttctgtggtcatgtcttacattttttttaaaatttttaatgtgctctctcatgcatgggttatagcaatcatgaatatggagtttttttttgcatccgctggaaacctaatggtggtggttgtgttgaatttgccatcccaccactaactcttgatttggtcaccatattttctgaatgaagttacatcatttgtgcaggtaggttgtaataaaactatttttatatgcaggtttagaacttattatatgtttatttgtaatccattacaatgcactgatttttagctagtattcacatgtctttacattgaaactctataggtggaggaaaactttaaaccctgatagctcaagagtgggtagatggtctctcgatgatgataaacgcctcatggttaagttgtttgggtctggaagctgaataaaattgctcagttcattcctggtcacgcacggagtcaatgcaatgaaggtaacttggtagttttaacatttctctccacagtttgggttggatggtaatgatagttatttggggacattaaacaagtatctgaatgttcttgatctgatatagatctttggga

SEQ ID NO: 86650 - DNA, 2010 bp, Oryza sativa
gctaacttgtacagctaatcaagatctacaacttttattttggtcacttcttcatccgacaaagtgatagtacgaatgtttacaaaattgacatatctgtgttgatatttataaaccaatgagagaaatgtgatttttgcgaataatataactatcactctatcggatgaagaagtaaccaaaataaaagttgtagatcttgatgagaggataaactttgttgttgaccatatttccatttgaaatcatttagtatttacaaatgttgattatatttgtcatattgtcaaaatcaatttcaagctgttgaaacaaagttatatagataaatgaccaaaataaaagttgtagatcttgatgagaggatcaactttgttgttgaccatatttccatttaaaatcatttagtaattacaaatgttgattatatttgtcatattgtcaaaatcaatttcaagctgttggaaacaaagttatatagacaaatgaccaaaataaaagttgtagatcttgataacctctacaattttgttgttgaccatatttcgatttgaaatcatttactatccgaaaatatgttatgactaataaaatgaattattatacaacagctatatatcttgtactcacaaatataaagacttgcctggaaaatggaaaaatagtcatcggtgatgggccttagttcaagcccgatagagattaatctatctctatcgggcattatcttagggcccgtcacagatgagtcatccgtgacgggcctaaatgcaatctcaatcgggcattagtatggagcccgtcaccgatgagtaatctgtgacgggccctacggcaaagcccgattgagatagattaatctctatcggctgtaaactaaggcccgtcactgatgactcattttccatcttttatttgttgtgagtgcaaaatatatagcctatataatttttattttggtcattattctgtataatttttttcccaacagcttgaaattgatttcgacaatatgacaaatctaattaacagcatttgtaaatactaaatgatttcaaattgaaatatggtcaacaacaaagttgatcctctcatcacgatctacaacttttattttggtcatgtgtaataaaacaaaattagccatattaatgactacacatatcaagtctatgcaataaaacaaaatactttattcattacaatagataagtacaaatgcatcagccacaaggttatgccttcggtatgatctgaacgagcatatgccacaggctcttggggatcatcgtcaaggtcaatgtgaggtcttatatgaagattatggttgttttcttcttcatcgacgacgttgtcaactcctacaattcggcgctttccatccctcacgatgtgcatcttcttgtttgaagggtcttttatgtagaatatctgctcgacctgtttcgcaagtacaaatggttcataggcgtatcccaccttagatagatctactaaagtgaaaccttccttgtcggctttgacaccagtgcgtagattcacccaacggcagcggaacaaaggaaccttgaacttgacgtagtttagctcccagatctcctcaatgtggccgtagtatgtgtttgacccaacttgatcctggaatgcatctatacggatgccgctgttttgcactgtgcttttgtcatcttgtttgacggtgtaaaatgtgtatccatttatatcgtatccttgccatgtgtctatggtccaagacggtcccatccccaacaactgtactgtctcatttgggacaaccatggacattgtcacacgattcttgaaccattcgttgaaccgagaattatgttctctgttaatccatgcatcagatcgccccaagttctcatctcggattttcgctaagtgttcctcaaagtatgggccaacttctgccatatgttggagcatagcgtaatgagcctgcgcgtacgacgcttgatcgggcctaattcttttccttccgattgt

SEQ ID NO: 86651 - DNA, 982 bp, Oryza sativa
atatacatacgcagttacgcacacggcattgtcaagaaggtgcaagaaaaagttgagctggtatttttgaatttctctcttctttgatacaagaatcttactacatgtacataaagtagtttttttttttggcaatcttcagaagtttcttttttacaaaaagacaaaaaagagctttggcttacaaatcatgaatttgttactcaagccaatatatgtagagatgaatggaaaaaaagtgcttgccactccaaccaatatatatatatatatatatatatatatatagagacacacacagccactctagccaatatatatgaataagatgaaaaaaaatagggggattaagagtccaatgtcctaaccgctagaccatggaaccattcgttggtacggagaacaaaacaaatctaatatccattatatcaaattcaggaacccatttccacataaattccaaggatttattctgacattaaaatggaagccaagaaccactgattgatgctaataacatgccaattatagattctgaaacatgaagctccatctcagaaaacaaacgtatacacacaagtatgaagcatatatatttacctgaagttggggtcatccctgtagctgacaaattcagtctcagaaactgctactccttcctcttgagaggaggaagcagcagcaactgcctcttgctccttggtcaccacagaagcagaagagttggatgagctgctgctgctgcacagaatgctccctctggccgcctgtggatgcttcttgcagagcagtgaagagctgaggttgcctgtgaggaagacggggttgtggacggcggcagaagcaggtggagcagggagctgcagccacagggaggccgccattgttgcgcctcctgccctctcctctgcttcctcctcccggtgaggtgagagagagagagaaatggaggtggaaatttgggggtggggggggggggggg

SEQ ID NO: 86652 - DNA, 3705 bp, Oryza sativa
ctccaaataagcgtagcatcaacgagcacattgcacacatttaacactacaatcaacaaatcccaatttgcaacggtcaaaatcacgaaatttgcaaaaaataaaaaattggttctaagggttaccctccgatctacaaaattccaccaatcaaaacgaaaaaaaagaggccacaatggaggagaataccttgctcttcgattagcccaaaaaatctcatgaaaaacggctccaaagtgagtggatttgaggaggtaagggaggggggagagagagaaagcgcaacagccctgctcaggctggggaggggccgaatgggtgggtagggggagggggtggggcccgcgcagttaagtgttgcccaccccccgaggggagcgcgccggtatggctggcgccaggggggtggggggtgggtggacggggcgctgtcctcctaccacatcagcgcagggcggccacgtggtgccatagtggcacggggacgacgccaaagatgttggtgccgtccagttggaccacggcggcagcgcctctggtgccacaaaaagaactattcctggaataagtttttccaagggtctctttgtaaaataagttttagaaaaggaccaaatcgtaaaaaatctagaagggtggttgggggtaaaattagttgaaaattaaatgaggtggttggtaagagaagtatagtactctatacattgttatattcaaggacaaatttcaaaagcttgaagtccttatatttgtcgacggagagagtagctttatatttcatactaaatatgaataaactttagaaacaatggttgcacgtagacagttgctgaaccgactctagcagatctggaggaaaaaaaaaagaaaacttaacacacctaaacttgactctaacaatggttgcacttatagaatcagtagtcactcgagaaacagtttgtgacttcttgtagcatacacacatagggggaatttacccacctaaacttagtctttctaagttcacacatttaatttgagaccataggatttgaagtgttattaagaccatgctgaatagtgcactaccacggttaaatatttttgcagaaaaaatccattaatgaatgaaactttctgaaaatcataacacaagtatactgattctctcttactagattagtggtggtgacatatatgtagttaaagaaggtgcccttgattgataacccaaaaaattagtctaacatttgaaaatataaacgctgtaactgaaattcggataagcccttaagaaaatcttattcttttgcatcaagcttttgtataaagtataaactgactaactgaggtagtccaacctgaccatatacatcactgtactgttcaagtagaatgaacggcaaaactgatgggcagatctagctccattctgcaattgaaaatcacatattagaaaaccttggaactgatgttcttttttctttttacaggctgacatatactgcaaaattactctgatagtagtctaatataaaggaacacatgatactaagtacacatgagcacgtaacaaatgtatctaatgtcacaaaattgtattcgagtagatgaaataagttttatgacctctcttagtatgcgagaccacttattgtatgcaataaccattaacaggtggtcagattgtttattatctgctgtagaagcagatccatcaaggttttcattcatcaatgaagcctttgccttctccacattttgcttctgcattatcaatgaaacaatgtcatgatagtgcatatccagattatataaattattgaccacgataatatcataatacctcatcttttggagagatgaatggggatttataactcagaaaagcagcaacagaaagaatgggagataagcagccaaagatagcaccatagagcatcatctgcagtcgcacagaagacaaatcaaagcaaaacattaaataggtaaagtactacaaatgctccacaaatcgatggaacaaacataacaattactgtcattatttgttaataacatgcagaaactatttatttctatgaaccctgaattatctgtatagaactataataccattgggaatgctcaaagggccacagatatgaaaaataagtggtaaaactcttactgttagtcaattacagaggtgtgaaaaaatacagtattgcctacaaaaattactgtgcactagagttaagtacataaaaggtaggaaataaagacattccaaagggacatgaagaacataatagagttgtgatgtactgtaggttcttctttctttaatggaatgacatgcagttcccatgggcgttctcggaaaaaatggaacataataaagctcactgaagtttattgtgaatagggcactgtagtgaagaactgaagattaaagttgtagttaaggaatggaatgaaaaaaaggtatttcatatggaattttttttatgtacataagaatatagattaggcatgaaaagggctgggctgtctttgtttgcacgcagattgaagaaaagaaacaacattaacaactatctgctacttcgccatttaacatgacaaacaaaatctccaatgcaaatgtgaggttagatacagcaagctatcttttcttatttggaaatataaaaagttatacaactctaatgcctacaactaactcatatatttacatacattgaagaatttatggtgatattgccacacagccatgcacagacaaatgctagcaaacaacaacatgtagctagttactatgctgaaatgtatgcattaaatatctatgtcacttttgatgaatgagccagaaaattatattttagccgcacctttccaatcaaaacatcaactggcaatttggccaaatgatagccaagaggtgataattcctcatgtccttcaaatgctccaacctacacatgacaccagacagtataaagtttggttaagaactacaaaaggatatgccaaaaatgtttctgctactaatatgcacacatgaataaagatttatatgacaaaaggcagaatagaacctgatataacaagtcaatagcagaggagatagcttcttctttagggggttctatggcctgaaacaatacgatatgaaatatgattatttggcatcacaatttcacagctgacacaaacagaaagcagaacttctggtaaagaaaaaaagtagaacagatagttgtccacaaattcctagcaaaaactgcatcaactaatgatactgcacaaacacattcagagaagcataaccgttcatacaatcttagagagatcatgcaagattgcatagatgcatgtgaagaaaacaaaaatagacaagtgatgaggataagataaaatatacctttaaaagaaatgactttatgccacccagatgaagtgattttatttgcaaacacagctcagtcaatggcatccgcagcatctcaggcaccttcaagcataatagacagaaatatcaaagcatgatggttacagatgttgcttaggacaattgtacttgtccttagcaaaactattaacataaacatagctcatgttcgtaagcaaactcatttttttatatgttacagatactaaaatatggaatctctggtgcagaatttgaatttagtatctttttgtaactagagaacctgaaatgggcgcatcattttttca

SEQ ID NO: 86653 - DNA, 1178 bp, Oryza sativa
gccgccaccatccgacgacgtcgccgccattccattttcatggtcaaactcctccgccttcttgaccatccgatctctcaccctgctaccccgatcgccgccacaaatggcgctgctgccgacgccatcgacgacgacggcgccgccccccaccaccttactcttcttggccaccgccgccgccgcatcaccaccaccaccaccatcgatggcaagactcaacttcaagttcatctactcctcgtcaccttgaaatcccaatcgatctccaacctccaagagaaacggattgatgcaatatatcttcttcgtctgttctccaagctctctcgcatgcggcaatggagatcaatggcggaggaggaggaggaggaggaagaggaatgggtggaggcgaaggcgagggatatatatataagcgcgggaattggaggggaatctggcgcgaaatctctcgatcggcgtagctttggatgcaagaaatgcctatgcttcgcggacgttttggctggactcgccattggattccaagaaatggatatgcggttgggtcgtttggctttcctctttgtcctctgcaaaaggatctatctgtctctctctctatgtgtacctgtcatctgtcgatattgtaccggttccactgctaggctaggctaggctagctatctccctctctgaccctctctttctctggtctacatgtagcttggaaagaaattgttcattattagtgtttgtgttaacaatgtgtgtgatagatgttgacaattagttattactcatatatagtagtataattccagtgtcttagtatattgtaccaatgtttatgctttgggttcaattgctatatgtcatgttcataccgcaggggtgtgcttctacactgttatgcctggtcccgtctgaccatatgggcatatatatatatatatatatatatataaattgctcatgacaagcctcgaccgatgcaattttatattctgggggaggtaatgttcagacttcacacttcagaagtactccaatatagtttaaggtttgtaagctagctttgagattccactatggttgttactagtatattacataacaagcttaacattgactcatgcaagctatagcatcatcagcgtgtacgtcaagaacatggagcatacgttctgtggact

SEQ ID NO: 86654 - DNA, 2423 bp, Oryza sativa
gggaggcgcggcggccgggaacggcgtgcacgagctgctcgagtgccccgtctgcaccaactccatgtacccgccgatccaccaggtgaggttctcgcttgattccgcgctcgcatacgcgtcgtgtgggatgcgatccgtggggggttcggaaaagagggggggggggggggatctgtgtgcgtctgggcttgggagcctcggaatcggggttgaattttagagcgaaacaaagagaggaaaatgtcgttttcgccatgcctgtcatgatttgattcctcttgtgattggagcatcatatccaattcgatcattgatacaatgatactggcacaatggggggtagacttcctgttggtcgttcagaatttcctgggatcttggtgttctctgggctcccgattggtgttgtgtattcctgaataatttcggtgatctgttctgttattctcgtgcacgaattgctgacttagcttatcgatcggccgattattgttcaattcctgcattatttttctagtaattatagagctcctttttgacatatagtcgatgcctaagaagaagcaggaatgttgaatcttgcgaatgatcaactgttagaattagatggctaatatctattataatctggaatgagctgccaaaataatcatgccttcaggtcattcggtttatctttagcagaatttataaaaaatagtagtacctttaacatttagccatggtgagttttcccttttagcacaagttataaaagggaaggaagacgacggtacttgtgaagtatatatgttgggtagaagtatagaacttaattaacctaaaaatggatcattcgaagatccttagagaatacatgggctgaatttcaataagcaattctaaccatacactccctttcccaattcgttgtgtcagattgatctagtggtgtaaacctgaagagtctcattatgtagttctgaacttctgatctttggatatgattctcatctctttgaatttcattgcagtgccaaaatggacacactctgtgttccacctgcaaagctagggtgcacaaccgttgccctacatgcagacaagagcttggtgatatcaggtgtttggccctggagaaagtagctgaatcgcttgagcttccctgtaagtactgctctttggggtgcccagagatcttcccatactacagcaagataaaacatgaagcgcagtgcatgtttagaccatacaattgcccttatgctggttctgagtgtgctgtggtgggtgatatcccttatcttgttgcccatttgagggatgatcacaaagttgatatgcatagtggttgcacattcaaccatagatatgtcaagtccaacccacgagaagtcgaaaatgccacctggatgctgacggtaagtacctatagactgtggcgctcttgttattcttattgaacttataagaccttgttggtagagataagattatgttgtgcagattgtattatagaaatattggcacattgaatcgctgtctggtgaggaggtcttccactgtttcgggcaatacttgtgcgtgcactttgaggccttccagcttgggatggcgccagtctatatggcctttctccgtttcatgggtgatgaaaatgaggcaaggaactatagctacagccttgaggtcggcgcaaacggcaggaaaatggtatgggagggcaccccccgaagtgtccgggacagccaccggaaggtgcgggacagccatgatggcctcatcatccagaggaacatggcgctgttcttctcggggggcgaccgaaaggagctgaagctgaggatcaccggccggatctggaaggagcagcagaccccagacggtgcctgcataccaaatctctgtagctaagcaatcacaacattcagaagaaacaaagaaactcaactccactttgcggccggataacatctatcccgttgccatgtcttactgtttttttgtatgctccgaggcaacgccttcatgttgtacctttgctaaacaaacattaggagggtaggacgctcttgtaaagtaaaatgtgtgtatatggcaccccatatcttacaggttggctgatcgagcgttcaagctctctgttgtcttcagttcggctggatctgaaactgcatttttgcttcctgttattaaattgtgaattccattagtcccacaactgcaagcaaatttcagttatctgcatcagcaaatttcagcattggaagcgaagggtcttgatggagatgtgactatttttcaagtgatggctctggttattctgaagagctacaagttgacagcaaaacatggttgaacacttgattttgatctgggagatctacgatgatatcagcagttttgatcagttatcagttattctggacgattggcatggg

SEQ ID NO: 86655 - DNA, 1276 bp, Oryza sativa
tattgggagctctagtgctaatcttcacaggtacaagctggtggtttctttacagcaagcacaacatacccatgtcaatggaggcaggctacaggatggtaacaagccaattcaggatgttcacgtaccgagaattaagggaggcaactggaaagttcaaggaagagattggaagaggagcctctggtattgtttacagaggagtacttgaagataagagagtgatagccgtgaagaggctaatgaatatttcacatggtgaggaggaattctgggcagaaatgagtattattggaaggatcaatcacatgaacttagttaggatgtggggtttttgctccgagggtcaacaaaaactactggtgtatgagtatgtggacaatgaatcactggacaagtatttatttggtgatgtaagtgctgagcgattgcttgcatggagccaacggttcaaaatagcgttgggtacagctagaggtttggcctatctccatcacgagtgcctagagtgggttgtccattgtgatgtaaaaccagagaacatacttctgaccagagattttgaagtgaagatagcagactttggactagccaaacttgcaaagagagacagcactagtttcaatttcacccatatgaggggcacaatgggctacatggcaccagaatgggcgttgaatttgccgatcaatgcaaaggttgatgtctacagctatggagtagtgctccttgagattgtgacaggaatcagggtttcaagcggcatagtggtagatgaaaggcaagtggagtttccagagtttgtccaggaggccaaaaagattcaggctacagggaatgtcaccgatttagtggatgacagactgcatggacactttgatccagagcaagtaattacaatggtgaaggtagctctttcatgcctggaagaaagaagcaagaggccaacaatggatgaaattctgaaggctctcatgttatgtgatgacgaagacgactaccatcctgcctattcatattagcctgcagctactgcataaattttgagatgtgtacgtaataggatatcctagatgatgtaattataggcatagctagatatggtgacaagggcttattgtttatgacattggaatgattatattgcataatgtaacaagttttgttctgtagatgaaatgagtgaatgaatagtatgcagggctattccagaattgattggtttgttcgttttctctcaattatctctacaagcctacaaactttaaccgtcatt

SEQ ID NO: 86656 - DNA, 1272 bp, Oryza sativa
aattatataacctggtttgaaaacaagcccaaagttgttcaagttcatacaaaaacaaaagagaaaagaccactgggatcaccagctttccaacaaaggcatcacacatctgcctcagtgctggggactaactagtatctgggttggaaactaactagtatctggcaagtgaacttgacagcttcctctggtggatggcagtgctggggactggcaaatgatactggaggagcagaatcagggccaacctctgggcttgcaaaggcaacagcatttctcgctgtcatgtccttgctccctcttgcatctctcactgaagcaagaccctcatggtctcttctatcccttgatggcttgataatgggccacagctgccaggcagcaagttgcctacccagttcaggatagccgacaactcagacatctagtaatctcctgccgaacttggcctgcaaaacaagtcagaggtttcaggggatgattagccaccaactagttaactgctcaaagcattaatgatatttctatctgtttataaccaaaaacatcctgaagagttctgttgacatcagtacaaaatttgatgcagggtcatgatggtcaggacgtcatatccaccctccgaaatggttcagcagctgtgcatgctgctgctttgatgaaagaaagaggctacacccatcgccgtagatctcggcaccgtctcactcctggtaccgtaaaatttgctgctttccatgtgctgtcccttgaaggaagtaaaggtctcacgatattggaagttgcagaaagaatccaggtttgtttccacacagatatgctagctcaattttgctttgtgattttcttctttttgttctatagttgaatgaatttactcttttttatgtttagaaatctggattgagagacctcacaacaagcaagacgcctgaggcatctatagctgctgccttgtcaagggatacaaaactttttgagcgaactgctccttcaacatactgtgtcaagtccccttatagaaaagatccagctgattctgaggttgtgctgtcatcagcacgtgaaaaaattagggcttttcagaatgtgatttctgactctgaagctgaaaaggaggctaatgatgccgagagggatgaggattctgaatgtgatgatgctgatgatgatcctgatggtgatgatgtgaatattgatgtaggagatggcaaggatccccttattggtgttaaagaacaggatggagtaccgattacaactatagtagat

SEQ ID NO: 86657 - DNA, 3884 bp, Oryza sativa
catctatagctgctgccttgtcaagggatacaaaactttttgagcgaactgctccttcaacatactgtgtcaagtccccttatagaaaagatccagctgattctgaggttgtgctgtcatcagcacgtgaaaaaattagggcttttcagaatgtgatttctgactctgaagctgaaaaggaggctaatgatgccgagagggatgaggattctgaatgtgatgatgctgatgatgatcctgatggtgatgatgtgaatattgatgtaggagatggcaaggatccccttattggtgttaaagaacaggatggagtaccgattacaactatagtagatagcacaaagagggaaaaagaaaaagtggatgcattaacccaatcgagtgatcttactacatctggaaaagaggctcccaagccttctttaggcaagcccagttcagcaaatacttctagtgattcacctgtcagagcctcatcagagtaccatgaagtacctcctactgatgctgaagataaggagattgatgaaagtaaccaaggtgaatcttgggtccacggattagcagaaggtgactattgtgatcttagtgtcgaagaacgcctcaatgccctggttgcacttgttagtgttgccaatgaaggaaactttattcgtgctgtgctggaggtaataatcttacttaaaatatccttcaatctttgctatttttctcattggataacacctgatcacttgtctttcaggaacgtctggaatcagcaaatgccttaaaaaaacaaatgctggcagaggcacaacttgataagaggcgttccaaggaagagtttgctggcagagtgcaatataattccaacatgaatttgaaggctgatgtaaatcaagaaaatgctactgagagtactccaactccatttcataatgttgataaacataatgatggaaatacaggggttgtggataataataataatgagataattgaccataacagtaatgcagctaatgcatcttatgagaggaatggtttagggcaggacatagctgcaacaccagatactttgtcagttcagcagtatgcttatgctgataaaacacggtctcagttgagagcatacattggtcatagagcagagcagctctttgtttatagatcgctgcccctaggacaggatcggagacgaaaccgatattggcagttttcaacttctgcatcaccaaatgaccctggttcaggacgaattttttttgagtgcagagatggatactggagggttcttgacacagaggaggtagccttttcttttaaatatctactgattcaacttgattactattattgctctcgagtaaaaataatgtcacattttcgactatgtgacgtcaaccttagtgaatcatgaatatttatttgtattagacatactgaaatggtacatgtagatttatcggcttatcgctaaaaatgcctccatgaaactatagtttccccgtgtcttacaaatatattacaagagaaataagttgtcatttacattttggatgtccttgaaactgcaagttagattgatatgctaatttgtatttctatctttttctatacgctataattgttcgaatgcaatgtgttaatccacgtatgaggattgtaccatattcacattgcttgataaacatatgaatttttgaaccaattacatgtccgcatgctccatgcacttatgaggattgtaccagattcatgtttcttgataaacatatgaatttgtgaatcaattacatgtccacatgctccatactggtatctaatatcataatgccctctggtcttaaactacacatagtgcaacagcaactgcttgttgaaatataaaccttatgccagtttttgccaccaaatggtgaattcccttgtacttgggcttcacactgagctatttatagttttgagtttaagacatgcataatattgttacggagattatctgcatttttttttaccacaagtgcctgctcttcatgcttttgcattacagtggatgtgtagttcatgataacctcattaagtagaaatgtgattgatctattgtcaatgtttttttttgcataatgagcagcattttgtgccagaactgtacataaatcgcatgctctctaaactttggacattgtatctaatgaaaatgcaggcatttgattcattagtagcttcccttgatacacgtggcagcagggaagcacaattgcattcaatgctacaaaggatcgaaccaacctttaaggaggctattaagaggaaaaagagtgcagttgtagaacaatccgctggaaggtatctaaagaatggagctacggaaatgattagggcaagttatcgtagtgattttggaagcccaagcagtaatctttctggtgtcacttctgatagtgctatagcatattcagattctttcaaaatagagcttgggcgtaatgatgttgagaagactgctatttcaaaaagggcagatgtctttataagatggatgtggagggaatgcaatgattgcaaattgacatgtgccatggagtatggcaagaaaagatgctctgagttgatgcattcttgtaattactgctatcagatttacttggctgaagaaaggcactgctcttcttgccacaagaattttaaatctattcacaatttttctgaccacgcatcacaatgcaaggataagctaagaactgatcataactggaagatgcaaactgcagatcattctgttcctataggagtgagattgctcaaattgcagttatcaaccattgaggtcaagtaacatgttttatgtttgtcacctgcttctaagttgttttttttcttttaccagttgaactgtttggaaacgtgttaatatttttgtttacaggcttctattccaccagaagcaattcaaccattttggactgatggttatcgaaaatcttggggtgtgaagttgcactctacaacttcgttggaggaaatatttcaggttctggatttgctctcctttagttaaaccagtttcctttttgactggcatacatctattacctttggttgcaaacttgaacatttgctggctataaatagctggattacatggttgacttgaggccttaaacaacctcaaacaagaatcaattgagaacaacctcattctttgttaatacatgttgaattgctaaaatagcttgtctcaccttagttatcattttatgatgcgggattttccatcaaattgaccaggcacatggttgattaaaccatgtaattttcatccttactgcagatttgaattaatatattgaactaccagtcccaaggatgaaagacgccaaccattttctttaagaatttacaatttattgatggctttcttgtatcttctttctgtttccttcttctgaaaactaatactacgggggtatatttataggcaaaattggttctgtagcatcgaaagttcccatttttacttttatagcatcgaaagttcacagcttactagaatagcatcgaaagttagctctgtttctcatatttagcattccgtcaacaactctgttagaatctcatcggtttcctttttttttaaaaaaaaacatgtgaaataccagccgtgccctctccttcttccacctccagcccccctctcctttctcttcttcctcctccaatgaacgccaaccggatgccatcctcgaggctcgagcttgtggctgtcagcacgctgacgagctcgaccatctgcacgtctgcacattctcaagctcgaatgaatggtggtactgcagttggttcggctgggcacatgccgatgccacagatggaagtacacggtccatgaggacctgttg

SEQ ID NO: 86658 - DNA, 4104 bp, Oryza sativa
aaggaaaatttaatagtagcaaaaaatatgtctacaattaaaacaatctgcagtgccaatatttatatcagaagagcttattggtatgatgtacactctcatagtaagtactcacagtagaatgaaatctaaatttcataaaagtagcgctaaaacatataccatattcagctgaggatattaaatttggaaaactttacattcaaatattggaaaattttaaattcaatgtcaagcaagagtttacattttgggctacatatttaagaattcaattagatgtacagaaagttcagaagggtctgtaactcgtagaaactaaaacacctaaaaattttgtcatcaacaaatattaaaattcattatctaatcatgtttataaatgttctgcataatttccaacttagtaacttcgagggttttattacagataattgagtcaacacatgtagtcaaaacggaggatagctggagaaaacattatgtaatattactgcaaccagagaaaaaaaaacctttttcttttttatagtagtagttgtggaggaagttccgcactttcacatgtttactgccagccaagagcggctgattttcaaaagtcaaagtaagaccatgcctgagaaacacaggaaacaagtagatgtgtgcattcatagcttacaggagcatgtatgatacataaacatgaagtaataccgaaagggaaaacatatacctagtcttaaaataatctttgtaggtaacaacagtcccatcatgttgaggcaaacgggaatttgcatctaagtcaagaaacccactaataacataaaagatgttattatgaggggtacacacaatggaatttttaaggatgcacctgcagaaaggaccatcttttgtctgcagtaaatcaatatctctacaagaatggcaatgtgtcatatgtttgttgttagcttcatatattggtgaggatgagaacttcatactgcaccaatcaattctgccagaaactaaaggcagaagtagatagactactccaataggcacttgcatctcatggaagtatttaataccattgctaacctccaaatggtcatcaccaataagaaacgaaagaatagttgtctgaaatcttctagcaataattacctggacaaacaaaagttatatattctcaatgaaatggtctaaacaacaatagcctagttatcaaagaattagagaacataaattgacaatttacctgttcttgattgagatggatgatgccaacatatttcatggtaacactagcattgtcttgcccacctggcaatttaaatgagctagaagtaaagtcagatcccaaatcacacttcaaagctaacagtatgtcagttggagaagctgttttgggacatccttccaatgagatcttatagcaataatatatgccaagacgagaaaaggagcgccaattatccacaaattcttctggaaagtaagaaggctgctcaattttgttctcaacaactatatgagaaacattaaggcaacattagtgcaaagccccaatatatatcacacttaaaagccaacttcaaaaattacgacagatcttttactttcaagattagtgaagatatcaaatttagcaaacaaaataggtaaatttgaacaaactacgttcgttttgggacaggcatcatgacatgtatgtatccactagaccagtaaattatcaagtccatgaaaactatcaagtataaatcagtaatgcacgaaacacatttcctattgtaccttcagatataaccttacccaccatgcatcaagttttccttaaaacacatggtaaataattacttgcaaagtgtaaattgagtttaaaattttgatagcacgtgtaaaatacttttacttatgtgttactgcattatcataactcgcacaataaactgctccctgaataatcaattggaataaaatatataaattgcaacaactggaacaaattgaattaaactgcttagctgaataaccataccgatgtcaggttcttcatcacatggaacatctaattctggtaaaagagaatctgtgagtgcaccaatggcatgtagttcttggcaggccttaagacaaactgtctccttgagaatagaaccttctccttctacattaactgtctgcacaggactgctcttaggaagatgcagagtgcatgtgccagatgccttgtctatatcgaacgctggagttgactcgacacggtaataggtatcctcgcacaaggtgttctcaagtggttgacaagaaattgatcccaatctcagagattcctcccgcattatttgcccacttgcgagaaacttctttgcattagtatgagcttccacatcccccctgatgcagaaacgtgtataatgcacagtaataaaatgcaaaataggtcaagtaacgatgacaacaaaaggaggttatcgtgtcatctaaaatcagaaagatgacggataaatccacagcaagtgcctacaatagtcataggatctgaccaggtccaccatccaagagaattttggcagttccatactaaaaattcaaacaattatttcagttgaaacttattaccaggatgatacaccagttacctctggttctggaaaataccatcaggaaccataagtcaattttataataaaaaaaagctttataaactgctattactccctagtataatccagcttggatttaagagtcaacgttaatatttagtgccactatggatgatttgattcactacaaaaaccaactgatgaaatgggaaaagcaatcactaatataggtaaccactaacaatttcctggcactaaccagggatttttttttttatccagtgcatgcaactcttttgatgaaatgtgaaaacagtgaacagagtccatggaagacacaaacaattcactaaagatggaacagttaacaaatttgcacagagaacaaacaaagcaacaaaattgaaaacgtgccttccgacaagtaaaagatagtcagagttttccatcctagctcgaccacgggactgtataaagctgcatactgttgctgatggatcaaagcgaattaccaagttacaacttggcacatctaaaccctcctccaaaatttgtgtggcaataattatatgtacctgcataaccatcattctctcatcagagaactatcatactatgacttaacagaatgcctatagcatacttaacagaatgcctatagcataaaatacaagtaccaatatcgaacctttccttttcgaaaagattcaacaatttctgtatgatttttcctgctctgagatagcaaaccaggacggcttcctgccatgtgcttaacattccacccagacatttgatgaatagatgaaagtaggggctctaatactatgcttgtgataactctctgaacaaacacaatgcatcttaagtcttgcatatgcctgagagagagagagagagagagaggtgttacttattgaatgatcaaaagaacaaaaagttttagtacaagaaagtagaagcataagcatctcttacaatcaccaagttacttattgaatgtcgttttgcccgcgcggtttggtctttaatccagtttgcttcgaatattagtttacctaatagtacaactcatatgtttgggcattggataagaagacaaccacacaatttgagatctttggtcttattaggggcaactaccactatttggtctatttggctttgcagaaatgatgtggtttttgaaaggaaaaacatatcttcccctttgcaggttatcttttttattacacattggctctgctcatgggctatccttcagaaggtcaatttgcggggtactatcattgcggcttgtcaacacttggagctagtggccatggagttttctaccccggcgcatgggtggcgttctaggctacggttagagggctcctgaagttctttttgtccctgctattttggatgatgagtttatgttttgtttctttcttgttggctgtgtgcactctttgggtgcagaagccagaggtgctctcagaataattgtatcacttgatagaatttactgagattaata

SEQ ID NO: 86659 - DNA, 3877 bp, Oryza sativa
aaaagagacatctgtgctaggatctgaaggacttaaaaattacttgtaatgttaatcaggagaaaacaagtactattgtattacagcaactgttgattgtgatacatccatattatgggctatggcagtgtagatcgtattaacagtaagtacaagaattgcatagcatagggcaaatcttttgaaataagatatgtagctataactgtgtaagaaattaaaattctatagaatcaggttttacaaattccatattatacatgagaacatgatcaatatgtggtagtcagccaaggctgaaaattaatacagtataacatcaattgagttataaacatttccattttgttggtttgttatgcagtacacgtgcattcaggattcagcagcaaaagagtgaaccaacatgcgccttgtaccacgctccagcaaagctaagacaggaacagaataaagatgatggtatacaacatcacagaaaagttttaacaagtttcgtataaacatacattgcatttccacaggtattgattcttcgtgaccatctgcctttgttatgttaggtctcatgaactcgacaatgtaagggccggagaccaccaactgtccatcacctacaatattcccctgtttttgtggggttcacctagcatacaaactctaggatagcgttctttgagacctgaaatttgaaattgctatatacttttgtacttaatttgctcccatggtgaaatattttttttcaagataaagaaagtttttattgatcttagacgattacataaaggtgatagaatcatattgagaacacttcacctctgtataactaagatgcgcaaaccaacatggtcaataattggttgcaaatataacgtattctgacataattaagcaagctggagaatttctataagtatatatgcacacatgatgcgtttattgagaacacttcacctctgtataactaagatgcgcaaaccaacatggtcaataattggttgtaaatataacgtattctgacataattaagcaagctggagaatttctataaatatatatgcacacatgatgcgtttaaatggaacagaaacattacaagttactgaccggcatgttaaatctataaatgatatgcttcatcaaattggcaacttatcaaatgtgcaaagcaaatgattccagaaagaaacaaatatattttaccatcactttaatgatcaatgccactacttctccccttgctacgatgctaagacgatgcgatcaggccataaagaggagacaaatcaatgtcactcgttgagccaataagcacattcaaattattcttatcaccttatactagtggtaataaagaagtagcaagcaggaataaaaaatatatttcatcataatatactagtggtaataaagcgatagcaagcaggaataaaaagatatttcattataagctagcctagctactcataaactaattgaggcagaaatttatttaaaacttattttcacctctcacctttcactagtgtgctctctacatgggaagagttgtaatttgactacgtataaatcttttttccattaaatactttttacgtccgaaattctagcattatgcagtccttgtctgcaggtgatgcaccctaattaaacctaatacatgagtgatcccgatttgtctgtgaatgatatgtccgtccacaattaagcctgcacatgatatgataaccctgaaagctcaatatatcataatcttaagcgtacgcgtctctcctgatgcaattatacttaactaactccctaatagctggctaggcttgatcacaattctctctttagtgagctatatagctggcaagcctggcatcacagcccaatctgcaggtgtgcctaccctttcaaaatgaaacgacagatgctattaaattcaggcgaataatctgtctcttatatgcatggattgtgcagcacagtagtgcattatcataaaagtgacagctcctgacgattttgcatttgttcgccacaatctttctgatgcgacataaaaatgtactaatttgctctcccaaacaaacagataaaactttcttgagacaacttattccatctgaataccactcctccatccatgaatcatagtgctagggtatatccaattctatactatattgctatattttagaaagtgctaggtatatccaattctatactatattgctatattttagaaccaagggagtacttcttttgttggctaaacctggttgcagctgcactgtaactgcagagacactactgtgtggtgtacactgtacagtgcacccgtggttcagtcactgaagttcagtggagcacccaacaactaacagtggctaaatctgtggatgatacaggtatagtgcaatagtaccatgttaaatctgcttagaaagttccaaaaggatttttttgggaccttttccactgaaatgttatcttactacgcggactaggctattagcctattagcactatctattttgaattcttgcgcccacaaaagttcgttaggaatttattcttctgagagtccaaaatcatatactccttccgtttctaaatatttgacaccgttgactttttagcacatgtttgaccgttcgtcttattcaaaacttttgtgaaatacgtaaaactatgtgtatacatataagtatattaaacaatgaatcaaatgatagaaaataataattacttaaattttttgaataagacgaacggccagacatatttaaaaaaatcaacggcgtcaaatatttagaaacggagggagtatatatatatatatatattgacaataatatttacggaactcaaaactatatgttctgtctggttcctgatttcacatttggctttctcccaaaagccgggtcaatagtaatgttgatctgcctctaaaaaaaaatgttttgtctagctactgccaaaattttgactgtcttttttatatcaggttgaaagtgaggttccgctcaaactgagtactcactacctgagtcttttatatcagcagctgcctgatattctccatcagatatcggagaaacccaagaagcgaggaaaacacaaaacgcaaaatcctgcacccaagtccggtggataatttgaaatccatacctgatgctcagattggatgaagaggcgatcatgcatacattcatccgcgccaccttgtgcagcctacagcaagcagatctttctatggcttcaaggtccggacagccaatgagcagccatggcgagcgtatgctgcctctgaacccagcacagtatctgcagcgcctgggccattcgatcgagctttccgctgctatgccgcggcttaccggcgaggccccccggagaaggacggagatttcccggagacttgggccggccaccggcgtggcaatccctcgaacaccttgggtgcgtgcagccgttgctgttgggaattgggactcagacgacgacacgccagtagggaatacagcggcggcgggctactgactactagtagtgtctccggctagcgcggcggccggcgggcccggcgccgacgacacctcgccggcggccggccggccaacgcccagggcgcatgcgcgagagagaagcaatttctttaatattttccttttttttatttttttttttgcacgcagcttgcattcccgtttatgggcttcctcggcccacataatgtgaggcccatgttcaatgaggtcgtcatgttgtggacctcatctcggcccatctcaaccacttactacccaagctactcgttagagacgaactggattggaaaaggtgtcttcgaagaatattggaaggaaccatgccagatttg

SEQ ID NO: 86660 - DNA, 996 bp, Oryza sativa
cgccccagggaggagggcgccagcatggctggcgccgccgcctctattcctgtttctctgtgtggagttgcaacggtgtcatttttattttatttttttgatgtttttacacactcaggatcacgatacaaccaaccataaaaaaaatttaaactcgaactaccacttagctaagtctgaaaatatctagtataccacttagtctactttgcaccttcactaaaattagaccataactcctttagtaaaactctttgatcagcatgttaaacataatgcactctaccactatatgaaattacttaatctaattcaaaatataaccacatgaaatgacatatataagttaaacagtacatagagatgcaatttttttatttttatttcatttttttgatatttttttcacacttaggagaacataggaaccaaccgtataaaaaataaactcaaacggacaaaatatgtgacatgtagaattttccaaaactctaccgaaatggacaaaatatgtcatctattaaaataggcgtaactttctcatacggactcggaattaggcaaataatatatgcatggacatctacagaaaaagttacatccgattctccccagctttgctgggttcggcgatattaaaacctccaaattccgcttgcaagattgtgttttcgaggagagaagtttttcggtggagctttggaaaattccatatgccacatatttcgtccgtttgagtttattttttacatggttggttcctatgagttcctaagtgtgaaaaagtatcaaaaaaataaaataaaaataaaaaagttgcacatctctctcctctgcactagttcggagagaggagaggagaggaaaaattctacatgtcacatgttacgtctatttgagttcaatttttctatggttggttcttgtgtgtccctaagcgtgaaaaaaatatcaaacaaataaaacaaaaataaaaaattttgggggggggggggg

SEQ ID NO: 86661 - DNA, 4552 bp, Oryza sativa
tcaatatgaatgtgggaaatgctagaatgacttatattgtgaaacggaggaagtataaactaaattatataggatacatgagttgtgctggaaaattctactctttgctcaacctttcaagcaagattaattgtgagtcatctgctagaatctgcttcctctggtatcactgtcaaagacacagttacattgttcgcccttttaacaagaactttaaatggcactccaaccttgtcccccatgatatcaatgatctggaataaatattttatttataaatatggtttaacatgctcttggctcttggattgaagacaggacaatataattactaggttcctaaaggaatactgtaagtgatacactagttagcttagttacctctttgatgctctcaaccagtttaccatcaaattcaacgaccacatccccaggacgaaatcctgcatgttcagctggtgatcctggtgtaacctggttgacactcatatggtgtcagcagtgccaactactattatgatcataataaaaatagacgcatgctaaacatgtgacaccagatttgcagttgagttaaacagtcatagactccagccaatatccaaaggccattgcactgtgatgattaaaactgaacagtaaaattcaattcaaacaaggtgattagatccactctacccagctgcaagaagattcatcagacatgatgaattaagcatcacttaccattggaacaagcacaccattttttacatctggaaaagaacttgatctttctttaagttgtgcaatgatcattgggttaaggtcaagcatctttaaaccaagccatggtcttacaactctcctgcattgcatgttggagaagtataagtagcagctaagcatattacaagctaaaccagaacaactaagctaagtgttcattacaaaagcaaagccatgtctgatttcaagtaattgttcactattgaatgaggtttcattacttctcttcgcacaagagaaaccaacaggaactagaagatttaatcatgataaaataaatgtgacgataatacatatattacagaactttactgttgtaagcatgttgaaactattttgaaagaacacacccattttaccccatttgactcttatgagcccccaaactacaaaagcataggcctcaccagtgttttcctctctctctctctgtttctcttatatgcaactgccagcagctgagcgccgctcccttcccaataccctcactgtcaaagttactacacgagcaaccttgtcactgtcttattttcaaatatgcatcttctcgtaattttatctccccaactatcctcaataatcctgctgggtctaagcagtgctctcattcctcacatcttaagccatggaggcaaggtggagcagtggccaagatcaaacgaattgataagatgcaaagttggctggttggaaaagtcttgctgtcttgaagaatggtacaaaagttcacatactcatcaagagtgaattcatatcattttaaacacagcgaaggaaaacaggtgaaatggaaaaccacatgtatgctaccagagaattgaaatgggtgagaatcgccttcctattcacagtcacctactcctagtcctcatctagccactgatacggattgtttggggaattcgaactaaatataccagcccatcccggaaaattggtcatgatttaacccgtgctaaacaagacttgagtgggatcaatgactgctatggtgaggaactcaataacatggtagctaattcaacagctttatggctgtgtaaggcaccgaaataaggtcagtgaccacaactgcttgaagcggcggtgatcagcatgaaactattagtgagggcttccatgtgtgcattagtatgccaactgtgaccatgtgcacactaatatgcacatgaaaaggacaagtagggtttgtttttgccaagatatagttactacattaggacgtgacgactcgaaatttcgaatgccatgtcaatcaaaaccacactagtcttgagagtaaagggtttactgattttgataatcaagagggtgaaacttagacggtcatgtagttgaagggttgaagttggattcttctggtaattgagggtgtatactagatatatacctatttcaaaattgacagaaatattacaagctgatttgaaagtatgatactatgatgctagatgtcctcataattcattcttgtacaagagtgcaatgcatgtggaatttatgtcacaaaaaaaagaaaactattcataaaagtcaatgcataaagacagactaaccaccaaacggtttcttgtattttatttctcccacagaacaagttggaaacaatgagggcattccatttaattctcacatttatagaagtacctaagtgggtaaactacaggctttaatcactaaaaaaacctcaacctgaactgaacaaatatatttcaaaagaaaagacgaaatacacaggaatggtatctaggaataaatagtacaatgcaactggcatcatacaacttagaaggaaggcatacccatttttcttgaagttctccactattttcacaatagagtcaatcggtactgcaaagctcaaaccatcagctgcccaaactttcatcacattaactccgacaatttcaccgtcaagattcacaagtggaccaccagagtttccctgtgtccaataaatgcgtgaactatttgacatagagaaattgagaaactagaacaggaactagggaaaaaaatatatcctagaagtcggtacatgtgagcccaatcatccataggacagagtacagaaccaacaaaaaataactccaacagacacaaaggagtttatgttcctccaaacaagtataacaagaaagcaagaaaattaaaaggaaaatgggatggttgacagcacaatgtactatatttttagttgggtaagccctgataagaaggggaaaagtaattcacaattttccgattacccccttctgcaattactagaattgcgatcctgaatcaaattgtatatgcttcagtagaattgaactctaggatcaaagcgtagaatcttagacctattccaaagtggcatgagagtccgtttgatcaccgtggcacctaatttgattcatttatcgtttatcttagcaccataatactgtattcctcttaataacataataccgtggaatacatgcattattgactgattttttttcagcaatgtgcagtacattccatgggttaatggtaagcatgtttattagatcatttacacataatttggttggtaaatatactccctccgtcccaaaataagttcatctttgcctccacttgtttgtcccagaataggttcatttttaagcaatcattacattgtagtttgtgaaagtagggggacaaatgcgttggaagtaagtgggggacaattccatcgggatttagttggagggtattctagtcctcttgcttttgtattggtatgtatgtgatgggtgaaaaatgaactaattttgggacggaggtagtattatttagcaactaggtcacattctgatatcatttgaacaattctacgcctagaatagcaattttaatgatcttgacattttatgtgacaaactaaactaaatatatgtaatccatttttactttttcatccttcaggattccaaatttaaagagaaaatctaattcatcaaataataacttcaaagtaatcaacgtagaagttctaattctttccaaacctgagaaagaccacacaagccaactcccagaatggtacaatcttatacgatcctacacgactagtgatcctatgactgggattacaagcattcgtggatgagctgtagctcagtggtagatcacccagtagaggtctcggtgggcttcgtacccacttccctgcacaaggtttcgggggccccttctttaaagccaactcaagggggacatacttgccccttcattgagtttttttaggattgcgagacttccagatatgattcttgatatgattttagttgtttggttgggtggaatcgtagaaatcaccctataactagaatcgtgattttaacaaccaattgttaccacccagtgagatgatataccaatggtaaccactcactgaacaaacagagtacataaaggagataacacctatgagtaccactcactgaacaacagaacagagtagctgagaactgtgtggtgttacgttaattgttttatcagtgggtttgaaccacaaaactactttgacatatgcttattagatatattaaaatttttctgcatttattgtgatggtttggtgacagggagtagtacaatggcataaacattagtataaaacaatctagtgtactcataaaagcaatgacttaggggtataatgtaaagggtcttgccttattgatagcacaatctgtttgcaaatactcccttcttattcctccaagacctaggtcactgcttttccggtcaacacaactacaagagaatg

SEQ ID NO: 86662 - DNA, 1675 bp, Oryza sativa
ctttgtacaacacaactcaccacagtgcaccattcctggatcataatcccccccttataaaacaaggcatggactccccagcgacccccgtgggcttatctccgccacttctcagtttggtgctccgcaatgaatcatgctatacaaaaggtaaagccgttgcccacgctggcttgtggttggcacgattaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataatgagtcataagttatcccaatagtgtgctaatgtttctaagcatggctaagcaattatatctaatatctagttgaaccaatatatataaagctcaactagtccaattataatcacccaaggtatcaaggaataaagtaatcaatgaaaacaggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcacgaaccttcgcaacaacggaaacgacaagctatcacgcaaaacgaggaaaaagactaataaaaaccaattaaacaatacataaaaaataaacaaacatgtagatcataattttagatgaattatgagacttgaacggcctcattctgacttcaaatgaatttattacgaattttacaagattaaatctatttaaagcccatttaaaaagaattaaataaatttaattcaatttatggacaattttaatatgtagatctttattttatataatttttgcaacttgaaccacattaaactgagttcaaatgaattagttatgaatttttaaagattaaatcggattaaaacacttatatggattttaattgaattatgacgcaataatgaattatttttgaaaaggaaaaggaggattattgcgtcagcggctagggtttgcggtggaccgggtgcacgacgacagttcacgggaacggacggccaagatcaaccctatccaaaacggacggccgagatcgatcgggtccacggcggctcacgggagacggcgacgatgacgtcagcgatgacgtcaccaccggcggcggcggctcgagcggctcggcagctcggacggcgcacgctcgccggcgaacgacggcacggcgaactcaccggtgaccaaaggagcggcggaagaccaacggacggcgacggcgatgtggtcaaagcggcggagaagatcgggtcgacggcggcgacggtgctccagcggtgtccggcggcggcgaaggggcggacgaggacggcgacgacttggcgatcccgacggcgaccacgatgacgaccttcccgagcgacggcgacagctgaaacggcagcggcacacggctggagtggcggcgacgacggcggcgcaaaagctcacgaggctagggcgctacacacgacggcgggcgaaggcaagagaggcggcgggtagaggagacaccgggggtccttttaaa

SEQ ID NO: 86663 - DNA, 1523 bp, Oryza sativa
cagcgctagtgactattttttctattactattaataagcgacctacatcatactaatttgattcttcaggttgaggatttgcactctataactccaaatcatttcttggaagttagtggtgctgtgatccatccactttcgtaccagcaggtatgtttgccacagtttaatggtcttttctgagctgttgccctctctgccccttctctagcaaataattggattaacatgtttataagtttatgaatcggatagtgtatattttttaatttagaaagtcgtcaagattaaactttgaccattaatctgctataacatgtatatttgatagttaaaaccaatattgtgcgaaagcacgttgaagtatgaatctttggtaaatttacttgtaatttgattatttcttggtcaaaatctgcaaagtttgctagaaatattggatcatgttgaactttttgctagaaatgttagcctccctactctggtcttgcatgaaaatagttgcaactcatttaattgtatacttcatcatatgttccctctttctagaaagtcatttaacatcataaaattatatgtttacaatatttattgagtattgaaacgttactaatctttttttatatgtaggcaaggaattttaggttcaaatgcggtctcgtatatgttgctgaggcagggtaagacatctgatgataacaactgatattcatttcctgaaagggcatcaaagcatagttgtgatttctagctggtctattttaccaggcattggtcatatgataaatccctttccatagattatgataattgagtcgggtttgaactcccaactaagtttcatttttcacagctattactttcagagcacaacaccccttagtgagttttagctgcaatttatgtttatatgttattcatctctttgcaatatttcacgttgggattatatctgtctttttattggcttttcaagtttcctgttggtgtcttgcctgcattaattttcttctatttgttagctgatattctgtctaaaatgtgatgttgtttatcttaccttttctgcaacttaaccaccatcataatatgcaggtacatgctctctcgggcatctgttccacgccatgctattattaaaaagctcgcaggagaggatattgaaaatttaggggaccttattgcatgtatttcaaaactatctagaggagcaagagttcctcttgaatatgtaaagtacaccgaccgttataggaataaggtaggaacatcttccttggaaacttttaatcatgataattagtcatatttctgtgcgtcctagtaaacattaactcacttcaaaaattacaactgatcatttatcttgtttatgtatccagtctgtactggtgaccattgatcggcatgaatggtatgcgcctcctcagttatatactcgaaatgatgcaactggcttgtggactgcaaaatcagctataccgccggaatctccttttatagcttcagctcatcatgctggt

SEQ ID NO: 86664 - DNA, 2588 bp, Oryza sativa
gcagaggagaagctcatttttcacaagaggatgatgctaacctcaacacattaagtgaagacccaaacaaaagtaacctccccagtatctccatcattcatgaagctgtaggaccattagagtcaagagatcagaataaaactgctgccttccccagtacttctggtgtccaggacactggagaaccaaatagtgctttacacaatgtcagacatgaattggattcattcaagagttctcggcagtgttctgcatatatagaagcaaaaggaaggcaatgtggtaggtgggcaaacgatggtgatatttactgttgtgtgcatcaaagtatgcattttgctgaccattcgtctagggaagataagtcacttactgttgaaactccactgtgtggggggatgactaatcttggtagaaagtgcaagcatcgagcccagcatggttttatcttttgtaaaaagcaccgcttccaaacaaatccagatgcaatgagctcagatagtttgttaagttcgtctgagggccgtaagtgggaagagtcacagaaaagcgtggagaagatgtcttcctcaaatgcaacttgtagtgtaggctcagagcaggcaaataatttccaggttgctgtgcacatgaaagtgacaccaaccatggctgttgagacaactagtgataaagttaacgtgtcagagaacgctgatctctgctaccccatgtcaacttccatggaaaactctaacttagatgcttctatttgcattggaattcgctctcatgacaatattgctgaatgccaggattatgccgtacgacacacactttactgtgagaggcacataccgaagttccttaaacgtgccagaaatggaaaaagtcgactcatctctaaagatgtctttatcaatcttttgaagtgttgcacgtcaaggaaagaaaaactgtgcttacatcaggcatgtgagtttctttattggttcttgagaaacaatctttctcaccaacgcccgggtcttggtagtgaccatatgccccagatattagctgaagtgtcaaaaaatcctgatgttggagaatttttgttaaaactgatctctagtgagagagaaaagctttcacatgtttggggctttggtacagatagctctaatcaaatgcattctgagaaccaagatggatcagtgatggtgttacgtgaagatgggacacatccttcacctggtctgaagtgcaaaatatgttctcaggagttctctgatgatcaaggacttggattacactggacagaggttcacaaaaaagaagtgcggtggcttttcagaggctattcttgtgctgtatgcatggactcatttaccaacagaagagttctcgaaaggcacgtgcaggaaaaacatggcgctcagtatctccaatattcgacactcttacgttgtatatcgtgcaacagcaactttttgaacacagatcttttatggcagcacattgtttcagatcattctcgagatttcagccttctggatcatgtccctcgacgacctaggggtcaatctatcaaaagaacagaaagggcaagtgatgagctcctttatgataaccataaccttggtaaggatgatggtttacagaagttcacctgcagattatgtgggatgatgtttgatcttttgccagatcttggccaccaccatcaagttgctcatacaaactcaggtacagtcagtgatatcccttcaggacgtgaaaagtatcagtttaaccgtggtcggcactattattcagccttcaagaaaagtttaagaccatccggctcattgaagaagaggactagttctggagttgagaaacattttaaggctcaaagcttggatctatctatggatacatcacacattgtggaatctgagaccaccacccttggtaggttactggatttccaatgctcagacgtggcattgactttattttcaaagattcaaaagacaagaccccacccaagcaaccttgatattctgtctattgcccgttctgtttgctgtaagacaagccttcgtgctgcattgaaagctaaatatggaatcttgcctgataacatatttgtgaaagctgcaaagctttgtagtgatgttggcatccaaattgattggcatcaagaagaattcttttgccctaaaggttgcaagtccaggtctagttctaattccttgctccctttacagccattgataattatattcgatttttaaaatctcaatgataataaaaaggagaagcagcaggcacgatgtataggagtatagttgcagagccgccaacggttggcgggatttctagaaaataaaaaagaattccaacgatacttatgttcgatttttcgaatcccaatgacaataaagagtaggcgtcggatgggtcgtagaggaatatagtggcatcgtttgacgtgacttctcaaaattataaaaaataaaacccaacaagacaattaatttttaaaaactacagggtccaatttttaaagatacgaaacttctaaaaagtaaaaaaacaatgataatcatgttcgattttaaaatcttaatgaaaataaaaaa

SEQ ID NO: 86665 - DNA, 3492 bp, Oryza sativa
agggaagcggtcgggcatgacgccactcataaagcatggtgacaggtgggaccggtctccgtgattgggcagaaacccaacggtctcaaaccacgcatattggtaacggtgtcttagccgtcagttatgggcggtctcttcaagactgccacattacttgagcgacgtacgaatctgggtgagccgatttgcttcgcctggagatatggtgatggtgcttttctcggagccatcagaatagcgtatagcatcttctgggcctgagggtatcgggttttggcgtcccggagggcctgagggtatcgggttttggcgtcccggagggcctcgctaacaaagtagacgggccgctgcgcctttcggcggggccgatcttcttcgctaggggccgcatctccagggcgctcttcatccgagaggcagcgcggggcgcactcggcttctgtgccgacgacctcggggttagagggcgacaggcgcggccttcccgcagtggcctcggggccatcctgggggtcgggggcgcctggcaccgtcggacaagcaagcggagggccagctccggccgtcgggggccttgggccgccgttcggctcgggggcctttcctccctgctctctctctctcttcgggcagaatcctcggctcgcgttcgccctcaactccgacgaggagggcgatgccagcggagtgggcgatagtggcgacgaggccggcgacccgggtgcatcggagtgagcccccaggcctccgccaatcttaatagcttttccttcttcttccgaggccttcgggccccttttttgtatagatcaacttaatctgcaatcaaaaatgatgaaaaaattctttgtgtcaattttattttactatgcgtatgagacgaggatggtctgtgccatggtccttctgtgtcttggcttgaacaagggctcgtgcccaggtcccagcctcaaacggcgcgggtcaaggctagtgcctggggagatccacatgtcgagactggccaggccgggagcgtggtgaccgagggttatgggtgacccgattgtgggtttttgccgattcccccccggagttcaccacgccccggggcacggctcggttctgggccccgtttggcgattttagccgacccgagcccccgagggcaggattgaacacgagtgacctatttcaagtcaagattcttcaaaaggaaacaaaagcacagacacagcctttaggaaatcgaaaatgcttttattgaaatacggaagagaaaaaagataagcccccggccaaccctgcacgccccgggggggggcgcggggttggcccgagcccgaaacctgacacccgacccccactaggggtagaagcgacgaaggtgttcgatgttccacaggttaggcagctctgtgccgtcgcccgtggccagccgaacggagcccggccgggggacgccgatcactcgatacggaccctcccacactggtgagagtttgctcagtccagcacgcgtttggacgcggcgtaggacgaggtcgtcgacgcagagtgatcgggcccggacgtggcgctgatggtagcgccgcaggctctgctggtagcgcgcggctcgaagggccgcgcgccgccttcgctcttccaagtagccgaggtcagggagcgtcggcctctttctttttgtcgctcgcaggcctcccctttcgggtggcccgcggagcgccctcgacggcgaggacatgaccctcgtcgccggaatggaccgacctcttcttcctcctcctgtcacgccgccctgtctgggcggcggatccgggggcggccgaagctgccactccggaaccggaggagttccatgtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgtgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcctcacgtccatgtcgaggtgacactctggacgaagaggcgccctccgttgcgcggggagtacgccggttattacgccggcgctcgatgtcgatgcaggcatccggctctccatgctgatcctcccgagttggaggtgtcgacgagggagtggcggccgaatggcgtgcaacagccgccgctcgccgcgccctccgccttgacgacacggagccggtggtagcggcgccggaggtcttggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcctgaagcgcaccctgaggcgtgctgccgtcgccgtagacgaggaggcgacgctccccatctcgccgttctcctgcatcacctgcgactggtgatgccacagatttgtcgaccctctcaagcgcctccccctgcttagggctttggcgcggaggaggtgggggagtacgagctcgacgacgtggattcggctccccgtcgtcgccgctcacactcggagagaggtcgtgcgcttttccttgctcggccattaggctgaacaagaaatacttggcgcacacggaagagtctgagagctcagaaaacacacactgagccccctacctggcgcgccagatgacggagcccgtggctcctcaccgggagaccgcgcaggcccccctttgccagttcggccgggggcttagggtgagatctcaagctctcgctgtgtgtggaaagatcgctcgcccggaagaaacacgagacacggcgatgtatacaggttcgggccgccgcgaagcgtaataccctactcctgtgtttttgtggatttgtgtatgaatgagctacaaagtgtctgcccacttctcccccgctctaggctctaaatctggcaagaatcaaccaatcccttctctatgggcaaggtcctccttttatatttcaaggggataccacatgcccccttccctttccaaactggacttttcttcttttcat

SEQ ID NO: 86666 - DNA, 1099 bp, Oryza sativa
aggggcttctactttccatagcagtagccagtgaccgctacttcttcctcaccccactgtacccacaagcgttccacgctcttctgggagaggctagtatgctagctaccgagtcagcaccttacctactgaacctgacagcgacccatccacctgtcccggagatggtgcgcactccactgatccctacaccttctccgcagataggttccagtttggagactccgatccaggtcgactccgagacagaggggaccgacaccgagccagagatcgagccagacatcactgatccttcagaggatgagacccctgttccccgcatcaccttccttggaggtcctcgcaccctcagcactgctcgcaagagcacacgacctccgggcaagaggcccaagccagatccagaggccactacttctgagccgtggggactcaggtttgcgtgtgccaacgaccaccctctacctgccccaggatcctgcggatggctggaggactagactgacagactccttgcagcttcgatctcgtatcagatggtttttggatagcatgcgagacacaccccccctcttacctagattgacgagtagattgatgattagtttgatgtatcttttggatgaaccttattcgactgcgtatgtacgcagtcgattgcatcatgatttatgtaccatttgtgaaactctgtgatgttatttatgatatctattgttgttgtgttataaatgagtttattccaccatgcttgcaaaacaaagttcacatcaaaacaatctcccctaatgggataaagccgtaaaagatagccagagaattaggatacttactcaatcaatcaacctgcacagatggcaagccgacgtcgggcaacaaccagcaatgacgaaactcagacacccgacttaaccactctggccagagttatggccacccaaactcaacttctgcaagccatcgcaaacaaccaaggcaaccgcggcggatcgagctttggagaatttatgaggaccaagccacccacattcgccacagcggaagaacctatggatgctgaagattggttaagggtcattgagaagaagctaactct

SEQ ID NO: 86667 - DNA, 2262 bp, Oryza sativa
ccgcctcatgaaggcaactaccctacccatgatttttttttatctgcggcggttcatgctctagggatctggcggcactatctcattgggaatcgctgtgaaatatatactgatcataagatttgaaatacatcttcacccagtctgatctgaaccttcggcaaaggagatggtcagaactcatcaaggatcatgatgtgggaattcactatcatcctggtaaggccaacgaggacaccgacgctctaagtcgaaagagccattgcaacactcttaacgtccgtggcatcccacccgaacttagtcaacagatggcagccctgaacctaagcatagttagtcgtggattcttggctgcgttggaagccaagcctaccttgctcgatcaaatccgcgaggctcagaagaatgatccggacatgcatggactcctcaagaatatgaaacagggtaaagccgctggtttcacagaggatgaacacggaaccctatggaacggaaatcgagtatgcgtcccagataacagagaacttaaacagctgatacttcaggaagcccacgaaagtccttattccatccaccctggcagtacgaagatgtacttagacttgaaggagaaatactggtgggttagtatgaagcgggaaattgcagagttcgtggcactttgtgatgtgtgccagcgtgtcaaggcagagcaccaacgaccggccggactcctccaacctctccaagtacctgaatggaaatgggatgaaattgggatggatttcatcaccggacttccaaagacccaaggtggatatgattctatatgggtagttgtggatcgattaaccaaggtagctcgatttattcctgtgaagaccacctatggagggaacaaactagccgagctctacttcgctaggatcgtgagtctccatggcgttcccaagaaaatcgtatctgataggggaagccaattcacctctcacttttggaagaagctccaagaagagctgggtacccgattaaacttcagcaccgcatatcacccgcagacagatgggcagaccgagcgtctaaatcagatcctagaagatatgcttcgcgcatgtgtcctagatatcgggaagacctgggataagagtctcccctatgccgagttctcctacaataacagctaccaagccagtatacaaatggcaccttatgaagcgttgtatgggtgcaaatgccggacaccgctcttgtgggaccaagttggggaaagccaagtgttcgggactgatatactgagagaagctgaagcgaaggtcagaaccattcgggataatctaaaggtggcacagtcccggcagaaaagttatgcaaataaccgtcgccgtaacctggaattcgcagtggatgattttgtgtaccttcgggtcacgccattgcgaggtgtacacaggtttcagacgaaagggaagctcgcacctcggtatgtgagtcctttccgtatcgttgcccgacgcggagaagtcgcttaccaattggagctgcccgcctccttgggcaacgtgcatgatgtgttccatgtgtcgcaactcaagaaatgccttcgagtgccatccgagcaggccgactcaaagcaaattgaagttcgcgaagacttgacctacgtggagaggccagtgaaaatcctggacaccatggagcgcaggaccaggaaccgggtaatccgtttttgcaaggtccagtggagcaaccacgccgaagaggaagctacctgggagcgtgaagacgagctgaaggcagcccatcctgatctcttcgccagttcttccgaatctcggggtcgagattccgtttaaggggggtaggtttgtcgcgtcccaaaacgactctaaaatacatcctcaaaattgtgcatagaataagtaaaatccatgtgaaagcctccaacaattaaaatgtgcaaagttaaaagtcgaataaggcttggaggatttttgtatatttcctaaaagcctaaaatgcgtaaataaattttagtggaattttcagagcacaaataataattaagaagaaataaacaaagttaaaaaggttttataaaaagaaaaaccctaaaaagtttcttttccctccccctctccctcttgggccggctcggcccacctccctccctctctctcctctcccccgcggaccaatcggccccctccccgcgcgcgcgtgccactgatgggcgggcccgcccgccaccctctctgacgggtggagcccacccatcat

SEQ ID NO: 86668 - DNA, 924 bp, Oryza sativa
ttcgggtgggatgccacggacgttaagagtgttgcaatggctctttcgacttagagcgtcggcgaccacgttggccttaccaggatgatagtgaattcccacatcatgatccttgatgagttctaaccatctcctttgccgaaggttcagatccgactgggtgaagatgtatttcaaactcttatgatcagtatatatttcacagcgattcccaatgagatagtgccgccagatttttagagcatgaaccaccgcagctaactccaaatcatgggtagggtagttgccttcatgaggccgtagctggcgtgaggcataggccaccacatgaccatcctgcatgagcacgcaccccaatccttggcgcgaagcgtcacaatacaccatgaaatccttgcgagtatccggcaagattaacactggcgaggcaaccagcttttctttgagagttttgaacgccttctcgcattgcgggctccacacaaatttctcttctttcttcaacaactgtgtcatgggtcgagcgattttggagaagttctcgatgaacctccggtagtatcctgccaaacctaagaaactgcggacttgagtgactgtcttgggttgcttccaatcagtgacggcggtcactgtttcggggtccacagcaactcctttagcagatatcacgtgccctaagaatttgacttcggacaaccagaactcacacttgctaagtttggcatacaattgatgttcccgcaactttcccaataccagacggagatggtgctgatggtcttcctcggattgtgagtatatcagaatgtcatcaatgaaaaccacaacaaacttatccaagtattccatgaacactttgttcattaagttcatgaaaaaggcaggtgcattggttaaaccgaatgacatcaccgtgaattc

SEQ ID NO: 86669 - DNA, 2143 bp, Oryza sativa
ctgatgagcggtgaatcgatctactatcacccgccaccactgtcacgtgggtctctgtggattttgatacactggtggagaaaccatctttcgtcggtcggccgatttccacaatagtcccggatgcaataaaaaccagggctaaagatgatctttagtcccggttcaaaagggtaacgggcatatttgatctttagtcccggtttgtgttaccaaccgggactaaagatcatcttagtcccggttcgaatgctgttaggtcatgtcaggccccccccccgggatctttagtcctggttggtagcaccaaccggggctaaagatgaccgggatctttagtcccggttggtaataccaaccgggactaaagtcccacccctatatatatatgtcttctccagttcttcctcctccagctgcccgaacaagctttaaaatttcttcaaaaaagaggggaggtcatgccaaaatttctattgaatttattttggtgattacatataaatcggaggtgcctaaaaggtttgcaacttcatcctccaatgtttttttttgtcatactacatttgcacctatgttttgcacacttttttttgtctccaaaatttagttgtaagttgatgagagagaaaatgtgtgtggggaagaaagaatatatagaaatttagttcatttgctaaacaaggttttataaaatagttgagaaggaaaactctagttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtatgcccgttaggactggaagttcataagattcacgcatgtccaaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgattgcacgctgaagagcgtcaacaggacgggatgctgagacaccctgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctcccccctggctatgcatgaagaggaagtacataatgatgccgattattattcaaggccccaagcaacctggtaacgacatcgacgtgtacctaagaccactggtcgaagatcttaaacagttgtgga

SEQ ID NO: 86670 - DNA, 6102 bp, Oryza sativa
accattagagtgttttggagggaggagttgccaaaggtgtcacaacttgcaagaggagaagtaacgggagcacctttgttccctatgcgctgggctaaatgcctacagtatgcaaaaagaaaagagaatggggtaccacacatttgtttttcatttatggaattatgtgcggataccattttagcaaagatattcttctaagaaaattcactatttagaatacgacatcaagcaacattaatcgcaaggattgttgcctgttcattttgcctttttttttatttgataacatgggttgtcgatccttgctagatgtacttcgcaatttttattttttttcttatgaacaatgtagtatgaagtatgtcttttataaatttattatttttgcgtgtcatgcattatcttcccatggttcaactccgtcaaggtccctaaatatgtcctccaaatagtttttaaggcctaaggtgaaaaccaaaggtccaacaggacctcgagcccctagaataggaaggctcccaaatcctaccccataatcttggggctctagattccatcccctttcaccctagttcgtgtctctatgtaagatgttgctaggaagattggatctggagctttgttagttccactcatcttttactgctagggataagcgagaaggaccgttgcaaattctgattgcgctgataaaaatgtttcgaagttcagtagaagttatttgcactcctagaaaaacattttcctatttgtgttggtcaagaagatcataagcatatcacagaagaatgatattatctttgctggctttgattagctttgaattataataatatgataatatctctaaatgattgtctgaacaatctgcaggttttggatattcaacctattttgtttgggattaaataaactgttaattcaggatttattggttgagtgccacagcgtctagaatgcctacttcttattcgtccttaattcttattcttatcataatgcttaactacttcaattgctagtggaggtgattcctatgtagtgcatatgatgtctgaggatatgtcttttgcttgcttgaaaattttgaatttgaaaattttactttatatatggttgaaatctatgcattagaaatatttatatttgaattatcgtggtgtaaactatacgttaacatagagtatgtgctaaaatagaagagaaaataaaatatgagctaaataaataggcactattgctggagtaggtggtgtattttgggtcctcaagaaatagaagcaatccccttttaatccttgagaggtcaaatatggggcatgttgctggagatgctataagaaaacagaccaagatcaaaatttaggttgctagttatgctagtacgttgcataatctaatcaatggctcttgggtacacaaagcagttgaaacaacacaatcaagtaccaatgtaatatcaagaagaggctaaatgtagaaatacattatatacttaaacttcttcttcaaaataggttctactctctccatttcatattattagacaatttgactatttcctaagcaaacttttataagtttgattaagtttataaaaaaacatagtaatgctttcgacagcaaacaaatatactgtcaaaatttgttcaatattttatttaatgaagctaatttgtttttgtaagtgttattatatttttctataaatttggtcaaatttataaaaagtttaacttaagtgtcacgaagggaataaaatacaactaatccaacgacaacgagataagccaggtaaggctctatgcaacaatgagccgtggaatcatcttatcgtcctctctatcagggtttaattaatcgcacaagaacaggttactgtttcctgcaattaaagcaatatcctggcctgtcttctgatcccatcggtatttgttttccataagccatgcagttgaatttgctaaagccttgctacatgtatttgcatctctaagcaaccaatgtgctacgtgaatcattccgctttcacatacaattcagtcatttgcttgtttcatacgggaaagtagcatgaagagaatacaacatgattactgaccttctctttagataataatacacaggagatttgctttccaaatgtcctaagtgtatcccctgagcatgaagcttaaaacagcaatctaggtaacttaactactaggagagacccattcaacagcaaagtgaacaacaaacagtgacggagcgtggggctcctcaccgggagaccgcgctggcccccctttgccggttcggccggggaccctgggtgagactctaagctcccaatctgtggaaggttcgcgagacaggaagcatacaagacgccggcgatgtatacaggttcgggccgctgagaagcgtaataccctactcctgtgttttggtggattcgtgtatgaaggaactacaaagtatgagccagcctctccctcgttctgggttcccaatctggaaaagtcccgtcccctctcaaagtgggcaaggtcctccttttatatctcaaggggataccacatgccccatctctccctccaatttgacttttctttattaatggacggagatttgcatcgccactgtccgaatgatcttctgacgggacggcccatacctacctccacttccgccggaggcaggcgcgacgtaggaagatggctgtctgctgatgacatgaccattgtcagaccggtcacaaatcggtcattcttgtccaccacgtgtgtcacaccctgaaaattcaaaatatataaattgttgtttaaatggaatttttagaaataattttaaaagtcttgaaaagaaaatctaagtttaattaataaattccaatataaaattgggccagataaaatttcattaaatactttgcttaattctataattcctagatttttctgggatttatttgagctaaggaagtatttttaataaatggaattgcatttaagaaataatttaaattgaaaaagttttaaaaagtcttcttttggctttgggccgaaagtcggcccaaaaccgccttctctctcttctcggcccagtccggcccagtccgcagccgcccgcgcgcgcgcgcgccctcgcagccgctgacaggtgggtcccacctgtcaggccgtcgtctttctcgggccgaaaccctagtttcgcgccgccgagctgccgtcgccgccgctttccaatccggccgctcctttccgtttccggctgaattgatagaggggaaatgatctccgggatctcctctaccttttctcctttggaaacttcggctaaatcggtttggaaatcgatggattcgagttcgaatcggatcggctttcctctctccaagccgcgagtttccttcgccgttgccgtcgccgtgggccttcgccgccgcccccgagcccctttaaaaggatccccgtgctcttctcttctcgccgccaccctcgccttcgcctctcgtcgccggagtagccctagcgccgtgtgccctagctttgccttcgccgccgccgctccagccgtgcgccgccgtcgttccagccgtcgccgtcgctcgggaaggtcgccgtcgtcgtcgccaagtcgtcgccgtcctcgtccgctctttcgctgccgtcggagaccgccggagcatcgtcgccgtcgtcaagccgaagaccgccgccgtttcaacctcgtcgccgtcgccgtccgttggtcgtccgccgtcgctttggtcgtcggtgagttcgccgtgccgtccgctacccgttggtgtcctccgttcgtgccgtagcgccgccgttcgccggtgagcgtgcgccgctcgagtcgtctgcctcgtcgagccgccgccgccgtcggtgacgtcattgctggcgtcatcaaggccgtccgccgtgaaccgccgtggacccgatcaatctcggccgtccgatttggatcggatcaatctcggccgtccgttcgcgtgaaccgccgcccgtgcgcccggtccacccaaaccctagccgctgacgcaataaatccccttttccttttcaaaaataattcattattgcgtcataattcaattttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcggaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggccctttcgtacttgattaccttattccttgataccttgggttatattaatttgactagttgagctttatttatattggttcaactagatattagatataattgcttagccctgcttagaaacattagtacacttatgggataactaatgactcactattatttcatgatggcttattgatagttcacgatggtcaattgtgattagttaattaattaatgtgccaactaaaacctggtaatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctggccagagtaaaactattcgaatagccgtgcccgcggttatgggcgggtctaacaatgtctttcgtgattagtctcacacctctcatcattataaaagatgctataactggtaataatttgattagctcctggtttggaatggtacattcctggtttggagatagaactgtgcagccggggtggttgttcagaatggttgggcctatacaacagggtatgttgtatagcgttggattaatattgcttaattattacttaactgttttatcaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacattgaggctgatggtgtggaggattaggtgtagccttggtcaagctgcctgtggagtggagccgtctgcgccgtttatttaatttccgctgctagaactttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaacgtgtcagtttaacaatctgcatgttcgcccttcttcacacaacatcttgcctgtaatggttaggatgaatcctggcatatatctgaccaggactaacgtgccatctctgggaggtaacacgctagctccagctggggacgagcgcctagaagccctcgtcctgacgggatggggcgaggcgtgcgtcagatcgcctgtcgccacctaacccacgacctgaccggtctgtgactggtcacagaccggataaatgagtgcactgcactgcgttacatgcggcgtgacacgctcagccaaaccgcaataaatgtggttaggtg

SEQ ID NO: 86671 - DNA, 1572 bp, Oryza sativa
ttgaccataaattgaatgcgttaatttattgagcatacaaaaccaagccaagaaaccgttcaactggttgtcccgtcttattgacaaaccgcgagcaaagaaccagttggttcttgatttcttttttttagcaactttttctaaaaaactctttaaattaaccatgggaccctttttttctcttcatgtttcaaacctacaaacaacaatatcaaagagcaattgagcaaactagaaaagcagcacaggttcggtggttcctaaatcctaatctagtaatctagatagtcattcataaactatgaagctaaaataatcaatacacttcagttcaccgactcggcgactcaccgttgcagttgctcgaatgctcggttgctgtgatgttgctcgaggatgggaggccgaaggccgcgaggcgcgcaggcggccgccgggcgcggggcgctaccgcgccggccaggcgcgaggtgcggagccgcggaggcggcgaggtgcggaggcggcgagcggcgagccgagcagccggcgagccggctgtggcctgtgggcggccggcgaggcaacgccgcggccgcgaccgccgaccgggcgtctgggcgtccggcgacggcgaggcgcgcgccggcgcgcgcaggcggctagcgggctgggcagcgcgactggcgacggtgaggtgcgcgggcaggcggccgggctggcgcggcgacggcgcagtcggcgcgtgcgtcgactggcggcggcttgcgacgcgtgggcgtggcggctgggatgggaaggggagggaggtgaggagatgagatagggttagagaggaagtgtgcttttttcttctattgggccaatgggcctgaaatggtgggtggtgggagggttcagtttgggcttcttttcagttttgaatgggtataagtatttttcctttttttcctatatatacatatggaatatatacttcatatatgtatttttgttcaaaaatcttgggtattcatttgaatacctattaattgaattgggcccgcccctgagattattgtgcaatcctcaaactccacatgcgtgatcgatgcatgatcaccaacgaacaaaatggaagtcaattagcaagaagaaaatctgtcagcgtcagtgcttacactctcaggaagacggtatccatggtcgattggaaccagggagaggccatggccttgttcgtctctgcaggtgaggatgttgccggcgtgcctgccggcgttggccagcctgatgtccaacacgcagatcccatctcgccgagcgctggcctcagcatcgtcgactccactccggggacagtggcaccaccgccggaggggggtggcgaccgcctcttcatcgagccgagatccacggccatagacccgccggacgaactccccccgcagcctcagcctcagccccatcgcggcaccgactacccagcctcatccgctcccttgtctccatcatcgccgtcgccgtcgaccgggaggatgagctccctggcccagaacccgtatcagcttcaggccaccgccggcgacaccacaccgtgggccatgccccgcc

SEQ ID NO: 86672 - DNA, 18520 bp, Oryza sativa
ggtttctccaccagtgaaacctcccaccgcggtccgccacaaccgtccacgtattccgctgccctcacagcccgtgggggatagcctcaccgacaagctctccccaccaccgcggatcaagttgtgcctatgggtggttgggggtgtcactaccacctgttcagtaagagctttttaggattggagaaatttaacggtgctcgacacaatgcctgaccgggacatggtctcctaaaacaccatgctcaccgctgcactgcatactcgtatcgaaatggctctttggcgatcagtcgtgcaactctgtagcgcttgatcagatctgccccaccattattggcccatgtgtttttgtccacttttggcgatgcgaggtgcctaagtcatttttgtggcgcggtgggctcggcccattttcaattaattttcgctcggttcagcccatcatgggcattggttgtgggaggcggagcaccccaaactgttaaaaaaaatgagtctgttgcattttgaacattttcatttttcctattcccatccatctctctatttttcccactttttttcctagagagagatttgaaaagaggcgtaaggcaggggtgtcgcctgttgggtgagagcttttttggattgcggaagtttaaccatacatgggagaaggaagaaagaggtaggaggttggcggctagaggaagaagacgatgatgagtagtcctcatgacatgtatgcaaaaaatgaaaaaaaaattaagaagcaatctctctccagtgacaaatttgtatgaatagataaggggcatatagagagttgtcaaatctaatagtgacaaatagttaaattacttcccaatagtaaatacgcacatttttttcctttaataagcatgatgcttccatttttgtttacttctcatcttggaaactcacgagatataattatatctctcttcttcagacgtcggcgtccacacaaacgtcccacacagttacgatgagtccaggttgccgtccatctaccaagcacagagaaaggaattcgaggtagcaaatcttcatattcctttccgcgtcttaagtttcaaaaaagcaaatcttgttaacaactggggcacttctatgtagccattccatcagcctggcttcgcactttgttccttggaagccatttatcccaatttccacgagatgtggtaacgagacgctgaggtaatcggcttgattaccagcaggatctgttggtttcgtctgctcctatacaattaaaaggagagaaaaaaaatccgagagttgttagcatatcaaaacttgtaatgtttaattttttttaatgaactgacaaactgtgctaatttcataatgtttgattgttgtaatgttaaattagcacatttgcagtgtgcagcaatgcaaattaaccctaacaaaagtttatcgaaatagacgtcgagatcaattcagtaagaggggacttaccacaagataagcgtcgttcatatcttagagagctccatcctggaaggcgtgcatgctagccacttgatctgttgcatgttttagagaagtttgatgagttatattttagttatacttcagttacatcctagttacaatatagttacaatgtaactacaatgtaactgcattgtaactacatcgtaactactatgtaactgaactgtaactacattatcatctctatataatttagatatagtgttacatatattattttaatatttatatacgagttacattatacttatatataaaattatattgtaattataaactgtcaacagtttataattggctcgttaaaaaactaggaggaagagcaagttttctccttaaaaaactgtcaacagttctctaggtagtccctttgtatgctcgtctacatcagaaaaagtctcgtcctcgggagaaaaaggatttaccgtcaaagatgtgacaagaggcaaatgtggtatgtcgttcatcatcatcacgtcatcaatcaccccttcctcttcctcctcgccttcctcatcggcatgagataccttacaagcaaggtggacatcgagggattcgacggcggggcatcgccggagaaggcgtccggagacatcaccgaagccgatgcggagcccatcagagctcaagtacagatttttgaggctccgcacgcacgacattatgtcgccgacgtcgagcctctccaaagtttcccagttgaaggatgatttcagctcctctagccccggcgccgacatcgtcagcgtggtgtggtggatgaagtagcattcaatgccaagaacacgaagctttggagtgttgagctccaccagggtcaggcccacgccgtcccagatcagggacagctccaggagctcgccggcgtcgagccgtagctccttcaacccgactatttcctccagggctagcttctggaggcgcgggcagcacgccgacgagaggaggcggccgagaaggtggacgtcgtcgagccggatttcgttaagtgaaagatccaccagagaatcgaacgccacggtggccgggagaggaagagttaggtaggtcagtgggccatggactccagcatcgtcgagctagggagctcgtccaggaccaaaccgtcggcgtcttcgtcgaagtcgtaggaccgtcgctgttcaggcagtggcagcaggttgggctggtcgagtttcagggcgaacgatctcaccccttgctgttccatggcgtaccgaatccacgcgttggcgtgtgcgccgtggacggccggcacggcccgggcgcagcagccctcgtgcagctcgatggagatcgtgagctgctcaacgccggcgcggcgcgtggcgtggacgcggttgacgaaggcgacgaaccgttcgacatcctcctgccgcttcacgtcgcctgatgggttaattagatgagatagagagaagcgcaggctgggaacgcgcgcccggaggcaacgccaccgccgcgacacggcgcacgcgcgcgccacgtcggtggcgttgggcaggaggccgaggacgtgcgcgaggacgtcgtcgttgagctcgctgatcaggtcgccgccgtggcggcggcggaggtagtaccggtgatgcgtcgacgttgtctgtggtcgtcttctcttccccatgccaaacagaaggcgagatgtagctgcacgggtatatacttttttctttacggatatatataatttttttatggaaactgatcggatatattacctttttttaatgggaactgatcggatatataacgtgatatttctatatacatccctcatgcgcgcgaataggtttccctcgcgtgtgaaatcgaatcccagtatagatgactataagacccgcctggcacggcccggcccagacacggctaggcacggtccaccagcaatcgggtcgtcacggcccgatcggcacttcgtgctaggccgtgccagctcatggtctgcacctccagcctaggcacgacccatcagctgtcaggccgtgcagtgccggcccgaaggaacgtgtggcccatcgtgccttcttaaaataaacctattttccatctcctctttgggctgtgacatatatatagctaaaataagtctattttccctctcttctctttgggctgacacgtatatagctaaaataaatctatttttcatctcattctttggaccgtgacatataatatgtctaattttactccctattgtttatgtgtcgggtccggcctgccgacccattgtgccatgctggcccagtcatgccggaccggcccaacgtgccggtggggaggcccatgcatggcccggcggtcatgggccgggctaaaatatcgtgccgtgggctgggccgtcggacatcggacattatggccatctataaatccaagtatagcacttacagcaactccagtgtatggacaaatcgatccgtgagacggaaaaatcgtgtgtaatatgtatctagagatgaaacacaacacaaacacagcacattaaaggcccaggaaacggtaaattgatgtggattcgaatttaaaaatagagtaaatttcacaaaactacacattttatggtccaagttgtagaaaaccacacacactttaacactataagtacatatattttattagtgtagttttacaaaaccacactatcaatgaatggattcacccgtgagatgacgtgtttgtttcaccaggacgaggatgtggcatcatattactagccatcgcacgaaattaataggatggcacgtcctcatcttagatggaacaaccacgtcatctcacgggtggatccattcattgatagtgtggttttgtgaaacactaccaaaatatatgtacttaagtgccaagtgtcaaaatatgtgtggttttctgcaacttggaccataaaacgtgtagttttgtgaaatttactcttaaaaatattgggctaatagctaagcccaataatatggggtaagggatttattggagttatttacggaagaaacaacaattcaagatgtgcgatattatgcgtataattaggaggatgccacatgttggacatctgataatttcacaaatatcgaatactcaacaccacacagccgtgcgcctgtagagcctacaggcatgcatacccatgcaggtgcatgtgctgttgtattcccctatctaccgagtagtgcattgttgcattccttgccgctgcttgagcgaggactgaaaagccgtctcgtagatgtactctacccatggaagccagcgtagccactggcagggacgatctctggtgaggcagcggagatacatggcgatgaccttgttcacggcttcggtctgtccgtcggagtggggatgaaatgccgacgtcatgtggagcttggcgccgatgagacgcataagctcaatccagaatagggaggtgaacacggggtccctatccgagaccatagactgcggcactccgtggaggcggacgatctcgccgaagaatgcttgggccacggactccgccgaatatgggtgcgccaagggtatgaagtggcaatacttgctgaagcggtcgaccaccgtgaggatgactgacttgccgcccacgtggggtagcgcctcgatgaagtcgagcctgatgtctgcccaaatggacatcggcactaggagtggaaagagtttcctagccgagtgaagatgttccgacttgtagcgctgacaagtgatgcatgcgcggacatggtcctggaccaccgtgcgcaggttgggtgagtggaagtcgcagcggagtcaatgaagagtccgctgcaccccctcatggccgtcgccgtgtaccgcggcaaggagctcttggagaagaggtgaggccggcgggatgtagaggtggccgtcgtatgtcaccatgccgtcggtcaacgcccatggggcggcgtgctggtgcaccatgaactcctccctgagtgccaacagcgtcggatcgatgtcttgggcttggcacagacggtcgatgaagtcgaaccgcggcccagagatggccagcagcatggtctcgtcggtgtcgtgtcgtgacagggcgtcggccattgtattgttgacaccggccttgtactccactgtgaaatcaaagccgagaagcttgccaacccaatgatgctgttggatggtggccaaacgttgatcgagcaaaaacttaagactgaagtggtcagttcttacgaggaaccggtgaccccataggtacggtctccattagcggatgacgaggatgaggccgatcaattcctgttcgtatgccgccaaggattgatgtcgcagggtgacggtgtggctaaagaatgccgtggggtggtggtcctggaggaggacagcaccgaagccataggtggaagcatcacactcgacaacgaatggcttggcgaagtggggcataacgagcaccggtgcggtcgtgatggctgtcttgagggtggtgaaggctgctcctgtctatccgactaggaaaacccttcctcgtgtagcagtgcggtgagtggtgctgtggtcgtgccgtagttctggacaaacttgcggtagtagcccgccaagccgaggaatcctcgtaccacacgcaccgatcgcggctgtggccagtcggagatggcttgaaccttgggcgggtccatggcgacgccctcggaggagaagatgttcccgagatagctgatagaggagacgccgaaagcacacttggaccacttgacaaagagacggtgctgctgtaggacttagaggacagtgcgtacatgacgtaggtgggctgcccatgagtcgctctatatgaggatgtcgtcgaagaaaatgaggacgaagagacgtaggaatgtccggaggacgtcgttcatgagtgcttggaatgtggtgggggtgttgcaaagcccgaacggcatgaccatgaactcgtagaggccgtcatgtgtgcggaacgcggtcttggtgacgtcggcagcattcatcctgacttggtggtatccggagcagaggtcgagcttcgtgaagaagcgggcaccgtgtaactcgtcgaccactggaatagggtatgcattcttgaccgtgatggcgttgagggcgcggtagtcgatgcaacatcgccacgacccgacatctttcttgatgaggagaaccggtgaggagaaagccaatgtgctgcaccgaatcaatccttgtgtcagcatagcggcacactgccgctccaactcatccttgtgggaagcggggtagcggtaagggcggacggccactggcgccaagcacgaacgaggttgatgtaggggtcccgtgatcgaggtggaggcatgcccattggtttggcgaagacggtggtgaattcctcgagcagggctcccatgatgtcgtggccggcaacgacttgcagcgatggggccgtcgagcctgcaacaccctgccaacatacacggtggtcgtgccgccaaaaagacatggatcgtgagtcgaaatcccacaagatctacccaagggacgccagccactgcgtgcccaggacgacatcgtagcccgccagcggcagcgcgaagaagttggcgtggaaggtttcggcgccgatggtgaaggccgtgtcgcggtacaacctcggacatggaacgcgttcaccgttggcgactgtgacctgcatcttgccgcgagggaggagcggaagcttggtgccgttggcagccaatgtggagatgaagttgtgggtggaacccgagtcgagcagcgcgaggagtgcggcgccgccaaggtcgatgcagacttgcatagtgtcgcagcaacggacgcccgcaatcgcgtggagcgacacctgtggctccgtctccccggtcccctcttgggcgctgtcgtcgtcgtggtcatcgtcaggcacggccaagtcaaggaggaagaggcgttggcagacacggttgtggccacgcgagaacctgtcgttgcagttgaagcacaagccgaggccacgccgttcctccatctcagcctgagataggcgcttgaccattcggccctcaacggtcaccgtggcagggtctgacactggtggttgaggaggcgccggcagggcgagttgctggggtggcgccggcagcaggccccgctagttttggcactggttcggaggccctggtacggcagctgcggcgcactggtcgcgcagctcgagcttgcgggcgatgctcatggtgaaggcgagcgtctgtggattatggatctcgacgtcgaggctgagcggtggttgaaggccggccatgaagatttgcatgcgttgttcctccgtgagtgtgcctgcgcgaggcaagagagactcgaacttgtcttggtactcgatgacggagtttgtgcgagaggattggaacataggggagggccaaaacggaggtggagcagctcggtgaagcgacaccatggaggagtgccttcgtcttgttggacttgaatgtaccacatttgcgtgccatcttccagggtttaggaggccatccaaaccttctcctcatccgcaatgcgctgctgatgaaagtatgattcacaacgattgatgaaggcgagaggatcggacttgctatcgtatttgggaaaatccatcttctggaagcgaggaggccgatcgttgtggtggtcgcctgaggacttggatccggaaggtgcagcctgctggagcgaggtgacctaagtctggagcttgtcaacggtggccgtgagcaccttgatgagcgcggcgagctcggtggtggatggtttagccatggtggaagtgatggatggagtgggtgacgatggtggattggagtgggaggaggaacgcctggaacctgataccaagttgtcaagcgtgtcggtgccgaggatagccgggccgcggctacgcagtttgtagctcgactcggttgaggtgtcaggaaccttccctgcacacccaatggtggaagaagggagattaggaaaagttgattgatattgcttgcctttagcaaggctggatacatagtttatattggctcgtggccatcttaatacaaggaaatgtcattattcctcctaaattaactctttccttgtttgattctttccaaaggactattccttgattggtgttgcttgctatgcatgcggttgagcaccatccagcttgcttcagcgctggtagtaatgactccacatgacatacttttccacgcctcatccctgaacctctccatctctactctcctgtaacagaataggaaaacccaatctggcgatggctgtctgccgccggtgcccggcagtgctgttcctccgttcttccttgcacaccggtgggtcaattaacctcagtcgattcttcttgcagtttatttattgcgcattgaatcaatctaggtcagtagatcgccttctctccttaattttcagtcaatcaacaagttaggcaaactcaaaatccccaatagcttctctgtagtttggccccctattcccctccatttccagcagtttatcgccgccataagggctcgtttaatctgcaagagaaagggggttcagagaggattgagaggaaaaaattccacaccataataggtgtagaataaatccttccgaatcctctcggtccacttgtgagagagggattaaaagaaggtcttgttcggtttagaggggattgaagaggattggaggggattgagggggaataattccacaccataataggtatggaataaattccctccaatccctccctcatggggattaacccaacaaggcctaaaggggtagggttccactacctcccatttccacttttctgatttcttggttgaaactctcgatggtcgccggcaagtcctccttgggtcctcgtcttcgtgatcgcagttgttgctgcttgtagtgtgtccgatctgcgagtatcctggtagtgtgtaaacttgatttcatcaatgcacagctattgttattctgaagatccaccaagcataatctcaatgtataatttttaattcactaaattattctcattcctgattagtatattactgtttaacataacaaggcacatatgtagatggagatcgaagaattgcttgctacgaagtatgaacttgagtgctcaaagtatgaagtgaaactcactagctcttagcttctcttcccaatccttttctcaacccaactcccttctcttctcaaatctcactcacaaagatctaccacttagctaggggattagagagggggtatgtgacttcggatagatatgtttcaaactcaagaatagccatcactaatggaggggtggaggagtttatataccagagcccctgaaaactagtcgtttctggcaaagattccttttttggatgtgccgaaatgcatcaacagaaaacaatcttagttttgcagccattttcggaattttcgaaaatttttggtcttttcaaaatatttttggacattctgaaaaacaccagagagcaaaatggccataactttttgatcggaagtccattttttacgatcttagactttatggaaagctcactcagaggattacccaactcaaccaaaaagaaggtccaaaatcactcaaaggataggttaatgggtttctctcaaataggtcactttaagcaccgagacatacaaaaacacatcgacgttgcatacctcttaatagtatggcattctatcctcaaatataaataggaaaataattataccaataggaatgtcttcatgccatcttcctttatttgtcttaagggatgccaacaccaaaaccatttcatcatatattcttcaaagatcgatgtgggctccttgtagcttcaaatggcctcgcacagcccatcatgacgaagccgtcaatcacccttcgccagcggttttggtccttcagtgccaagccccttgcttcccctttaccgacacatggtccatggcgggcgagcatcacctgcctttcaccgtgtcgtcttgtccatggaccatagtctttgtgcaagcctatgaaattgagcgagtttggtctaatgtgtgctccaataattttttaattggaaaaatatgtaccagatatgaaatgatgtagggatttgatttgtttttgttttatctagtaggagcaaatttatttaggaaaaaatgggagttcctttagaaatcacgtggattagttttatagccttttggcgaaaggtactgttgaacatataaagacttaggctctgttctatttcttcaactccaatttcaacttcctcgttttccgttagcatgcttttcaaactgttaaatgatgctttttaaaaaaaaagtttctagaagttgatttaaaaaagcaaataaatccattttttaaatttataatagttaattaattaatcatgtgctaataaggtttctcattttgcgtgaatccaaaatttatctccatgttgagatctaacggggccttagggtccgtacctacttattggggtttttttttccttttggataggggcaaatgcaggaagcaaaatgagtgggggtcgacagtctacaacttagttagaataggttaatgtatacataaaaatgataggggcatttgcccccacgcgatgtagagggccaaggccccccactgagtatactctaatccgcacaagcatttagcccgattgtcatgaaaaattataccaaattgttgacgttcttccaccttttcccttatggcctggttaagatcctcaaaacaaatctggcattcaaaacttgtgacctcagatgagcactcagcaaggccatatatggtgtagttgtagccatttgctatgagatttttccttcatgtgacaaactttatagacaagttagttgccttacttgtcaaggcaaaaataagtaatagaacaatatagttatattatgggttctaaaaggaaaatgggtcgcaaagtattgctatcttgtctatatttttagaaatattgaaatgaatagtgtgacaagaaattctaagcccacacaagtcgtaaaagatggtagcttccatctttgaagctcaaactatttgcacgttccgtattgcatacataacacaactattgtctgtagtactactaatatcagcacgacaccatccaactgcttatatctcctcttttgtgctattggccatgatcattgcaaacaaatctaggatagatgagaccttaagtggcagtgtcattgataaaaattgcatgtttcgcttgtatatattgtctggtgtgtagtttttgccttcacaatgaatctaaagataattggataatcccgtgacatatccagataatagtagaaatcctagcataaccagtgcaatcgccatcatttcaggtggttgctacacaaatctaaaatcataattaaaagaaagttagttcgacttaaaataatgacaattacatttttcttttaaaatgacatgaagagggacaaactctttctaactattttttaggggagctctttcaattctaaattttgagagtatattctacagttggtcttatcatgaaatgtgtttccattttatttttaaatcaattagatcatggttcgactgatactctccatcataaagcaactcattgtatatggttgttagagaatgaaacctcctcacttggattgtgtcagtcccatttctcttttcaaatccccattttgctgcagccttttagaactttatgctaatctaacatatttgttatgatttgtacatttagaggatcatttgcttggctactttatatttctgttggagttattcactgggctcaatatatctattgcctctcaatgtctggtcatactagctaactctgtgctctatactacggttggacttggtgactttatcatttaatttgatcacgcttttcgaatttctaaatgatatgtttcgtaaataaaatatattatagttaatacttaattaatcatatgctaatcacccgtttcgatttctgttcctagaactacttaaacaaaaaggtattatgaaacaaagccattatttcaaggctcgtacttatggaataactgatacttttgaacagggcaaatgcgataagtaatagggggcatttttttttgcagctataatttcaaggttcagcttcctatttttttgtgcataacacaattaattcattccttcgagtttttcctctcattaacatttgtgttgtactgaaaatgcagattttgttcggttcgcatgcatgctcattgttgctgtggacagagttacatggaaaatggaatacacttactcacttggccagtagctacaagcaagttaatcgatgtttaattttttctatcctcaatcaggatgcattgattggtgataactaattataactagctagcttcagtagtcaccgtagaaagggttggcacttttacatgctaccatcccaataagtatatgctatggctctttgcatgttatacccatatgtgatcaagtacttctatcatgagcagtaacaggagtgttccttagctaaatcagtttttcaataatcattacgttcgttctcttttcagtatgtagtgtttctgaaagactatatataacttacaacttcctagcaaatatattaatcactgaaagttatttacaataatagacaaacatgcatcacaaattctaagccaaattgccacgtggctgttaaaataggtgccggtttttagtttaaagccggcacctatttattgggtcaaaaaaaattgcagtaaattcatccacacaaccccaattccatataaacccaaattcatccctagagccccacatccatacagcacattcattcacattcacattcatcacaacaaataaaaacctacaagccattcatcacaagttcataacatataaaaacctactagcctaagtcaaaattcgtaagtcaaaaaattcttatctttaaatcctaaacatttgcatatataaactaactcaaaatgtgcctagtttaaaattcctaagtcaaaagattgtaagtctaaaatttttaagtccaaaaattcttaagtctaaggctgtgtccggcagcaagttttcccaactcctatctctcgtgttccatgcacacgtttttcaaacggttaaacgatacattttttttgtaaaaagtttctatacggaagtaacttaaagaagtcatattgatctatttttgaagaaaaaaatagttaatacttaagtaatcatgcgctaatagaccgctctattttccgtgcataggatacttgttcccaaccagtcctaacgaactcggcctaaattgtgaacattaatttgcacatatatccttaggtgagaaattcacaagtctaaaattcaaaagtccagacaattgtaagtgtaaattctagacatttgcatataattcacattcatatcctcgagtaaagagcaaatgagatattgctgagactcagcgcaccagtcaacttcagcctgagacgtgcccgtcaaaccacacgaaggcgatgaccagatgtgttacacatcccaggagacttgactaaatcgcttgagctctacaacatctcagaaattcacaagtcaaattcgtaagtccaaaaaattgtaagtgtaaattctagacatttgcttgtaagtgtaaattctagacatttgcatataattcgcattcataatgaatatttacctttaggcttcaatctttaaccaaacacaaaaaaaaaaagagcaaaacctcctcccctcctctagctgatcgggcaagaacgagaggtgccgctctcttcttgctcaatcagctcgagtggcatgggatggagtataagtactattgtcggaacaaaggtgtcggtttagacccaaaaccggcacctttgtcttcctaaccggcatctttgtgttgggcatgaaaagcactattggaacaaatgtaccggttctagaccaaaaaccggtacctttgtcttcccaaccggcatctttgtgtggagcataaaaagcactattggaacaaaaggtgccggttctagaccaaaaaccggcacctttgtcttgtcatagcgtgtcacgcccggaaattcactagtaatttccaaacttatttgtgcataaaactctcgtccaggaatcagccgaggtacacaaactgacaatttaatatacaaatccatcataataatatcgttacatacttataaaagaaatgaaaacaacagcggaattaacggtctagcgatggcttcagctccactcacacaggcagctcaactggggtataagccaaacgtcttattcttctggatcatttttcttcaactaaggttgattgattattgcaaggtgagcatatgacatactccgcaagccgcacagtaaatatgtgcacaaggataccaaaggatggcataatataggctcatttgcaaaagcagcatttagcaaaaatattgagaatgtaaaacaatagagtaattaatcaattttaatcaacactgaacagcacacccatgctgctcaggcccaaccattctgaacaaccatatccagttgtacagatctaactccaaaccaggagctaaacaaattattaccaattatagcatcaataattattgtgagaggtgtgagactaatcacgaaaaacattgctcaacccgcccatgaccgcgggcacggctattcgaatagttttactctggccagaggtgtaccattgtacccacaagatacagccccaaaacatgtcaccatgctctcagtaccaccacggtacctcgaaacggaattgtgacagtacccttcgcacaacaactcatcacagtgcaccattcctggatcataatcaccccctcaataaccagaggcatggactccccagcgacccccacggacttctcgccgcttctcagtctggtgccccgcaatgaatcatgctatacaaaaggtaaagccgttgcccacgctggcttgtggttggcacggttaatgtctcataacagtagctcgcgaaccggtccttaattgttatgagcacgaccttcaaaaccatgtgctcacaaccgccctttgccaagttttaattatcaattaattatcataacacgattaaccatcatgagctaccattaaatataaccataaataataatgtagtatgattcatcccattaatgagctaatgtttctaggcatggctaagcaattatatatatatatatatatatatatatatatatatatatatatatatatatatatatatatatatatatatatatatatatatatagcttttagctgaaccaaaccaatatataaggttcaagctaatcaatttattacccaaggtaacaaggaatagagtaatcaatgcgaattggccattacaaaggaatatgttcacagttgaaataaatacacagttgaaataaatagagaatttaaatataggatcaacatgctcaaaggaactgtgtttaggatctgtgtgacttgccttgcaataatcggtcttcaattagtcttcagaaccacttccgacgcactcgcgaacctttcgcaacgacggaaacaacaagctaacacgcaaaatgggaaaaaagactaataaaaaccaaataaacagtacataaaagtaaacaaacatgtagatcatgattttagataattttagatgaattccaattaaacctattaaagaaaatactattccaaattaattaaaccatttacaaatgatttataactgagagaaaagattaaaacaacctttgaaaaagattagattatatttggtagatgacatatagtaaaaagaaataatatgccattgaaaagagagaacggatagaagtctcaccgaaccaaagtgatcggagacgaagggatgatgacaacgttccagcagcaacacacggagatgacaacgctagaccaaccacggattagattatattggattaagaccctagggataaactacaccggtgaacgacataagagcggcggttgccggcgaaccacgacacaataatgcaaacagagggcaccgggaggtagaggaggcgacggcgattcttaccaacccttacgtgatgacggacagcgacggaagacggccggcgactctggacaacagcggcgacgaccaacggtgatgctccaacggaaacaaagggcacaggaaggaataggaggacacagcgaactcacctgtggtggcggcaacgagaaacagcgacgggagatggccggcgacaagctccaaaaggcgacgaggtactgtccacggtggcgacggcgtttcggcgaccttcggcgacaatggaagggtggccgggcttcacttcgcagctgcgaatccaatggacttcgggttgatggcgacgacgggcttcccggggtcttcggcgcaagggaaccagctgctgggcttgctcttgaccttgcggagccgagagatgtggtggcacaggagggcgtcggctgaggcggcggcaaacggcggctggagcggctgccggcggcggagagagaagacgaacgcggcgacggcgctacaagcgacggtggagagagggagaggtggcggccgaaagaggagagggaggggacactatttatagccacgggagagagagatcaggcttggaacgcaaagaatcgcgccgggaaaacctagggtttggtggagagataaactcgaaaacgaatccaaattcgcgtcgaattcaaagggataaagtcggatttttggtggaagagatagaggaggataagaggaatatttcccctcaactaattttaggaatgcacgagagataaggccggattcggaggagaaaaaccgagccaactcggtctcagtttggcagccaggggttgaagatgaacagtactagggacgtaaggtagactttctctgtgagcttcctttactaggccggattgaaggagggaccaaaaatggactttggaggagggatcaggccagccgaaaggaagggagaatgagccgaggactaaaggtgaacttttccagtttcagcctgaaaaggaaaaagggattttaattacttttccaattaaattaatcactgaaatgatctttgaattgttaaaaatacttccaatgctcaaataatttcaagaaaaatcctgaaaatacttggacacccaaagtacttaacaagattataataagaccatttaatgattaatttaatatgtggataattactgaaatgttctttatattattaaaattaggaattgagctccgaaaaatctgagaaaatttcagggagtataattaatcatggagaattaaataaaaattaaatcccgccatgatttatatttagaaaattttatttcctatatttaacttcacttgtaaattaatgaacatttaatataaattctaataataatttattaaataatttataaatcctaaaacgaaaatcaggatgtgacatagcagctagtgtgggagggagaatattaaaggtgccggtttttggtcgagaaccgacacctttgtcttgtcataccaagaaccggtacccttgtgtagggcccaccgtcgttcataaaagcactattgaaacaaaggtgccggttttgggttgagaaccggcacctatgtatggggcccgccaacggctagtgggggagggagaagattaaaggtgccggttttgggtctagaaccggcacatttctctgacataggttttagttgtcggttttatttaaaaaccggcacatatttggacataaaggtgtcggtgttttgtgtgccggcacctatagtggcgacatctatttgccttttttaagtagtgctcgggctagatgtgacatattctagtacaatgaatgttcaaatttgtagtactgtactagaatgtgtcacatccagtattacgttagtttttatggaacggaaggagtataccatatcattttatt

SEQ ID NO: 86673 - DNA, 2489 bp, Oryza sativa
ctgcagccctaattcacattagatcaacatcaactccaccaccaattccttgcttcctatataactagtaaagacgcacacagtggacttgaaatctgaaggatttgttgctaagacctgctggatagaacggccagatgtttttatgtttatctagtgtcgatcacttattttcacagggcatttttgaccaactttaaaagaatgttaatgagaaaaccgagaaattgaccagttccacttttcttgatgtttacaatagaagctatccacagagtacttgatttgacttcactgagtttaccgactactccctccatcccaaaaaaagccaacttctggctatgtatctagacatagcctatgtctagatacatagccagaagttgtttttttttttggggacggagggagtactcattaacatagtaagcaaaaaccggactagactggcagtccaaaaatccaagtaaaaatatatttttgttaaagtttggagctgagcgggatcaaaccagggacatctggcctcttcctgcctgaggcttctaaccaagtgggttttacctctgatttgtaagtgatcttgcacattcactcatatgtgtaatctcagatccaatccaaaatacattgtaatataatattatccaacccgcctgttcactgtatagactgtggttataccaggtagagtgacacggtttgcccatgactttttgtactatgcttgtttgttactttgtgaaaagcttaactgaattgctagtatctgttgacttgagagagttacattatccttttaggtggctggttagtgattacacttgtgaatttgcaggtagttgcgaattgcatgcatgcattacaggagatctggaccctagaagcagctaagtcagaggaagctgcaagggagattgagacactatatagcaagccagtagtattttaccttcttaacaggtagattaccacctacttttttttctgttaactactctctcagtctctaagtagtattttaccttcttaacaggtagattaccacctacttttttttttctgttaactactctctcagtctctagaagagtgtagttttagcctaatatttttccctagaagagtgtagttttagcctaagatttttccctaaaagagtgtagttttagagtggtccactggacttctttaatactactatatccttttcttgtcatttttagccactgaaccaatattattccctcctcctccctcattgttttctccccctcgttttctctttgaattaatgggcatagtagtcttttaagttttaaccttgtgcttaatatgtctttgactagctaaaactacactcttttagggacggagggaatactcaataactctattccgtgcatacttattgttttatttgtcattgcaggatcaaagagttcagtgagtgggcacagtgcctcgttctagaattagtgtcaaacttcctaccatctgataacaacgaaatttttgacatcatgaaccttcttgaggacagacttcagcatgcaaatggagctgttgttttggcaacaatcaaagtttttctccacttgacaatgtcaatgactgatgttcaccagcaggtcttactcttgcagcatagttttgatacttacgctagtggaagtttgtcactgttatgcatacagatatactgaaattccattttgcataactaaagccccacataaatgctttggaagtttatatggtctgataatttcttcactctgatctgagatcacctggactgtttggatttttatacctttttgttgtatggatttcatttgtgacattggttttgtgcactttatagtatgaaagaagagacatgactgatgatctttgtaatcattgtttgcatactccattgtaggtttatgagcgtataaaagcaccactgcttactcttgtaggagctgggagtcctgaacaatcatattctgtgctatgccatttgcatcttttggtgatgcgtgctccaatgctattttcctccgactacaaaagtttctactgccagttcagtgatccttcatatgtcaagaagcttaaacttgagatgctgactgctatagcaaacgagagcaacacctatgaaattggtacagcagatatctgtttccattgattatacatcggcatatctcacaacatatgtgatatatttttaactccatgattttcattatgtttataaaattttgtggccttctttcgttccagtaactgagttgtgtgaatatgctggaaatgttgatgtaccaatcgcacgtgagtctattcgagcagttgggaaaatagcgctgcagcagtatgatgtgaatgctattgttgacaggcttctgcaattccttgaaatggacaaggaatatgtgacggctgaaactcttgtaagtttttttgatagtattttaactgttcatcattcacta

SEQ ID NO: 86674 - DNA, 8188 bp, Oryza sativa
  unsure (1)..(8188): unsure at all n locations
ttcccttgcaatgcattgaagaatttgatcaaaactggaacttttttttttggaaatttaaactggaacaatattgacacgccgtgcacaatcgacagcgaaaggttggtatagagattcaacgttaggtgcagatgatataggaagtggcagcacaagaaggcaggcatgcccacctgctgcaaccagaggcaccaaggagctgcagttagatggtaagcagaacagctgaggaagccgtgtatctttcttttgccggcaatttcattgtcagatcagatgttagacaaccccctttcttaatactacaaagatgtgcaagtcttttgcgtgttccctaaaagcagctaagatgaaggctgtgattggcagcaatgtctctccttataataacagtggccatgccagctaggccatattgatgaagggtgtgagaagagcagatgggaaggatgaacaaaggccatgattttcaaaaccaggcgaagaagtgaacatgccagttgatgtaaatttgtgagactgtttcctagcgttctgtcatgtttgtgctcctttctctattttttttaatgtaaaagtaggaaagcggctagtatttcattgaacggaaagaactcctttctttttcttaatgatataggagtaacaagcaaaattatctacataatcttaaaaaaaaacatacaagttggtaaccaattaaccatatgcgccagatttcaatcgtgaaattttatgtattgtataccttctagaaggtttttaacctgctgctaggtgttagtcaggattcagtaaagacaagtggagaacataggacaattgtgaattgtgtgtgcattttattcaccattgactactccagattttgcagagaccatagaatggttaaaaggaaacatgttgcattgagtaggatccattaaacttggtaccaggcaaacaagcagctagcgaattctaatcacatctcttcagcttctcccaccaatgaattcagaaacctgtacagaacaaaacataattccttttaatgtgtgggtggcaattggcaagtgccaaagcacaacaaaataaatcgattattttttattgttgactcaaaatcaccagaagtttcactttcatatttgtttgagataaaaaaaatatcgattataaaaaaaattgcaagcaaaaaaaaagagagagatcagagatcgaatcaaataaacattttcatctgtacggggctaatttttcagccgtggcctccgtgttagtcatggactctgaattgaacacaataaaattatctaggagggatagaaagtttgaaaccaacataaccaagtcatatgtggaaattccccgaaccgccaaattgagaaaaacctaaataaacccccaaatcctcgaatcaagttaagctctttctttcaactagacatttcacgcgcgttgcacgccctatcaccgtatcacacagtaggatagcgaaatagtagtttgttttaccgatatctatacatgactggacaatgcattacaattataaatcacttaacctaaaatacagatcacacattgcacatcataattcatcaattcaggtcagctgtcatcacactatcgaataggtacacgttgtttaattacatacaaatacccaacatatatcagtaatctggaagtgtcacatttatatctccatagtccatttccgtcaaaagttcaaccaccaaacaatctgcacacacagaaaaggcatttgttagataacgaagtatcttcatacactgtaggaataaggacattttgtgctagaaccattttagcccatgtatgtatatatccaagagggcattgacaggaactgcaataccaaactcaaaggatgacgtgtcagatttgctagcctgatgtgcattgattatcatacatgcatgccgaccaatgcactaaacaatatatttttctcaaatgtgaagtttgagacaccccccaaaaaaaaaatctaagcaatttacgacacaaatctaaaacaaaaattacaaataaacagagtgaaactaatgactggatgcatacctgattttggttccacctgaaacagcacaaaagtaatcataatagagtgaaaaaaaatatgaccgtcaatctgaagaccatgtgtacaatgcataatttattgatgttcggtagatttgctcaggatacacaaagaaaatctcacctagtcacatgccaactatcgtaaattaacctcaattcacattgtttacatttcattgaagagcagaactataatattcgtagcaaacatagcagatgatctactcaccaaatcaacaccgtgaaaaaaaaggcatagctaaatatacctgaaacagctatttccataggaaaactaccattgaaacaatactaaatacaaaaggcaaaaaaatctagttgaagttcaatcacggaaagcttttacctatcatacttccacagctccactatacagttttgaatggtgttactgcccaatttccttcctgttccttctacctgacattcagttggataaaaaaactggcagctaacagcagtacaaagggaccaccgagtacctgctctgcttgatacatcagccaaactaccaaaaacatattattttcagacacacaaacatgaaaataaactgggaagttagtacagacaaaatgctgaggggacttagtttcagagatgggtatacctatgttgattcttagtagcatttagcaattttacagcctactcagctgatgctctgcacagacatgtaattcatagccagtttaatactttaattatgacaattgccaataactgaactacattcagattcaatcggagtatggatgatcaatcaaacaaatatatgacagcaaagtatgtttttgcacgttgagcaaaaacacaataaaaattacatgtataagagctaaaatatcgaatttagaatcacttaaagcaaaagnccttttcttttcccccttttttctttaaaaagaaaaaacccccccctttttttttaccttgattgacagcacacatatagcacaaccgatcaggataaggagccaagaacacaatttttgaaccaaaataatccaaagttagcatccaaattttccatgcccaaataatggatatcaataggccatgcatgggtagttgaaaaattttaagatagtttcagactctgtgctaataggaaaaatagcaaaacaccttaaaggcaaggcaaccaactcacaagcatattctccgtgctcatccaaaggtggccttcgtaaaataatagtagaaatcatatgtttactacttctatgcatactgtctgcaatatacccccaaagcgctgaagcaccttctaatatgtttgagctgaaaacagtcttcaccgttaatccacccatttgatctccaagaagtaagaactactaaatgttctgtgcagagataaatcaatagattattacttgtttggtgaattaatgttgcaacacacagcatggcagtggaagaaaacgcccatgcgagtatgcgacaatgttgtttcccggccaagggccaaccgtgcggttcccaccgatgaattaggcctccatgatttccagtatgtgacccaaatcggttaaattaaaacctgccctgaattggttggtgagttgagagctattcgggggtggcgtgttcgcatgcggagctatccacgtcgcccgcgagcgcgtctccttccgcgtccgcgcaagccgctggctggcgtgccgtccgattggcttgagcgtacggctaggatgaagcaggtggatttttgcagaaaggaccttttcttagtagataatacttttaggtccctcaccaaacggttttacgttccgagttcttaagttaaggcccgcgctctgaaaaactaagtaaaagggtcttttttgaatgaaaaaaaaagagcatacccaatccgcaattgattaaagcggttgctttggagttgccggaaaatttggatcctttagagtagtagtagtagtagtaatattcatgtaatgtttgtgacttcttccatgctctgatctttgcattcttttttttttccgtgcagtaaatcaatctctctggttcctgaagatgaacagcatcaggaggttttctgggatgcgcaagcctaacgccccatctgcaatacataaagacaaagacgagagcgtagttttcttcagggagatgtacaagcgtgaaaaagatagggacatcaacctcctggaacccatgcaatccgttgagtttgatgctatccaaggtgacatcttcggctcttgcgtttctatttttcctatatgtgtcgtcagaaatgttatggacatattcacaatctcttgattagcaatatgaacatttgattagcaatatgaaaatttgcagttgaaaatcccactcaaattgcttcaaagatggatgacctcactgcagtgtttgtgttcttttgaatttgtatctgtgataggtggccgcacgagcaaagctccgtcagggaagacagatttcctcatagcagtggacgagaagcatgactacgactggtaggatggaattcaattcatccagatgactagatcatatacttgtgttgttggaactgtttttttagaagaacagcttgtttcaggctgaagacgcctccagctacaccactgtttccttccatagagatggaaaccaactcatctcaaatggttttccagaaggagctaccaattcatcagcaagttaaaccttcagcttccagggtatatactaatttgctccataaattatactgaatgattttctttttactgaatgctacagtttagagctcctaagtggattttctgctcaattgcaatctgcatttctagattgtctcttcatcagagagcttctcttgatcttgattttatcaattacagctatcaggaaagacagaggcaacgaaaacatcggcaagatcaatgtttcctgcacctaactcttcatcagagaagagcatattcagagtgtccacacaatccatctccaatgagaagaaccaaattgaaaggagatcaacttctgcagccataacgagcggaacaaaggtagttgctgcaattacacctacagctcctaccgcaacttgcaatgcaaccaagaaacactctgaaagatgctatgcaagccaaggtagcagtacaaatggactcaagagagtgacgaaccctgagctcccctactgtgcaccgaagaatctgatcacaacgccattgacagcgaaagcatggcgtagtgatctagcatttggtgtgcatgacacagcagaaattggcaggataagaaggcagtcatgcctaccagttactgtcatggatggcaagcagaaaggcttacctgataaggtgaaggctgtgactgtcagcaataaccgtggtcgtgcaggcgatgccacattgatcaagggaatgagaagaacagacgggaagaaagagcagaggccaaagcatggaaatcaagcgaagtgagcttgtcatttggtataattttgtgaaaccaataattttatgagacattttcctggcgttttctcgtgtttgtactcctttttttttcatgtaacgcacaagactatttgcacatctggtgtagatgtggtttcaactctgaaattgcatgccttccaagttgaaggcttttaaacagctgttgggtatcttggatttgtggagcagaattatcccgctgcaaatgatcattgatcagacacctcatttttcatctatatctacatattttgctaaattaactagcatccagatatcaaaagacatgttcacattgccagcaccactgctgtaccagtatacatgcatgtaccaggtaaaacttttctctgcagaatcttgcaccaaaacgaaccaacacatgttgtatctaactatagtatcaacggtaatcggcgttcatcggtttggaacctgaggcaagtatcagatttgcaagagggaacagggcaacaggctgccaccggcatggccactgccattaaacagcattggtaggattgagtggctttcctcgccccatggtaaatcctcttgtgccatctggcatacgaggaccagggggtggctttgaaggatgatcagcaagagcactgtgattcgatggaggagtgccaattggatgattggcatcccggctatggccatagtactgaccacgggcacgccctcttccaccacgtcctcttcctctttccgtgcctcatcccgcctttgtcatggtagccatcatcagcctatgaaatttatacatgtcgttataatatccacacttgattctggcgcacaataatggtgagcaggagaggatcatttaaagtacctgatgatcaagatgtgcttctgaaatctgggaagcatcctctgtttcgtagtcttgtggatggtcagttgtttcagggtcatcttcgtctgcagcatccacctcatctccacctcttcttccttgacccatggcttgtttctaatgacaattaatgaaaacaaatgtttaacgatttaagaatcttctattttacaaataaataaaataacatgcatagtaatgtaggaatgttaaatcttactaagctagtcaaacatgtttttctgggagctatatctgttgataaatgatgaaatgaccaaaaacaagcttacacctaatgtttacccatcagttaaatatagaagtaactaaatcaagaatgaacaaaccacccagtattgccgattaatgaaatataaatgttaatgactaagatctagtcaggaaacacaagtagtgcataaaggacaattgtgaatcgcaaatgcattttaaaaatcagtccatggttaagggagaacaagttgcattgtgtagggtccgttaaagtaccaggcaaccaagcagtgagcggactctaatcccatctctccagcttctcccactactgaattcagaaacctgtatacagaaaaacagagttcctttaaattgtgttgatggcaactaccaaagcacctcaaaataattcctagaaaaaaaaaacaaatggttagagaaatcaagaagacatactgccttttcagcatcttcaacagtttcatactccacaaaagcatgcacctgcaagtaaagccaaaaaaaatgagggacgaaatcaaggtactggtgttgaaacttgaaatgccttccaaaatagtatttcattgcttatccctcttttcaagtatgacatttcggacatggacaaggtcaccaacatgcaacttttgatcatcacttctatctatgaaatagtaagcaatgttttaaaaaacagtacatggtttcgtgtggtcaccccaccttgtagggcttatgtggtgtaatcggccacatatgcagcttacacggtacaaggttagggcacctgtaccttgtatgtatgcaaccttgtaagcagccttgtagaacttttttttaaaacactaaataagaatatatgaagctaccataatgtgaaactatcccatgagaaatctaatgctaacatctgcacatatcaatccaaacagtaaatgtattagtgatcaagtattaagaagttggaatacacattcttgtatggtgtcaaatatttattaacagagctagaacaagtatatgcaataactaataaactttccgtgttcctttagaagttagatataccatgatacattaccttattagcaaacaacatctcaatctttgatgctttgccagtagaagttccagcaccatcaatcccaccttgtggatagcaagtacgaattgatttcacactgcaatatagaacatcatgtgttcaacaccacatttggcatatatttgtgctcaaagacatgcattgatgcatacctcccaaaagctgagaaaatcttcataagatttggatagcggtgctcttcacgcaaattttcagcaacaacaatgcgtgactgagtacacatataacagaaaattcagttcccatacatatataatgaatagattttatttgattaattagattctgacctgaacttcttcagcatccgcctcagtaaagagcactcgacgtctaaccctttttccatcatctgaaacaacctgtatataagaagat

SEQ ID NO: 86675 - DNA, 923 bp, Oryza sativa
gtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtatatatatatatatatgtatatatatatatatatgtatatatgtatatatatgtatatgtatatgtatatgtatgtatatgtatatgtatatgtatatgtatgtatatgtatatgtatatgtatatatatgtatttcttccttcaattccttctttaactgtggggaggcttcttcaaatttttctattatcttccaatcaatatattccccatctaatggatccactccttttgttaagcattccttgtatgtgggttttttaaaaaacccttcttcttttatagtcatcttaatgggtatttctgaagtcttctttcctttagcttttttgcatttttgaatatattcttttgcagcaggctctagataataatttattcttaatatttttctagcttggcttaatgcttcatcaatatccttatatttcttccaagatattcctcccattaatttagcatctattttttgagccacaatttcttcaaaagaaatgtagaccccagggagctttccatcaaatactacatatataggcttttgttggattacttcatgatcttcattggcaggcattaatgacccatttattaggtgaaaatattcagagaggctattcaatattgataacaaataccctttttcttcccttttattattgtattggtaccagaaattatccaagatgcactcttgaacttcatctaggattatatggtcctttggcttaaatttatatgaatttggtgggaatattctgagtttgttgtcatctccaaatgtgaagcactcgactccggcgtaattcattgatcttttcatacctgaa

SEQ ID NO: 86676 - DNA, 10592 bp, Oryza sativa
acccttattcacgtgcatagatcttataccgtaaaactttgcgcgtataaaatatattctatataaaaatatttgaatccaaattcgaatttaaatcggggtatataaacttttgacttataaactttttctctataaactttagatatgtaaactttcggtatataaacttaccaaaacagaaaagtaatgtagtgctatataaaaaatatatgaattcaaattcgaatttgaatcgggtatatacccttttgacttataaacattcgctcagatgtgtaaattttaggtgtataaactttagatgtaatataaaattactaaaacagaaaagaatgtggtgtgaaaaaaaaaaggtgggaaggggatccgatcgcccgatcgcggggcaatcgatcgccattagtcttttcgtccctttcccccttttctttcctctcttctcaccggtttcatttgtgccaaagccatagagctctcctccctcctctgcacacaccttccggcggcgcaccaggcggactcgaggacggagtgggagacgggcggcgactccgggcggtcgcgggcggcgactcccggcggcgcggcggcgaccttcccggcggcgagggcggcgactctcctgacggcccaggcggcaaggacctcgggggcaacgagcaacaaatctgggcattccattcctcttccattcctcttcaaatcaaggtatactacaaatctgagcatactacttgtattttggggattgatttgtttagatttgagtgctatagtagtttctaagcatgtgcatgaatggttgatagtgctatatttgccattttttgatattttgttcagatctgagtgctatatgttgtatgtctcaatatatgtgtgtatgaatatggtagacctgatttcgtatcaaactttggcattgtagatggacagcagaacaaggtttctgatttatgcggctgcatcgtatatgttgctgccaatgatggctatggttattgagtctagaaaaaagaaaaggaaaagggttccaaggagagaagggattacctatgggccaatagatgaaagggataggaaaagatttgattatcttaatgacaagatttggaaaaatgatatcatctgtgtgaatatgctttggcttaaacgagcaccttattttcgtttttgtagactttttagggatcgtggcttgcttgtggatactatatatatgtctgttgaagagcaagttgctatgttcttacatacaatcgggcacaatgttagaaacaaggtagttggcactaattttgataggtccggtgaaactgttagccgatatttccacgtagtccttcgtgctattggtgacatgagaaaggaattaataaggtcaccatcaacaacgactccatcaaaaattctagggaacccaaggtgggatccttattttaaggtatgatatattatgaagtaacaacttccactggaatgtaaccccaatgtatagtaaactataagctctcaaggtggcatgtaaaacggataaaaataaaaagaaattaggggaacacattcaaaaggtcactaaggacagatcagaataagagctggaatataatgcaagttaacagaaacaaccaaaacaagcaatgaatgcaacaaaaaaatcacaacagtaaactcaaaacataaaacaaatcgctaaatactgtactagtagaatggtagtggaaccaaaattttgtgacacattaagggcctgcttgggagtttagtttttttttaagtaaaacacctgtaaatttggattacccaaaaataacagtgaaaccccctctaggatctacttcatctgtttgtaagaactgaatcctacatggccatagcaatgtgtatggacatttgtgtctaacagaaatttcagttcataggatcaatctggaactacaaaatttgataaacaaatatattcagattgaatctcattgttcatcaaaatttcagaacagaacgtcaagttgatgccttattccaaccattcaaagagtagcgtgagtataaacgaggatctgtcagccaatagctcgattattgccggagtccccaaaattcacacacaaaataaacaactgactcaagctggaaatcctcatattcttcacctaccgagccaccgatgtgtttcgcagctactatgatcaatcgtgtcgtccagatagaggacacgtcggtagtggcggcggcggcagctcagatcgaggaccggtgacggagcttatctatggcgcccctcggcggcgactcataatgaatgaagccgccccaccggcgacagttcagatcaacaactcccctcggcagcgcggtggcgcagactgagggcaaccccggcggtggggagcggaaaaaggtttcggcgacaacggcggaggcgccggggcagtggcttgagggagaggcgcccatgaaggcgatgtgttcgggcagcgcaatgcccaagccgcacgacgacttagcactagctgctgcagcaaagcaaaaccacacccacgacgacgcagcggcggcagcggcggcggcggtggcggaaaccaaacgaccggaaaaaaaaaccaaatggctcgcccgcgatcgccggtgcggctgctcaacctcgacggcggcgcccacctcttcacgtcgccatcaaaccgagcacaggagggaaaaaaaaccgagcgattcgattcgcgagagggcaaagcatcgaagcttacttgcgggggtggagaagccaaaaaaaaagtttcaaatccacaggacgaatccgtcaaccagacgacctcgagacgcactcccctcccaaatggcggcggcgagcgaggctgaggccgacgaacgtaagagacgatgaaccgaccgcgccgcgaagaaatctccgaaatctcgtggattcggtggggggagaaatcgatcaatctgtggagagaatttttttttttagaatccgatggagaaatcgggggggaggggggggaggaaatcatggatgagctgtctccgcggcatgttcgaggtaaaatgtctgctccgctaacatgggcaggtgggcgcgtgagagcgagaccaatgttttcgtcgcgtgtcagtggtggtggggccatggcgtgtggggcctgcttcctgaaccggggatttgctttgctttgtgtgaatgagatggatcgtgcgctgcagtgtatgatttggctggtgtcgaaggaggaggtggtatgctacagctacacgctgtggttaccagtttttttttctctttctctgacacgttgtctccacagattgatcgatttctccccccaccgaatccacgagatttcagagatttcttcgcggcgcggtcggttcatcgtcccttccgttcgttggcctcgctcgccgccgcctacgcctcagccgccgccatttgggaggggaggcttgcgtctcgaggtcgtctggttgagagattcgtcctgtggatttggaacattttttttttggcttcacccccgcaaataagcttcgatgcttttccctcgcgaatcgaatcgctcggttttttttcctcctgtgtgctcggtttgatggcgacgtgaagaggtgggcgtcgccgtcgaggttgagagcagccgcgctggcgatcgcgggcgagccatttgggttttttttttcggtcgtttggtttccgccaccgccgctgccgctaccgccgccgcgtcgtcgtgggtgtggttttgctttgctgcagcagctagtgctgtgtcgtcgtgcggcttgggcattgcggtgcccaaacacatcgccttcgtgggcgcctcttcctcaggccgccaccccggcgcttccgccgttgtcgtcaaaacctttttccactccccaccgccggggctaccggggtgtcctcggtctgcgccaccacgctgccgaggggaattgttgatctgaactatcgccggtggggcggcttcattcattctgagtcaccaccgaggggcgccatagatatgctccatcaccggtccttgatctgtgccgctaccgacgtgtcctctatctggacgacacgattgatcatagtggctgcgaagcacatcggtggctcggtaggtgaagaatatgaggatttccagcttgagtcagttgtttattttgtgtgaattttggggactccgtcaataatcgagctattggctgacaaatcctcgtttatactcacgctactctttgaatggttggaataaggcatcaacttgacgttctgttgtgaaattttgatgaacaatgagattcaatctgaatatatttgtttatcaaattttgtagttccagattgatcctatgaactgaaatttctgttagacacaaatgttcatacacattgctatggccatgtaggattcagttcttacaaacagatgaagcaggtcctagagggggtttcactgttatgtttgggtaatccaaatttacaggtgttttactttacaaaaaaaaactaaactcccaagcaggcccttaatgtttcacaaacttttggttccattaccattctactagtacagtatttagcgatttgttttatgttttgagtttagtgttgtgatctttttgttgcattcattgcttgttttggttgtttctgttaactcagtatattctagctcttattctgatatgtccttagtgaccttttgaatgcgttcccctaatttcttttattttttatccgttttacatgccaccttgagagcttatagttttactatgcattggagttacattccagtggaagttgttacttcataatattggagtaatattatattctcaaactagtgtgtctggtttgtctaagccttgctctttgatatctgctattctgttctacaatcttctggcatgcaattatgagttagcttaacttcctgagttcaattgtgcactgctctgagagagtataaatcaataagttcagaacgtagcaccagctttgacaatcatgcgctgattcttgttaccctgttttctaactttgcaacattttgtactgctttgacaagtatttaatatttgcgagtagtctatcaagttttgagttcagcagagataataatttcgagagtatttgtttgcaggttgtcaaatgagtgactcaataatctagaaaatttatatcatgagaaaaatgtgccattcatgtgaatcggaagatgcaacaatggatggggtcgatgatggccttatctgtagtacttcttgctataatatgtgtggccatgctgacaaatcttcaataattgatggtgagattggttgtccaagcatggaaataagcccttgcaacactccttatggcactcctctttttagccgagaaagttcttgttcaagctttgccagttgcttttcaagcctcggtgagtgttgttgcactgttctcctatagatgaaatgctgtcattgatatcatttgctattttttttgctagcataactaatattttttatgccatttatttcctagatgactacctagttgaaactgactctgaagaggaaattgaggtcttagatactggccaacttcatcccggcatcttattctctgatgaatcgatggagcaaagaacagtgggttctgtacaagtggaagaatgtcaagtcagtcatgctgctgttgttgacgatgattctagtatttccattccgacaaaccagaacatttcatctggtcaacagcagttggagatacatcttgatgctaccaatgaaaattctgttccatccaatgttattatagatgcaaatgtaacggatcctcatcaagatgtcatttccaatggtggacttatagaagcatgttatggtgtaccattggatgatattgatctcaaacaatccaatatcttagatggtgaagagattactagccttcctatggctgacaatgaaatgactccactgaatgatcaaattatggaccaaattgatgatatgaaggaaattagtactatagtttacaacaatacaataagcgctgagcagcatgcaaattcaggttcagagtttgagaaaggaaatgaatccagtgaaaacctttatccgctagtaatgcccagttttgatacagaccctcacatttggttaccaccagacccagtcaataaggacgatgacactgatattgttgctaataacgatgataatagtgacaacaatgatagttgggtacagtcaagtttcaatattagctttgatgcaaagagaaacaagactagttgtgaagaccaattgcagaaagcaatgtcggaagttatgaatgggcaattcaagattcttgttagtcgttttttagctgctgaagggctctctttgtctgatggagaagctgacaagaactggcttgatatcgttgcttcactatcatggcatgctgcattacttgtcaagcctgatgccaatgttggaaatgcaatggatccttgtatgtatgttaaggtgaaatgcatagcttcaggatctattgagcaaaggtaacctaccaacattcttcctcattctgcttttttttctttgcttagtcatgtagacatgccttaactagctcccttttctatcttttttttttgacagtgaagtcatcaacggccttgtttttaagaagagcgctgctcataagcagatgcgtgccaacatgaagaatcctagactgttacttctgcagggtgttgttggccattcttctgcagggctattgtcaatggattcaatgaaacaggtgtgcatgtatgcccttagtagcatatttacattatgtacagagttatgtcatatgatacaagatatgcaaatttcttttcattgtcattgatcaggaaaacgatcacttggagaaaattctcagtgatgtaattaccaaatgcaaacctgatgctatattggtggagaaagcagtctcacgaaatgtaaatgaatatattcataaacaaggagtcactgtagttagtgacatgaatatccgtcggctggaaagaattgctcgttgcactggttctccaattttcttgttgcagaatgttcttgcaacacccaaccttattaaacagtgcgagtctctacattttgaaaagtttattgaggagcataatataactggaggaggaaagagatcagccaaaactttgttatttctagaaggttttcgaaagcctttgggatgcacggtatgttcttttcctatcttgtttttagtttgtaggtcatctgttctctttatgtaggactgatcttctcatggtggtcagagttgttctttctctgatcccttgagctgcatttagtatattctttcagtatattatttacattatatgtgttagccttctatgataaatatttttttctgccattttttttgacaaactggtatatataatgataaaatataatcctgtccatttggaatcaacaaaaatatattaattaattttgaagctaatgaatttccttattccagacttgacatcatgatttagactgaaattgattgaatcagataatataatcttcattgttggggttctgaattagaatcttaccttgcatttgtttgtgttatttagtgaaattatgttgatagaacaaaccaattagctttttaaatatacttttcccccatgacattagagcttcacaccttgttacctgcttaacattgagttatatcctaaagatgtattagtacagaaattgggacaaagtttcatagataggattgagttgctcatattgatattgattatagtatttctttttgaagaaaaaataactttgatttgtgcgacaatgttagctaatagccatatatcacccaaattgcttttaggggctttatatgttatgcacaaatgcataagatatgaattgttacaccttggatgtactaaaccatttgtgttaatgaattgaaacaaaatctaatcagcttaaaactattttgtagattttgctaaaaggatcaacaagtgaagaactgaagaaagttaagcgtgttcttcatttcactgtttttgcagcttatcatttgatccttgaaacttcattctttgctgatcaaaggttatttgcaacgggaaaaaatgccatggagaaaggcaactgtttgaaaactgatccacagctgcttgttccttgtactgctgctccgtcctccaaattctgttctgatattgcacaaaatagcgaccccacacaacatgctttgaacattcttgcttctgatggacagtatgttaatcaggatgattttgttaatccagagaaatccgtatgcatgcatgattccaaaattgaaacatctagagagcacgcggacagaaaacttgatgacagcaacaacattcagtcatattcatcattgccagttcctgacccctcgagaaatcttattggcgatatgtcgttagattttgccaaattggcatcatgtgatgactttgccggttccacctctggagctccttcaaacaatggggttctgcagacgtatggggcggatggcaaagattgtctagaaactattagtgatggaatatctacagggactaggacttctttagattctcagaacatattgatttcgatgtctagccaacatatcagaaaccaagcaatctgtgagcagagtcatctttcccgcataacttactacgggtattttgatacatcacttggtcgttatttgcaagatagtttacttaatgaggtcatacatcttaactgcttgttgatttggcagatgcttattttatcttatgatgtttcaattgacaatatattatttgcagaaacacaactgcttatcttgtggtgaacctccagaagctcacatgtactcttacactcaccacaatggcactctaactgttcttgtgaaaagccttcccttggatgtaactctttctggtaaggatcaaggaagaatttggatgtggactaggtgtttgagatgcaatggtaagcccacccagagggttataatctcttcctctgcgcgtaatctgtcatttgggaagttcttggaactcagtttctcaacacattctgctgctaagaagctatcaacatgtgggcatttgctgcatagggactgcctacgcttctttgggtaagtgcgttccaagatgctcttacctaaaggacaagtctttcctaatgacatcactaaagttacttttttcatgacttgcagaatgggacccaaagttgctatgttcagatactcatctgttgaaatatattctgcctttaagccaccattgactttggagtttcataacccaaacaaaaaagaatgccgggaagttgaatttaataatgtatgtctctccaaaaaaattttctgaaacatcctctttttagctaattacatattttaatcctaatatacttggttattcaaggtacttcgaaaatggaggctactcttatctgaagccgaaaataaaatacaaatcttgaaatcaggaggctctggtcaagccttgggggaaaacaccaaagtttcagtacatgaggaattatttttggaagtcaataggatacttgcacaagaaaaatatgaatttggggtaagcttgatatcaacttctattttgttctcctattccttcccagaagatttggatctacttttgatatgctaacatatcttgtcaacacgaggtttatccgaagacatttgacttccttgtaaaatctgggacttgtgctcacgagatccttgggttgaactggctacaccagctacttcttcttggaatttacatttgggatgtccggttgcaacatattcttcaatactgtaaagctaacgctgcatctccagatagtactatccagataaaaacaccagagaacaagccaaagaattctgaaataacttctgttcatggggacacactatctcttaccaacgttggaatggaaaggcaggaagcacgtatcgatacttgtcattcttttgatagttcatttggcggtatgattttggagaatgagcagctaactgagaaatcagtaatccaagagcctgggtcacatgttagtccagatcatcgtgaagatggtggatcatatgaagtcgacaaatatgcacatatctctgacagtttttgtttagaaaagttaattgacttaccagttaagaataatgaattgccagaactagccagaggtaatgaaatgtatcctgttgccaagccaagcaagtgttttgatatattccttaacctatttgatttcttaagtaatgatgccagaaaatgggtctggggtagttttagtcacctggaaaaggagtacaagaaagagcttcagggtggttctttggacaagtttcatctcatcaacaaatacatccccaccttttcatcactggttcagcttaaatcccaaatggacatggtacagtttattgttggccctggtggtagtatcttgtccattgttgaggacgaggcatctagtatgattgcttatgccctattgatatctgagcaacaaggaatatattcggaagc

SEQ ID NO: 86677 - DNA, 2310 bp, Oryza sativa
caatgtttaaaacattttaaaagcaaaataagggaaatcaaataacatttgagaatggtaagctcattttacctctttttcgctgcccgagtggatcgcaagttgtattgcgtgggttgcgtcccctgaggcgcgtcgggaagctgtgacatgtctatctcctcggcgtctggtgcgacgtagtcctcatcctcctcgtcctcatcgtcatcgtcgtcgctaggtggagccggcgccttcccctttcccctcccttgcttaatgcgtgacgacgacgagccaccaactccgtcacgctcttctatcctgatggagtgtcgagcagtacttggacgcgcggattgaggtagtggtggtggtagtctccccggttggtacacgtcgtccaatccaaccgacctgcaacctaatcttgctgcaagtttccggcacctttgacgaactttctgcatttcaaaaaaaaaaaagtttgttaggcataactcaagtaatgcaaagtgctaaataaattttacctctaaaacattgcggagcgtgttctccgtgtcctcaccacccctcggagcttggagggcatgccccatttcattcacactcctgaggagctctctcgactgaaagcgtgaaaagatatatgttagggtctagggtgcaaatgtaagtaactttgacaaatgcaagaaaacttacgactctgtctctaagtggggcgtgctccatttgatatccaactctagtccggacatcatagggattccgcccctcatcggagtcgcggtcatcctctatgtcggcttccgtccaagtagggcggaggaacagtctatatgtcctatgcagccaacgaaggtactctgagaaaagatgattttggtgtatagtttcgatgtacctatcgttccttccggctattctccattcatcaatgtatctattatgctctagcccccagtctttcaccttctttgttctcaccctgtcatacctagacaagtagaaggtgatgaaatagtagtgagcatcgacaagggttaaatggtacaaaattgaacattgacaatgaaagcaaacaaagataagaaatatttacttgtgtaattcaactccagttgagatgtcctcaaccggccaatcttgtttcttcccgaactgtcgcatgacacggtgcggaaggtggtactcaactgcccagaaacaaatcaatgggcactggtacatgaaatagtcagagtctcgattgcacatcgagttcagggtcaggcttgaagcctcatttgtgtggtatggtaaccactcaatctgcaaaagttgaagagatgtcgttggttagtatctcaattaaagaagtaaatgtctaactagaagtgatattggaagtacttacatgttgaggctgcaagcagtccatctcattgacataatgcttgtatgccacatcccggtgagcatgtgcagtggcagtactctcaaaaaggtaggccactgtcttctccatgtctggctcattgtagggccaaggagtgaagctttgcctccacttaggccttccaaccggtagtcttaaccacatccacatctgaatcaatagcacacaaccactcatgttggatgatggtgcctgacgacaacaggcctcacagagctgtctatatgtccacgccaacactgctgacccccaactgaaacggcccagatcaccaaggttggcgaccaaaggaatccatatcgccgaagcaatgtcacccccagcatcaggaaacagaacctctcccaacaagtgcaagatgtatgcacgggcataacactcaacacgccatggctcagcatcgtcgtcaagatgtgagaagttctgactcagccaagacaggggtattccattctgcttcttcttccccccttgcccctgctcaatgttcagtggaatgccaaacagctgctgcacttgtgcatgccatccaggagtatctgtcctgcccgtcacggcatgcccccgtaatgggagggccaagatcatagccacatcctgtagagtgatggtcatctcaccactggggaggtggaagctgtgtgtctcaggcctccatctgtccacaagtgctgtcaacgcaggagcgttgaacactggcattcctctgctcacgaccaaggccaccccgagcaacccggcagcccttaggtacgggatgtacctatcgtcgaacactgggggggcatgagctctgactcggagcggttgaagtacctgcattagcaattgtaaatcaattagttaatataatgtcaaatacacgctaccgatacttatgcaca

SEQ ID NO: 86678 - DNA, 3284 bp, Oryza sativa
attgtaagacagaaaactgtctgaaccgagcaaccaaaaatggatacaacgctgcaaacaatgtaaaatgactattcacccattctacaaaaagaaaaaccatcgggatttttacagggctactcgataaagttcgtttactcagcagttcgctgaataatatgatctgctggatatggtgtacgacctagcctttgctcagcctaactcgcaggtcctattacttatccactttgtacagatagtacatctcgagccatcgattcattatgctaacacgaacagaaaatgatctttaagctagtaatgatttaccaaaataaatgctttttgctcatgactgaagaagcccgtcaccttcccaaccaagacgtaacatctgatccactaccttcaagctcaactgcaacattaccagctctattagaacgaaggttaagtggcaacgtaagtactttatggaaaagcaagtgctaaatggattttgatacatcaggaatttatggtactcacagcaggatcagtgaacactattagctgcttatcagcagtagacagtagaagatttgtgttctctttgtttagagcgattgctgtgacgtcctggcctttccccagctccattgtatgaaatacctgccagtaaaatatttctggtaaggttaccacaaatgaaaaataagccccccccttttttttttgcttgtgacactaaccttaagtttatgcagatcaacaaagcatacagaaggcacatgaacagattgcctagtttcagcttgtttagatatgccatccttgccatttggttcattaggttcatgatccccagtctcagtactgtcctcacacttataattgcttgaagaacatgttcccattaaggcgaaatggccatcagtagaaatctcaatgcaactaacccgtccacaaaaaggtgatagaactgtggtagcaatagggagtccattgacagtgaatgtagatagtcttttctttgattcattccaaaccagaatgaccccttgagaagataagcatacagcatgtgcctccgctacattaagcttccttatcagacgaccagtcctcaaagaatgtagaagaacacctgacatgtttgatgaggatacaacaagtcccaagtcaggactgactgaacagctagtcacttcctcaagatgtcctctcaatacatgcataggaccttcaattcgacgcctcctgatttctgtaaggttgctcacactaggactgcgtggtgttgtcggagttgttggtggaggctcaggggcatttttcttatgtaaggagcctgcctgatgaatcctccagagtataactgtggtatctcgagaccctgttacaaggtagttgctatcatgagaaagtgcaaggcaggtaacaggagcaagatgtccagtagcagtttcaatagtcttcgctccatctggggagatcaacttcacagaaccatcagcatgcccacctattattgagtaaaatggtattagaaagcagacgaaacttcataaaaaaaatcattaaataatggaagctgcctaccataacacttcattaaaatccagaagtttctatttgagaaaaaaaatccagaagtttttattcgagaaaaaaatccagaagtttcagatcaagctgtttgcttgactttatctagcgcaacaggtgttcagtattttaatttaaatccaatatatgcaagatataaagggcaaatttgcatctttggattcgaagtgttgtcacaactcacaaggcaatcttaaactacattgcttacatgcgcgtgactttttacattacaatatgaatccacaactccatgctgtgttccatttaatgcctttcttgtacgttagtgaatgtctagcacatatgaacttcattggctcatgataacgaatctgtctggtaagaaaatgattatgaatctataaactccccccaaatctagcaggtaggatgtctcatcctccactagtaagcagagaattccccagaaaatggaaagaaaatgatggatgaagaggaaagatcatctaaatgaacaaaaaaaatacatatagaagctaaagcataaacagtcaaaagaaacaattaccagtgataatctctttgtcacatgtgacagcaacaactgctgaactacggatgccagaagcagcaaatgctatagctcttgggaagtcataatcttctccagaactagcagatcctttaaaaatgcgcatcagtgcaccaccggttgaatttgcagcatttctaccatgatgaaatagaaagggtgtcccttggccatctggagtatttggttgccaatggtgaagtgccacatgagcagcaggcacatttacatctacaactacaatagagtcattggatacaaacatggtactggccggaacattgcagcgatctggatttggaagtaaatatgatttaagttcacttggattccggaatatagtctgcacagcaaataaaagggtcagtccatgtaaaaaacagtgaggcaggccgcaagtaatgtctactcttgaacatggaataccagctccaccatgtgaaaactagttagctacacaacccaaacttaattaaattgccagctaatgcttttgggttcaatttgaactactttccagtgttccacaccaggtaacttgaatctgtttacttgacttctatttgacaatactcctcatccaaggtggaataatttggttctgttcaaagaaatgctttgaatcgtttgctttgggggttgttctcaatagccagggtttaatatagattacctgtagatgtaaaacttctgccaatggctttctcctcatgtggggaatagttagcaattgagatggtgtttgtccaaagtaagcaatttgatcttgcatggcttgccgttgcaccttcagcattttcagttttaaaaaaatatgagcagatagatgacaacacgggaaaccaagcactagcttgagcgcatactagtacttactggatctgtgattttgtcaatgtccacagttccttcatatgtaatgtagaagaacacattgttggccattactgcttctttacccctctgtttaaatctgcaaaagaaatattcctaggtaaatggtgatatgcgaggagaaaaaaaatagaattggcttcttaaaaatactaaacagaagtcctatatcaccctacatcattcataaatgctaaatttcaataattcattgatatgatgatccaacaggaccattcta

SEQ ID NO: 86679 - DNA, 2131 bp, Oryza sativa
tgcaacaaaaagaagataaacccatctataacagaacaagcatgcattaaagtataaccatgaaccaaaaactttacaattaagcttgaatcaacaatcaaaattcataatttcatacgatttataatgcaacatcttaacaagcacatagtttgaagaataaacactaaacacatatacctattgcatttatcactctttctcaaatgtcctttagcacaaaacaaccaagagaattttttaaccttttcttttcttgagcctttttgctcatatttttctttttattctgggtacgtccctgtcgtcaagactgtttccagggatttggcacacattattttgctcacatcgaatacatccttgtcgtcaagactgtttccaaggattcggtattcatttttttcatatttttcttattctctttttcacaatgagcaattaaatctatttgaggaataacaattcaataaagcatatatacaaagcatttatagatcaaaccatatgctagcatcaacattgcatatttgcttaattcaagtatagaatttaagtgtcatgcatcatctcccttaaaagcaaaatctaaatctcatgaaaagactagaatacatacaagctatgctatagacaaataaaccttcaaagtattgctagcatgcacaagaaaataccatatgtataaacaaagctctcatttattaattttttctcattgtcatattattgcttgataaaaccatgaggtacaaactccccctcaaatcatgccaaaagaattcacgaataagcactaactccccctcaaaataacctccaattctccccgaaaatcaagaaaaaaatcaaagcttttgaaaaagacatccaattgccaacgatatcaccaaaattctcaagaattgacatatatccaatagtattaaccaaaactacaacctcaaatactagcatatgaaaaaagctaataaacaagagagtataacaaaaaaaaatatgtcaattcaaaagtaaatagatgttaccttgaaaagcaatcgtcatcttaaaattgaacactcatggggagtatgccgccaaaatatctacgaacaagaagatgtcgaggcctccgtgttggggttagaaataagaaattttggaatctaacactgagtcacacgaccactagaaccagtaggtacatacgcacttacaaaatcagaattagacttaccaaaaaaaacttacatttttgcttcacaaaagtctgagttgaatttcgcacaaaattgcctcgaggccggtctgaccgccgttgtgcctatggtctaaccgggcctggcaaccggtctgaccgccgatttacttgcggtcttgaccgctggccggtctaaccgactggtcagtgtcggtctaaccgtggtcctcgaattaaaacccgatttttgctaacgtcgttttgcaaaagcaatttctctttcctttttctatttatgggcaagtctaaaacaaaaaccaaccaaatgtccatctttttcacaaaaagaacaagtgtacttctcacgacaaatttgtgaagtagatggttttgaaattgatggttttgcaacaacagaaggttttgcattcacaacatttgatttcgaagaagatgcattcaaagaagacatgatgccagcagatttaaacacagtgttcttaggctcagtttcaatcaaaatttcacctctcctagcaacacccaaaacagtaggaggatgtctagcatgatgagcataagaatcaaaacttaaaccacgattgtgtgtgctaaccttagattgatcaagaatcatgttgaggttctttttaccatcagaaaatctttgcaaagaacttttcaaataaaaaacctcctgagtaagaatagcacaatttttgcaagcatccaaaagacctttttgttttctataagttgagcaagaaaacacctcatcttgtttaacaatttcttctatgtgtttaacacggcttaaagcatctttcaacttcatctcattcaaaacacactgtcggtgacatggggccgggggtatcgtgactagaggcttgggtagccgcgatcactcacgtggcccgaccccctcggggggggggggggggtcgg

SEQ ID NO: 86680 - DNA, 1892 bp, Oryza sativa
taaaacgaaacggagggagtactgatttgatcatattcagatcaacccatcaaaatgggccaacaaagcgcaacaatgatcccagacaaaacagatgtttatgaaaaaaaaaaaaaggttctctatacattgttcagtgtttctagtggttcacttaaccaagaaaatgtaccacagaacagaagaataccaggcaaccctcatgataacggcagattgactatcataacaacaaagaagagggggaaaaacagccacaatatcaacaaggcaatgtagagctttaaccagacaaacccaattagagcaaacaatttcataaacaaagttgctttagtgcaaaatatctgatacctgcattgcaatagtcgaaggatcacaaaattcaacagactaccacaggcgagagtgggcttgccacaatttgtaaagaaatcaggggttatctgttttttttttaactgccgagtacatacagtactgtagttttattgcagttcattaattaactgcataacaaggaaatcaacaaacaaatgataaaatggaagtacacattgccatctccctgcttccaatttttccgaaacagagtttagaatttgctgtgtgaccggaactaattcacatctttgtcgtggaaagcaaaagtgcaaaactaaataactgactgaagaaaatgtttaagtcaacaacgctaacagtcttacaaccttatcccaccatcgactggaagtttggaagcaagataacctcaaaatatttcagaccagagaactctgaggccagtgcgaaggtcacaaactgaacatgttaatcgcactaaagcataaaacacactacaggattccaattcagtgacaattagcataattccattcatcacatactccacaacgttcagacttcagactagtgatttagactaagactaacttcagacaaatcaatcaaaatgggcaaacaaaagctgcaacaaactggttatctgaaaaaacagggggtcttctgttctctttatatacattgttcggttcattattcctaagggcacatagatgcaatcctcgtgataagggcagaaacatgtcaatccaatgctaaaagaattatcatagcacaaaattggataaaacattcacagcatcaacaaagcaatgtagatttctaaatataagattcctgcattgcagtagttgaaggatcacaaaattcaacaaattgccacatattttgggcaagacaaatgcagcaattgttcgacaattcatctccatcagtggaaaatttatgggatccaataataccatgaagtgataataagatctaaaaggtaatgcaactgactaaagggaaagatgatgattcattcaccgagcgccgctgagaccaagcagcatctggctgctgtcgccggccgggatgtacgagacattgggggagcgcgcaagctccccggcgatctccttggcggcctcgatcctcctgagctcgatcaggccggtgcccgcggcggcggtggcctcggagatgaggcgcgcggcctcgctctccccctcggcgcggacgatggcggcgcgcctctcctgctcggcgcgcgcgacgaggaacctggaccgctcggcctcctgctgcgccacctgcttcttctcgacggcctgggagaactccgggccgtaggcgaggtgcgtgatggcgacgtcgtcgaggacgatgttgaactcggcggcgcggcggatgagggagtcgcggacaagcgcggagacgtgggggcgctcggagaggagctggtcggcgttgaactgcgcgacgacggccttgagcacctcgttgccgatggaggggagcaccttctcgtcgtactcgaggcccagcgaggtgaagatgtccgg

SEQ ID NO: 86681 - DNA, 877 bp, Oryza sativa
atccccattcaagtctcagtaaatcaagaaaaatgtgtttaatccattaaaaatggttttgttctctgtttcagtagtcttatagcctgtttgcaatgtttgctttgtatgtcgctagattccggttccttcgacgctccggtgtacttcgagatagtcgccgaggttcctccagcagcagagcaaggcaagtcatgcttgtcacttgaacatgttgatcctatattgcaaatgctctattgttttctttcaaatattgcattgttttataatatcactatgggatggatacctattgttacagccatgcttttggatatcatgctcctttgttagcttgggttataacatgattagattttggactaggacttgcttagccatgcttagttcaactagcacacattggggatctcatttaaaacctagactatagttttatttgataatgttggtttaataccaccgctctggtgttggttaattaaaatgaaccacatggtgggctgtgggtgcatggttttgctagtcgcacccatggcagttaaggaccggttcgcgggatgccctggaagaatttaccgtgcttaccacaagccagcgtgggcaacggctgggcttgtagtgtagctttcctctagccgacgcatccaggcaagggtgggcgtgatggagtttggatgggccctgcgacggcttatccgctttccggattcacctaggcacgagagggactggccccgtgccttgcgaggagtgggggtgaaacctgaggtgtggtgtgcttggttagagggggttatgcgaagggtcctgtcacggcctctttccggtatgtcgtggtgacatgtcggcgcacggaaacgtgtcgtggggc

SEQ ID NO: 86682 - DNA, 2319 bp, Oryza sativa
ggcgaattcgagctcggtaccctacattaaaacatgaagggagtagtttttttataaaatataccccacactggcttcgctgaaacggaggagagcggcagaaggaaggatcggagcggggagtggggggagaagaagatttgagagagttagacacttgagcgacgaaacggaaactgcagtggtaggagacagctgacgtcttcatcttttcccccctctttctctctttatttttcacccttctttagcttttcttcacggactgttaacacttaacagtcggttaatttatcctttttccctctatttttttaaatactcccttcgtattaaatattaatgtatgtcgtcgtttactttttatcaacgtttgaccattcggtttatttaaaatatttatgtaattatcatttattttattgtgacttgatttatcatcaaattttctttaagcatgacataaatacttttgtgtttgcacaaaaatttcgaataggatgaatggtcaaacgttgctcaagaagttaagaacgtcatacattaaaacatgaagggagtagtttctttataaaatatatcccacactagctccagtgaaacagaggagaatgacacaagggagggtcagaataggggagaagaagatttttgagacttggacactagagtgatgaaacagaaactgcagtggtaggagacaactgtcgtcttcgtcttttccccctcttactctctctctccatttttcacccttttttagattttcttcactgaccgttaacacttaacagacggttaacttatctttttttgcctccattttttttagaaaaatactccctccgtattaaattttaatgcaagtcgtcgtttactttttatcaacgtttgaccattcgtcttatttaaaaaatttatgtaattatcatttattttattgtgacataatttatcatcaaatgttcttaaaacatgacataaatacttttgtatttgcacaaaaattttgcataagctgaatggtcaaacgttgctcaggaagtcaacaacgtcacaaattaaaacatgaagggagtagtttctttgtaaaatgtatcccacactggctccggtgaaagagaagagaacgacggaacggagggtcagagcgggggagaagaagatttgagagacttggacaatggagtgatgaaacagaaactgctgtggtaggagacagttgtcgtcttcgtcttttccccctctttctctctctccctccatttttcacccttctttagcttttcttcattgactattaacacttaacagtcagttaatttatctttttttgcctccattttttttaaaaaaaatacttcctctgtattaaattttaatgtatgtcgtcgtttactttttatcaacgtttgaccaatcgtattatataaaatacttaggtaattatgatttcttttattgtgacttgatttatcataaatttttctttaagcatgacataaatacttttgtatttgcaaaaaaaaattgaataagatgaatggtcaaacgttgctcaaaatatcaacaacgtcatgcattaaaacattaagggagtagtttctttataaaatgtaccctacactggctccggtgaaacagaggagaacaatagaagggagggtcgaagcgggggagaagaggatgctggagagtgatggaacggaaactgcagtggtaagagacagttgccgtctttgacttttccccctctttctcccactccatttttcacccttcgttagcttttcttcgtcggttaagttatctctttttctccattatttttaaaaaatctctgtatcatcccggcatagggcttaataggattaatagaatactcatatcaacaagttgcaacttcttttccggaagtcaatctccaaagaactccagggttaagcgtgcttggcctggagcaatttgggatgggtgaccgaccgggaaattcttcccgagtgtacacgagtgaggacaaagtgtgcagaaaagacatgtgttggtctgtgagggcagtcttatgacctatgaaagctatcagatgtaagcgggcccggcaatttgggatgggtgaccgactgggaaattcttcccgagtgtacacgagtgaggacaaagtgtgacatgtgttggtctgtgagggcagtcttatgacctatgaaagctatcagatgtaagcgggcccggcaatttgggatgggtgaccgactgggaaattcttcccgagtgtacacgagtgaggacaaagtgtgcagaaaagacatgtgttggtctgtg

SEQ ID NO: 86683 - DNA, 11651 bp, Oryza sativa
agcaacgataatagaatggtccccttattccagtgaagcagaacttcttcaagaggtttatgttatgttatgttgtatttatattatattattttattggttctaaatgcggatatagctgtgttttgaatgtgttcggaatagcttgttcattgtttgcagaataaaggaaagggcacagctttgcaaacaaaaacatacattaccaatgtagtaaaaccaagttactgttagattacgcgacacattgttgaacctggcatatcataaaaataaagtactgatcgttgttgctgatgtctcttcttttcttggcttagttccttaaatgattttttttctctgtactttgttaccgttgtcctcatcttcttttctgtgtgtctaatggctttataatagtacagtttagctcaatcaaggaacaagggactcggattattatatacaatctatgggagaatgaacagggagagttggagcttgattttgatactgatgtaaatgtgagtgccaactaataattaatgaagtcatatagccagcaacagaaaatgtggttaaatatgaaatttagtgatgtttgagatggcaggatattcaaattagaggtggtaaccgagatcagaaaaatatccagctggcaaagcagtttccaaactccagacatttttttacatatagacattcactgcaggtaggttccagatttactttgtctgtttgtgccaaagcaatgctctgaatgcttttttttttcttttttcctgaggaggcctctgcagttaatgtatcaaaagaaaaaggaaattttagtttcaaagagaaaaacaaaaaaatcatggtaaaaagagagagaagaaattacagggaagacaacaaaaaaagagccctctactctgaatcataattgatattaggaataccatttaatgttggatggctacttattttcttagagaacatgcaaaggcactgcatatcattttattaaggcagacttagaaatgataacaaggcttggttgattgtagtgctatttgctaatccactaattctatggtgaattttctgcagtagaaaagacagtagtaagcatatgagccataaatagttcattggaaaatttagcacacttacataaattgtgcagaggatatatgtcaacctgatgttacttcctttctgcagagctatgcatcgattttgtatcttcgagttccatctgtattccaaatgattttacgaggcaaagagattgaacatcataatattattggtgacatgatgatgaagaatcatgttatttacaaaccagtgatgactgatggatttccgagggatatcgatgtaaagattacaagttctgtacccatcgtttcttgtatagtgatgatcccttaacatattttgtgcatggttcctcatctttgcatgctagatgatgactgatgttacaattggttttgttaaagatgcaaaacatcatattcccattcaaggatttaatgtttaccacaagaaccgcttgataaaggtattcatttagttatgccacatatatattcttatgatgatgaaaataaatacatttttatttctagcttctaaaatgactgcacatccatataccaattttacaattaatggaaagtaaatagatttgggatttgcacatttatgttctatgttaaatttctctgtaactcttatgttttaagctgatctatttttggagtaaaatgcaccataggtccatatggtcctgttgtcaattgggcatcgcacttgggttcttcaagttgcgggcatgtcgctttggttcctacttgcaagctgcacatataggtctgtaattttgtaaagcagtgtcaaaaaaggtcaaaaaccttcggtagttaaagatgatatgataacttagctcaatctaaaccacaatgtgaccatgctatcacctttttttagataatggaagatgagggatacatctctggtggtctggcctatgcagaatgcacccagccaatgtttcaccatttgaagtcattgggaaactaatatttttttgtttgaataataaagtttgtttctgcgtgccgttgattttcgatgcttctaattgatggtagttggcaatagcattgtcatattttagcttaaataggattgaggtgccacatttccaattaagctcagtgtcagcttctattggtacacctacacatctaaggatctagatgtgcaatcatcacgttgaggataaatgataacgtgcccacacaagtttatggacttatcgcacaccttatttctcttattacgcttggtaatcaactgaatatttcttgttctaagcatggccatcagcctgtcttaggtgattataacagtcaggatacgagtctcatcagaagtatatatgtttttttagcctttctggagagtgtgggctctacctggaattcaagggcgtggtgttataggtaagaaatccttctataagcccctttggcacaacttcttcatgtgtggaaagctgatactggaagaagctggtgacagacagcttctccttcatagccgtaagttgctgcagaatcagattctgtcaaacagcgacacttcaacttcttagtggagaagctgatgtagaaattgtgcctaaggggtctgtaggtcccttcttcagaccatgtgtaatcattataacttgcaggtgtacttgaagtcaactttgtagaaccagctcatgataagcaggactttgaacgcacaaatagccttgcaagactcgaagcacgattaaatttaatgcagaagaaatactggtttgtcatgtcgttttgcattgtccatttgttgtctgtaggcataccagttctttgaagaattctaattagagtctaattaccatggaaaacacttacttctgtttcaggtctgataattgccatcgaataggttatggtggcaattctgctaacagaaaatctgggagagaatataaaggtaggtagtgacgcagggctccctgcttgctttatttggattacttggtttggttaatagcttaatatttgtatttttttttcaactacatagtacaaaacaagataaaccaaattggtttggaactttagatagccctgaacgcatgcatgcatacctttgaacctagcaaccttagttctttcttttctttgcgttttctttttggcagaggttttcttttacacagtttttctgcataacctgtgctaacaactgagaattttttttttgtttcattctaaggacatactattatatgttgattcaaacaaatacactggcatgcatgtcagttggcaacttcccttgtgtgttcatgtttgtacatccattgccaaacatatgtcaagacataggctaaatatgctaattatatagttgatgcatgagacaattgctttattaagtaccctattattttgttggaatagagacacctgaaaatactccacacacaggaccaacatcagatcaatctcctgaaggctgtagaagttcgaattatttgcaaagaaaaagaagttttggaagtccatattctggatcaagtaataacaatagcaaaactggaataacatccttgaacacaagtaaaataagtcttcctgagagcagattctctttaagaacaacagctcagcagacagttgagaagaccaaaaggaccttaagatatacgagaccactactgcacggtctatcacatacaagtaatgatagtgatgctcagacttcaggcaccccatcaagatcaacttctcatattctaaagacacctgaaaaatcatgccacaatgagaatactttgcctttaattccatctagtgaagcaataagaagtgaagggacaacaagatatcagtcagaggtatttgtgttcctctacatgtaataaactttgtttctgtttccaatatttgtgggtatagtggtagttaaataagctttatcatgatcttacacagtaagttgcattcataatggctgcaacatagcagatagcacaaagcttggattggtttttggtagatcctttactgttgaagtgttcgatttccttttggcctcaggaacaataagatgaatgtactctgcacaacttatctcactatgggaccaaaaaaaagaaaaagaagcaaatgataataccctaccttgttcttttcctccatcttaattacattggatgacctccttcggtcatcccgacaaaaaaaaaaaaacataccttgttctattccagtaattatgtgatggaaaatagttgacatgggatgatctctcatagttttactttcttctagatgactgtttcagtagagatgacctctcaccttaggaagacagtaacattcctcccattaaaagttaacaaagtatgtagtaccagaaaaaggaatgcagatgagtgaagtttaagtacagtgtaaattatagtaagaaaaaactgaagagcaatgagagatggtcattaaagatgtactgaatgtcctaatctatccttctttacattttgcaaattttccttggtttgttctttacatatcaagagcatttttttttccttttgagacaactgatatatatgctttacaggaaagaaatgtaacaaataatggagatggacaaactgttgataaccctgagacagttatcaaattgttgaccgatgaaaattcgtcattaaaagaaaggtagctattaccagtgcttcattcatttcttttttacgttttactggcagttgtatggacaataataggcggtaatcagttgaaatctgaaatcttaagtaatgttgagaggttaaatgttactgtagttgaatttagccaacatatgggtgtttattccaggaactttaacatttgccacatgttcctttttattcctttgttaacatcagtacccttttttgaattattaaaattgtttcctgatgtatgatcagcagaaacttgtttgtttaattcaaaattcatgtaaaatttttattttaaaatcactttatttccaaacagaagtatatgacaccatttaatatcaaacccaagatcatgaaagcttggcttagatatttggtttttcagtgttcaatatatcaaaggtcctaatccaatggattgcttgttaaaggttttccccaaatgacacttagttgttcgcatgaaataagatttggaacttagagtgacttttcctcttcattcttgtttttttccctgtgtgatagtatcatgaagatggaggaatctttgtcaagagaattacatatcgaacgggacaagaataagtctctcattgaaagggtaagcaatactaacttttacctgtggggctgttggtagtatactgtgtgcttgtcctgaaatttttactatttagcccttattcaaaacttgctgcaaaaatgaaccccgccaaaaaagttcaacaaaaaatggcccctgatctctgcaccatcggactgacactgagatcgcgatgttggcattgacccttgccacggtggtgggtggggagactggcgtggcaaagggggtcagcaccagaggtattggcgctaacctcctattggtaaaagggtaataggctattctatacaacgatgcaaaatgtggtgcagtggtgtgatgtctcatgctaccaacacatttattttcttctttatccaaatcatgcctatatatgcctaattctgaccagctaatcgaaagtatgttttatgtttagctaatgtgaactgtatatttttgcaaaagtaattagtacctttttttaaaaaaaaaaacaaagaatttgaacatgtgtgtgtatgcttaataatggtcattcaaagaagagggactcatcctaagaaggccttctttggtaaagcaacaaactactataaggccttctttgtgttgaaggtgtgcctactacatttttaagttataggaggttagtgccaaaggcctcggggctgacccctttgccacatcagtcagcgagctcccctgccaccaccgtggcagggtcggtgccagcatcgatagtgctgagtacctcagcgcgaggtcggagtcaatttgtggttaaagtttttggtggggttcatttttgcaataagttttcaaaaggagcaaaatagtcaaaacttcagcttgccatgcgttaccccaattacaggttaccagaattttattcaactttgcacctactgaggacaatttattctttttcactacagtttggtgtagtgatttatagaaacattttaggcgtcacaaaatatactgacatgacacatgcgatgcgatttactggagccaataatggcttgaagggtttgaaaggtcagactgcattatttcagtctttgtaaccaagtccttccatattttgttttccagttggagaatgttcagaagcaacttggaactgcaaacaaggagcaagaagcattggtagatatctttacagaagaaagagcgcgtcgagaccaagaggtggagaaccagcggacgaaactaaaggttagttagatcttaaaactgtagtggatttattgcgcgaatgcaccgatccaatccgccttgtcgttgaggatggcatcacggcataactaagctcctcagtcggcatagccatttttgatgtcgtctctgctgttccaggaggcgtcgtccaccatacagaacctgctggatcagctgaatgctgccaggagctgccgcaagaactagaaatggaatgaagaagatcaattacctcgttggtccattgtggctatcgccgtaaaataagtttcccttgtacatgttagaataagctatatatgtcccagatggttaattggtgctagaacagctagctgttggtatgttttatgtgcaaggtatgcagtgctgcattttccagtgctaacaaagaagggtgagtcgaccaccactctaaactcgaaaatgtgggagatcgaccatatcggtttcagaccttcagtatcattcgatgcaatactttgtctaaacttgagcagtatgtaaaactgtagttctaaaactcctatcataatgttagtctggttaatcttatatttttacgagttcaccttggtgtgtattatgtttctcggtattataattgtcttccgtgttgatacgcacatatgcttttcctatgaagtccattttttggtagtaaatttattttacaaaacattaatcatgaacttggtatatacatgatcaccaaaagcttatgtggaatatgaggtgatgaaccgaccggttaaagaaacagaattgtagatgtaggtgttgacgcagtaggtgaacgttggggtgaggaatactgaggatgttgccagagagtacgctggggtaaagctatagatggccaaaatggccgccccgcccgggggcggctgataagcgatcagccgcgcgcgcgcggtcagtcgcctccctcctccctctagtatctcatatatactactatatacattttatatatatatatatatatatatatatatatatatatatatatatatatatatatattatttgtttggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtgattttgtgcattagataccatggtgccccatatgagtgtcctatatatatatatatatatatatatatatatatatatatatatatatatatatatatatatatatatatatatatatatatatatatacatatatatatatataagcaatactagaaagttttacattgtgaaatagagaaagtaacagacagtgcctacttacttcctccatcatagaaaaaaataatttctgcatatgtttagatacatatatagtcagaagatgattttcttttcttacgaagggtgcatctcacagtgcaacctgtttttatatatatttgttgattggtgagagacaatttcaactccgtacttggtaccttaataggtgtagcggcctattgaaattaagtacacgtatggtttctttatttatgattgttagttggtgtgcaacgtcactatatctgtatcttaagtttgtatgcgcatgatatatatgttcatctaatgaccatcccttttatcaatatccatcgtttatcacgctatatttcatgtctagctttaaaaatgatcttattttcatgggctggcaagtttcaaatttgatccaaaatattctttgatttgctaaccatttttttcaaaaaaaaaatcaaatttctgaactttcaatccatacgtaggtttgtggtttggctttttttttttgattcaaggttccataaccattgccaagagtgccacattatattttgatcttttggccggggtcggaagaggggctttaggtgtgggatatatagaatagatctccatgttcggagggaggtggctaaccaatagcacatgagcatgcttggaagcaagcggtgcagggggatgaggtcggtaacacgtacaacaagaactcaagtggctgggaggtgttggcgtcttggcgagatgtggtgctaagtgttaacaatagtggaggcttagtggatgggaatatcttagctaaagctgcacaaaacatctggtttgaagtggggggataattagtagggaagagggaattgagtgagtgagagagagagagaggaggtggctagtgaagcatgtggatgttatcaaggcaggggttgtgtctagaggaggaagggtgacgtcatcgtgttgcaactttggataaacggaggaaagccattgacagagacagctcccaggcaggtcggacaacctcccaagctccaccgctgccatcttctttgcggattgtctttcgacattaaaaaatcacagagaaacattgttagccgtttggatttaacaacggtattggttccgcccctaaagaggacgagtacggtgagggatttttttttccttaaaaaatgaagtacaggtagacactctcatttatttttcttgaccgaaaagtttctccaatatgaatttggatttccctccgacagtagcttctagatcctaacctcgtttggatgggccaaaatcctgacgaggccacgtctatcagtgatgatttccatcggtttttctgaaatgtacagctgcaccgaaatctcggccaaacggaaaacgggagttttcaactttgtgctgaattttgtcaattgcattgtcggttatcgaattgaaactactccgaataaattctgacaattggttagaatggtttgtcaattgcgtttgttcaatatctgcgctaatcgccaaatctcccccaaaatcttacaaagcaggggtcgacgaggcggaaacgagaacgacccggacactcacaacgggcaggagtgggtctcataataagttcatatttcatgtatccgtttaacctaaaaataagttaatttttaacaattattgtattattccatgcttccaaacgtataagacttattccattcttttgtttttttaaaaaatctaagtccaatttatagttactatgtgttaaattaagttgttgattagaacccaaaagccattgagggcggctagggaatgtatcccgtctgaacgggatacttgagattgacatcaatgctgacgtcattatacgtacgcggtaccacgtatgatacctacactactacgaaaacgatttttccgtgtggtccaaaagggttttcgcgtgcggatctcccgcccatctgcattgaagtgtcagcaaaaatccgattttttcgtgcgcacgcgaaaatctaattttcacgtgcgggtggcttatgtcgcaaaaaaaaaaaaaccaaaccctaacccagccgccgccctcctcgtggtcgccgtcgtcggcggtggcgttgccgccttctgccgctaccggccgccggggccggctcccagcagcgtcgctgccgcccaccgccgaatctgggcgggagaggggcgccgccgcccactgctggtcccggccacagccagggttttaaatttcaaaatacgattttatgccagtggggggcgaaattaccgaaatttcggaaatttctagccgaaattatttgaaaatttgactgaatttgaataaaatttgaccaaattcacaaaaacttgcaaaaaaccaaaaatttcgggcgagatttgagtatgccggtgggggtgaaaattaccaaaatttttgaaatttctaaccgaaatttcaaaccctggccgcagcccacaagcgaggccgtgctaccgtcgcccgtgagagacgagagagagatagaagaaatgaggataacgatgagtaggtggagaggataagatagaaatttttgaagtggttgagaggggaaaaatacctgaggagggtatttcgcgtgcggtgctcttaagatgcccgcatgcgaaaatttattttcgtgtggtccgcttgcaaaaataggtttattttttgcgtgtggactcttaaaaggcccgcatgtgaaaaccgatttttgtgtgtggtcctcttaagggtccgcacgcaaaaatgggaggacaatttttctagatgcggtcagttatggaccatatggaatctaacgaggggctcgtacaggaaaatcgttttttagcagtgcaattagttccaagacatgatatttgtgtaacaggtcagataccctataggtatcatgtcaaggtacaaaaacatgatacttaagtaacaggttagataccctataggtattacgtcaatgctgatgtcactgtatacgtatacggtaccatatatgatacctattggtatcgaacatgatacatgagtatcaagtatgatactttatgagtaccaagtatgatacctgcatgtaccagccatggtacctgggtaccaagttggtacctgtaggtaccaagtccgatacttatatataccagacttggtacctgggtaccaggtccaatacatataggtaccaaagtattatgatactactaaagtatcatagcacactaagaaccaaaaatcatatcttaccaagacagagctcaattaaaccaacaaagaaaattgattccgggaaaaaaagtcatcatagtggtagaaacacccatagaacatgtagaacaccccaagatcaaacctcaaacccaagccaacgcaaaagctcgggggtcacgagccaagatctaaatatatggatccgcaccacaagaggccttgtcctcgatgatggtgacctcatcgacgatggccacctcctgaaacgtggtgagtagctctgtcttcgtcttgtgcttgggtacctaccccacgat

SEQ ID NO: 86684 - DNA, 1835 bp, Oryza sativa
tggtgttaggcgactcccactagttgttaaccaagtctgtaaggagtaccggtgctctgacccgcagatggacgcttacgtacgccaagtgcggcgtatggagcgccattttgacgggatagagcttcggcatgtgcccagacgggataacatgattgccgacgaactctcacggctcgcgtcctcgcgagcccagaccccaccgggcgcctttgaagaaaggcttacccagccgtcggcgcgacctgaccccctaggggagacgggtgtgcctgaccggcccccgaggcccgtcggagtccaggcctcgggacccgaagggagcgctccaagctcccttagattgattgcttggatcgctgagatccaagcatacctcacagataagactctacccgaggaccgcgaagggagtgaacgcgtccatcgcatatccaaacgctacgtgctggtagaagggaccctctatcggcgcgcggctaatggaatcctcctgaagtgcattccacgggaacaaggcgttgagcttcttgctgatatccatgaaggcgagtgcggagcccattccgcctcgcgcaccttggttggcaaggcctttcgtcaaggattctattggccgacagctctcaatgacgcggtcgacctggtccggcgatgcagagcgtgtcagttccacgccaagcaaatccatcagccggcccaggccctgcagatcataccactttcatggccatttgctgtctgggggctcgatatcctgggaccgtttaggcgggccccgggcgggtttgagtacctgtatgtcgcgatcgacaagttcactaagtggcccgaggcttatccggtcatcaagatcgataagcactccgcacttaaattcattaagggcatcacggcccggtttggagtgcctaaccgtattattacggataacggcacccaattcactagtgaactcttcggcgactactgcgaagacatgggcatcaagctctgcttcgcctcacctgcccaccccagaagcaatggtcaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcaaccggagagacgccttttttcctcgtctacggcgcagaagcggttctcccatccgagctcaccctgaggtctcctcgggccaccatgtactgcgaggctgatcaagatcagcttcgcagagatgacctcggctacttggaagaacgaaggcggcgtgcggccctccgagccgcacgctaccagcagagcctgcggcgctaccatcagcgccacgttcgggcccgatcactctgcgtcgacgacctcgtcttacgccgcgtccaaacgcgtgctggattgagcaagctctcaccaatgtgggagggtccgtatcgagtgatcggtgtcccccggccgggctcggtacggctggccacgggcgacggcacggagctgccaaacccgtggaacatcgaacaccttcgtcgcttctacccctaaaggggggggggtcgggtgtcagattttggctcgggccaaccccacacccccctcgggtgtgcaggattggccgggggctaccacacatgcacatatattccctttttccttatttcagcatttcaatagaagcagtttcaattttctaaaggttgtatctgtgccgtttttccttctgaagaattttaacttgaaataaaatcactcgtgctcaaccttgccctagggggctcggttcggtcagcta

SEQ ID NO: 86685 - DNA, 1814 bp, Oryza sativa
tattttgagcaacgtttgaccattcatcttattcaatttttttttgcaaatacaaaagtatttatgtcatgcttaaagaaaaatttatgataaatcaagtcacaataaaagaaatcataattacctaagtattttatataatacgattggtcaaacgttgataaaaagtaaacgacgacatacattaaaatttaatacagaggaagtatttttttttaaaaaaatggaggcaaaaaaagataaattaactgactgttaagtgttaatagtcaatgaagaaaagctaaagaagggtgaaaaatggagagagagagagaaagagggggaaaagacgaagacgacaactgtctcctaccacagcagtttctgtttcatcactccattgtccaagtctctcaaatcttcttctcccccgctctgaccctcccttctatcgttctcctccgtttcaccggagccagtgtggggtacattttataaagatactactcccttcatgtttcaatgtatgacgttgttgacttcttgaccaacttttgaccattcatcttattcaaaatttttgtgcaaatacaaaagtatttatgtcatgcttaaagaacatttgatgataaatgaagtcacaataaaataaatcataattacataaatattttaaataatacgaatggtcaaacgttgataaaaagtaaatgacgacatttattaaaatttaatacgaagggagtatttaaaaaaataaagaaaataagttaacccactattaagtgcgctaaagaaaagcttacgaagggtgaaaaatggagagggagaaagagggggaaaagacgaagatgacagctgtctcctaccactgcagtttccgtttcatcactctccagcgtcctcttctcccctgctccgaccctcccttctttcgttctcctccatgtcaccggagccagtgtggggtacattttataaagaaactacttctttaatgttttaatgtgtgacgttgttcacttctcaagcaacgtttgaccattcatcttattcaaaacttgtgtgcaaatataaaagtatttatgtcatgcttaaagaacaaattgacgataaatcaagtaacaataaaataaattataattacataaatattttaaataagacgaatggtcaaacgttgataaaaagtaaatgacgacatacattaaaatttaatatggtgggagtattttttaaaaaaatggagaaaaaaagataatacagagggagattgtaatgtcccgccttcccccaggccgggcccgcttacatctgatagctttcataggtcataagactgccctcacagaccaacacatgtcttttctgcacactttgtcctcactcgtgtacactcgggaagaatttcccagtcggtcacccatcccaaattgccgggcccgcttacatctgatagctttcataggtcataagactgccctcacagaccaacacatgtcttttctgcacactttgtcctcactcgtgtacactcgggaagaatttcccagtcggtcacccatcccaaattgccgggcccgcttacatctgatagctttcataggtcataagactgccctcacagaccaacacatgtcttttctgcacactttgtcctcactcgtgtacactcgggaagaatttcccggtcggtcacccatcccaaattgctccaggccaagcacgcttaaccctggagttctttggagattgacttccggaaaagaagttgcaacttgttgatatgagtattctattaatcctattaagccctaggccgggatgataca

SEQ ID NO: 86686 - DNA, 759 bp, Oryza sativa
catcatcttggccggtacacagatgcgtggaccgcaccaaaccgtgccttgatcgtctatggagaaattgggggtgctttcttcttctgtattctttttattaactcttttatcctttcgacgtctttctgggcttcccggatttgcgactctagcggtaggctgtactgtcaagctggcagggacacctgactgtaccacggtcagcctcaacttctctaattctctgcacaggcgatcttggtcaggccatatttgagctacgttgcaatagaccttgcgacttagcgcatcagcgaccacgttagctttaccggggtggtaatgaattccaagatcgtaatccttgattagttccaaccatcttctctgcctcatatttaactcggtctgagtgaagatgtacttaagacttttgtgatcggtgtatacttcacatctgttcccgattaaatagtgcctccagatcttaagagcatgaaccacggctgccaactcgagatcatgggtgggataattgacttcatgaggcctgagctgcctggatgcataggccacaacctttcgttcttgcattaggacacatcctaagccttgtcttgatgcatcacaaaagatctcgaaatcttttcggatatctggcaaggtgagaactgaggcagtggtcaaccttttcttcatttcttgaaagctgtcttcacaggctgcagaccattgaaatttctttttcttcttaacagctcggtcataggtctgact

SEQ ID NO: 86687 - DNA, 9853 bp, Oryza sativa
tcaagaggaggccagagcttcggccccttgtcttcccattggcataggaaagggatcttcgtccaaaggagatcaaaatctccagtcaagctgcctaccctcatcggtacgtcgacatcacaacgcatcttccccaagaccaaagtgatctagcacaagttgcaagtcgacctggtgctaatactcgtgtgaagtccatcgcaatcagaagtgttgaagaagttatatctcaggcaagggaagagcaggaagatcacattaaggatggagaacttaccgaaccagaatcatcatcatcatcagcatcctccttggagatgaaccttaatcctcttcattacaatgatctcaacctgtccataccttcggatggagaacgttatccggctaactttgatagtgcaccggcccatatggtagtagatggagaaccgaagcaagatgttgtggtactcccggggcaggacattaacccacctccgaggaacaacgcgagtacatcaagagtaccaccagcaagcctagaagaacaaatacaagagcaaagacaagtggtagatcagttaacggcgaaacttgaccgcttcatcgacatcatgacgacatctacttcaaacccaccacgtgttgacatggctccggccattatagatccgcaaattgaagaattggacgccattgcacaacatccaacacaaacccatgacgcccgacgttctacatcaagtgcacatccttgacacctcaacattcccgctgcctctgctccagctcccaccacattgaaagactatcatgacatagttgaagacctggtgaacaggcggttgaagcaaatctccatcgagcaaacacccagaccaatggagagtgagctcgaaaagccatatgaagcctggcatgatttagttgctttcccggcaaggtggcacccacccaagtttcgtcagtttgacagaacaggcgatgcaagggaacatcttgcgtacttcgaagctgcatgtggcgacactgccaataactcttctctcctcctccgccaattctctggatctttgactggccccgcctttcactggtacagtcgcctccctacgggatctataaggagttgggcaagtatgaaggaggtgctcaagaagcactttgttgccatgaagaaggacttctctattgttgaactatcacaagttcgacaacggcgagacgaagccatcgatgactatgtcatccgcttccggaatagcttcgtgcggctcgcaagggagatgcaccttgaagacgcaattgaaatgtgcgtccatgggatgcaacaacattggtctcttgaagtgtctcgacgtgaaccaaaaacattcagtgcgcttagctctgctgtggcagcaacgaagctcgagtttgaaaattcaccacaaataatggaactgtacaagaatgcaagcgcctttgatcccgccaagcactttagtgcaacgaagcctagcggcggtgggagcaaacccaaggccccagctgaagcgaacgtcgcgagggtcttctccaccgcacctcaaggtcaagtgcccatgctcggggcaaagaatgagcaagctagaggtaggcaacgcccctctattcaagatctcctcaagaagcagtacatcttccgccgggagttggtgaaagacatgttcaaccagttaaaggagcatcgtgccttgaacctgccagaaccatggagacccgaccaagtaaccatggtcgacaatccattatactgtccttatcacaggtatgtcggctacgccattgaggattgcgtcgccttcaaagaatggctccaaagggcggtcaacgagaaaagaatcaatctcgatgcagacgccatcaacccggattaccgtgctgtcaatatggtatccgtcgaacccgggtcgcgggaacaagaaggagccgacatatgggtaccactcaaccaagttgagcaccaaattgcaagaatgatgttaacgacgactccggcagctcatagggaggtcacccatgacaccaacaagaagatgtggaatacggtgcgacgaaggcctcaatttacaggccctccacctcgtcacccacagatgaagccacaaccccgtactgccccaacaacaagaagatggccagacccaagtcggcgacgcctaccgccttgcttcgtccccttctcgaagggagatgaatcctttcctcgccagggtcgtgagctacctactttggtgcagtttctgcccaagaattgggggcaagcatcaccaataagcacgaaggaagccgaagaggtcgccggctctaccccaactccggacgtggtttcgtgtaacgtcgctccgtgcaacgtcgtgctcacctacaacgacactacgggcgctagctctgatgacgtgttcaccacaagggagcaagaaacgctccatgccaagtcagatcagacgagagtagaagaagcccacatgaatctgcgagggggcaaaaccttgccagacccacataaggccaagccatcaaaggtagataagcctatcaaggaagcatctcctccaggagaagctccagaaacaaaggctaggagcaaggagaaacccgatattgactataatgtccttgcacatctcaagcggatcccagcactgttgagtgtttatgatgctcttatactggtaccagatctacgtgaagccctgataaaggcgttgcaaactcctgaagtctacgaagtcgacatggctaaacaccggctcttcaacaaccctttgtttgtgaatgaaatcacattcgctgatgaagataacatcattgaagggagcgatcacaaccgtcccctctacatcgaaggaaatatcggtcctgcgcatcttcgacgaattctaatcgatcccggatccgctgtgaacattctacctgtccgtagtctaactcgggctggtttcacaacaaaagacttggagccaactgacatggttatctgcggctttgacaaccaaggcaagtcaacactaggcgccataacagttaagatccagatgtccacattcagcttcaaggtgcacttctttgtgatcgaagccaacacttcatactctgctctcttgggacgaccgtggattcacaagtaccgtgttgtgccctctactcttcaccaatgcctgaagttccttgatggcaaaggggcacaacaacgcatcgtcggcaactcctcctcgtacactatccaagaatcgtaccatgctgacgccaagtactactttcctgtcgaagaaaacatgcaacagctcgggcgaacggcaccagcggctgatgttctaatccagcccggcaccgcaatgaccccggaggtgaggcgcctcatcatgtcatgttccccgatcatcagcaagtcttcgtcacggaaccgcaagtgcaaccgtaggggaaaatcgtccctaccagtcgatcttgattccaagcttccatcccccgctggagctagtgtttagacactgactactgcaccaatattactcaaagcaagacaccctacctcaacgcccataaatttgggagcgggtactcacaaaggcagcaagttgcctaaaagcgacgacaatgcgccaacaaccatcactctgcaggcaaggcggacaccaaacaaggaagccacgcctacgcgatcaggagtggtcaagaagagagtagcagaaatagaggaagccaaagcgggtgttcaatgtatgcagcccccggcgctctacacttccgtctctaccccgctagaggtatgggcaattccagatccatctgcttgtacacctcggaccattctctacaaggtcccacaaattcaagaatgcgattctgtgattgaattccctaaacctcactctgatacagaggaagcatgcacaaccatgaaggctgagcctagaacggctcgcctactgcagaaggcgggcatcaacctacggtgaaactaccggctactaccacctccagcgatatgtgaggactggtgggcacaagcagaagactttatcaagagaaaatgtaaagagcaaccaaagtacgggctcggttacatcaacacagatgagaccgatgacgaagatgaagcacttgatgatcacacattccattgctgcactgcaagtgtcactacaatagctgacgctcaactaccacaacacccgttccaggtagcagcagctgaagtcgaagaagaactcgacaccatgcaagcacctcaacaactcgaggatggcggtcagccaactattgatgagttggtagagatgaatcttggaaccgaggatgatccacgcccaatattcgttagcgccatgctaacagaagaagagcgagaggactatcgaagcttcttgatggaataccgggattgcttcacctggacatacaaagaaatgccaggacttgaccctcgtgtcgccacccataagctggcgattgaccctcaatttcggccagtaaagcagccgcctaggcgcttgaggccggaattccaggaccaagtcattgcagaagtcgatagactcattaacgtgggttttatcaaggagatacaatatcctcgttggctagccaacatcattccagttgagaagaagaatggacaagttcgagtctgtgtagactttcgcgacttgaaccgtgcctgtccaaaagatgacttccctttgctaaacacggagttggtggtcgcttcaacaacagggtatggtgcactatccttcatggatggatcatcaggctataagcaaatcaagatggatccccttgatgcttccgacacagcgtttagaacccccaaggggaatttctattacactgttatgcctttcgggttgaagaacgcaggtgccacttaccagcgtgccatgcagttcatcctcgacgacttaatccaccattcagttgagtgctatgttgacgacatggtggtcaagacccatgatcctaaacgtcaccaagaagacctacgcgtcgtctttgagcgactgcgccgacaccaactcaagatgaatccccttaagtgcgccttcgccgtacaatcgggtgtcttcctcggcttcgtcgttcgtcatcgagggagattgggaaagtgggctctactcatgatggaatatgatattaccttcgtactgcagaaagcaatcaagggccaagccttggcggaattccttgctgcacatccggttccggatgattccccactcgtcaccgacttgccagacgaggaaattttcagcgtcgagcttggaacaccgtgggagctttacttcgatggagcctcacgaggagatgtcaaccctgacgacacccctcgacggagagccggagcaggattagtgttcaaaactccacaaggaaggggtgatctaccactcattctcccttctcaaggaagagtgttccaacaatgaggcagaatacgaggccctcattctcggccttcttttggcactctctatgaaggtacattccttaagagcccatggagattctcagcttgttgttagacaaattaacaatatttacgaagtccgtaaaccaaaactggtgccatattacacagtggcccggaaacttatggacaagttcgagcacgttgaagtcgtacatgtgccacgaagtagaaatgcaccagttgacgctctagcaaaactagctgcagcgctggtctttcaaggggatgatcccgcacgaattgttgttgaagaaaggtggctttttccagctgtcctagaactcatccccgaagaggttgaaaccaacaccatcaccacagatgctgttgacgaagaagattggcgtcaacccttttttgactacttcaagcatggcagcctacccaaagatgcagtcgagaggcgccagctacagcgacgactcccctcgtacatctacaaggtcggtgtcctctacaagcgatcttacgggcacgaagtcttacttcggtgtgtcaatcgaaatgaagccaatgaagttcttcaagaagttcaacacggagtctgcggtggacatcaaagcgggccaaagatgtatcatagtattcgattagtggggtactattggcccggcatcatggcggattgcctaaagctaaaacttgtcatggctgccaaatccacgacaacttcaagaacaaaccaccagttccactctacccgacagtcccttcttggccattcgacgcttggagaatcgatgtcatcggcctcatcaacccgccttcctcaagagggcaccatttcattctcgctgccacagactacttttccaagtgggcagaggccgtaccactccgagaagtgaagagcagcaatgtcatcaacttcctcgagcgacacatcatctaccgttttggcgtaccacatcgtattacctctgacaacgccaaagctttcaagtcccagaagatctacaaattcatggagaagtacaagattaaatggactactccaccggttattacccccaagcaaatgggatggccgaggccttcaacaagaccctcggcaagatcctcaagaagacggtggacaggcatcgaagagattagcatgatcgtctctatgaggcgttatgggcgtaccgtgtcacagtctgtaccccgacacaaaccaccccgtactcccttgtctatgggagtgaagctgtgttaccattggagatccagctaccatctgtacgagtggcaatccacgatgaacttactcgagatgagcaggttcgccttcgattccaagagctcgacgccgtagaagaggagcgcttgggcgccctacaaaaattggagctgtatcgccagaacatggtgagagcttatgacaagctcgtcaagcaacgggtctttgggaaaggcgagctcgtactcgttctaaggcgccccatcgtcatcacgcacaagacgaagggaaagtttgagccgaaatgggaagggccgtacatcatcgagcaagtgtatgatggaggtgcctatcaactgattgatcatcaagggtcgcggccaatgccgccaatcaatgggaggtttttgaaaaaatattttgtgtaaacttcgtgccttttgtttctaaaaaaatatatgggcttgccaacatgcactaaccattgcactgcttggcacccctttcttttcatttttacacggacatcgtgtccaacaaaaattcaaaaaatggctttccccatgtcacgctgagctggtatgtgaagacttggctacctcagaacctcttagcaagatccaatgggtgacatgactgactacgcctacgactaaacatcctccacaccaacacacaagtacaattggtgctcatcttcatggggcaacaaagacttgcttgggttacttctcagtaacaagttggtccacatgctctcgtgccctccggtgtgcttcagacccatggagatatcaagccccagggaagactataggagaagagcaagaaagggctacctacctcaacacaagttgtggcctagtgtgcagccacttgccattcctgtgaggtgtgtcaacaggggactttacaaaataaatcggcttgcgaggattacgtagcccacaaaggggaatggttatcctccaagttctaaggatgccaagatcctagatcaatctcaacgaagtcatgatgatctcaactcaagaaaacaatgcaatatcaatctcaatgaagctgcggtgttctgaagccacgaggcaaaaaaaaaaagaaacaaaaggagaaacaaaaatccaagcaaccagttatctccactgcattctgtcagaaggaggaggataaccattcaccatcctcagcaaaaggaaaaggccgctctcatagccattcccctaaaaccctctctcaatttagccatacctaaatctctcggttcgatgaagcacaataccgggggcatgaaactcgtgggtggtccagtgacaagaaaggctagagcatggattttcgctgccatccgaaaatatcaccgcgtatactactccaatgcacaaacacaacaggaagttaagttgtcagacggcaatcgtcatggtcattcagcggttctgatgactggttctttggcaatctcgtctgaaactacctcatagccagtgttcagtgggaaagccaacattttttttaaaaaaaaacaaaaacatcaaaacccttttcggtgttgggttccgctcttttaaacccgcctggttgcgcggctctagcaaccatgctcgatttcttttatgtgatgcaggattttcgcttcacatctctcagagacaacacttcgctctccaaggcaacacacgtccttttctggcaagtcggaatcgcagctgccattcggtcacatccggattaataaaggacactttcgggagcagtccggcgcaccaccacggttggtgcttagctgcacacctttcaatttggcggatcggcatcgcattcatcaggcaatcacgtccaaatcgataaaactatcttcgggagcggggtggcgcaccaacgctgttagcgtcaagccgtgaaacccttcagttcggcaagcaggcaccgcgatgtactagcggtcttggccgtacgcctatagtatacgtatacgtgtatgtataccaaataatcctccctaggattaaaccaacggcaagcaaaggctagtacatgggctgtatatgggccggtggatcaatgctgcatgctcatcgtacatatgcggctggataaccacgcgtacacacgtacgtgggcaggatttctcgccaacggcaagttactgatgcggagataacgtcagtcttatccggtcatctcgatctgcagcaactgaacccggaagagccggatcgatctaacgctcggccgcggcggcgccgagggattcgtagtgtgggttagggctccctgcgcctataaaaggagaccatcactcactacacaggagacgcacacagccatttcactctcttcacacagccatctcagtcatctcgacgcagccatttcactcctctcttctcacacactcactgacgtagcctcgccggagcagccgagtgggatcggctcgacgggaggagactccgtcaggaacaggagtggtgcacgtcgacggctgctcggcggctggaagaactcaccagcgacaggagtcggcgtcagatcgtcggcgtcagatcgtaggctgtctcctccctcacgtattctccgttgctgtcgttgccggcgccgtgtcattcacattgccgggggctgccgtggagccgatggccaagcctggagaagagcacgccatctgcagcaactatggcaaaaatcatcacacgctaatgtttcacgtgtgcatgcatgctactatgcacacagtgacaagcaaaccaacaaaatggcttattgctaagctatactcatttggccatgaggatgtgtatcgttatacactaatttctcaagtgcaagtatagttcggtggtctgcatcgaccatctcctactattcctttctttcctaatatgatcccgatgcaattgctatgacgtcgagccgtccaagctacgcgattccatgcatatcttcttcaagcaatctacaccgacacgtcgttcaagaccgacgaggctagatgacgagggcgggcaaagccgacgctaaggctacgtcaccaacaacggtgcacggaccgacgaggccgtggatcgctgccagcgcccacatctacatcaccatcacaaccatgcatggagaatgcgaagcgaagacaatgagacgaccactagcagcttaatcggaggttctctgcaggcctaaactgcggaggtaattaaccgggagctttacgaggc

SEQ ID NO: 86688 - DNA, 983 bp, Oryza sativa
gactccaagaaggtgacttgtaaccaggttaggatagaccgactttcggtaggggtgttagaggtaaacggacttgctttcctccaggtcctggcaaggtgatggacttttcggcacaatctatctgtcctttgtgcttagccaaccaatccatccctaggatgatgtccaagctttgcgagtctaggactatcggtttggctaggaagtcaacttcctcaattctaaggttaacttccgggcatacttgagttgcccttatattcctcccaggggaatgtactatcattggtaaacgtaaattttgggttttccaaccatttcttttcacaaaagcttgtgatatgaaagaataggaagctcctgaatcaaacagaactatcgcgggtacggagttgacagagaacatacccatcacaacgtctggagcatcctgagcggtttcagcttgaatgtgattcacccagccccgaccaaagttgttggaagcacgtgaaccttgtccacttgcctgagagctaggacgagatggagctaccgcgggagtaggagttctggcagtgctgccattcgcatgccctgagttggtgttggtaggattctgagggcactgtctggcatagtgacccgtctggttgcaccggaaacactgaactgttgacggtccctgcggtgacttgaaagaggtaacactgtttggcgcagtattgccactaggggcacgctgctgtggctgaggtgccggacggttcatctgaggacgaggggtatagcctggctggcggttagcttgagtgaccgactggtggtattgcatgggttgaccgtagcgagggcgaggtgcgcctcgggaggaatttccctgatggatagacttgcgtttcttgtattcttcggtagcctcttttccggcattctcaagtagaagtgcgttgttgatcatatgttgaaaagtggggaagtcatgagcaagcaagtggagt

SEQ ID NO: 86689 - DNA, 3052 bp, Oryza sativa
atatttagtagaacaacagaaaactcaagatctatcccctgaacaacaagattccaaaacaattcctatggaacccattattctaagaagccatgaagatccttcttcccactctcaatttgaggtatctagacctcaatctgaaacctatcttttgccttattcttatcctattacaactatacttattccaactgccaacaacgaacagcaaaagggcaattttatcaccactcctaaagataaggtagccaaatcctttgatattcccaacaattttcctaatactaatgaccagatgtctaattccttgacaaaaatccaagcgtcatcttacgataaattgacgctccaaaaagaagtttctaccttttataacaaaatcgactcttcggtaaacagagacctcgagagttatattaccagagtcatcaatacctctttctacaacataatcgatgatcctaaaggtattaccagatcaaaatttagattgttccataatgttctcttctccaagatctatatccaacctaatccaaataaaacactttgttaccattctcgaaccaaaaactcctttgaaagaaaatctcagaatcaaatctcggctgaagccttctgcacaaataatgaaatcctagtccataagcaagatctttttggaagcatatttgttatttctgatacaaatcaatttggcacttttaatcctgaggaagaaaggaccaaaagaaaacttaagattaatgacctcttccaagaacaaaattatactaaaaaggaattaagagacctaaagggtaaatttcgaagtctagaattacaaaataatagttgcatgggccaagatgaagaggttgtcaactccatcaacagttatgttaagcagaaatggtatgcagaagtaaggtacaaattcaatgatggattccaattcagctataagactttaattgattcaggagctgatgtgaactgcattcgtgaaggtattgtcccattcaaatactttgaaaaatcctcccataaaatccatgctgcagatggaaatttactaaaagtcaattacaaaatcccttctattcatgtttgcataaatggagtctgcattaaaacttcctttttgcttataaaagatctaaagcaaggagatattttgggaacgccattcttatccttaataaaaccctttattgttactgaaaaaggtatccagtttagaatcagagataaaaatgtgaagttaaaattttcttctaaacccgagcaaaccatgttaaactatttaaaggagattatcacacaaaaagagcaatttgtgagtgacatatcttctgaaataaaaaatgctaggatttcccaaacccttaattatccaaggtttcaagaaaaaattatactattagaaaaaaggtttataaaagatatatgttctgatttcccatcagctttttggcatagggggtagcaagctcgaattcttccttatatctctaattttaatgaagataagattcccactaaagcaaggcccattcagatgaatagttgacttttagaaatttgcaagcaagaaataaaaaacctgctagataaaggattaataaggaaaagttcctctccttggagttgtgcagctttctttgtagaaaatgctgctgaaaaagaacgaggagttcctcggctagttatcaattagaaacctctcaataaagttctacaatggataaggtatccaataccttataagcatgacttaatacgaaggattcagggttcaaagatatattctaaatttgatatgaagtctgggttttggcaaatccaaataaaagaagaggatagatataaaactgcctttactactccttttggtcattatgagtggaaagtaatgccgtttggtttaaaaaaaatgctccttctgaattctcggttataaaattcaatatgatcaagttcaaccagtagcaagagtaatagaatttgcagaaaaatttccagatgagataaaagataaaacagagttgcaaagatttctagggtgtttaaactatgtctccaatttttataaagatcttgcaaaaagacagaaagattttaaccgagaggttaaagaaaaagcctccagcttggacagctaaacatactcaagctgttaagaagatcaaaagtaaggtcaaaaccttgccctatctttatatcctagatcaagttgccttcaaaattatcgaatcagatgcctcatattatggttatggaggaattcttaaacaaaaaaaggattccagagagcagttggtcaggttcacctctgggacctagaatgaggctcaaaaaaattattcaaccatcaaaaaagaaatattggccatagtaaaggtcatatcaaaattccaaggagaattattgaatcaaagattcttgctgcgtatagattgcaaggcagcaaaagatgtcctccaaaaggatgtggagaacttagtctccaaacaaatttttgccagatggcaagcaatattatcatgctttgactttgaaatagaacatatcaagggagaattaaactccctaccagatttcttatctcgtgaatttttacagggctatggcacctaaaagggacttatcagcccaagggagaactacagaaagttcaccaaataagcataaatataatgaactaggaaatatcattcctagaacccctacagttcgagaaaagtattggaataattcatcttatatcctcaatatagaggaagtaattctgccattagaatttggagactctgatctcaatattatcaagattatgggaaagtatttcccacaacactaatattttatccctgaatatccacggaaagatcaaaattattatgagactattatgcgagacaagaagtgcacagatattccatacaaggaatggtgatgaattgggattcacaaaattattgatccaaaaaattataagtatcgatgattggaataaatcatcaaattctgatgcacccagaaatatatattgtacatcctgtacaaa

SEQ ID NO: 86690 - DNA, 1869 bp, Oryza sativa
ttctagcctaggaccagcacggtacttgactttgaacaattattcaacttttcattatctgagttgagcatttgctattcctttgctacatatataagcctacccagagctccacagatttgattacagccataccgcaagtatttgccaaggcatcgatacatccaacctccattggggtgcttggttgagtcggtgtatgtcaccattccacttgcattggtaagatcttgtaagagcttggttaaaagcttgagtgtgtgtgatttttgagctgccactacctagtagttaataggaacgcgcatatttttgggtatatttcttgttttctactaacaatggcagggatacgcaagataattggggatagctgtgctcaacatcgacatcttcatcaagacatgaggagtgatcaacatgaccattatgaggtaagtgatgatgttctaggtaagatcaaatctgcactgccttatttcgagggaaactatgatcctcatgcttacattaattgggagctagcggttgatagtgaatttcaaaagcatatcttgtctgagaaacaaaaggttatgtgtgcctctagtgttttaattaaacatgcttctaatgattggaaacatctttgtaggcataacaaaataccacaatcttggaaagacctgaaacgatatttcagaaatgtttatgttcccatgtattatgctgacattttgttcaacaaactgcaatgtttaaaacaagataccagaactattacttcatactatcatgatatgcaagcttgtttattacgttgtggtttagatgaatgcgaagaagctaaagaattgaggtttttacgtgggcttaacaaagaaattcatgacatgcttgcttgtgaaaagtatagatctctttctcatttgttacaacttgcttgcaatgctgaaagtaaaatagagtaggatatgaaaaagaaacacgctatgtctttgcctacaattactaaccatttgcaggaagtgcgttatcacgaaaaggaggaaagagacatgaaagagccaccaattccattgttcacactcaagttcgagacacctccatcatctgaagaggacatcaaaggtaaacttaatggtgctgaaattaataaaggtgagtgtgtcgttaatgaattgaatctgtccacatttcatgctatagtagagcaaccattagtggaaccaactgctgagattcctttgtcacaagttgatttgtttgctgttccttgtgataaagaagagttgtgtgataatgcttcacttatatccataccacaactagtgaatgaacatgctattactactgttaattattactgcgctgattttaagcatgttgttcacattgctaatgaagcagaggagcgtgaattgagatcttctttaaatactttgggctatgttcagtttgatgatttttgtgagctcgataatttgaaggagaaattatttgctaagtctgatttgccatgtccaaccaatgttatatttcacatctttggtgaatataatgatcttggaatatattttgtgcatagagtttacatctgctcggatttagaacttcctgtacatgtggataaaacatgcaagctagagagaaatgttattgctaaccaaattgtctcgagtttctcttgttttgattggaagaaacaggttgttgtaaatggactacgcgatgagcaccatatggaaaaattgaggacggttttccgtgaagaaggggaggatgatgtgaccatggctactacggatacaaccattgctcacatcatggaagaataagatgatatcaagatcaagtcctccaagtgctggaatcagattcggccacatg

SEQ ID NO: 86691 - DNA, 817 bp, Oryza sativa
ctggatctttcgatccgctggaaccaccactgtaatataattgagattattactgtagtagcataaattgccatgttagaaatagtaattattttaacccatatatttcataccttaatttgttcatgtccaatctttcaagcttcttcaatataggtttaacccaagactgatccacggcactaacatttctcatgaaaggacgagtagtatttattaactcatggtagacaacatataccggcagtttcccgtattcatcaccttccagtaggaaaaatggatgcacctgcaaaaagaatatatacaaactggaaagggtcaacagtaattaaagtttgtaactaaagaatgtagtcaaaccaaattgacaaattctacaaaacagctttaaaccagtcactgtgagattcatgcgttcctgttgcatgagacaactattatttgcagctaatatccagcatatctaaaatactttgtcgacaattacccgagaacaaactgcatactctcagcaaagcatattcagcatatctaaacagttcaagtagcaactgaaagtttcattggcttctacatctagtaaaaagtttggcacaaaaaactgctaccttttggtttggttaagctggctaatgtttcattcgccagaatcatctcaatttacccttgccatttatgcttgacactatagcaaaactaatctgatagattgcagaagtcaatacctgcactagttgtgccctgtatccaaccgtatgataaccattgtgatgcagcatcctctcagcgagctggttaccatatccaacacata

SEQ ID NO: 86692 - DNA, 6959 bp, Oryza sativa
acaaaacgtagaataagtaatgaacacaagtaatggctaatacctttgtagctatcattgcgtccaagatggagtgatgactcgtcaatgatacggacagtgaggtcagatgtggaggagcagagagcagcggcgagacaagctgcagctgctgacttaccactgcaaggctgcccacatattaccacaagcgccatggaaaatgtatagacctagcatatgaagataaaatgtatcacaagtgtttccaaggtttaaactcttcactagtaaatctttcaatgatatagcaattgagaaattttcccaaaaaggtcagatgcatgccatagccagtctcaggaggtttgaagtctaactccactacaaaggagcagtaaaacaaatgagaatgcgaccagattgtgatcagtcaaatatcacaatcaggcgaatttcaacaagttcttactagttcattcaaataaaactaatttccattgggataaacatcaccaccaagcttcaattgtacacattgatgcaaaataacgtgggggcaacgggtattttgcttgcaaacaggaggggtgctattagttctacacctcgcatcaaagaaatcatcactgtccgggtggatttccaatccatatgccacgcgaggctcactgctgaggaggatgacgatgaaggggaggctacgagagaagaagcaataccttcgattccgtccgaactcagacggaggccggtggaaggaggatggccgagtcgcccctccaaacagtggcggaggacggaaaaaaatctaggtatgggtgtggcccatggactagcgcgagaattagaacataacaagaagaaagggaaaaaaacaatttcaattcacgaaattatatgacgcaacattatcccatcatgacgcaatctcaattctcaagcatggcaacaagcaccagtcataagttcacaattcatcatccatttgccaaaagtgtaaatagaagaggcactcataaataccagaagattgcagttgtcaacaatacatcacatgtaagaacgaactattgaggatagatagacatgtagtgatgtagacctgctgctgccctgcctgcctcactgcctgttgccggctgccctgctgcgctggctgcctgcctcccgcggccgccgcgccaatgcccagtgcggccgcaccgcagcgcgcccacgccgcctgcctcccagagcggccgcgcgcccgcctgccccgccggctgcagagcccccaccgaccaccgcagctccctgtcgcagtgtcgccgtcggccgtcggcccgtagcgccgcgccgccgccgcttgcctcctcagccggatgcctggattggattggggattggggattggggaattttggaggtagggtttcatgttcaacaggtcaaaaggcccattacacaaaaaaaaaagcccaattggttggcctgttcgcacgtgggctgtgggcaggattggcttcggcaatcggcagttggacgcctcgccgccggctcgagcgtccgggctgcaacggcgcagatcaatcctctgcagggtgccggcggtggcggagcggaccgtgcagaagctgggttggaggtcgtgcacaatcggggtatcacctactccctccgttccaaaaaaaaaaaactcaattcctaaattttcgtgtctaatatttgaccatccgtcttatttaaaaaaaatttaaaaaatttaaaaatataagtcatacataaagtattattcatgttttattatctagcaataatgaaattactaattataaaaaaatttcatataagacggacggttaaacgttggacacggaaacccaagaattgagtctttttgagacggagggagtatggctgaggctgatgccgacgagcccagtgatgccggacgcgctatctcagcctgacttcgccgtctcgcgccggcccagcctacttcaccccgcgctgctctgcgacgaccgtgattcggtcagtcccacgctctcgcctctcgctcgcccgcgcgcaccgccgccgctcgctaatcgctagagttagggatcgggagcagtcaacagtggcttgggttggaaagtttgcgggtagaggtgtcttcttacatgttgtcccatttaatctgggtccacctaattgacatctaaattaggagcattttaaaaagtgatggcaaaattacaaagtttagaaaatagagataaaatcatttgcattgcaaatgaaagtaggggcaagaacatgattctccctatatatattgttagagttggagaaagaaatggaggcatggtggacgaggtttagccgcgatgtcggctagtgtggaaaaaaagtcaaaaaaaagttttcatctggcttttcaactaaccgaaattaatttgattataattcggttagcactctcgattaactggcattagaaaagaggcctaattatttatctcgatgagtgttaagttgtaagttaaaattagtcaaacaacttatgttctgtctcaatttcgaccaaaattacattaagggcataacaaaatctttcaatcaaaattaagatacataattgagatacaaaattagtataaattcatgctaatttcattgccattcggtgaactattccaaatatttcaccgaatggccatgaatttggcatgaatttgtactataatgtaatgaacttatttgattactgaatttggcaaaatggcatgaattttcgcatgcatggcaataaattgtactgaatttgttctgaaatggcaaaatggcaataatttagcatgaatggcaagtcagatatagatggaactagcttaaagttgaacacaaacatagatcccacataatgtctagcacataatcttaaatttacatggtagcagcaccattaaaagtagaacacacaggtttgtgtggagcttgggataccaggagcaaaacataaaatagtctagacatcaatctacataaatagtcttgacatcagcttgggatacctggaaatgacaggccacatcacaaaatacataatatttgatattgttcaaatcgacgtcagtcttcatatcctaagcttcttccttggagtaagggtgtgtttagttctttgggtgtaaagtttttaagtatatggacacatatttgaagtattaaacgtaaactaataacaaaaacaaattacagattccgcatgtaaactgcgagacaaatttattaagcctaattaatatgtcattagcaaatgtttactatagcatcacattgtcaaatcatggcgtaattaggctcaaaagattcgtctcgcaatttacatgcaaactgtgcaattggttttcccatattaaatgccccatgcaattggtttttggccaaaaattttttggatctaaacaaggactaaactttcttggagaccatctaggtggcttataggaatgcaaattgctaaattgttagcaactgaggcagtagtaaggaatatagtagttttgataacattacctccttgtaggcccatcagtaggttttttttgtgtggctaggaatatcagagctattcccatactttacttttgtagtgttcctccttggcttcctcttcttgcaagttttcagattatgtaggacataaaggataagtagagaaattaatatagatagattaatacttgccttttctttgtcccattaagatgactgttggtattttcttaacaacattgctagaaatatgaattcccggcaatggcgcaaaaataatcctggtatatttatggttacagaagtaatccgcaagcgcatggatataccattgtagcatttcaccgaaaatattctcatatttatttaatctcaagagaagatttataagaaagaactatgctaataatttatatacattactcgtatatatcaaagtctaagcatgggttaattcagatcatatgggtagaatgacacaaagcagaaggacttagattctctcatttaaataattttagactatctggaagaagaaatagaaaaggtaattattcatatacttctaataaacactcaactttagtttacatttgctagtatacaattgtgtaaccaatacccctaatagtgccctcctggtttttcgaaagaccaccccgggttgccgagtttcttacgacaacctgtcatagtggccgtccaacggggctaaatacggaggagtaccctccccaggaaagtgtcttaggaatatatatcaatgtggaggaatacccgtgctgaattgtcaccatcagcggcccgtcactactgtcccacagcatatatgtctaattaatgatatctaataatctaagcgccatgcttacattatcaaatactactctataccctcgagaataatatagagcaatcattcgcatgaacattaaaccacaccactgcacctatctggtaggctagtcacacaactatatcggcacaaataaaaatgaaaaccagtgctcaggcaaagtaaagtactgaatatataaagaaggatattctattaattctgaaagtcttacaaaagaagaaagaaaagctactagagccatacccgaaatcttccgaagactcaaggactctgagaactattctattgtactccacttagcactagagcactaaactaaacttgagagagagatcaaagcttcttacttgaggtgtgtagaaatgaatgaagtgacccctttatatagccttccaatgacagttaaaacggttggaattgtcggaaatgccccccaaccgtcattacggaagcatcttgaacgtacacgtggagggccgagctgaggcgtcgttggcagggttccgccgaacctaggccagcctagcaggcctccaaattcggtcgggggatgataggtgggtcctcatggcggttgtggcaattatgatggttttcaggatggttacacctgacttgtgagcccttctatccttaagcttgcttaggagtgagtttttcttcatttcttcaccatttatgtgctaatgatgaaccctgagttcctctcaacactcaaggctgttgttggcccgatctttcggtgagttgtgataactacgatttgggagaaacgttgacgatccgactacaaccgtacgagacgttgtgttgcgccttagcgatcgatacacctctccgtaggttgttgatcttgccggtgcagatcaaccctattcctgcaagcaaatcgaagaaacaagcaagaacaagaataaagcaatctgatattgcaaataggaatttaatacaaatgataagttggggttccgaagaacaagcagacggacggtctagccgacacgcgcgctgcaagcaagtagcaatggctaaactttaatctaacaaaaacccaagaaaccctgaaggggtacctaactatttatagaggtgggaggacgactaagagggtccaagggtcgtgctccaccagattggggcgcaccccacatgggccccacatgggccagggtcccaaacaaagttacaagcccattggcccaatacaggagacgcagcaccttgcttttgtgattgcggccaaacgagatagatttccgagatgaggctggatccgttggaaggaggacttcgagagctttccatcaagtactcacgggcccaaaacggagcacgtatgtagatttggcggccgtttgaagtcagcaatgtaacacgtggccgaatcagattgcagcacatggaggacttgatcttgatgtcttcttgttgattcatgatgtgagcaatggtcgtatccatagtagccatggtcacatcatcctccccttcttcacagaaaaccgtcctcggtttttccatatggtgctcttcgcgcagtccactgaaaacaacctgtttcttgcaatcaaaacaagacaaactcgagacaatatgattagcagtaacatgtctctctagcttgcatattttatccggaactacaagatgttctatatctgaacaaatgtaaactctatgcaccaaaaatattcctctatcattatattcgccaaagatatgaaaaatagcattagttggacatggcaaatcagatttagcaaataatttctccttcaaattatcgagctcacaaaaatcatcaaactgaacatagcccaaagtatttaaagaagatagcattcgcgttcctctacttcattagcaatgtgaacaacatgcttagaatcagcacacaaagaaatagtagaactaacatgttcattcactagttgtggcatggatataagtgaaacattatcacacaactcttctttatcacaaggaacagcaagtaaatcaacttgtgacaaaggcaactcagtaattgattccactaatggttgctctactatagcatgaaaagtggacaagtgtagctcaccttgagaatactcaccttcatttctctcagcaccatttaatttaccttgcgaactttcttcagataatgtagctgcatcagccttctcctcattcgcgagtgatggaagtgacatctcaaacatatcgttcttctcattttggagacttttctgaacttcctgcaaaacatcagtgataggaggcacaagcatatcttgttgctccattggattctccaaaattttgcgctcaacaatgcaagcaagcatgaacaattggcctatatgattatatgtcacattaacaagcccagcctgaatattgaaattaagccctctgaaaaatctagtcattgtgttctcattagattcttgtaaaccactataagtgatacaaattttaaaatcatgaaagtactccctaacagttttgtcaccttgttttagatgttcccatttctcaaggagagcacgtctatagtatgaaaacacaaatctttttctcatcagtattttgcattcatcccaagttt

SEQ ID NO: 86693 - DNA, 1480 bp, Oryza sativa
cttgacgtagtttagctcccagatctcctcaatgcgcccgtagtatgtgtttgacccaacttgatcctggaatgcatctatacggacgccactgttttgcactgtgcatttgtcatcttgtttgacggtgtaaaatgtgtatccatttatatcgtatccttgccatgtgtctatggtccaagacggtcccatccccaccaactgtactgtctcatttgggacaaccgtggacattgtcacacgattcttgaaccattcgttgaaccgagaattatgttctctgttaatccatgcatcagatggccccaagttctcatctcggattttcgctaagtgctcctcaaagtatgggccaacttctgtcatatgttggagcacagcgtaatgagcctgcgcgtacgacgcttgatcgggcttaattcttttccttccgattgtgccaacacctgacaaccttccctcgtgacgagacgctggaactccgataggatcggcatcggacatgtaattgacacagaactcaatagccacctcggtcgtgtaaccttcaatgatgctcccctcgggtttagctctgttacgaacgtacgacttcagaactcccatgtacctttcaaacggtcacatttcccttagaaaagctggaccacatagttttgtttgcttcaccagatgaacagggagatgaaccattataacaaagaaagacagtgggaaaaacatctccaggtgacagagggtattcacaatattggtctgcagcccatctagatcttctggatctataaccttctgtccaattgcattgaagaaggcgcacagacgttggatcgtgtgacgcactttcggtggtagaatgcctctgatagtaactggcaagatttgtgtgattagcacgtggcaatcgcgagacttcattccaacaagttttagatcgtccaatttaacatacttacttatcctcgctgaatagcccgatggaactttaatatccttcaagcatgataacattgcgatcttctcatccttcgacagtgtgtggcaggctggagggaggtacactttacctgtctctgcatcttgtatgggctggaattcgctgcgaatattcatgtcctgtagatcaaggcgcgcgttcaacccgtcctttgtcttcccgggaatattcaacatcaggccaaccaaactctcacacacattcttttctacatgcatgagatcaatgcaatgacggacatcaagatctttccagtaaggtagccgccaaaatatggattttttcttccacatacccttctcctttgtcttgctacgttttcttttcttcccaaactcattgcttatgtccttgaccatattgtggacctcatctgcggacaaatctttgggagcaggctgaagttctctcttaccattaaaaattttcttctttcttctaaatgtgtgacgtagcgggagccacctccggtgacccatgtat

SEQ ID NO: 86694 - DNA, 14644 bp, Oryza sativa
taagatggtatcaaaattggaggaaagaattcaaaatctagaggaaggttcttgtatggatgctcttgtccttccacttcacggttctttgccacctgaacaacaggtaattcattaatcttccattctagtgtattgttatatttgtttcttgcatatatgacatcccatgaatgcttgtatatgacattttggacatgtatgtggtctccaatatgcgcctttgaatactttgtttgattatgctcatgaaaatttcgtggagcttttatattactacctccgttcttttttggtgacttttgggacatgacatagtcataaaattcattattgatagcgatatgaaagtattcttcatgacgggcctattaatttcattttcacctataaatcttttaggtattcttcatgacaggcctattaatgtcattcacctataaatcttatagcgattaggaggtgtttgcatttgtttatgagtcaagattccaaggtttgactgcacacgttctaaaacatcatctgtttgagaatagacggagtgtgaaatactattattaacaaatttgataatgtcaacttcacctgaaatatgttttttatatactgatgtttgaatttaaggaaatttgagtgtatgttttagattataatacaaatttgaacagagaatatattttaatctttcagttacttaatcaatttaatttttcgtatatgagcttatctagtgatccatagctactgaacctaataaacacacctggccatgtttcttctccatttctctaattgatcaatgaagcttggcattgcaatgtacagttcctacactattgcagctaagtgaaatttcttagcaggcaaaagtcttctgaacaagccttacaattacttatctagtagtagattatattaaagcaaaatttgtaagattttgtgatgtcactgaaaaaaattgccaactaggaatatttcaatgtttatttttccttttttgttgtgtgtattgcttgctgttgatcgactttcttgggggactagagtatcttttttattctgtgcttgctgcattgctgcaacaggataaccttggatgatatttaaccaaccccctaacaatatatggctatgatagcaaaatttaactacctggggatcacgttctaacaaatggatgcactgatggatgcgaattataataggctcaactgagagttgaaaagcaaggtcgatcccgatttgttgccaaagctgctgttttggtctaatctttttgggtttaagcacacttattagtatttatattcattaattgtccttcattccatttgttggtaaatgtttgatgctctatagtatcattgctgatgtattcccttgtcacaataggtccgggtatttgctccagcacctccaaattgtcgacgcttcattgttgcaacaaatgtagctgaaacatctcttactgtggatggtgttgtgtaagcagcaaactgcaaacatagtcagttaaagtgcacatatactttcagtttccatcttcagccttttttatttatttagtgatagattattgtgtttatgatgtatttagctgattttgtggaaaagtatatgcaaataaatactttttttagagttatgcaaggaaatggctagaatttttgttatgaactactagtaacatgctattaaatttatgagagttacatcaactgatctgctagtatcagtttttgaagtgtatttttgtaaaaaaaaatggtaggagcaaatggctataatatcattaaattcacatgaatgcttatattcttaaacttaaaaggaaaaaaatatatggtttatatgttgaattcacaaactaattatctatttgattttatataaaagaaatatgcataacttggagataccttgtacatgtctaggaggaaaaagcttgaatatagctttgccactcgctctttaatgtacgtacgaagttgtgatttgagtatgatctttcatcctgagaaattagtgttacgattaaaataatgtgctgatgaacatttgtgatttcattagctgttttgttaataaataagaaactgctgaactgatattgcgttatcaaaatttgcaatctttctattaccctgctgaacttggaatggctgcaattttgttcttggagacgtgttttttcctttttcttttgggtttgtatgcaaatcactaaaatatttttttatgcactaggtttgtgattgattgtggttatgtaaagcaacgccagtataacccatcgtctggaatgtattcacttgacgtagttcagattagcaggtaaatactatgttgcacacactgtggttatctgtctactgtcttcatctgttcaactagatcatgatcctgttcagagatatctagttatgatccataatatttaccatactacttcttgaataacaagagtgcaggctgaccagcgagctgggcgagctggaagaactcggcctgggaagtgctataggttatacccaatttccatttatcaaaaggagtttctcgaggctacaatcccagaaatccagcgttcttctcttgccggaagtgttttgtatctaaaatcgttagatctacctgatatcaacatactgaagtttgatttccttgacccaccatctcgtaagataaaactccagaattctctattcttaattatagctcttcaatcttcatccatctttaatgcttttttgttgttagaaatcactttatctattggattagctccaaaaggcaaacatagacaacggccattggcaaaggaaaacgagaagaacaccctaatctacagaaactagatatatactcccttcgtatataaatatatgatcccattgactttattcgttcaattttggaaagttttaccatcaatagctctcaaaatatttattttgaaaacataaaaaatcatatcggtaggtttttctttacaagtacttttacaatattataatttgttagatattatcgttatattctaatagacaagtagtggtcaaagttgcacaccaaagattgaataaagtcaattgccatatatttgaatacaaatgtagtgctattcacaacataagtagctgttggtaaaatcttggttctgcatggtttaacttaagttattacatttattgttctaggtccagcctccacccaaatactttcatggtggctggacgagcctatttcaaaaggcatatgacctactccttccgtcccattttaagtgcaatcatgaggtttcgtgcccaactttgattgtccgtttatttgaaatttttttataattaatattttcattgttataagatgataaaacatgaatagtactttatgtgtgacttatgtttataattttttttccaaaaaactttcaataagacagacgatcaaagttggacatagaaaatcatggctacacttaaaatgggacagagagagtactaaccttacgctccatttggcactgtggtggattatgataatatcttttgatgcacctgttttaggagttgatgcccgctaactcctaaagcccaacatgcaagtgtgccacatgatcaccctctagcatttattatctagaatattttaaatcacatgcaagtgtaccacatcatcatccatagcagttattatctagagtattttaaatgtcatgcaaacatgacatatcatttacaattttgttgtatttttagaactcaatatgcaagcaatgtcaaatcattatttccacatcatttttacattatttaaacatatacatataccatttatacaatgtacaatatgcattcatccacatatcccgcagcaaagcgcggggatatcaactagtagcttactattcctgtttggtatcaggagatcctcagtgaaactgcatccacttctttgcctgtacaaattgtcttgtgaaataaaaactagtattgtctatctcttacctttgatgcacaatgacctgcaggtgaatcattagaagatgctttgaggcaattatacctcatcgatgcaattgatgaaaatgggcaaataacagatgtaggacgaattatggcaggtattctcagcttgcttgtcccatttcaattgaaatgaaatcaggtggttatttgagtttgtcttcactcttgaacaatgtatgcaattaaagtttgatcaaatcacgagcatatctggtttctttttcttttatttgaacttcacatggtctaattttatttgttgcataccaatataatattgttgtatctttagttcaatatgtgcatgtgcgtttttgatgactctgttagcacatccagcacatgaagtaactgttgatgtgtggagcggcagcatgaacagggatgatcattttctgtgtttgtcatcttctttttgttaaccttttggctttattttaagaagtttatactcttaaatatgtaacggtctaacctctaatgttctatataaggaggccatacctggcaatgttttgatatttcaattcagaaatgtctgatatatacaactgttaagaggtctaatgtttttgtgcaaagcttcaggcagtttatgttgacattgttgttttattggtatttctaacaggaatacttacctagtagcctccggtcagattactgcgttttggggatttttcttttttttttacccctccagtgtttgccgcgtgttaaactgttttctttcctagctgtgactggctcttttttctcttaatgacgtagctggtgtccagttttgtttgttgacgtttctacaggggtttcgtatacgtgccggtctttgggtttttacaatttttgtagttgacttgcttacctggttatttctgctctgcgtgttttttccttggtgtgttcggctgctgcttgtgcacggcttgtgtttgcatgcgtcctgcacgtggtgccatgcgcttgtgtgtgtagcctcgtgggtgtgcccatgctgtcttacgtggctgctcccaacccttttgtttctactcctatttcttattttctttttccctttcatatatttagccttgatcgtcccaaagtttttcatgcttgctgtatgttacgtttccttaatcaacgttgtgttgtcatcttcggttgctaggtcgcgttgtgctgctgttcggtgccgttcttgttttgatcttcaagctggcaatggtctgtttattgtttcttgttttacttttataatttgtacagttttttttccttatactacaaccgtgtgtttttcctcccgttgactcaaatcctttttgtgttcacacttcacagtgtgttctccgatagaattgctatcgttctcttaattttgctttgcacttatgcgggtatgccactggttgcttggcgctacatatagtttgtgctggatgattctgatgattctattgttgcctcttcattgagcatgaaggtagcagcaggaatccgtccacatataccccatgccaggtagcctgaaatgtctacagggctagaaatctcaataattctcatctcatccatgagctgaaggaatttaaaagattatgagtttgggtttttttgtaccatccttgagaaatatgttgaagtaccaaaaatttttatgtaaaattagtatctcgaggtatcaaaattttacactacaaaatatagtatctcgagttttgtcttttccactggtttccaaccagaagcagccttcaggagtgtatagtgcacttttttcggtttcaaggtagtgccatggtttcttacacttatctaagtgcaattccaggtcaaggaaaactccattcctaatctgttatctgatcaactgataaagcaatgaaccagatggatttgttctcgcaagatgcttgttgggcatagactagtttactaagctagaaaacgtactatatctatgcttgctttaatgctttgaagtggaacaacaggctaatatggaaccacatgagagcgaacggaaagcatatttggattttaggggtttttacaacaaagagtgaattttttagttaatcacggcacatatgcatgtttacaagtttctataagcaatattatatgatagttgatattaacctgtgctgtgatcatcatgtgtggatgtgcgatcatcaagtttctataagttgatattttatcttacattagccatgtgtggattgtcatcatgtgtataaaatatttttagtattcttttaggccaaataaaactgaagtgaaacgagtaattgcctgagcgcggcgtgtcgccgcgtgggcacgtctagttttttaatgtctggtgagtttttgtgtagtaagatttgttccctgtgcaatggccatagttttcctcttgttttgtcttgagtatgagccgtttacatgtctatataatgtttggaatttgaatatctccacaatgttatagaacctgtcttgggaacaagctgttgcttttgtaatgatctggaaatttccacagttttgtactatctgcttctaattttctagatatatgatatttattgggaaaattttgtatttgcaactagtaacttgtctaatactccctctgtttcatattgtaagatattttgggtttgtcataagtcaaacttctcaagtttgaccaagtttatagaaaaaaagtaataacatctacaacaccaaattagtttcattactatttgtatactatatttgttttgtgttgaaaatattgctattcatttttctgtaaaacttggttaaacttatagaagaatagaagattgacttaggacaaacccataatgacttataatggaaggaagaagtatcaagttgtcaactatatattcgaaaaccattcttttcacatgccagtgttccatcaggtcacattcttacatgactggtatatgagaaaactgttgtgagatttttacttgtaattcataacttcttaaatcctgcaatatgttgctaggcttgataaccaattgtttacctatgtcatctgagcccattagttcccatataaaagcagtggtcaatatctccaggtccagcagcattgcgcacatgaacagtacccgcgtggttactgttcaaacgtatgaagctcacgtgattgctttaatttagattaatgagttatttattaccatgatcttagatataagtttcttaagaggcaatataaggatggggctgtatttctgttcattaagcaagagataaacaagtgtctttagtctcgccatcttcttgcctgcccttgtggtacacagcctccatggtgccaatgtgccacttgggtcaactatgcctaaggcccttatcttagtaatgcccattacatgctattgtattttatgattgtacgcgacatgatttgctagactaaatatggtgcttgtagtagatataggagtatgacgtgggtgtgggtcactctgtttgtaccttgttgactgactctggttcaacaaaaccaattttacttttgttgaactagagtgggtcaacgggtacccacagagtaatttgtacccatctaaaagtagctatattattcctacccctttactagaaatgttgcaattgcttatctgtactggagtacataacagaacctagtgggtactgggtagcgatgatgctgaaattgtgagtgtgtgataaattatgatggcttcatgatcgactcttattcacatcccgatgaattctgtttgttggatatgatttgtgtgtatgccactgatagataaattatttgtgatggacacaatgtgcaagggtgatgccaaatttttgtggcagccaacgcacccccttctgcctaaaaagacttggtgccaataacccttggctccagttacctgatgttgacccatggccacgtcgggatccagcgtcgcacagctgcaccagggttgatggtgctggaatgttgtttagaaaagaaccagtacgtcaaaattctagtgtcaagtaacttatggacttatgcaagatatgttgtcccgtgatatgtgtgcagagctccctcttgagccttctctttcaaggactttgattgaagcaaacgaattgggatgtctatctcaggcattgactgttgctgcagttctgtcagctgaaatcacattccggtcaactagaaggtgggcattttgttttgtaattcatctaagctactgtaacacattgaattttatggtgaacttattgcacccttacagcaaagacatggagggaaagaggaaaaggcaagagcttcctgatggttctggttggggcgaccatatacagttgcttcagatatttgaaagttgggatcgaacaggctatgatccaagatggtgctcagatcatgagttgcaggtgaatgaaaataacattttgattctaatatgatacagtgaaaggaataaaattattaagtactagtgttgcaaaaataaatgcaactgtgttggaccttcctgcatagaacaagccgaatcacaaagcatgatataatacctgaattttattttaaataggtcatcgaagcatgtcatgttaaatgggaacatatcctatgtacacaagtttctgatacacactctgtgcacagcaattaacaaatgtcttcgaaaattctagaaaaaattggacatgcaatcctaatagtactccctccatttggaattgataagtgcaaaagcaaaacattcagaattgatcagtgcataagagcaggtacaatagcaggctattagccggctataaacatattttaatgagataaatgatgagagagaagagcagcgggctacagatttgtagccagctgcagcacggactccaagacacaatgtgtgtatgacaggtgggaccatatattaatagtatagtaagcaactattgtatgaattggctattagattggctatagatgaattggagctagtagtgagctatactattgaacttgctctaaggatgtggtagctgttcagttttgcatgtaaatttattgttttcccatgcaaggattgggtggctctttgatttacatgctagccaatcagttttgcatgcagatttattgctttggcatgcaaggattgcctggctcttcggttctcattcaagccaatcaattgagcaaaaataggatgcttcattgaataaaaattggctgctcgtcttctcattttgcatgcaagtgttccttagtctggagcccaggtgaaataggttgatcaaattcgaatggagggagtattacacatatgtgtaaagtctcatctgaaaattcattatattttagccgtagcaaaaaaagaaaaaactgtcaggtataagagtatactatcagaattttgtcttttatgttacgtctaaaaataattaattcaaacatgagatttcacacataggtgtaatacaattgagagtacaagtctacttttttctagaatttttggagatatttgttagttggtgtgcatgaagtgtgcaccggaagcttgtgtgcatatgatacgttcccatcttaaattgccttttagcatttatagttttcatgctagcaatgcaaactttgaaacatataacaaggataacattgtgtgatcatcatatctatatgcctgcatatactgtttgtcatgatacttacagactttataccccctagatagttttctagacattagattacaatgtagatcacagaactatcttttgcaggtgagaggcatgaaattcagcaaagatgtgagaaaccaattaagtcagattattcaaaaaattgcaaaaggtcggtgatcagtaattctagtttctgttttattgtgtacccaccctttcaaaaacctactacctgtttgcttcttcctttcctgggacacctctgttgttgagctgttttttcctcttttgtcaattcgttgttctactttttgaattttaacttctaggaactaccacaaagatattgttacatatgccctccatgaagatgtacgtcctacctctagaacctcagtaatatccatgcagtgctcgactacagatgcaatataacctgaactcatcttgctcgtattgcaaccaaaatatgtaatagatccagagcccagcgcattacgtattccaatgttcactcaactactatgtttaagtttggcccgtatatcaaaaactactaaacctacctctttttttgtaaatttaggttcaacagatgtgcaagcaaagaaagagcggaagagtgaccctgattatagaaaattaaggagagctctatgtgttggatatggtaaccagctcgctgagaggatgctgcatcacaatggttatcatacggttggatacagggcacaactagtgcaggtattgacttctgcaatctatcagattagttttgctatagtgtcaagcataaatggcaagggtaaattgagatgattctggcgaatgaaacattagccagcttaaccaaaccaaaaggtagcagttttttgtgccaaactttttactagatgtagaagccaatgaaactttcagttgctacttgaactgtttagatatgctgaatatgctttgctgagagtatgcagtttgttctcgggtaattgtcgacaaagtattttagatatgctggatattagctgcaaataatagttgtctcatgcaacaggaacgcatgaatctcacagtgactggtttaagctgtttttgtagaattttgtcattttggttttgactacattctttagtttacaaacttaattactgttgaccctttacagtttgttatatattctttttgcaggtgcatccattttccgtactggaaggtgatgaatacgggaaactgccggtatatgttgtctaccatgagttaataaatactactcgtcctttcatgagaaatgttagtgccgtggatcagtcttgggttaaacctatattgaagaagcttgaaagattggacatgaacaaattaaggtatgaaatatatgggttaaaataattactatttctaacatggcaatttatgctactacagtaataatctcaattatattacagtggtggttccagcggatcgaaagatccagaacctctagaggataaacaagtaagctccccaaagaaagcaatggatgttaaacaatctgacgtggacagtaaaatacaggcagctcgcgagcgctacctggctcgaaaaggcaagaaatgacagtatgtgcttaaccaagctattctttggagggtaggtcccatacgtaatgagaggaacagggagtgataacatgacaatcttcagtatcatatttccctacctcttattacttaccatagcagaagtactgtaggtacaagcagagacatttatgtgagtctaaatttcatcatatccatccatttgtcaagcttgagaactttgtaaccgtttaaaggcctgtttggctggtgtcttggtgccatatgcctgaggattttgcatgccagagagccacccgagatgatgaattttgcctagtcaggcagcatgtctcttttgattgtttggtttcgcacagctgtctgaggaaaaattgggttaggctttagatgattactgctaatcaaatgttgatcggaagataatcttgctaccattgcaatcatgcatcgccccttcaaacaaaatccatccactgccaactttccgtaaacaaataatttgcatactaaaatctatccaaataagctcttgaatctattcagcgaagtggaagctgcagagatgactggcggttcacatgatggctacagtgcagcggcggcgctggctgcaacagcgttggcagcttcgcgcaacggcctttgcggcggcaagatcctgtgaccgagggtaccaatcaagggccacatcttttaccctacaacatatatgttgatgatatatgttgatgctaaaatgtgaatcttaaaatttaattttcgagttaattttgagggttttttttatcgtagtttcattttcaacattggcgttcaagtcattaagaacacatgtaaaagttttaagagtaaatttcacaaaactacaggtattttgcataatttatcaaaaaaactacatatttaagatttaagagcttgtttcataaaactacagatttagtgtctcaatttatcacaaaactacagatttatacaaactatcacaaaactatatatttaagaatatgtttcgcaaaactataaatttagtgcatttgtttatcatagaactatacatttagtgtcttcatttatcacaaaactacaggtttcacaaaactataagtttagtactaaacctgtagttttgtgataaatgaagatattaaatttgtagttctgtgaaacaagttcttaaatctgtagttttgtgatatattgtgcaaagtacatatagttttatgataaatgaaggcattaaatctgtagttttgtgaaacaagtttttagtcctacgctgagaaaagataggggaaagagataaggagttagaggaaggaaagagataaggatagaggaaaaagagatagtggagagataaagatgagaaagtctaagtctatggtggttcgatatatttaagacgtgggagggagatagttggtgatatcaaccgggattaaagatctattttctcggtgctctaacgttgtctaacacaaatagaaccgggactaaagatgatttttagtccgggattaagggcctgtttggtacagctccaactcctaaatataactctaggagttgagtctggagtggagttgtggagctgcctaaacccagctccacaactctagtacattttgtgagagttttatccaactccactcctagttttggtggatctgaaactgtttggctgagctcctggagctggagatagagctgtgccaaataggccctaaagatcatgaagtccccgtgcacttttaaactgagactaaaaatggtttttagttccggtttttagttgaaccgggactattgtggctttttggcaaccgatcaaaaatggtttctccagtatctagatgtgttatattacacattaatgttactgtaatcatactaaacttctgcacgaggtttcatctactaatataaaaaatatttcgcccgaaaactaccaatggataaagaaagtcactatcggtcccctgtgatcgctcccgcctcttcccgtgtgtcactctcatcatctcgtgcgtgctactagaaaccggcgtgctccccattagtgaagaatgagaaggatagggaaggggatttcatttgcaagttagtgaggggaactgttggggtgtacttaaaacaaccaaaattttgagattagaagccatgctgagcatctgttggcgatgctcttagagcaccatccaaaaatccagtaccaaaactattcatttactttcatctaaccaaacctggatttttatgatcatttttttttacataaaatggcatataggtgttgatgcgaaaaacacgaggcctgagagatctgcttaactccagtgcaggtccaaaaatcttgccattaggttcgtgagcgtgccagttgatttgattctgcaattaacaagaaataaagtgtttggagagaaaaaataaattttcgtccctccgcacagggaaataaaataaaataagatgcgcgggcgtgcagtgtactaagtacacaaataaaatagacgaaggaaaatgcatttattataattctcaaagaattaaaaaatacaaaatccttggtcaaatgctctctatggcctgtaggcaaggtggatctgaattggcgattgtgttctcctgtttcccagggtctcggaagacacctggttaattactctcgcgagttaaactcgtgagaaacctctgattaagctgtgctggtcgtcgttggtctttgcttcacattctcccactagaacggataccctcatctcaatcgggcggtaagccccatctcaatcgggcacagcgtccgtcacaggctagaagtcactgatgtgaagagttatctcaatcgggcaaacggccgtcacgaatgaatatatctcaatcggttcctaagtaaagcccatcactgatagctttgacccagacgaccagtcaaactatagcccgtcacagatgacctatctctatcgggccacaactagcgcccgtcacagatgactactaacctttatcgggcctaaactagagcccgtcacagatgatactcatcttaatcgggcctaaactataacccgtcatagatgactgatgacctcaatcgggcctaaactagagcccgtcacagatgactgctgacctcaatcgggcctaaactagatcccgtcacagatgactagtgacctcaatcgggcctaagctagagcccgtcacagatgacctcatctcaatcgggcatttagttgtggcccatcacagatgactataatccacaaaaaaaataaattttgttttttggctagcctcaggcctttgctagccatgtccgctgcaaaaatgacagaaacaaacacagatatccaata

SEQ ID NO: 86695 - DNA, 6596 bp, Oryza sativa
cagtcggccacgcgcgggcagcctcaaagccgacgcgcggcgacacgacgcacgacaaagtcggctgctagagagcgtgcgcaaaggggaggagaaggccaactaaaccacggtttttgagtgggatgtggtcccctaggagcaaatctaaactttgtgcaagattggaagggatcgggctgctctagttgggctaggcattctaccgaacaccttttgtgcaatgaacagtgaatttcataatttttgaatattttgctagaaaagatttgaattcaaactaggagtttgggagggtttcactagggtttagagtatagcaaaactccactaataatagagtaagctaaagaaataatctatggtttgaatttgagagaatttgctcaaattcactagggtttagaataaagggaataattagggtaaattagtaggactctaatacttgaacaagttttaaatcaaatagatttttaaaccaaacaaatttaatcaaaagctagcatgatgcagtcaaatttttagttttaaaatttgaggatgttacagctatccatttgatttagcgagtcaaagtcgttgctcgcttcaacagcctctctatctaccctctccattacaattctatgacaaatgggacccatatgttatatctattaaccttcttcctccatttcctccctattttccccgctcatactactgcctcctcccccacaccctctcctttgatgcggcgacggcgggcgtgcgaggcgacgggctgcagcgagcggcggggcgatggactacaacaagcggcgaggcgggcggaggtggggcgacgggtggaggtgaggcggcagggcgatgggcggcatctcaatgggcggcgtgacgacggctacgacgagcggaggccggcaggctgcagcgagcggcggggtaggcggtggccgactgttgacaggaaacacgaggcctgggagatctgcttaactccagtgcacgttcaaaactcgccttcggatgtatgagcgtgccagttgatttgatcctgcaatcaacaagaaacaaagacaaagaaaccgtgatcaaatccataaatgatagccgatcagctaaataccgatgacacatcatttatctttgagccgatgtcatatgtaaatcgatcggcaagtgttaagtaaacaaatcaaaactaaatctattcgatcggctgtagatatcaataatatataatccttatatcgatatatacttgagtcaagtgattgggatagatcggtcaccttgccgagacagtataaatcacttagatcgaaatacatattaataatgagattatatatatattcatagcatagccgatcaagtagatctagcatgtatcggctaatactccgataccgcttcgtgttaagatattaaagcaaatagaatataccaaacataagcctaatatacttaaatgcaataagatcttaatataaagggcagatctaacatgtcaatcgatcatataggataaaagcagttagatcagataagatcggctgtaactccgatactaccctaatcggcaactagtaggcaggctagagattgaaattctaagcacgacttaatagatcaaactcaactgatacagcattaagtatgaaaagaagaacaatatctagacaatcaagccgctggatgtttcataaagtggtggatatctcatataatctaagccaacgtcgttatttaacctaatcggctgccttctagtaacagatgttagccgattgtaggttagatgacgatattgtcaagaattatgcaagatatatgataacttgacagattacataaacaagattagagtatcataaggatggaagcactaatcttgagaacacaaaccgccataacaagttttacctcttgttgaagatcgaaaccgatgcagctcaacccgaaagcaagaactcgtcgaaataaagcaaaaagggtggcgatgcgccgaaattgtattgaacatgtgtgtccttttttttacatagggctcggggtctatttatacccgagaattataagatatgtccatattggacacgactcttatccctaacaaactctaagataccataagtctttgcggcagacttttgcccacatttatctctaaggaatttacataaatatcctaattaatagatacaactgcctttccaggactctatccatgcatggcaatcatcttgaagcacatcaattcaaacccgatgtcgtacacaagtcatattatcggaatcggctgtatcacttaactcaacccgactcaaacctagccgatcccaatcgtagccgatccggactccagccgattcttactctgtttccgcaacaacccttatcttcgattccacttcgaccccatcttcatctccgatgctgatattaccaaatttggtcgttaacaccaacggctacagcgggctacggcgagcggcggggcgggcgccgtcttcacctcctgtagcaatgctcctccccatgtctcatcgcctagttgccatgctcgagctcgccgcctctcgtagcagtgtgccggcgtcgagattgggtgggaaagagacagatgcaagagagagagggggtggaggagattggtagtgtggggcccaccattggccagccaaatagactggccaaatttagctagcaaggaggaggatttggccagctaaatagcttgaccagtgagttggagaggctgttggaatatggtttttttagaataggtaaaatttaacttgaagagtcaattggagaggcagatggatatgctcttaatatactactactaaataggagcgagatgtagcggccatattgttttgctgccattgaccgtcaagttgaatgggtttacttttccctgcgacggttaattctcttctagtaacaaagaacaagttgatcgggttttcttttcgttgggatggtcagtggcagcaaaacaatttggcatatcttgggttggtgtacctggcctgatccatttggtctttggcttcaataaactaataggagcatttggcctagtgcttgcatacgacgcgtacatgccaacataaatcttctgaaatatttcaattaactagtcctaggtgcatgatggtggtccctggtcggtggtcaagctttagcttcatattgttgttttgatattgaaaaggaaagggactgtctactcctcatttgacagaaaactcctcctagtatcttgcaaatttcagaccattggattgatttaagatttgtgcgaagtccacaaaaccctaaccagtttttcttttttctctctgccgccgcacaacggcacaagtcactcgagcctcgagagctcccctcctctcagcaccgtacacctcctgcaccgccgccgtcgtcccacctggcctcgccggctggtcaaaaggtgttaacggcgctgacaagccccccaggctaaccccctccctctccctttccccctccctctcctctccagtggcggcgagctgtcccgtgccgccgtcttccccgttgccggtggtggggcgccaccaccggccgcctccacctaacactctttccgcttgcccccgccacttacaccggccccccgcccgctcccgaccccgcggtttcagcggcggcgagctgtgccgccgtcctccccgttgccggcggcggggcgccaccaccggccgcctcctcctaccactctttccgcttgcccccaccacttacaccggcccaccgcccgctcccgaccccacggtttcggcggcggcgccgccgcccaccgccggtctgccgcctcccacggccatccctctaaagcctgtgaactcccccctcttcctcccacccccaccccgggaccctaattcgtcgaccctctgccggattttgggttgtcgccggcgccgtaaaagaagaggtcgccggagttggagaagatgcaactggagcacgaatcgcgaagcatatccagtggtccaaaatatgcaagatttggggtcgtattttctatcgacagaagtatagccgattccgtttttacaagagtggagcacttattatggtcagcttgagtagcgagacataagcgagagagaaacagacatggattttctacacctaggtataatcacacctattatttgcatgtcgtctaaacatttataggaaaaaaaaaatatctggttagattgagtgtcgtgtaataatcgtacccacttgctgcttgatttgccccagaaccttcatatccttgatccttcccattaaagtgcagtgaagtacactgatagtgggcgtaagggcctatagcctaatggttataagagtctcaatagtaatttaggccctagattcgacttctcatggaaacgaatttttcagaaattaacgactttgtgctttcagtagtaggcgacgtacccatcgatagcgaaccactccaggatggatgtgtaattctcaaaaagtagactgatagtggaacggaaggaatttgtgggtgcgacgccgaaggccggagtccctccctccctcctatggccggcctgaccatgctggcgttccatgcatgatgacatggccctccccaacatctcccgccttctcattgaggatgacatccaaaatccacaccctgtaaccattcgacgatgaaccgcctagtgaagtcaggcattgtcaaacaccaccagagacatgggcaattctctaaaaatctatcgattgtgaaacttaaaatcttgaaataaacttaaaaagtgtacaagttggatgaatttcacgagacaagagctttagagatcgattatatattgtgtaaattaaagcaagagttgaggagctgcgtcttgatgctgtcgtcttcctggaacctgcctgcctgcctttcatgatccatccatccatccatgtctcatgtgattggtgtctccctcgtcccctccacgcaacacacagacacccatcatcgcctccactctcttcccctccatccaaagtacctggagagagtggaggcatcgggaggccatggctgccgcgccgaagccggaggaactcgtcgtcgccatcgagcagccattctccccgtcgctcttcctggacctgcccccgacgccgcaccacgatgacgaccccaacaatgtcaatgacgacctcctcctccccttcatctcacgcatcctcatggaggacgacatcgacgacaagttcttctaccagttccccgaccaccccgccctcctccaagcccagcagtcttacgcccaaatcctccatgcccctgccacatcttcttcctccgacgacaccaccatcaacaacaatacgaccaactccacctccgtccccgacacgctcgccatgcccgaccacgacgccgacacccagagcgcgccggacgacatggagatgctctacatggcgttcctcaagggcagggaggaggccaccaagttcctgcccacaaacaacaccctcttctctggcttcaaggcagagccggtgctggatattcaacccaccttcacgttcggaccaagcggcggcggcaggggccggaagaacaggcacgccgaggaggacgacctggagacggagaccagcaggagcagcaagctgatggcgccagaacatgacgacgccgccgccgccgacgagatattcgacgaaataattctcaatgggtaccagatgatcattaaggggatagatgagctgcgcgtcgccatgggcagccagagccaggccgacaagaacggccgaagagcgtcacgcgcgaagacggcggtggtcgacctacacaccctgctcatccactgcgcgcaggctgtggcgacgggagactggcggagcgccaccgagctgctgaagcagatcaagcagaactcgtcggcgagaggggacgcgacgcagaggatggcgtgctgcttcgctgaggggctagaggcgcgtctcgccggaacggggagccagatgtaccagtcgctcgtcgcgaagcgcacgtcgacggtggacttcctcaaggcgtacaagctgttcacggcggcctgctgcatcaagaaagtgagcgtcatcttctcgaacaagaccatctacaacgccgtcgccgggaggcgcaagctgcacatcgtcgactacggcctcagctacggattccagtggccagctttgttctttttgctgggagccagggaaggcggaccgccggaggtgaggatgaccggcatcgacgtcccgcagcctgggttccggccagccgaccagatcgaggagacaggccgccggctgagcatctgcgcgcgccagttcggcgtgccattcaagttccgcgccattgccgcaaagtgggagacggtccgccgcgaggacctccatctcgacccagaagaagaagaagaggaggtgctcgtcgtgaactgcctccatggattgaacaccctgcaagacgagagcgtggtcgtggacagcccgagccccagagacgtggtgctcgacaacatccgcgacatgaggcctcacgtgttcgtccagtgcgtcgtcaacggcgcgta

SEQ ID NO: 86696 - DNA, 830 bp, Oryza sativa
tatatatctatatacatatgcatactgcatcacatatatatgtatagatacatatatatatatgtatgcatatatatgtattgaaacatatatatgcatggtttatatatatatatatatatatatatatatatatatatatatatatatataaaccatgcagcaacaggggcatgaaaaaaaaaaaggtcagctctatctttagtcccggttggtgttaccaaccgggactaaagatagagctgacctttttttttttcatgcccctgttgctgcatggtttatatatatatatatatatatatatatatatatatatatatatatatataaaccatgcatatatatgtttcaatacatatatatgcatacatatatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgttagctcagaagctaaggaccggtgaattgtgtttccgtcgtagtagaattcacccttgggatcaaggatttcttcgttgatgaatcccatgagttgttcttgaaccgctgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtct

SEQ ID NO: 86697 - DNA, 1444 bp, Oryza sativa
ggggggcatgaaatttgcaagggggcccccttgccgccctccgcgagggcgattttgcactgtgcgggggccgcctgcaaatggcgggcgagggggcatggaatttgcaggcggcccccttgccgccctgggggagggcgattttgtactgtgctctatattttttttatataaatatcaatagttatcaaatctttttatattgaaaactatacaagattaaaatctccaagattggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttctattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtataggtatttaacagtattaataaaaagtaaagtaccgtgtgggcgagggatcgacgctccgtgagagaaagagctggcgaacgcgcccgaagaggtggcgaacgcccctgcggagctcgtggaagcgccggtcgtgcctgcgaacgcgctcgaaggcatacgaggtcctgcgatgaggaaacgtgcagttaaaacatggtgacataatcgtgcaaaagctgaaacaaaa

SEQ ID NO: 86698 - DNA, 3817 bp, Oryza sativa
acgtttaaccactcgtcttattcaattttttttgaaattattattattttgtttgagacttactttattatctacagtactttgagcacaacttttcgttttttatatttggaaaaaaaatttgaataagacgagtggtcaaacattgcaagcaaaaactcaaaatcccttatattatgggacggagggagtaattagcaagctagtgcattttcacttggtcaggtcttggtctatggtctaaatttccgggcggaaatgaagtgacagagagtcaagttaagaccgaattgaagacttgatcggcaaagtgtccctcgtttttgcatgtcgtaaaaaaagatctgaagaaaatttgacggatcaacacaagggcttcggtgatcggtggtgtgcttgggtcgctatgcttttttgaactgcaacaacaagagtgttaatcaatggcaatcccgggaatgagattcatcaccgctgaggagtccgccaaggcgacccaatctcaccaatgatattcatcctcgtgatggattttctcagccttctgtttcaaaaggcggaacacgaggggctattgcaggatttgggaatccctcacataatctctctttatgctgatgatgtggtcgttttcatcaaaccgacgattgaggaggttaaggtcgcaactgaaatcctaagcatcttcggtgaggcctctgggctccggacaaattttggcaaatgttcagccctgccgattcagtgctctgaggagttgcttgctgagatacagccagaattgccctgccctattgcttccttcccctgcaaatacttagtctgcccctttccatcttccggttgaagaaggaagacctgcagccattcattgacagcatagcccagcggcttccagcttggaaatccaaccaaatgtcgtcgataggtcgtgtaacaatggtgcaggctgtactcagtgcaatcccaatctacctgctgatttctgtcgacgcacccaagtgggtgatcaaaggaattgacaaaatccagcgcgggtttctctgggcaggcaaagtgcaagccaatggaggttgctgtcggatcgcttggtcgagggtgtgtgctcctaagaactatggcggtttaggcttgccgaatctggagttgatgggtattgcacttcgctccagatggacttggctacagcggacttcactaggtaaaccatggaaaggcctagacatcccggggtcgcaaaaagagaagagcttcgtggctgcatccacagtctgtcagctgggagatggacaaacgatcctcttctgggaggatagctggctgcaagagggctgcatccggtccattgctcctaacatctacgatcgcgtttcgccttgcatgcgccggcaccggacggtggctgaggcactaacggatcgtagatggatcaaggatatcgccggggcacttgggatccaagccatcctagagtatttgaagctttggtcgctacttcatttggcgacctgtatccctaccactcctgattctttcagctggaaatgggaaagctcgggtcagtacatctcaagatcttcttacaaggctctgttctttggtcggatctccttcctctcgaccccgatttggaaatcacttgctccacctcgatgccgctttttcctgtggttggtagcaataaacagatgttggaccgccgatcgtctgcgaagccaggggttgcctcacctggaccgctgtgtcctttgtgaccaaaaggaggagagcattgaccacattctggtaggctgcccagagtcgaggcaactttggtggtggacattaagagcgttaggcattccagattgtctacccatcaacgaaccatcctttcacctctggctttgtggaagccggatgaaattgagagagcaacatcgctggggctttgacaccattacaacgctgatggcttggtcgatttggaaggagcaaaataatcggatcttcaatcagcagtccaagtcttggatcgaagtggcgaaagcaatggtggaagaagccgtactttggaagtcgacaaatgcaggggtcccttccattttacctctgtgaggtcgtggtagccaaatctagcgccagatatcatgttagatcactagtctccagtatcggtcccgtgcttgtttttcatttctcactgtaaataacttttatttctcttaagggaaaaaatgcgctccttgtgtattccccaaaaaaaattttgatggatcaacgagtccttgttttgctgtagcgcgtcgtctgcatgtctggcctacagtacacgaggaaaatccacctcgatttgatgagcatatactcccttcggttttgtattattaacgttttaaataaggttaaggttaactttttataattttgattaccaataactttaaaatatataatttaaagacactatcacgccatatgtaaatttattttacaaatcagcataataaaaataaaatcatatttattatatatattatattacaaaatctagttaaagatatattttagagacagtgttattattgtttaattatcgaatcggagagaatacttactatagtcactgtagctcgtctgcatgtctggcctacacgaggcatataccccagggcccaagagaagaccgtgacgaggcatgcaccgcacgtgacgtcattcccgaccatcgccgtcgtgtgttctaggcttctagcacacgtctaaacgagattacaggacactagccacgtgtttttatcacttaacacacctgtgtgtatgtactgtgtcctgagattaaatactggaaaatgtgatcgagcaaccgtgtcacttttcaacaagaaatttataatttgattgttggtcaaacaaactgccagtatttagtgccgattcttagtacagctagcatcctagtagtagttatactgcagtcggtatattttttgaactcaaggaaaatgaattcagtatcacaggagagaaagcagtctactgcactctgcagtgtcaaccttcagcatctaaatcagttcagaagttaaaaaaaaaaggaaatccataatgcaaataaccattccatgcaccaacctactgaaagcctgaaccacatgtcatttaacctagtacataacacaatttgatatgtagctgtaataaggaggaatccgagatttccacaccaaaacctcgaatttccctcggcgcctgacgcgtccagacagcaaatcaaccagcttaatctttggaccatcatcttcaacaagagccttctggtagctatcacgcagtacaaagtaattttcaggtttaggtctcacaattacccaaccgaacttaggatgatcctggcaatcacaaggcataagggagttaatttcgtctctgtactctctgacgaacgcaacaaacctgctccagaatttggagttgaaattggctttcagtagagctcctccgatgtgtgcacacaagaagcagcctcttagcactgtcgcgatctccatcgccatggatgcaagctttggatgctgctctgggtctgtggctccaaatgcaagaaccttgaagaagtaccagtaggcttcgaatggcaggaaattcagcctcagagcttgtttggctcccaacctgatgatcttctctgatcggcttgtgatcatgattttgatctcatgtgtcatttgctttctgaaagaagagtggattttcttgagtgttctttcatcaacatctcctaagagctcaatgataagcagcaatcttccatccatggcatcgtttgattcatttc

SEQ ID NO: 86699 - DNA, 2742 bp, Oryza sativa
ttcctgcagccctcccacttgagaggccatctagctcaaccttacctctaacaaaagattggaaggatatggatgtgttgtgtagcataagaaattgttcacgagcaacatgagtgcgaaatctactctgaacagctctagctgctctattctgcacttcagttcttctagcatccaattcagccatctgaccggctctcagaaacaccttagttcttccaatctgtcaaagacagcaattatttgcaatatttttgagaagtttcacgattaaacagtctatatatttgcatgaagctcatcaaagaaaataatcataaaaagcaagttgtggagtaaaactatttagtgtatcttgttaattccaccgtgacttttgttttccagggagaatatctagtgaaagtaaaagaaatcaacttttttgaacagttgaaaacttcagttgcatcaccaaatcaacaagaaaaatcctcaagaacttactttctaccttacaagctgtaactattcaagaacatttcttttagataatggttcagtaacacatacatatctttttacttggtagccttatgggatgagaaaaagaggaaaatggttgtacaatacatataaagtaggatttattctgttaaagaatgactcacctgataaccctggagtcccattttgtccaaaatcttttggcagattactttttcatcatttctgtcaaatatcataacagtaaatgcaggacagaggtagcagaattagaaggtataggtaaacattatactcacctttctttgaaaaaatcaggagcaataatgcgaaaccgttgaagaaaatcacgaaataattttcttgtagggtatccagcacaactgatgcgaatagcttcaagaacaccctgaaaggatgacccgttaggttatataatagtactggctttctctggagactatctgatgaatgatgtattccttaccgaacatcgaagttgatgtaaaacattggcgttctcaaaagtagcaggcttaagaagattattgggcttaatacatctaatataatgaggttctgtagaacttaaagtctccatcaggtcatggagttgcccctgataatttgcatgaaatgctcagatattgtcactgtacagaagaatttacatgaaaaaaaaataatcttaattgcttcacatgccccctatcaagtaaatgcaatcttttcttcttgaacttgatggcactactgctctacgttgtgaaaggtatgaatgtttagaaaccattgtatctacgcactccaaataaaagtataaataaaagcaaccatcattcaggttcatatttcaagtacatacgactacacataggcacatgtcaccctgttatatatgaagatatttctagagtaaagtaaaatataagtgcaaccatgcagacctttgcagttctagaatcagatcaatataaataagtcaaggataaaatttgatcatgagatatatgaaatgttgaattatccaccaaattttcaacattaatcccataatttgagaagaaacaaacagaaaagggagaagattatgttactgctagtgttcgatcttttctacgcttctgtccagtgtatcatgtcagaatttttcagttttgaacactgaatgtaatttgattctggtgttcaaatattatatttcaatcggaactttccgcgtagatccttttttattacgtaggcaggctacactgagagaattaatggctaaattctatttttatgctcaaggccaagttagtttgcatatagtacccagctaataattttcactatgtatgtccttattaaatacagtctgcataatagtgaggcttttacctgaatttagagtctagagaacaaaattgaactagcaggatcataccttaaaacgattagcaattgaggactttgaagattttgagttctcctcttgtactgatgggaataaccctgacacaaaggagcacgtggaagcattaacaactctggatgttctacgactacataatctctgtttttgtccaggaaatgatcagactgatatgttacctgcaatgatatcaagggattaaaaggaatatgcttaatcaaatgcatataagcaaagaatgctatgttgtgacagaatgctcacttctcctgcataatgttggattgtaaatgcagtacgagaaagctttggtttgctaaaccttttgtggttcttgaacttctcgtacagcttctgagaaaatgactcatgtgtacatttaggaaacatactggtgcacacaggatagagaaaagaatgaaagaatgatgaatcattgtcagaactactaattcagaaatagatatagcaatgttgattataacaaagaagcaattattttcacgagctgcctgttgcatgcagtccatcgaagaagggtttaaacactaaccaagcttcatcaagaagtgcaacaatcccaccaggtttctgaaaataaaaggagatatgaacaatattgaacttaaacagagaaaagacaactatatctagtatgcacaaatatgttggtgttatgggcacgggcaaggcccatgcagcagtttaggcatgataaattaggaataagtcatataaaggtaggagattatctagttaggaaagagatgaggtttattagaaagttttgagataaagattggattggtttctataatactatagattagttccttaga

SEQ ID NO: 86700 - DNA, 3518 bp, Oryza sativa
taagaagcatgattaatctaaagcgagaaagggacgtgaaaagttcaaatagccgaacataattattcaagcttttatagaactacaaaattgttgattaatatcgatataggtacgccgtacactacccaaacttggtgcagctgtgataaacatcatttagatacactgaattctaacttgtgtgttagctgcctacctactcacccacactttctttactagtatttttccttttctgtcccaactcaccagcaccagctaaatctttaggcaatgggtatgcagactagagcagaaggttagtatgttaggctattggaacattcaacaacacacacttcagaactcagtattatggaccaagcagttaataaaggagaaaacatgcacgcgctccataagatgcatatccatcttaccagtagccagatacaagtagcttccccccgacaagtttgggaggtttaccccaaataagagctttagggttcttcttgaagatatgtttttgtttgttggctcctctgaacacaagatagctgtgggcccaatggaataaaccattgttaaagagattagaatgcaataaacaggccatatattatataatcgaaagcaggttctggtaacataggaagagtacccaataacgaaaatgaagcagttaactacagcagccaaaagggacagctccactttgtttctcaaaagccaccatccctggtcatcaccgttaaaaaaataatatcttgaatgtcaaccacctgacttactaacaaaagaggcatccatacttttagttgacttgaaaacgtgataaagcttggaattaattgaatatatagccatatgatgcatgaatggtaattctgactgaaacagtgacatgggtcaaacttagcaattgcagaactaaaaatatatggatacacacctgaatggtgaaggtaaatggaatgaacactagatcaccaaagaccagcatgaaacccagcctttccgcaataatgtcccatctggaaataataaaaaaaaataagctgtacagaaaaacaatgaggtatgaactccgtccttgctgatcgtcacatgcatttcagatgatcattcaggcacactggattgatattaacatatctttatattataggacaaaatgatatacttacgttgaagtcatgaattcttcatgaacgaagtaatctacaatataccactgcatgaagaaacataactagtatcatgaactatggagtatatgatgatcaaaagaagaaatgtccatgtccaataccgcacaaaagaattggtagagaatgactgaaagattggctgaaccagctaggtagctctttgcaaacaaagataggttgataaataaccatgccatcatcccagctctcacaaaaaagaacctgcaaacatggtgaatatttttttgaaaaaaaatcatcataacacgatcccactggagaaattaactcttttcccgaaaagagtgagtcctccaattattttatcatttgaaagacaaataataggaacaacttgagaaaagggaaaatagctggttatggatatctactttatacatcacactgacaaggattcatagtaactcaccacaaattcgccctaacaaaactcaccacagattagttacgtgactttagtagatgatgaattaaaaaagaaaagaaaatgttatgcagcgcatctaaattcatgtacaattataatttgcttttgtccacccagaaataaaaagcctacatgtcttactattctaaatcaggtgggacgaaacaaatagctgtgacagggtaaactcaagtttcagcagaccctaacattcctgaagagcttatgcgctcaacaacactacttcctcttttagaactagtcaactgcacaataaacaagtgttccatttgaaccacattggcattgtgcatagactgtatgcatcaaataattcgatgagaacattacaaaactaatcaatctgttggggcataaaaatcaataggaaatggaataaatacttgcaccagaagcaacaagccaatagcacaattctcacaataatcatgctgctatttaaatatttgaacgacatatccaaaatggagcaagaaaacaaagacgttgctgacatacttgaggtcaactcccatgaaatgaggattgagctgcactcccaaccacctagtagacaaagtgatcaatgtaaaaattatcagtattaacttatatgattaatacagaggatagtttcctgaacttttgaagatgactaattgaaatgagatacataagcttctaattggtaaattttagaagttgaaatggcaagaactgatgaaatatctcgagtgcaaaagggatgctagacgttaattttcactcattatggtttttatacaaatatagagtttcttagaagtaccaatcttgtatgaagttcccagtgatatgcggtttcaaggaagaacttttatgatgggaccttaatcctgaataatacagtaagaaggtaacctgaaatacaaaagcacgaaatgagtcgatgaaaagaacttaaatgttttttgaccatatgttagtgaacactaaacgccaacagtttaatggtgctgacaaaatttggttgacagcaaaactagtaggaagatttcactatgtgtatcatctttttttgttatttcttacaaattctagacatatccagtgtgactaattcctttgctaaattttagctgtaccaaatgatagaggtagtaactggggctaaaacatcaaacatgtcgatggccgtttatttcttctgaattagttatgttcagttggtacttaaacttagattattcagatttgcacctaattttaagtctgtaacttcattaacaaacagtacatatgaaaggagggaggtcagatgagtgatgccacctacaataacactaaaaatgaaggttgtagacaacagctcgattccacggtcagcaatgacctgcaatcataagcaaacgagatgttgatcaattcaaggaagggagcaactgaaagcttggtacatgaggcagagggagggagggagtaagcaagctcaccctaagggacatccataccatgtagacaccgagcgcggagagcaccatcaagaggaggatcgagagcaaacctgctcgggtcacgcacgcacgcatgaggtggctaaaaagcactgcatcaaaaaagcgtagagtatcagggctagtgctgcggcggcggatccgttagcagatgtatgtggaggcgggacgagtccggtaggacagttccagagacgagcttgccggggaggacagcgccggcggcggcgaggtagcctaggtaggagaagagcaccaacacctgcagagaatggagccaaaaaaaattccaatccaggagcttccgatggatgtatggatgcaggacgaggaaggaggacgcaccgcgctccacgagggcaccagcgaggcggcgactgc

SEQ ID NO: 86701 - DNA, 6860 bp, Oryza sativa
cagcgcccgcccggccagcggcgcgcgcatcaacctcgcctccttctacctggtcggcatgccggtcggcgtggcgctggcattcggcgcccgcctaggttcgccgggctgtggctgggcctccttgccgcgcaggctgcctgcgcggtgtggatggcgcgcgccgtggccgccaccgactgggacgtcgaggtggcgcgtgccaaggagctgaccaaggcgtccactacaggcagcggcaccaaccaccagcacgagtgcaacaacagcaacaccaacaccgccaacgcaaaggctaacaccaaaacgacaacgtctcccgccgccaataacatcaatgccggtggcggcggcagcagcgacaaccgcggttacgtgcccatcagcgagagcggccacaacgacggcagcgacgacctggagaagctggaggaagggctcatggtggccacgagtggcggctgctgcggctgcggcgacgcgttaggcgtcgacacgaaggctggggacaagcagcagtgcagcaacggtggtgccggtacggcggagggaaatgcggggcagaggaggggctcggcgtcgtcggagagggccccgctgatcagtgtgggggacgacgaggaggccggggaggagaacgacggcgacggcggtggaggtggccacgtctagctagctgctaatcaaccagcgtggtcgatccatccatcgattaattctggagaggttttgatcgtacgtacgtaggctatgtttgacactgatcggccggtctccatttcatctttctctccatcttgatttgggggtgaggtttagttttgtctgtataaccaagctgagcagctaattaatgagagtattcaggaaaaaaaaagagggagaaaaaaacatatatattcttcccttatttttcttaattaattatacttctatgtacaaatactaattagtttgggtgtaaattataattaaatcaattgatggtgattaattaagaattgacaagtgcatgcatgttgctgtttggcatgatgtggcagtactgtttgttgtgttgagagtgggggtgtgtgtggctttgggacctgtatatatcgctgttcccctagtggttacatacgtgacaaccaatggtggtgccccatttcggccatttcccaactgttccaacatcgctaagagaaaaaactcgcattggccctcctttaagttttctccgagatggctagcacagctacctagctagctacctttcttccttttgataaagtcgcaaccatttgatatctacaagcacttgggcgaaaaaaaggcacccttggtgttttgcgatttttaaatattactactgcatatgcacctttttatttatttctggctcctcgtgcaaaggaaagatggtgcgtgtgactcagtttctcatgtcttctatattgagataaaccttttgatcaaaaggctcttgccacaaatattaatttgccattgctcaccacacaagaagtgctctctcgagggtaaaaggatcacactagctagcatgaatttatactttctgtgcagatgtagaaatgtggaatataacccttatgtgggaagaaaggatctatatcataaccaaaatttgatgatgcttgccttagtgtccgtagcttataagatgagagagagagagagagagagagagagagagagagaaacctagagtgctagaaattcttgaacttaaacaaatcgtatggcaagctcttaatttggtgagccccggattgcgactagcatgcaactgttggggacatctaaatgtgttccagccctgctctatcataaaacaattattgttaaggtgtttattcctcggcccgctctttctatgagtggttcaaaaacatacttttgttcacaaatagatgtcatttgaggaatatttttccctagatatataggccctcttataagttgtcgagactcgagacttgtaatagaactagtgggcgtgtggggctattaattgcagttaacaatattagtttgaaagtggtaaatttgtcaaaataatatgatttgattgacgaccgcttcatatgcccgaaactaatatgacgttcaagaagaacggtgcgaatattagatcgcatttttcttaagactataagcgtacgtggtccaacatatcttttatcctttagtgttttcttatctatatttaactagttgatacccacactttgctatgagatatgtggataaatgcatgttatacattatagaaataatagatatatatatttaaagaatgtaaaaaataatgtgaagataatgatttgacattatttgcatattgagttataaaaatatagcaaaatcgtgaatgatatgtcatgtttgcatcatatttaaaactctagataataattgctagtggtgataatgtgatacacttgcatgttgagttttagaagttagtggacatatatatgtctaggttcgtatataaaagttgatttttttttcaataacaaagggaatggccacataggagcgttaaggaaactattcactaattttgtactcatatactagtataagacccttgctggactaaaaatcacacatagcagtaaagtttgccgtccaaggatacctgcaaaagcaccatttgcacattcatctccctcatttgcacctgctgaccagaattccctttttcaaaaaaagaaaagaaaacaaaagtcccctgatgagactcctgcctacagtttttatccgagaagacttggggtgtttagatacaggggtggtttagcgtgtcacgtcggatattatatatgtgtcgcatggggtgttcgggtaataaaaaaactaattatataatccattaataaattgcgagatgaatttattaagcctaattaatctatcattagtaaatatttaatgtagcaccacattgcgaaatcatggagcaattagatttaaaagatttgtctcgtaaattagttgtaatatgtgtaattagttatctttttagcttatatttaatactttatacaggtgttcagacgttcgatgtgacatggtgtaaactttttaggagggatctaaataggccttaaaacaaaaaaaaaaacaattggaatactaccgtgtttgagagtaccatggatttcagtagcagcagcagtcaatccacggacaggccaggaggcaggcaggagtgcagggcagagaagcagagtctgcagagagaaaatagattactcctacttgacaaggcgttgccaaaagacgaatcagaggctgcccaatcgccacgccgatcagatcagttgcgacgagacgcttcgggcacggcatggagagacagccgatcacaagcgcgaccaccatgcatgtcaattttgtcatgcatatgcttgcgccgatccattagaccatttacagtccgttctcctcattcgaggtgcatcagagtatcacgtagactaaggttatgggtctaaaatcttaattcttcacagtgcaaatggctttagttctaatatttttgtttcagttctaatatttttcataatttgtgtggatgtccaaaatttacactgaacaccctagaatctagaaaaaaaaataaacccctcctcacccctctctctcctcctctctccctactatggcagtttggcatcctccttcggctaccccgccgccggtgcccctctccccctcccctcctctctccaccgacgtcgacgccggtccgagcgtggttggcaaggggcaagcagccggcgagctccaagctacgtggtcggcgagctccgaccgacagagcgggctccgggtggcgtgctcggcgaggggcaagcggccggtgaccctgtctcctcccatagccggcgcccctctccccctcccctcctctctccgctgacgtcgacgccggtccgggcatggtcggcgagggacaggtggctggcgagctccaactgacacgacaagctttgggtggtgtggtcggcgaggggcaggcggccggcgaccctgtctcttcccacggccggcgctcatcatcttctcccctggtcggcaccctctgagctcggcggcgcggatcgaacgcctcgtcaatggctaagaaatcggcaccggatctagcggctcaccaacggtgtggttgagtggcctcagcggcgagcgggcggcggtaggcaggccctggtagcctcctcttctcccccggtgcttgttctcgcttccgacgccatcttgtgttgctgctctcgttctcctttccgctgctcttgcacgagagaaaggagagcgcgggaggggaaaaggagcgcggccgcttgtcgaagccacgagcggcgaggccctgacctccacaacacggagctgcgcccctctcccgcgccgcgcgcccttggtcaggccgaagaacgggtgaccagttttggctccgcgttcttcacgggacaacgctggtagatgatgtggcggcaaatattctgttcctcacgctcgggccgaacgacacgtccgcgcattgtgaatggccttatgtcacagagttgcaccagctgattgtgaaaattcggttatttttacaattaaatttagcttgtgtcaccattgaaaaacattttcgattatatgtacaaacaatcgataagaaatcatgctcataaaaaatcatgggtaaatatttaggaccatctgtgaaaattgttttaaaaggatcatctattaaaatagagttattttatagggatctctttagaaatcgtctatagaagtcactattctcacacaaacccctaagggaacatatattttcacaaatggttccttataatggatggctatgaaaattgtttgactacattaaaatatgatgggccgaataagcgggtaagtcctccctcccttcccgcaattccctcctagccttcatgcttatcgtcctcctttctaccatccggaagtggcggatcgacgataactgtggggctcgggagcgcatatcgatggtggcagggccaagaagagtggattcgacatcgatagatctaagtagcagtggatcgatggcagcgagttttggggctgccaaatttagcggcgtcggcctcgggaccactagatatagcggtggtgatcctcaatatggcttcatttcagttacagcaatgatgaccgcaacagggtctaagactcgacaataacatcatgatgatgaccgtagtaaggacgtcgtctcggctgttgctaccacttttgcaaagggattatgaagagggacttgggaaatttgatcatgacctatgtagaactgcgattcgatgtagttttcatatttttttttacaaatatatttgcaagtaaagactactgtctatgaggcaggtaatttatcagaggcgagcgagtcacccaaccgcccacctgtacaaaccaaaattagtcacctgtatacaatggtagactggtagtgctttcgtaatagtgtgctaatcaaacaggaatacgatgaaacttgtgtactagaattgtcagataaagcaccctgatcttcttagatttctttggttatctttcgctttgcatggtagtattatcaaacccaacccactagataggtggcgaactggccaagtttatttatgtcaccactcaccgagcatggcccaaaggcaatatgggtccacaagacaagtcctaacacatatattcatctgcatattgtagagaaaaaaaataaatgtgcactttgcacatcactatatatcttttccttcttttattttttcgtaagtagatagcctaagttgactaaagtgttatttaatagtatcttgccgataggacatatgacttggtgtcttgcagattggactagtgtctaatgcatttataggatcatgtcatggtgtcaacgctttagtgatactatgttcattatttatgttttccgaccatagtgaaaaattaaaggtccacattattctaaaaaaattgctggggaatacgagtcatcaaattaactgtttgctttatatatcatacaggaaggaggaagacaaatgggtgtttgtaacaatatactcactcgggtcacagtctcacagataagtgaatactacgtaattaatttgacgctttcacacaaacacgacattgacacgaccgatctaggcctcctttgaaacacatgaagtaatgtcaatgtcctgtcattaacgcatcaataggtcagatattatggcttattaaaccctacaggaagtgaatcctcatgaatttgtaaaaaaaagtgttattcagtagcactacagaaaaaacatatgaattttgagatacaataagagaaaacatgaaatcttgtctctggctaactttcctctaaaatttatatgaaatgagctattctataggaattccaaaggatttttttgaaggtcatttatttcaatccttcatgattcctccatttttttcctttgttccaaagaagcctttatttcttatattctccttcttacataacctagcaaaattttagtatcataaaaaatatttctgagactaatttacttaaaccattttaacattttctttacaatgaaaatgttacacatagctagacgttggcaacaaggatacgaccacaaagttctgttttaaagaaatagagaaaatacgcaaaatgaggtgagctattagtatatgattaattaagtattaattattttaaacttcagaaatagattaatatgattttctaaaacaaatttcatattttttttaaaaaaaacacatcgtttagtagttcgggaagcgtgcgtgcggaaaacgaa

SEQ ID NO: 86702 - DNA, 1222 bp, Oryza sativa
aaggcctcgatctgttttcagatgtcacaatagattatactgatgcaattttaggaaccacagtgaaggtgagctgttaaatgtggctccgttcatattatgcattacatagcaatgacatatatttatgtaatgctagcaggtagcagcagaactctggctccagctttacctagaaagagtgtttcttatttcaggttgaaacaatagagggattcaaggatctttatattcctcctggcactcagcctggggagcggctgaaatttgctcaactgggagctccagacattaagaatcctaccattagaggagatcataattttgtgataaatgtgaagatcccgaagagtatcaggtttgagttgcgagtattgttgtactttgtgatgggttaatgctagccgtagtattgctttgtagtttttatgcggtaaacatccttggttacagattatactgttacaaggcgcatcaaattatgttatattactcttagcttttggtgctttgccttatcaatgcttatattcatcagcaaccaagaacgaacattagtacaagaaattgcagcactgaaggaaactgggtgtatttctgttccaggtgaaggtacctattttcctttctgaggcattgttccattggtacatgactttcttatgtaatctttggctatttcagagactaaaaacagagaaaatttgggagagagaaactcccattcatccacagggaagagaagatccctctggcgatctatcaggaatttgttcaggtataccaccattcttttgtagcttctcttaccatgagcattaaatgcaactatacgcccatcatattgatatcatcaatataacttctttttgtggggctcattctataaaagttgggtgcgcctttattcatactgtgtaacagtttcatttctaccattctaggggcgacgatggggatacgagatttgcttcaatcagcgcacaatctgttactccattatggactccgcgacgaggatctcatccagctgttctgttgctagaaggattcctgatgatcacagtgctcttattcgtgataagcagaactcgtataatcaggtcgactccaaagcggtatgatcgtcctactgaagctaaagaagccgatggagagacttaaaatttattatggtgatgttatttggacgttattgcacacagattttttctcttctttt

SEQ ID NO: 86703 - DNA, 2768 bp, Oryza sativa
ttgctgccaaattttgataactatatatgccaaaattttggcaacttttgggcatcaaagtgaacaggccctaggatgtgtcgcattcagtccaagttcgctatattttgaaacgaagagtaccttggatcaatttggaaggaaatataagttttctaatgcttgcaatcgtagttaaggacaactacattgcaataataggctagtggcttgtctagattcattagcatccatatgaacatggacaatgctaaaaagtcttataatatgaaatattataaaacggaggtagtattaaattgctgatatgaacatgcaatgcaagcacaactagtcaagatcttggtacgcagttcatagcaaatctgcactgcacactgaaatgaagggtaaattttcttctatgccactggaaatttacccaaacccttatttgccagtcattctcccgatgctgcgtggacctagggcccgaatgagggcgatgatttgcgtgttaatctaaaatacaaataaattttatcatcaaaaggccataaataattgtttttgatcaaatgggaaacatctcaacaaattaacaccttcacagtcaaagatggaatagaatttacctaaatagtcaagacttcttttcctaaagaaatgtcgaaaaacaacaggaaaataacaagtatgaggtataattgagattatgtaaacgattgaaacaagaagcaaatcaaacaaaagaagcatcaacgtccacagggagcaagagggtgcaagaatgaatcaaagagagaggaaaaagaatttcaagctgcagtaaaaggtgagttatgtcaccctttgaactaactcctaaagaaacaagcagcagtaagtggcgatttaaatccctgaataaaaaatgagagaacatgaacatgaagttcaaaatgatgatataactgtagtcagtttgagcctttgaggagggatgtgctgtccttattgtattaagtcaaacaagaaactacttgtaatttatgtgacagtagatatagcagtgtccttatataacttcttcaaacaagcaatattcatggatgagttctgttgaaatttgtgttcaaaatcaattgttaagcacacatagaatgacttgcaaccctatataacatttgcccattcttgtcactagatgaacagtgcagcaattaagtgtgcatgcccccatgtgtgtccagctgtccactttcccaggaaatcacgaaatgtatacatggacaattaagaagcccacaagttcacattatcacatatgggcatcaattaagacactgaaatgataactaccttcttttgaaaaaggcaggatcaaataagcgacacagaggtgtgcgcacagtaacaccgttggattataggatagatgaatccgagccactagatcggtaggatgtaaatcaaccatacagctcaacaaatgcttttattacacatctaagagcaggtacaataaactagtttagccggcgataaaactgtcatatcagatttgtccatgagttgcacaagagagagaggacgagtgggcgactaaattgtcgctggctacacacacaacccaacgcaagtgcagcagcaccaggctagctttgattgggacaagcgattgtgggcccacgtgagctgactcgatgcaggatgaaacaacagcaacaagattaaaaaattggatggggaagctagctaaagagggctctttgtttaggctcaggcttattggtctagacttttaagtcagcttattggcttatatgatttataagccagtggatttaatgtcccaagtttagtggtggagtcatacatctatttcatataagccaaaaaaaacttctctaacctagcttttggcttaatagtgttagagtgacttatggcttcaaaaaagccaaatgaaaaagctgcttgtttgttttggcttggacttttcaacttataagttggcttataagcctaaacaaagagggcctaaacaaatagataatagtcgatgtgaacatgcttattgtatacattagctcttagcaatatctctaagaggctgatgtggtcatttttgcagcccttagcgggcggcactattgaccttgttctaatggttcaaaatcatccaatccaacacctagaggtggccaaacgggcggcccggcccggcacggcacgggcacgggtccggcacggcccgtttcggcacggcccgttaggcacggctcatgaaacgggccgtgccgtcccgacccacgtgccgagccgccggcccaagcacggcccgtggatggccgggccgtgcccgtgccggcacggcatgcgtgtggcccgccgtgtcagtacgggcccgtgaatgaaaaatgggccgtggacggggcacggttggcccaggaaccgaaatggcgcggaaggatgcgatgcggacttgcggaggtggctggcgggctgggccatcagctaggaggggtgctcaacggacttgcggaggcggctagcgggctgggccgtcagttgggagggatgagatacggacttgcggaaggatgagatgcggacttactacagtagccgtgccgtgccgtgccggcccgcgggctcggccggcggcccaagcacggcacggctactcgtgccgtgccggcacggcccgttactgtagcaggccgtgccgggccgtgccggctacaggttccgccgtgcctcaggccgcccgttttggcccggcccgtttggccacctctaccaac

SEQ ID NO: 86704 - DNA, 5414 bp, Oryza sativa
gcggtcgatgcggcgatcgcgggcgatcgggagggtgtagcggcggcagggaaggggggatctccttggcggtttgttcggagatggccgccgacgcgctctccatcatcccgggcgccgtgctgcgcaacctctccgacaagctctacgagaagcggaagaacgccgcgctcgaggtgagggatttcggctcgtcatagggggtctggttttggaacaatcgacgatggatttgagctggaattgtttttgttcgtggtgggctgtttgtgtatagattgaggggatcgtgaagcagctggcgacgtcgggagaacatgacaagatatcagcagtgatcgctctgctcaccaacgatttcaccatgtcgccccaagcgaaccatcggaaggtttgcttacatcgccgtcatcttcatattccctgctattggggatcagatttgttgaagttctgtggcgcttttttgttagcagggcggattgattggtcttgcagcagtcacggttggactcaccagtgaggctgctcaacatttggaggtctgttagctctttactggtcttatatccccgttgatttctctaatttaatcaaattgctattctgtgtatgctgaactcagtgcttgggatttagtattaaattttaagcagtgtttggttgtactgctaactggacaaaaaatagctgtagttttctttcctgatggtaaaacctaccagttttcaacacaccatataatcttgtccatggattaatctaagtctaaattgtttacttttgtatgttatagtatttacttgagacatctatcctgttaagttagggctatgatggactgcgtttcaggtcttcattaatggtgtgttctatcaagtgtcattttggttgcattaaacttttttgctctattcttccagcaaattgtgcctcctgtgcttacctccttcctggaccaagacagtagagttcgctactatgcgtgtgaagcactatacaacatagcaaaggtaaacattttgtcaagtaatggtacatgaattatgcgtttgctttgctgcattaatcttttctttattgtaggtggtaagaggggatttcatcatctacttcaacaaaatttttgatgcattatgcaagctttctgcagactctgatgctaacgtgcagagtgctgctcatcttcttgacaggcttgtcaaggtacgatcgtttgggcaactgatacatcctgtacgtattgcatccttgattagccctgataaacattgtttgtaatttataaaccaggatatagtaactgagagtgaccagttcaggtatgctacatatgtgatgtcctttttcaatctcaatatcatgcacaacttaatctagtatcgatttctgatagttcctgtatcttaattttgctatttagcatagaagaatttataccactcttgagggagcgcatgaatgtgttgaatccttatgtgagacaatttttggtggggtggataacagtgttagacagtgtgcctgatattgacatgcttggtttccttcctgattttcttgatggtaatgcctctcttacttttcaagtatattacttattacgttgacagttcagcaaccttttatttgtcacccctgcaggtttatttaatatgctgagtgattccagccatgagattaggcagcaagcagatgcagcactttctgagtttctgcaggaaattaaaaattcaccagtaagtccatcctcattgaaattgcttgtctatctgtatcagtcactgaacagtgagatgcaatgcaacatatgtatcttgcccgatgaatatccctttaataactttgtcttcatttataccacaaaattacatttttcattttttgggtatgcttccaatgctgatttgcaaccttaaatgaaaagaatgtagattatggtcgtatggctgaaatacttgttcggagagctggttcttctgatgaattcactcggttgacgtctatcacatgggtatttcttttgtcttctatgttttcttttgttaattttgatatcgaaatctaaaatatttagtctactttgatacacctgagtaatattttgtcacattctgcagattaacgagtttgtcaagcttggtggggaacaacttgttccttactatgcagatattttgggagccatcttgccctgtatttctgatcaagaggagaagatcagagtggtaattccctctcttctttggacacagacaattcttgaagatgtagcctgcttgtctgtcggaagtcatttctttaatctttatttactttttgttggctaggttgcgcgtgaaactaatgaggaactttgtgctataaaagctgatccaactgaaggatttgatattggagccattctctcaattgcaaagaggttctctactaaaccacttgcataggaaatttggtttcatgccgatgtatctatattcatggatcaagagttaaaaatatgtgcagtcacttgtaacatggcatttgtgaaataacaccgagcctttttcaatttcaatttcagggaattgaatagtgaacacgaggctacccggattgagtcattgcattggttttccactctcttagttcgatatcgtgctgaggtgctcaactatgatgctttttggggctacacaacatatattttaacaagctgtacctgcataatttgttcacatttaattttttatggactgtgggaggtttttcttcagacccttaggatttagctcaatttaaactctctcctgaaagtcccaaaggaatccccctctaacatggacatgtggtacacacagttcaaattcattattggatggtttatgttaatatttttttcttgtgtaacagttcttggcatacttgaatgacatcttcgatccactcctaaatgcactctctgatccttcagatgcggtgagctctcttacaaagcctttgaaactgcaccttttcattacaactttctgtgagcagctgattaattgctttatttgttatacaaatgatctgtgaccaagtcttgaaataaaatcaatgaaggtttaacttagtgagaacagtgtgtgctaatttattttttgacttggtgcaaatttagtgcatcgtgggcctattctttcttccatggataatataccaaggggttacttcatcccttcaaatgtttttttataagtaaccctcatggccctatatcagccatctgagtgtttggctttccaaaacatatacaattacacagacatgattgcgcttgcagtatagaaaccataatgggatgcttttcagtgttggcgttggcaatgattgaatccattttcgcttgctgttggcaaggatagatttgctgttgtttcccttccaaaaagaaaaacacctgctgttcttgccattggatttgtaatatcctttgttcataaatcttaataaagtctacttctccattgtcacctgggcttgacacaattatatgatagctataaataaccttcacatccccccaaccaccactgccaccaaaaaggaaaaatcatgctaaccctttgcatcatagttcaataaatgactgatgggctgatggctttatagggttattgaccattaatattttgctaattcaataaatttgttgtaccgtatcagagagcttggctattgtcatcacattttttcatgtgcaggttgttctattagtgttggaagttcatgcgcgcatagctgaagagtctcatcactttcatcatcttgtatcctacttaatccacacttttcacaacaatcatgttctactggagaagtatgcacatttccccactcaaaagttgattacatagtatatgtttctttgttattagtcctacttttagggttacacagttcactattacataaattgcttaccaaacaatggtttatgacatacttatacagacgtggcgcattgatagttcgtcgactttgtattcttttgggtgctgaaaaagtttatcgagagttctctactattcttgagaccgaaggtgaccttgaatttgcatccaccatggttcaggtatcccccactgttgcaacactatactactgcctaatttaactgtagacattccgtaactgttaaatttcttgtaggccttgaatttaattttgctcacatcaaccgaacttgctgagctgcgttctcttcttaagaaaacattggttgattcttgtggcaaggacttatttcaatctttatacgcttcttggtgtcactctccgatggctacaataagcttgtgtctacttgcgcaggtaatgaccaacttctaacttttgcagtttgtgtttcttacttgggcactgatctttggatgttcttttccaacatgtgtaggcatacaatcatgcaatttctgttatccagtctttgggagaggaagatataaatgtgaagtttctcgtgcaactagacaaattaatccgtcttttagagactcctgtatttgcttacttacgtttgcaggtagagctccattttccaataatacctcatctttgtttcattcggttgatatgaaactacttcctccgtcccagaatataagaagttttagagttggacacggttattaagaaagtaggtagaagtgagtggtggagggttgtgattggatgagtagtggaggtaggtgggaaaagtgaatggtggagggttgtgattggttggaaagagtgttggagaagttgttatattttgggacaaatcctgagggctaaaagttgttatattttgggacggagggagtagttgttttttggtttgcattttatttaaactttttgatatctcctaatgcttccacattcagtacaaatgctgtaaagcccatatgtatgtgttattcagtttatgtgatgtgtcacactgacactgtgtcagtagtagtttatgaatctttggtgacatgggcactgttcttgttatcttacttgtggtataggcgtatagcagtatggagaattgaatgttctgatgatactattctatgatatggtactccaatgatttgtttaataaaatttgcagcttcttgagcctggaaaacatacctggcttctcaaaacactttatggtctcctgatgctactgcctcaggtatgtttgatatctcattttttgtgaccctacggtcttgctttgatagtttcatgcatattctgtttccaaactgagaagcggaacacttgatacacatagagaaggaaattctcgtgtgttagattgttaggttggatgcaggaatatgcttaagttatgcctaacatggactagttagaactgttttagcttacttaaagtaagcaaagtatctggttgatgtggcaat

SEQ ID NO: 86705 - DNA, 6312 bp, Oryza sativa
aatgctagaatgacttacattgtgaaacggagggagtatgaactatttccttgataatttttacagaggtcagtataggtctataagagtcagatataggacaatacatcatctacataatcgagagcgagtgaaaaaaaaagttatttttagttttcttttttcagaaggctgtgaaccatactttaatttactatgtaagactattaataatcgtactagtatttttttatgtcatcatcatgcatgcacatcatgtcagatactcagatatctcaatgcaaggtaaacatgtaccctccgaatggactagagaagctaaatttgtcgatgttaacatacaagctctgtactgaaaaccactccctgtgtgttgcagatctcaacggccgtggtggagccttacaacagcgtgctctcgacccactccctgatcgagcacaccgacgtcgtcgtcctcctggacaacgaggccatctacgacatctgcaagaggtcgctggacatcgagcggccgacgtacaccaacctgaacaggctcatctcccaggtgatctcgtcgctgaccacgtcgctgcggttcgacggcgccatcaacgtcgacatcaccgagttccagaccaacctggtgccgtacccgaggatccacttcatgctgtcctcctacgcccccatcatctccgtcgagaaggcgttccacgagcagcactccgtcccggagatcaccaactccgtcttcgagcccgccagcgtcatggccaagtgcgaccccaggcacggcaagtacatggcctgctgcctgatgtaccgcggcgacgtcgtccccaaggacgtcaacgccgccgtccactccatcaagaccaggaggactgtgcagttcgtcgactggtacgttaactccatcatctcgctgaattccagagattttagccggagatgatgacgatgatgatgacgaagacggtgatcttgtgtttcaggtgtccgacagggttcaagtgcgggataaactaccagccgccgacggcggtgccgggaggggacctggcgaaggtgaggagggcggtgtgcatgatcagcaacaacacggcggtggcggaggtgttctcgcggatcgaccgcaagttcgacctcatgtacgccaagcgcgcgttcgtgcactggtacgtgggcgaagggatggaggaaggggagttctccgaggccagggaggacctcgccgcgctggagaaggactacgaggaggtcggcgccgaagtcgaggacgacgacgaggaacagggcgagtactgatcgggctagcctgctaggtgaatctagcacggtagataaaccgcaagtttgtaaggtcggtggaagggggtctctcggtttacatggactcttgtgactttgtggtgtgagagtgggttttgttgtacttgcatcacaaaaaataaaagaattcgtcagaaatcaaaatgtgaatcaaaagcaaatcacagtgagtatgtatgtcgataaattattcgcggcacaattatttgtgccccatttggaacatagaaatccacatgaaataatccaaaaagaaaagacaaatgtcatagaagacacaaaaacggtttcacagaaaccaaaatgtgaaagcaaatgaaaaaccgcatatcgataactttctcccaacaaaaattgtcatatcgatcgtttcaaaaaaaaaaaatcatatatcgataatttattcgcggcccaattatttaagccccatttgaaacatagaaatccacatgaagcaattcaattctaggcccacaagacaaattccgtccctggcccaaaagcgggctgctgtttcccgtgggcgccggacgggcagacgacgaaccagtggttttgggcgaaccgaaaaaaataaataaaaaaaagagccgaaaaaagtgaaaggcctgggagcgaagcggcagagaatggcagggaaagccggcggcctcaagggcgtcgccctcatcggcggcgccggcggcaacagcgcggtcgccggcgccctccacttcttccaggacccctccaccggtacgcgtctcctccctgtagctccgtgctgttcgcctgcgcgcacagcagctcgtctcgtaagtgaattgacctcttctcgctgatgtgattttggtggactactcgatctctgcgtggttttttagggtataccgaggtgagggggagggtcaccggcctcgctccgggcctccatggcttccacatccactcctttggcgacaccaccaacggctgcaactctaccggttcgttgccttccgtttcccttgcttggttttgtgacttaggttgtgaaattgatgggggatttggccatttggagcactgctcgataagatcgtgtattgcaattgtgaactcgcatactcctatattatgtataagtagaacttacaacgctaactaccataagagaagataggcatctaatttgagttgactgctgatcaaaacatggataggacgaaaacgtcactgaggtaggaacttcgtttaccaattgagttgtgctgtgaagaattatcaaatgaccgatttatttgttaaaaagtgcactggacaaaacttttttttttgtcgggacggccaaagataggccggccaatttcattaagattgggggaaataaagttttaattacaacgacatgaaggatgtcgcgccggtctcaagcaaactcaagcactggacaaaactgttggttgtatttatgtgtgcactacaaaaagagattgtcacgcctcccgcagagtttttatgagttacaatgccttcggcaagcctatggaaacactactattagcctttgcccaatgaatgatggatcatggaatgggtagtgagtgtactcaggtgaaagttttggggaactgcataagctcaatgtatgctgcaaaaaatgtttccaatacagaatcatctgctcacccttccattctaattgtcctgttcaaatcttgctactgcatttttaagtgaatggttttcatttcttttatttagggtttgtttttcatgaaaatttgacttttttcttcttcacgtgtacggggtctatatttgaaatgttatggagagatggataacatcaaactctatgttactagatttatttgagaattttcataacccaagttgggggtgctccatggagcagctgaagtgttctctcatgccatcttgcaattgttatttttcatttgttctgattaaattacttgtcccagggccccattttaatcctcacaataagtcccatggggcaccatctgatgatgaaagacatgtgggcgacctgggaaacatagtagccaacaaagatggttagcactctgtcaggccgtctacattaagacctttgaggcaactaacgcaaagaaactttgtaaattaattcatgtgtgtctaccaataatacatcacctttttgttccaggtgttgcagatatcttcataaaggacctacaggttccattgtcttgaaatatgtaaaatatcagtttgttcatcttattgtttatgctaatgcattggtaattcatattcattgctttgtgaagatttcactaagcgggcctcattccatattgggaagggcagttgttgttcatgctgattctgatgacctaggaaggggtaagcattatgtcattactcttgcaagattgttattggtcattcagaattgaagagaagtctcccttcctacattatatatgtcctcttattttagaaaatattgaattcactatttagagggtaatttagagcttattacctgccgaatggcgtgctatcatgcatttgaatattcatataactatttaacgtagaagttcccttgttagctatggttgatatgggattattcggtgttccaaagctgcctgagatttggctcttcaaccttgagtgtaactactagtaaaaatcatattcataagacaggtaatccctcccaagcccaactaacctgggatatgctgaattgctgatagctgtcatgaaattattgtggactgtggtactatgttaacatacagtagggtataaatcataatccagtaggcaagggcccaaaacaggtccagataacaggatttgcatgggctgtaccatgctgcagttcaaaatctaactgcccatgggctgtacaatgctacaggtcaaaaatctaattgccagtctctgttcctctgctgcatttatgctaggtttgtggtagcagacaaatgttactgtggtgccttaagaaatacatttctagcaatctagatctaggattctggcactatctatgctgcattgttttgccaattattttcagtgcctccagaggcctttttatacattatttgtgcaagacatgtcctaggagttgggatgataaagctcttgccattaccatcaataactgcgtcatactcaattctgaacaacatctgtttgtgtccaattatttaagtatgaaatattttggtataatatttttctctcctgttcaaactctatgttccatttgttaacaattggctaactttgactagtggtaggttccaaaatacatgctcaagtatccatcagttgagtcaaattacggattgcgagcctaatgttagaataggtttcatgcacaattatgttttgccatttagtatcacatggtgaagcattcactttttatgctgctgctcattgtactactttgatattttgaaggtggtcatgaactcagtaaaacaacaggaaatgcaggagcaagaattggatgcggtaagtgagaatctttttgtagtttctgaaactgagaggaggaaagaaccattcggacatactagtactcaggaacacataggacaaatattgtacaaaataaaaagaaactttttttttctctgcaagaccgatccttccagtggaatgacaagctaatatgtctgctaataacttgtaggtatcattggacttcgatctgcagtttaacaatctatagtcatgaagcttgaggtggtggtggtatgctgttcagagatatggaaatcattggcgctcctcattccagactgtttcaagaatggcttttgacgtgttatcactgccttcagttatctatacgtactttgttacggagtatattctttttttgaacgaacatacggagtatattctataaataaaggaaaagtttcctcatacttatactgtaccttggactgaagctgtgcaaactcacaataatgtgttactatttctcaatcttcagcttacaagcgatgctgctttgaatttggccataagccaatgtcctttatggtactattaaatgaatacatagcagctttttgtgaatatatatgctcgtaatactgttatactacgaccttaaggcactcctgttgcctggcaaccaagcaaacgctgacaaatctggaaacgggtttgtcatggtgtgtgttttatctttgcttcaaacatactgaaacacaatttgtcaacttcaaacctgtgtcagattctactccctattggatcgaagaactggaagtgctcgcctaccctctgtttaaccaaccattccaatttgtcaacttcaaacttgtgtcagattctactccctaccgtattgaaaaaactggaaatgctcaaggatcaaagtatcctgacagcgtatgacgtcgtgagcaccagccggccatgatccgtgagtgaccatcaaaggctgtgacagtcccaagacactccgtccaaacactacaatcttccgtctccaagatgcaaacaagagcaagagttcatgctacattaataggacttgcagtttgcaggttaagtaaatcacgcttagcctccggttgatgctgataccaaggtcagccctgggccctgggggggtaagaatgcctcgacgggaaccggacacaccggaacgcgccaaaagggcgagcgagccgtgcgcgcccgattcggtctcgcggcgcgcgcgaccctggagcttcccccttggctccgggcggtagcctagccgggcgggcggagcagagcggataccggcggccgcgagccgcgacggctgctacggacaccaccgtccaccacaccccgcgcgcgcgcgcgcctccccgcgcgatgccgccacggagaagcggttcgtggactttccggaggcgtccggtctcggcggcctagacataacggcgtcacgcacgcacgtagcgcgtacgtaccctgggtcggtttggggcgagtaaaataaacgagcacgcacgtagtacgtgg

SEQ ID NO: 86706 - DNA, 2985 bp, Oryza sativa
gagcatttctatatcctccttatttgcttccgattcataattgttgcctttctgactatttttgtaatttcccaccaaaccttttcttatggttcatcatgaactttttgtagttaccatgcaccagttccacatagttacacggtccagttcttttagacattgtacaagataaggagaatttataccaaattttcataaataataatgctactgatcatcatacattatttgatctgagctctctctatcctccttgatggttatctaaatttatatcagatatattgagttattgactaactgcaaaaagtatcttctagaagagacatggtctaatgaagttacctctttcataaacttttgtttatttaccatgcaccagttctgcatagttcccatgttgcagttctgctaatcattatctaagataaagagaggctgctacctggacgatttatatataatcgttccacagatcattacacactgtttgagcatctctctattcctcctttaattgttttctgaatttcatactataaggcatattgaaaactgaaaagtttatcttctactagaagagacatggcataaagcataattgatgttacctctttctcttctgtgaccggtgaatccaggccatgacaggagggaggatcccaaaaaggaagcagtttgcataaaccccagcaaaatccagtgccttggagaaggccgctgagaagaacgacgcaataacgataggaataatcagcacaatccatgtgagaatagccccatttcttccatggccaccgctagattcagagagctgcccaattcctcgcttcggagaaaacctctgcccaatcaactccactgtatcagccagctgcttcggaaagctcaccgcgtatcctatcaagctcgtcgccaatgcggcaaacgcaaagcctcgaacggcaggcaatgctgctggattcaccgagagcagcagcttaattggatcatcgaatctcgcaccgccactggaacttgccaacccgagaatgacggcattccaggacaacaccatggccaatgggacggcaccgccgatcagtattgcgcgccgcgcatcgtacactgaatcccccacaatcttgcagatgaacggcgtgatgacatggaacccaagcgtcaggacggtcaccggaattgcaggcaggatggtagcagggcgccagcaggcgtagccgagcgatctcagcatgctgctccggccgacggaaacgccggtgacaacaagcgcggtgatggaggcgagcatcaggccgcagagcgcgcggttggcgccgtcgacggccttgaaggggaagaacgcgatgagcgtcccggcgaagcacgggaagatggcgttggccaaggccggatccaccgccgggaagagctgggacaccagcgagccgatgccggcgacgcaggcgacgagcagggagaagctgagggcggcgtagacgacggccacgaccgccccgagcgtcgcccccaaggtgctcgacgcaagtcccgtgaagctgacctcgtcgacgccgccgtcctccatcgcggcgaagctgagctccgcgacgaggacgatggaggacaccacgtagacccacgagagcacgatcgccgccgtggacgggaccggcccggagcggatggtggcggacggcagccccagcatccccggccccaccgccgttccgacgatgaggctcaccgccgcccagaagctcttcttctcccctccaccggataccccgtcctcgacgagcggcgccggtgattcttcttcggcggcgtcggcgtcgccgtagtcgctccgccaccgccattgccgcctcggcgacagccaggacagcggcaacggctgcggctgcggcggcgcggggttcttggaagctagtggcggagggcgacgcgttcgtggctccgggaggccgaggcggcggcggcggcggagcggagaggggcaggttgccggcgaggagggcgtggcgaggtggaggcggctggagagtaacatggtcaacggtaaattttggtagggtcaaaggaggcgggtgaattctgggcctcttttaccattcgaggcccagtttttcaacatacgagtttctaaaacattttggattgggaatttgaagaatgaataataatacgtagtacaaactgagcggattcatgtaaaaaaatactgtaaaatttctgcgtcctaatggagcctcagcaaggccttggaagatttgggattagagaaattaatatggctgaatttacgtttccattgaaacggaagaattttagtgaattttcattatcattagtaagtagttcaagtgttcaacccatgcaagaatccttgaaaacaatcctacggttaacgcgctccacttgtgatggaggaattttgcaaaaatgaagtaataaagcctcgtagtgatcgattgaggctaccagtttggtgtgttaaggccattcgcactagtttgaggagctgagactaccacataggacgaagacacggaaaaaataatacttaccacaagtttcacagttctttgtgaaagtcattctctcctccatctccgaccgccgctcttccccccttctcccctcctctggtggctgccgctcccccttcctcctccaaccacgcctcctctttcttcttccggccgccggccaccgcgctaccccactgggtatgcgcctcacctcctccatctccggccgccgcggctcccccacttcctccgaccgtgctcctctggggtcgccgtcaccatccgcaccgcgcccggagacggagacgaaaggaaggacgacatggcggtcgcggaggaggaggtgacgtcgtcggcgaagatggtagagcatgtactcgccgtcgacgacttcactcgccaagaattgatctctggcgaaaggcagcgaatgggtgctaccaaaccttagggatggcagtgggtcggg

SEQ ID NO: 86707 - DNA, 3033 bp, Oryza sativa
ttattattggaagttgaattttaaccaagcaatttcattcacggtacaagaactcgtcaggcgggtgtgttataggcttctagtaatatgaaaaatgagcataaagtgaatcgtctctgtcgacgtttgatgtcgcgattccagtatttgcatggtatagggatcgttggtactatgatatacgcgagactgaggtaaaagagacagagacgaggatttttatacaggttcgggcccctgaattatcaggtaataaccctacatcctgttggccgaagccggagttattttttattcaccataatcacaccagtacaatatgtgaggtagcctatctaagtattgtcgacatggcggtctgaagttctgactcgtagtcgacaacagggtagtcttcctcctcgaatccgtgcacggcgagatcagagatagcgctttcgtctctcctgacagtatccggagacaccgtaggggactagccatgctaatccctgaagttgatatccggtatcttgtcttagcgtatgttggcttgtatgttgtggcttctgttgttccgtagactgtggtgtgtgttgattgaggtggtcgtgtcccctctcctcgtaaggggccttgtatttatacccataagtgtccccttatccaagtagaactagggaaaccaatatggatacaatccgagtagtccttgtcgtttccatgtagaactctggttgtctttccttatccgaaactccctccatatccgatgtcagtttccgtataagacatggtatgtggtgggtcctgccgagatgtagtcgactactattaggtatgtggtatccataaccctgacagtctcattgtcatgactatatgaacacctctcttttcccatgatgaatacaagttcaaatttggagttcttaaattatttgctaagaagcatgataaaaaaataaagcatggcaaaaacaatcctagaagagatggagtacaagaaaagataagagaaaatcaatcctataagaaatgaagtacaagaaaagaaaagataagtgcagaacaaccctagtagaagaaaagatatagaagagctgaaaaatagcagaagtaaaagaaaagatgtataagagctgaaaaatagaaataagtgcagaacaaccctagtagaagaaaagatatacaagagctgaaaaatataaacggagtgaaaattatgtcagaagtgggatttgaacccacgccctcgttagaggaccagaacttgagtctggcgccttagaccactcggccatcctgacttgatgtaattacttgaaataatttcatacaaatttcgtatattttacgtgattcgattctgctttcatgtcgatgactcattcaagatcgagcagccctactcacctgtaaggctgtaaacaaagagagttgacagaaacttaacctgaaaaaagaacatataaataagtagtatctgaactctgaagtatccatattctcctatgaaacattggagtcaccccgagacagagtgtggttgtgaatttatggactactctatattatgttcgtcaaaggtgaaaaatatgtgctgaatagattgatcttcatctagctgaatatacgccaaagacataatactaatttggaaatgggaggcttcaggtcattgagatttgcattgctggatcaacctaccgtgccctcttccttggctgttggccgtcttcagatcccatagaaaatgagacgctagctagtttatagcatgtgtattttcttaagaaataatacactcaaaataattatttaaaggttttcttaattttaaatttgtaaaattaagctagactagtaaaatcatcctaattagtggtcttatcatgctgatcggactatttaatttggataaatgactaaacctgacatatattggtgaaaaaacgtgttttattaatattcaacacaattgtcataatcctgcaagtgatagagtttgtataattagttggaaatacatatctaaaataaatgtgtctacaattacctatttctttatgctggtttcatttaaaaataagggacattgacatggtaaagatactgaatgcaacacagctggttaatttccgttgtttcaatggtagacaatctaccaatcttcatcaatccaaatatactcttgacgacctagtttttggaggggctcatatagatttacgtaagtaagtgtacgcaggtgtatatgagcgtctatatttattttgtgcttcacacataaaatttatagcaaaattattattattacttacccatgttccaaaataaatgaattcctagcacacagaaaatataatgtgaggagagaaaaacaaaaatgttccgaacaaataggaaagtagtggtgaacttatcggttaacatggaataaacctatatgtccatctaatttcatattttattctttctattatatagaaatttagatattttctcgtctgaagtaaacttattgtagattgtatttatctgaagactttcgattgttctaccatctaatttcacattttattctttccattatatagaaatttagatattttctcgtctgaagtaaacttattgtagattgtatttatctgaagactttcgattgttctaacacaatcattgctgctactctattattttttatttattttcactattttttttaattttctagaaacgcatgatgctaacgtgaagtgacgactttccctcgttccgactctgtagtggattaattgtaatcctattgttttagggccggtttggattggattcaagccaaaacgtgccctaccaagattttgggtaacataaatagtaaatgtgctagtttggattgaagctaaatagttggtagtgctcatgctcaatttagctatattctaaaatcttcttcacaaccctactaaaatttgattttatattggtatcaaaccaaatatagattagctaattttgccctacctaaaaattggtagtgccaaaatctac

SEQ ID NO: 86708 - DNA, 7353 bp, Oryza sativa
cggcgtccccgacccccgccgtgtccgtccagagctgggcggagcgcgggtactcggtggtcaccgtccagtgccgcgaccgccccaagctgctcttcgacgtcgtctgcacgctcaccgacatggactacgtcgtgttccacggcaccatcgacaccaccggcgaccaagcgcaccaggagttctacatccgccacgccgacgggagccccatcagctccgaggccgagcgccacagagtgagccaatgcctccaggacgccattgaacggagatcactagaggtatatcgaagccaaatcgacccaaatttccaacaccaagatgcaattcgttaattgatttggaagatgacgctaatgtgttcgatttcttgggtgtttcagggagtgagactggagctgtgcacgccggaccggccggcgttgctgtcggatgtcacccggacattcagggagaacgggttgctggtggcgcaggcggaggtgtccaccaagggcgacatggcctccaatgtgttctatgtcaccgacgccgctggccacgccgtcgagcagagcgccattgatgccgtgaggcagagggttggcatggactgtctcgttgccagggaggagcaccggccgcagctctaccagaaagctgggccgcgcgacgccgtcgatggcaatggcggcggcggcggcattgggctgttctaccttggcaacttcgtcaagaggaacctggtcagcttgggattgatcaaatcgtgctcgtagacatgaaaacaaaatggagaatccaacaagaacacaacaaattcagtcgagacagcttgttcatcttgcttgctgctactgttgtacgtacaacattctgaaacacaacatgaaaggtgcagaagtggctgatgaaatctcaggcatgtcacattcggatcaggaaacagagattgcaagattggtgacatacatccattaatggagaatcaagatccatggtagccaagcaagagttgcccaagggaggaggaacaagatgatactagagtactagagcctagagcctagcagtagaaaagttgggagagctatgtacatagggggaatttgatgctgttagtggtactagtgtgtagtgagtgcattcatgatgttcttaggtagagacagtagacaaacaatggaattccaggacggttggttattctgtactgtgctgtttttctgcccttctttggcaaaacaaaattctttgggttcgttagctttgcttctttctttctgtctgatgcttaacagtgtgtgttaatgcttttttcagctttgctgatggattatgtgactactactactatggtaattctgatctttgcttttgagtagtgtgattaagtggtggtgttgatcattaggtgtagcttgcaagggaaacaagatgcctgacttgggcctgtgtgagatagtagtagtaactggcaatcacagcaacaacagcctgttcttgcaacattgtcttttccttttgtggtatgtctgaggttgtgattgcagtggtgcgcaccagtgaggcccagtctagtttccaaaaagtttttcccgaaaacatcatattgaatctttagacacatacacggagcattaaatgtagattaaaagaaaaactaattacacagttagggaagaaaatcgcgagacgaatcttttgagcctaattagtctataattagccataagtactacagtaactaacatgtgctaatagtggattaattaggcttaaaagattcgtctcgcggtttccatgcgagttatgaaattaatttttttcattcgtgtcctaaaaccccttccaacatccagtcaaacgtccgatgtgacactcacaaattttcatttcgtgaactaaacaggccctaaagttactactattcatgggcatatggacaatgcagaattgcagagtggtaaatgggtacaattatattgcatggaaaaggaaatggctatatatgtatacaacgtttttctttataaaacttttacgacatgctgtgagtatgagtaaatctagattttctgtaactcgcatggaaataaggtcacacatgaatttcagaagaaacaaggttttttttcccaatcatctgtaaacaaggttccaaacaagagcctaaaccatgttcctttcttgaagttctctcccaaacaagaatctggttgccatttagctttcagaatgcccagtagcaaccatggcatgatttggacataagatttgatttggtaaaccagcaaaactttagctttgcctgaaagtttcggagtttcattgcaaagattccattagtcaaatgcctgatactgcgaaaagcaagagcttgtcccttttcagatatcagcatggctcatgccatcatgcgtccttgtttagtgctctcaatgctctctgaataaataaaaattcagatcagcagccggttttgtccaatccacaaccaccaactgcaattaaacactcaactaaccaaacaaatcctgttctgtccatgttgtgatgacctaattcttggttaaagaaacaccaattgattattcctcatgaactcagctctgatctgatcagatgggagagcacatacgaacaagaacaggcatctgcatccagcagaaactccaggccgtttgcacggcttctcaagtgtggcatctccatcaaaaccggcggcagagcttggtttcatgtggttgtgcagctttctaaatttgttctgttttgttgttcttcctagcttgtccactactgttgtcttgtgctcatgctgttatcttgatcagtggctcgatcaaaatggctttcttggctctctgccatgtgtatcggtacaggaggagtcaaagatggggtcatctgatgagacatgaactgaaggacatcacttgtgacaaattggtgctgacttgtgttcatgtctgaatgctagctagcagcaactaggacaattgttagtccatttctgctttgttggacaagaactctttcatcttcagacatggcaatgcatcgtactaatccaattcactgtttgcactgtaataatcccccatgcatgttctgcatcagggtcagattgggagacatgaaaatgacagggagcagttccagtttgctacaggagattgtactagtctgaatctgaaactttggcgatgtcaatgtggtggtatccctttggtttcagacttttgagtacagacaattacggttcatacgagtaattagcggcaacaattaagcgcaacatatgttaataataagcccactaatcagtatctgactaattaaatctctgacaggcacggagaaatctaaattgacgcctgaatgttaacacccttaacgactaatccctggacatctgcatctgcatctcagacagcaaaggagaaaacaacaagagtgtgagctagggttcgtcgcatgcaagcattcgtcgtcgtcgtcgtcgtctacctcgatcttgacccatctccggagctttcgcttgctgctgctgcttttggatccttgctgctgttcctcttgcggctgcctgtactttcctggctagctaggtagagtagctggctatctttaggctttagctgtgaccagccaatatcatcagatagctagattagttaaaagattattattagtagttaattaagcatgatactagtactagtagtatatgcattggggatgcagattaattagttgattagtgatcgtagctcccactccccaatgtctccaattccaaggaccaagaaacagacatgtctgcgagttcgaggttgctgaaccttcaatcccggcagcgtttttctgtcgtctcggctaatacgaatttaacacaaacagcgccttcgcttccactccaaactgcctcctgcaactgcaactcatcctgtagctgtagcagtacagaaaattcagaaagaccctgcaaacatctgtctcaagctcaaagacttttaacgaatatatacgaccaaccgatcaaaagaagatttttaaccagttcttcaaaccagcaattcaaatgttacttgcaaaataacctcaggcatgaaggtcattaaaatcgtgatcttaaatcaaaatcgcaggtctctaaataggatcgcaatcacataaccttatacataataatcgtagattctacttattagaatcataggattaggtctcttaattaggatggtaaagtcgaatcgtatgacaaaacctagtagtatattttaacaactatcaactactcctgtagttagttagtatgctgattaaagattaagcatgacagaaactagcacagattaaagctagttcttcaggacttcaggagtgtctgaaccatgattaacgagggtgtgttacttattgtacggctctgatcatggctaattacttaactaattacttgactagaccactaatcacgtggccgcatgagccgctgattggtcagcctcttgcatgcatgcatgcatgggctgtctggttggcgccttttcatgcacgcagccttgtctctctcacatggtcgcccttaagaccgggaagctgtctgaattctcatgtctctcttcactgacattgcttctgcttaaaccttttcttgttgcagctgctaatttaatccatccatccatccatcccagcttttgttgctaagcacgcacttgatggctttattagcgctaactctagcttaattagctttcttccaccgtgggctaatcatcttcacaacgactctggctctggcctctctttttgaccggtggtgatgatctggagaagaacatgtgcgtgccaatgcagtgcgaatcttggcgtgaagtttcgtcagctgtcactgacatgtgggccccgagtatcagcattgtgtttggatgtttcacctgaagattacccggtcctagctgctgaacttctgaagattaagattcagtagcccaaagctagcttcttcagtagaacttcagtgaagttgggcccactgtcagtcagagaagaaaagaagagagcattcccatatgtacgaagattaacaacatgtgtacagtttagacaacagttaattagagtgaaaaaaaattctaatgctaatttaataaggggtacaccaggagcaaattaagtggagtaatccaacaaaatgaaaaagaagcctagagacacacacacacacacacagaactaatagtacaattctgcaggtcgactatagaggatccccatctccaataagaccgacatggtgttacaaggaagcagggtagcctgatgcttaaacagtgactaatatcgggacagctacagcaattgcagttagactcttctgcctgaagatggaaaacctactggaactcagatacatcttttacaagtcagaaagaaatgaagccatctttggccgccaccggcgatcatggtgtgcggctgcagcagtgacagaccaggaatttcatggatcctggtcagttcatctcagtttcaggctccagaggcggtgaccttcacatcgcccgatggtgttctcgcgctgtcaggtatcgactgagcaggagatgcccagctctggtctgggttgtatgctgaggttacgatgtttgttgttcttggggcgacggagctgtgctgcccttgctcgctgctgtgcgtatcggtactagagattggaacagcaggaggagtctgtgcaagggcgggtgccgcttccaccctaggcttcttattcttctgttccatttgatagcttggtaggaagcttccgacaacaatctggaatccaaatgtatattagatggcatttcaatcacctcaacacagataaatagtacaacaaatggaccgtgtttgctcgatttatcagacaaaacatggaatgcgtttctgccaaaaatgggatccattcagatctcaattgaaggtaagaaaaagcacctgaacaggacttgctgccaccagaaggccagcaactccaccaccgacaacacggccatctgggctggcaagagaaacgctcatcccacctgaccgactccgtgttccgctgttttcagtaggcataaacgatccagacaaagatagcaactcaaaacgtccctacaataaaaataggggagatcagctgggaaccataaggccaatcagaaaattttcatctttagacaaatatacgaaatcatgtcatggtagatctgaaacaaaaacaaaaaggcatgtaaagcatcgctgtgtatgtcaagagtaggtctacaaacctcgtaagttaatgtgccacccgaggaatcaggttgacgcagtgtaacgtttgatatcacaccattagcagatagaatacagatagctcgtggtccttgttgagaaaatgatatgaccttcatagtcacatcctgaattacatgcaacaaacatcagtaccacatattattaagactttcaaaaagaagaattttagaaaataaggagcatagctataactatgcaaatatttgcaagaatagaagcattttaacaggcttgaaggccaaaacataatacatagagaagcatatccagtctgataaacaaaattcgagcatatccaaaattcatatcaaggtttgcagcccacctaatctaagcaaagcagtaaaaactaaaacgcctttcatctgtttatgtataaaacatgatatagcataaaatgtttcaaaatacataaaatgatgcaagtaatcacactatgttgcagaaaagcctgaaaccatatgattcacaaccataaaaccttcaacaaaacagtctgaaaattttacttgctctgtagtacagtattattcaatcaaattcaagtaaagaacacattcaatcattgtcaacaagaactcatacatcttgatcaattgaacccaatgtaagatgccagtgaagacacaagaaaacgttgatttttacatacctctccaggagcaacagtgatgatgtgaggagtaaaattcgcaccagcagaacaagccaccatttcacctgccagtacacacaatggttaacaaactgacggcaggtaatttcgaaacgaggtaaaaatgctcaagagattgcaacaagcgcaacgcgactacagcagcccgcggacatttccatgacactgaaatttcagtactttatgcattcatgatgcttgacaacgctagcatgctccaatccaaccattccagctcgtacaacctgccagaaagaccagattcgccaggacatcgcggccttttcgtgttgccatcagcaacggcagaagcacaacagagacagggatgatgattgatcgaaaggtaccgg

SEQ ID NO: 86709 - DNA, 3497 bp, Oryza sativa
  unsure (1)..(3497): unsure at all n locations
tcaaatgtcataaaattagaatagacatacaattggcgctaatattatggatttgttattcgtgattcactgaaatattctctatatatgtttgcggatcttagagaaaagaaaaacaattatgcttcgtcattgataaaaaaattaaaatcaaaatacaatatcaactatggattaataaattgaatattgataaactctcatagaggaaagcaccctaagaaaaactccaaaaacttgagcttggcaacttgggcgaagctcaaggtatggtggagcgtgcacatatcgtcgttgcagttgcaaaccatccccagcctctccaggtcggccggccgaaccacgggctccttcacgaccaacttattgacgacggcgatgtcgcaccggatcgcgaacccgtcatccttgaggtaccacgacttctccagctccttcctaacgacgaacctgtcgaacccctccgtgaccccggagtagaataccctcgtgaacctcttctcgtgcggttcgcccaacggcagcgtcagcccgtagtggtgttgagggaccaggctaaaccggacctcggcctgngcctgngtgatgtggtggagcgtgagggaaacaganacnaaacccggacacgtnctcccgtttgggtagcagaggatgccttcagtgtgggccgccacttngaaacttgaggactcgacgaagtgcccaccatccgtgcatgggggcgatccgcgtgtatccgtcgatcttgagcatatggcatccggtggtcgcagtggtgctgactgtagacacggttacatcatcctcagttggcgccatgagatagatggcacatgggtcgtcagacaacatacggtggtgttcgatttgtttgtaaggtacgttggtagggttcagttaattaaatatatggagaagttaaggtagatgtcggcctgtagttcgtctcggataagagccattttttgggactgaataagtattactactacatgttggatatcacggatcgttgcaaactcttcaagtctctgtccggttcgtaaacgaacaagggggagatattactgatttcttaagttgctatgaaaagctagtaaaaactaatgtgttaatgaaaaaaacggaggaatatgaaaaacataatattctgataggaatgtaagtataaaatagaggattgcaaaacacaggaaaaacataggaatgaccgtttgattggaccacaggaaaaacacaggaatttgaggagagataaagactaaggatttcttccatgaggttccacctcttgttaaaaatcctccaaaacttatatgagaagaggcattccatagaaatttcataagattctatagggttcattcctttgattcaaagaactttgtaagaaaaattcctatatgaataaaattctctaaaattcctatgaatttcctttgaataaaagggggccttagtatgaatcatattaatgtatccactatagcaagccaccaaaaatttgtaaattctattcccgtgcttcaccttgtcccgttctctttccctgccctacttccctcctaatgtaaaataattactcttacttttacatgaaaatagggttccatcgctaccaatcccctctctcgtgccctccactatcactcccccactccatcttcttgctgtcatgtccaatcacgcttctcctctaaggttttaactgcgcgtcctaaggttacgttgggttagaataatttctcgtttatcatgagcacatttatcaaacggctaaattgaaaaaaaaaattatatatgtattttaaaaaaacaaataaatttgtttctcaaatttattatagttaatacttcctccatcctaaactagagataaaagaaacaattattatcaccccatttgaatcatcccaattaatacattacataaatataatagttaattacatatgtcacatgcattgaattatgaaacattaaaaaaatagttatgcattatatttttaaatagagcgagtacttaaataatcgtaagctaattgatattctcattttttccgtgacactaactagctaacttcaaaagctagcaaactattctcatgtcccactcgttcatagtgccacacaagatttcaaatttataaaatataatgtagaaaaagatcgggatattgcgtcgcagctggccctttctttgtgttggagaataggagccttttgtttgggagctcatgcctgcagagaagcagagaatttgatacattagtactccgacttcaaaaagctcgataagcaaacatgttaacacatagtattaatttggagttatgtcacataaaagctttttcgtaaaatgaaaaaacaagtagcacgaataaccttcaagttatctgatttatttgtcactttgttctccccagtttgatggccaactttttcatcaagggaggcatgttctgcaggaacatcaccaaatatatcatcgatactccaagcagcaataatgctcccatcttcactgatgcgtttctttaactctttctgcacggatggtaaattaatcaacgagcacacggcatgcgcaattttacagttggatagttggacaagacaagaatttcagataaaagctaacccattgatacatcctcgcaaggggcacgactgcttcacggtaatcgaaaaccgacaactcggtaaacttcagccacagatcttgcatttcagaacgaacctgatcaaactgcaatgcaaaaaaaccgtgataattagagcatataattgtcaaaacaagaatgaacacaaggagagaacagtaaactgaaacgatgctcaaagtttcagacctcagagcttgataaatctttaggacaagccctcaacttcttcttgattctgtcaaggatctcagctaattcactgcatttcctcctcctcatctctgacagggtctctgatttcattccaccaggaggtaggtttaacactagctcgatcataccatctatgctctgaaactgtaacatctcatcgtggcatgaatagccatcctgtgatgcattctcagttttaaattttccacacagttttgtgtcaagaaatgacttcaaattcacccatagatcgtccgggtgcttattgcgcagatgttccagcaaagatgcagtgtccaggaacttcttgcctgcacattggcccgaagatcgcgggcaaatccagaaacaccatgaaccgtgtgtcttggagaagcgccgcgcttcggagactgtgttcgccgcgatttggtcgatcttgctgtagtgttcgcgcagttcgtcgatgctgacggagaggatctgagattgcttctcgctttccatggatgcccaatcgtgtacggctaacaagacaagcttcttctgaagatcacagagttgtttcctgagggatgacaccatgtcgccgtactcttctccaatcgcaaatccgagggggatttcctgcgccgccgg

SEQ ID NO: 86710 - DNA, 793 bp, Oryza sativa
agcaatatttaaggacctgcactagagttaagcaaatctctcagggcaaatgtgtgtttttttgcatcaacacgcttttggcatgccaggtgggaccatttcttgaagaatttgctagatggtggacacaaagacatctgatgttagtccagacaatgtcattccaataacaatggacaaattaccaccagagcaaaaggcagaatatgaagatctgatgaataagctctaaaatcaatacttgcattcccttgttcagaccagatcaggaacagtaattcagaggtataaagtaaatcttctaagcaatgaagacctagagtcaagttctgggaaggacaaggaagtcaagcaggaagaaactcctgaagaattcaagagtttacaagacaggattgattatgctgtacacaatgctttgatcaatcaatcaggagtgcttgtcaatactttgactaatatgaccaagtctgtagttgatggtactattgctgaacatcatgccaaggggccaatattcttgccagagggagtttttccacaatacaggccattgataaccaatcagcaacaacccgtgccaggactagtgccagaacagccgatatcagcaacatcagctatgattaagcaggaggtgtcagcatcggcacagaatcaacctggattcaatcctcaagttctgatgagacaacaacctcaacacatagggcagaacattcctagagtttctcctaaacaagttgcagctatgtttggccctaatcagtcagttgttcagccgatcttgcag

SEQ ID NO: 86711 - DNA, 1182 bp, Oryza sativa
cctttgagcggccgggaactcattttgaactctacaatgtgatccagaaacctgacgaatctttgagtgattacattcgacgtttttccgagaagcgcaacaagatctccaacatcactgttgacaacattattgctgcattcaccaatgatcaactcatcggcaagttcgaacgcaaacctcctagaacggtcaagcagatgtatgaaggcaaaatttgccacaagacacgcaaagattatggtctttgctgtgggacacccgaagatcgtgtttttgctcgtggacaccgcaaaaatgtggtaattagctagaggacaccagccgcattattttattatttgtcgtcgaaacggagagagaaatagcgttgaaagtaccaaaatgcccctagacactgttcttcttccttctctttgcttctcttctcttcttcagcgagggagcataatccccaacttcaccggcacgttggcggtgagccgctcctggtgaactgtcgtcatcgtcatccaaccatcaccacaccaccacgtcctggtcgtctccaaccaaccaaattcttgcacacacacacgcttgcacgcagctccatcgagctatggctggagtgaacaacaacctcgtcagcctcaagcctgccgcggcggttccgcagtcggtcgcctcgtcggcgctgccaaagcgcgtgcacgtcgcgtttgtcacaccctaaaaatcccaaatgtataaattgttgtttaattggaattattagaaatgattttaaaagcctacaagaaaagatctaattttaaataataaattccaatataaaagtgggctagataaaattttattaaatacttctcttaattctatagttcctagatttttctgggatttatttgagccaagaaagtatttttaataaatggaattgcatttcatgaataatttaaattgaaaaaggttttaaaaatcttccttttggttttgggcccaaaaccccctccctctctctccccggcccaatcgcgcccgacctagtccgccgagccgagcagccgctcgccctcctctctcccgctgacagatggggcccacctgtcagggccgtcgttttcctcccgccacagccgcgccctaacgcgcgcaagccaccgctgccacccttccaaattcgaccgctccttttccgat

SEQ ID NO: 86712 - DNA, 935 bp, Oryza sativa
ggaaccaagaatatatatatatatatatatatatagctgttagagaaacattgatcccaattgctgtaagtagaagtacatcactgaaacacatgttcaacagaacaatttccaagacaagctcatccctgaatcaaaacttacactgacactcatggtaaaacgagcctgatatagtcacataaaacaaattaattgcacgggataaacattgaaacaggtatgaacatgaactacgagaatcaatcaaaacattgaagataaaatatgttcttccttcataacataatgtgtgcaattgtcaagaatcaagcaatcgtatcacaagataattcagatattcctcaaatatgattcttaatgagcttacaaagttacaacttacaaatcaacaataatgaatggagtaaccatcacctcggttttgtcgataggcaatataattggccaggtgtagaagtcatgctgccttctcttgatcaaatcctgaaaaaagttgttcccttgcatcagaaagcaacttttctgcaaacccccgtgatttctccagcccaagtaatttcgggtatgtcgtcttgtcactcgccaagtcctcccctgctgtcttgccaacctcctcagaagacttggtcacatcaattatatcatcaacaatcctatcaacctcgcatacatgcgcaaccgttcaatctgctcataagagcaacctcccaagattgccccaatatccattgatgcctcaagaatttgatgcctattcttttttctaattaaaatgttactaatccaaccaagacaatgtaatctcttcagtaaaattgtgcttaagcagctgtgagatttgagcctaaatgatatctcgagttaaatcttgttacttattttcaagtattataccacaagagggagaagcaaaagcctcacctcatggagag

SEQ ID NO: 86713 - DNA, 1268 bp, Oryza sativa
attattgctaagtgcaccttttgcacagaccgtgttgtttttcttggttttgtggtgactgcagctggcatcaaggttgatgaagaaaagattaaagcgataaaggattggcctacacctgaaaatgtgaggcaagttcgaagtttccatggacttgcaggtttctactgacgatttgttaaagatttcagcaccatcgctacaccccttaacaatttgacaaaggaggatgttccattcaagtggggagctgaacaggaccatgcctttgaagagataaaacaaaagctttgtgaagcactgctgctacaactaccaaactttggtaagacctttgagatcgaatgcgatgcaagtggtattggcattggaggtgtgctacttcaagaaggtaaacatgttgcctacttttctgaaaagttaaatggtccacatctaaactactctgtctatgacaaagagctttatgccttagttcgagttttggaagtctggcaacattatttgttacctaaataatttgtaatccattctaatcacaaatttttatgccttagttcgagttttggaagtctggcaacattatttattacctaaagaatttgtaatccattctgatcatgaatttgtgaaatatctgcaaagccaaggcaaactgagccgtcgacatgcgaaatggattgagttcattgaaacattttcctatgttgtcaaacataagtgtggcacagataacattgttgcagatgcttcgtctagacaatgtgctttggttacacaattagatacaaaagtgcttggtttggaatcaattaaaaaactttatgctaatgaccctgattttaacgaacctttctctaattgtattgctggaaaaggatgggacaaattctatgtgcatgatggattcttattttggactaacaaactgtgcattccagcttgctcgatacgaaatgttcttttgcaggaatcacatgctggggggttggctggtcattttggtgtaaaaaagactttggacatgctttctgatcatttcttttggccacatatgcgacgtgatgtccagcgacacgttgagcggtgcataacctgtttgaaaagtcccgtcttaatccccatggtctatatactccattatctattccaaatgtaccttgggaagatatatctatggattttattctgaggtaacctcggtctcagagggggagggattccatttttgttgttgtcgatcgcttctcaaagatggcacattttat

SEQ ID NO: 86714 - DNA, 3236 bp, Oryza sativa
tttatgttcaggttgcccattctgttagcagagttgagtttcacgtaaaagacaatgatgtttttggagcagaacttataggcgtggttcataccagttgaaaacatcacaccaggtgataccgtcagtggttggtttccaatatctggtcagtatagtaatcctatgaaggcatctcctgaacttcatttgtctatccagtacaagccaattgagcagaatccattgtacaaagatggagttggttctgacggttgtcagagtattggtgtgccaaatgcttattttcctcttcgaaagggtggtatggtcactctatatcaagatgcccatattcctgatgacttttgtcctaaaattgaaattgatggtggaagagtatacgaacaaaataaatgttgggaagacatttgccatgcaattgctgaggctcatcaccttatttatataattggttggtcgtgtatcaccctgtcaagctggtaagggaatcaacaaaacctgtgcccaatggaagcccaccaacccttggagggcttttgaaaaccaaggttcaggagggggtccgtgttattgtgtttctttgggatgacaaaacatcacatgacaaatttctcttgaaaacggtaggctgcattccgaattatctattttacccctttatcatcttgatttcctcatgctatgaaaatggctatatatgaaatttactctgcgttttgaagtgttgtgaccttccatttttggttattatgctagtagaatacatgctttgacaaagggacaatgattataaagctaaaagtgcttatctaatatctctacatgctactacattaataataaaaaggtggtgagtgctgaaaatataaactgaaaagggtgggaaaaataaatggtaggtaatatcttccctcttggtactggtgtcatgggagctttggtaggactgctgagaagctaaatatccaaagtactcctttatgtttcggttgttattgtagctcaacttatataaaattgtttatgagataaatcttgatgaacaaaattcttactgcaaatgcatttgtttgaatgctgttttctttaggaaagagtagtctgatggaaatgatgtaggttgaatgcaggatggactcatgcatacacatgacgaggaagctcggaagtttttcaggcattctggtgtccattgtgtgtgggctcctcgctacgctagcaacaaacttagcatttttaagcaacaggtgggatgtatttgctcccttccattttggtggcagaacagttatacttatttatactccctctgtccgagaatataagggattttcactattcacgtgtaacggtttgaccactcgtcttattcaaaaaatttgtgtaaatataaaaaacaaaaagttgtgcttaaagtactttggataataaagtaagtcacaaataaaaataataataattccaaaattttttgaataagacgaatggtcaaatggtgcaagcaaaaagtcaaaatcccttatatccacgaacggagagagtacatactagttgataccccatgctttgctacgggatatgtggatgaatgtatgttatacattacaaaaatgatagacgtatatgtttaaatcatgtgaagatggtgatttgacattgcttacgtgctaagttctaaaaatacaacctaattacaaatgatatatcatgtttgcgagagatctaaaatactctagataataattgctagtgggtgatgatgtggcacacttgcatcttgagctttaggagttagtgggtaccaactatatagaaagtatagattgagtaatcgttcttgttctcttgatttttgctccttgtctatatctcctagcttcttaagtatcatcttttggaaacttaaaaatgtgtacatgcctatacatagagaatgtttgctgtcatacttgacaagattctaatgaatttaattcatgcacatgatgtaatattcctttttttgaccgaaaatgatgcaaaatattcctttcatgtataatgatgttcttcttttcttatttgatattgaaaggagataattagtaatttttcatttgtaaattacttgaaaaaaaattgctagtgttatttataattcagaaatatttatattaggagaaaaacctaattttaggtgtgttgtaaacattaaagcctattactaccccttatgccaactgccatgctcttcattaaacttctgtcgaataaattagcaattctcctcatatttctgattgtctggaaaagtccaggtgaactattgacttatataagagcatgctgcatttgtacttctaatacattctatccgttgaatttgatgcagtgaacaataattacaatgaagttactggttaataaagctttcatggatgcaactaagtttctaacaatgcttagttgcttaatgtactgcatctcaccaaattttcttttccaggttgtaggaactttgtttacgcaccatcagaaatgtgtcattgttgacacccaagtcatagggaacaatagaaaaataactgcttttattggtggcctagacttatgtgatggcagatatgatacacctgaacacaggctcttcaaggatcttgacaccgtcttcaaggatgatttccataatcccacattccaagtaaattctctaacactgtagttttccttctagagattctcctacattatttctaaaggggaatgtccaccatcggccctttaactgtgggcaaagtccatttaaaccttgaactcaagaatcgtctcatcccaaacttctaacgttgggccaaatatcaccctggccagagctaacctcacaattcccatcaactatagtattttccataaaaaccaacacctcttctgagtgctcaaggacacatcatgatcatacagtcatactatctgcagttctgcactattgtggtttctccttgtggactattttttagtttaggggcagaaagtgaaggcttttttcctttctaaaactataaatgagacatgaacctgctaaaatttagaacatcattctttcattcgcaggttaataagtctgggcctagacaaccatggcatgatttacattgcaagattgagggtccagctgcctatgatatacttacaaactttgaacagagatggagaaaatctgcaaaatggaaagtcagcgttagaagagctgtaag

SEQ ID NO: 86715 - DNA, 790 bp, Oryza sativa
tataagggttagggtttgcagtaaacagcattaaaagacccttcgttgctcaaagctattttgtaaatacgatcctagagctatacaatattattaatcaaggccgtgaacccacacgaacctgccttaacccaaggcctacgatgattcggaccgaactagcaacccgaccctgggtcccagctcgtcccaagccaacccaggccaaccattccacattttagttgttaagcaggttttaagaattaaaacactaacttgggtacattgctcggcttggccataaccgagggcgcggctattcgaatagcttatactctgatcagaggtgtacatctttacccacaagacacatcttcctcacgtgtaaccacgtgccacataccaccacggtatacggacggaagacgtcacatagtttccaacccatcctagccatagacaagagtaccgacccaaccccacctacggccgaaacctccgggacaggtaggcaggactgagcccctaacagcaggacaccggccctgtgccatgacatctcgactaccgggccgcagctcgtgtagccttcatttgccctagagatgtccatcgagccccgacttcatccatctccatccgtgtactatctccatccgtgtacttttgtttataaccagactgagccacaaactaagccttacccactagacatgtggaagtacggtagtgctttgcaatagaggcccgaagaccggtccttatatggccgaggtgctactatcaaaaccatgcaccccaagcccag

SEQ ID NO: 86716 - DNA, 1882 bp, Oryza sativa
  unsure (1)..(1882): unsure at all n locations
gccatacatcaattgatttatatggataatcaatacatccaaaatagtttacatcgtgtacacaataattacggcaatacatcaacggtgacggttgaccgcacgtactttctcctcactatttgttccctccttgtgatcgctacgtgagtaaggggtgtcttcatttgataggaggatgctaggtcaatcgtcaccgtgaaagggggttgcccatccaactgatcataatcctcgttagtcttgtcctcaactccgacgatttttcttttgcctgggagaacgacgtgacgcttaggctcctcaggccctctgcccttctttcctttgctagacatgtccttcacgaaaaagacttgcgttacatcattggcaaggacaaaaggttcgtccgagtatccaaccttgttaaggtcaaccgttgtcatcccactgtcatcaatcattacgcctccaccagtcaacctaacccattagcaccggaacagagggaccttgagaagaccatagtcaagttcccatatgtcctcgatggcactgtaatacgtgccagttgttccatcgtgcccatggcatcgacacgaacagcgctgttttggttcgtgctcatcatgtcttgggctctcatgtagaatgtgtacccattgatctcatatccctggaatgtcgcgatcgacccagacggtccccttgccaggaaggcaagttgttggttgatcgactcgttacccatgagatgttgtcgtatccatgtggggaaagtatcaatgtgatgccatgtaatccatgcatccgacttaccgatgttcctggcgcgaactagagccaagtgctcctcgatgtaaggagctaccaatgaagattgttgcagaactgtggaatgggctttacggaataaattgttgtctaccgccattattgctttccttcgagagtttccctttcncngtagtctccnttcatggcgtgatcaaggtacccgattgggcgaagtctccgataaatttacgcaaattcgatgacctcctttgttccataacccttgncgatgcttgcctctgnatgagcacagttacgaacatacttcttcagaacgcccatgtacctctcgaaaggaaacatgttgtgtaggtacacaggccagagaatactgatctctttcacaaggtgacaaagcagatgcgtcattatattgaaaaatgaaggtggaaatatcaactcaaaactgatgagacattgcaccacatcattctgaagggcttctaatctatccggatcgatgaccttctgcgaaattgtgttcatgaatgcacatagctttgttattgttgcccggacattgtctggaaggataccccttattacaactggtagcagttgtgtcatcaacacatgacagtcatgagactttaggtttgtgaacttcttctccttcgtgcttattattcacttgatattcgtggagtatccagacggtacctttatgctctccaagcattcaaacatactttccttcactgccttgctaagattgtagctggctggactcaagtaatggcttcctttctcctttggttccgggtgaaggtcgccacgttgttccatatgcttcagatcattacgtgcttccagtgtatctttcgactttccgtatacacctaggaagccaagaaggtttacgcaaaggttcttagtgaggtgcatcacgtcgattgcgtgggtacgtccaagaattcccaatagggtaactcccaaaatatagagttcttttccacatcgccgcgtgaccatcttcgctctctataagctggcttgcagggcccctttccgaacactactttaagatctttaaccttagcaaacactgctttcccgttgcgat

SEQ ID NO: 86717 - DNA, 2323 bp, Oryza sativa
gtgtttttgaaaagcctacttaggtcagccacatcactccgacggatcacattggctttccatggtatgattatgagtcctgacaatggggagccattccagaacttcctggttgaactatccagcctgatgaaattcaaggaaatttaccgcgctgagagatccgcattcagaccaaactgggagtaagcgtgatcattcagaaacagcgtgctacagatcaacaccaaaattcctaaattgcatgtccttgccaaaattgtaatagacaatgtgtaatgcttgtattatatttttctgccttctaatatattcgacaatactcttgccgctttcatataaaaaaaccaccaaaattccgaataactgaaggcatggtctatcgtgttgcatgcataccagaattattcctgaaccgctgagagcatgccgtactgtgttgcagatcgatagcagtattgcgagcgcaaaataaaggccgtaaaacttgtttaattcgtgttttacttagagagatatttttttagataataaaatagaatatcctgacctttactcaacaagttacagccaattattacagagtagtacacaaaatgaaaagtttctcacacaaaaaagaagacacctaccaacccaagataaggagtacacaattattgaattctgtttgtgaatctccatccaaaattggtaaacagttgcataaccgttgcctcaagattacgacatgcaacttttaaacgctcgccctcttcatcacacttttgtagcagtacccaagacctgagccagtgcgttgccctgaaaattacatgcatatatgaaacagatggtgatttgtcaaaaatcatatcattcctactcaaccatagagcccaatatataacagaagctcctatgagaataagtttcctatttttcttgtctacccccagaagccaatcataaaaaatatgagatatgcaattaggagggtaaagaccaaaagagaactatacagctctccaaataaactttgcaaaatgacattccataaaaagatgttgaatagtttcattcttcatacagaaacaacatctcaaacttccattccagttcctccttgccaaattatctttagttaatactacccctttaagcaagtaccacacaaagatcttaatcttcagaggcatcttagacttccaaataatcttatttctctcaatataaccattgtttattaaagccagatacattgaccggacagaaaattggccattctgatgatagttccatctaaaacaatcactctgttgattcaactcaatatgtacaatagaagcccacaattcataccactttgctagattctgaccaactaaagccctcataaaagaaacatttagcggaacaggtctcgtaacattagcaactgaagaacttttccttcgaacaatagcatagagagatggatacctacctttaaacactaagttatctagccatttatcttcccagaatctaacttgttccctattattcagaatccaggaacccatgtttaagaaagtattcttaactttcataagacctaacaaaaaatgagaatcaccttgtttcctatcaacttgggtaatagactgattataaagatactttgtttttaataagtcttgccaaaccccttactcatttattaatttaaacaaccatttactcaaaaggcatttattttgtatttctaaattatggacacccaaaccaccctgatctttgggttggcaaataatatcccatcttgtaagtctgtactttttcttatgatcatccccttgccaaaagaatgttgatatataataatcaattttttgaagaaccccttttagaatctaaaaaaagatatcataaacatagctaaactagaaagaacagaattaatcaaaaccagtctacccccaatagacatatgttttcccttccaactactaagtttcttctcaattctttgttcaataactttccaatctttgttactaagctttctaaaatgcattggaataccaagatatctaactggaaaagtacctaacttacaaccaaagatagtagaatattgttcataaaagtcctttgcctggccaaaacaaaataattcacttttattaaaatttattttcaagccagacaacttttcaaacacagataaaatcaatttcagattcttggcttgttataaatgtggaattaccccattaatggtaccaacatccacacttttgtagcagtgaccaagacctaagtcagtgcgttgccctgaaaattacatgcatatatgaaa

SEQ ID NO: 86718 - DNA, 9801 bp, Oryza sativa
taagctgacacgtggtgaacaaaaatgaccgacgtgactggtctgataccggtcatgtcgtcagcagacagccacgattccacgttgcacctgctcccggcgaaagtggaggtagttgtgggccgtctcatcagaaggtgactcggacggcaactatacaaatctccgtccatttatgaaagggggggtaagtccccacaaaaaagagagaaatggtgcatgtggtatccccttaagatataaaaggaggaccttgcccactgagaggggggactggacttttccagattagaaacccataacaagggagaggttggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccccggccaaaccggcaaaggggggcctgcgcggtctcccggtgaggagccccacgctccgtcattaacgaagtacaaaaataaggaaaggattaccgataactccggaattcctccgacttctattttactctctccctaattctaagtatataccatataacatataaagatcctaaagtatacttagggcctattgtagttcagctctacatcttgttgtgtgttaaaatgaacgatgagaggagtatttataggtggaggtgccttgggaggatagagtttcttccaagcatccaatgagcatcttcatcctcctagtgccaagtgtccagcttatgactattttcaccggtgaaaacggccataaccgtcaacggggagcgatttgctaccaaacgcaacctgggtcgaggcagcggcctctgtcatggttcggccgaactccggctcagttggccccggttttcagcctggacatttattttggaccccttattctattggtatggatgtttggcccatttagaggtgtttaatttggttttgggtctaaaactccataagttcggatacgagtttgattctcctcttccttcatgtatatttcttctcaacttaggtagtttgtcacttgtatatgaatatacaccaatactcatgaaaattgttagaaataaacattaccactatgttgtatgttttatatttatagtcttatgtaggtattgacagcgttaatttggtacttaacggccatcaaaataatcacctatataaatttactaactaaaaggggcatctatataagatagccatagctcgcgagacaactcattcatcataacgttatatcaagtgatccaccaccacttagaacaaagctttattattttcctctcagtactcatgcatgctttctgtcgttccatcaattaatatagccatataattatcactcaagcataggattgcgaggcatcagtaatgcctgaaattgggcgctgttgagatagtgtcttctactgaaattgggcgcctgtgagatagtgtctgctaggaacattttcgtgcagattcatccaattacatctaaaatatgttatgtggcttcattgtaggccaaggatgcatgtagcaaactgagaatgaagccagaaccaagcttagagattttggctaagtggctaacagcaaggccatcttttatgctaggcatcctttggaagcaaactaagggctcattcgaaatgtagggttgaaaaaaatataaaacataggatttgaaaatacaagaatttcggacatctttgaaatgcaagattgagaaaacataggaataagaaaaacataagaatataatgttatgattattgaattcttatgggattataaaacacagaaaagtctctaaactatcgtttgattagcacatagaaaaaacgcaggaattttagacacatgaaaaggaaaacatggggtgaggcctcatacttattttcctccaaaattgctgtagcataggaatttcaaaggaattggtagaaaacaattatttgttttaaaggactctataggattatttctcataggataaaatcctctaaaattcatgtggtttttcctttgaaacaaagggggccttcataggaatggatgtctagatgaaccatgggaaaaacacgggaaacaacggtacgtgaaaagtttattagagagttaactatagtcttatccctaaaaaagcattaaataataaaaaggagaagcctgatgatgcttaagccttgcgtacgttagtgtggcatcagggcttcatttgcctcgatcctccgcaatgagaaagaaaacaaagaggtcagactggacatttttcccctgcagttttcctacaaaattagcaccataagaaagtttccaccatttttccaaagggataatcctccattccgaatggacaaacagtaccatttcctattggaattagaatcctctgtttttcttccatgaatccccgatccaaacaagccctaaacatcatgatgtataaaagctaagggcccctttaaatcatagaaataaaaaaacgaaggaataggaaaaacatatgattatgagagaaatacaagtataaaacagatgattgcaaaacacaggaaaaaatcataagaatgattgtttgattgagccgcatgaaaaacacaggaatttgaggagagataaagactcaaaggattcttaacatgaggcaaaacctcatgttaaatttcctccaaaacttacatgggaagagacattccgtaagaatttcatagctaggattccataggatttattcctttgattcaaagggctatataaaaaaaattcctataggaatgaaaccctttaaaatttctatgaatttcctttgaatcgaagggggccaagaatgttaacagcttattagtttcctgatgcatataatttgtcaaaaaatattggcggacgatagaaatcgcaatatctcaatgctatgcatgacataatgaaaacatatttcattatattggacatagcaactactagagcgatttaataatccagatcaaatgtggaaagctcctattatgttgttcatcagtagagcttctccttttccactgttacaaatggattttcttaagcttcccctcattacaattgcctgcttagtgctaagtagttacaacatataggatatgcaacttggtatttaaccaatagaaataacgtgagatgaacacaaacactttattataaaccttgtaaccatcatcattttatctgtctcatggatatatactggggaaaaactcatgcgcttatgtgtgaagcatgatttaatactattacatggatatccaaaatgaatgtaggactgttgaatagatgtagtacaaatgagcacatcaaaagttagaaattaaattgcagggaaaatgaaagcatgcacggaaatatagcatggtgcatgatgtactttgttttcaaccataaataaacagctgccatagctattgatatcatatcagcacatacatttttttgatcttttgcgattgagaacagaaactttgaatcaatgaacgcaaaattttgaaggaaaaattaagtaaatgtgacggaagctttttctttttttctttttacccaaacacagcatggagagcctcctactgtaattttccattataaagagaaagttatgtacaacaggcaaaaaataatttttgagggaaaaataattacaaggagaatgaagaatgtacaacattggttatgctaaaagtcctagctatgatgtctaagtggttttttttcttttttttttttttgctctgaacacatgcacacgcaaagcaaaatcctctttgaaatgggaaaaagctttgatgtggcaatgccatgccacaggatagcaacatacaatgtggcacctcttaccacataaatagtgttgtaatgaagctttgcggtggtaatgtcaaagaatattggcatggtcaaaaggttcaggttaaaaaaaaagtttgacattgttcgttgttaaaaaaaatgcttttttaaaaaaattaaataacaaaagattcagctctaattcacctatggggcgatacagtacatacactgcaacccgtgcaactatgcaatatatttattccctatgtttatctcttggctttgcaggacggaacacgttcttctgggtttaagccatgaactggtcttgccttttatttttaatccgcattgaatttatcttgttagagatgacacaccagagccatggcctagtccctgtggcctccaccctgactagccacttgtcaacagtaggttttaccaaacttgcaatacctcacattacatttaaggaatattggcattattaatacacaacaatttaattttttgtccatcaaacatcatttttttttaccagagagagtaaccaagtattcaaatcgcattagatgccttctcttctgcgaattcagaaacagctatctcatcttataagttcagatttcagaatgaactccaggataattgagccaccagcgaatcctcggcccctccaagcaacaatcgcccagcttcattccccctgctccagctttggggagcaggggagacagggcgggacactggaacagaaaatgaaattgcattagtccatgctgagcaaaagatgaacaaggaacgtcctcttggtgtcctagaacccctggcagggccatgaatgctcacatggaagaatcgcccatttttcgcttgcgattgcgtggcagaataactcacggtctctgaatgcacaaggtgaaaatggttccatgtgtttctggtatcccagtaggccagtatacttctgatcaatgctttgtgtggagatctctggtttctataaaccccaggatgatgatggctcttgtgagttgtgaccaccaatttgtccaatggttgtccttgctcccagctgcacatgaagagcatgagaaagtagtcaattagttgagaacccagtactgtagtactacgaataattgagctctgtgcgatacttccaagttccagcatgtattttaccagtatttatggttcaaggggcaataattatattattattactattgaatgaaaatatcgacaacaataggactgcttatttcagttgggaatatcaaaatcaactggaacactgagcattcactttactagcagataaggtgtaagttgcaaatactcctactagatagtaaagagaaggaccagttatgcgatcgatttcctcacaatagtttgtccactgatacaacatcgggtattcttaaagtagtaaaagttttgtacgggaagcataatagatggcatcaaattgcatgtcagataaatgtgatgcagataaggcttccacagaggagaatctaatgtatgcaaaaaatgcaaataaataatattcttttggaccaaactagactccaagttatgctgtagtacctaggtttttgatatgcctaaacctatgatttccttgtgtttcagtaatgtgatgctatcgacctggagatctttaaaatcataaaaaaaaaagtactagatatgtgaaatcatccaactcaggagtcaggaagcacaaaattaccgctggcacgaatttgaaggactgattagttttaatcctcggacagcagcctgaaagcaaattaaaataacttatcatgagtcatgattggagtgacaaaggtaaaaaggaaagaagggctggagagtcagaatgacctggtgatcaaaacttcgatgatcttcctgaatgatggaaaacagaaaagttacaatataagccaatcagatcttctagtctctataaactaaagcaacaatatcttgagattagccttgaaaaaagaagtcctgaactgatgtttcaaaatttgttcacacccttccttacaaaagttcaaagaatgcaaaagcatgtcacagtcttacagaatgtgaattaaaatgtcaggaaagcctcatcggacaacatgaagattcaaaattagatcggttagacttctactagtacttcataaattaattggtcacttagtcatctcttagcattaggtgtcctttttgttaaagaataaccttgacactgtaaacattagggtaataaaaaggtaaagataggaaaaatgatgaaatggagcacacggcattaaacgaattttacaggaaaaagttcaattccctaaatcagggaaattcctgagaaatagagtccagagtgtccatcagctttctatgtcatattatcttcatctattttgtgattttccatatcaatatcatctctttgggtaatgctgcttaacctcagacataaataaacaacaaatattctctttgctaatgacaactttcagtagcatatataaaaaattcaatcaatttatcactccaatgttgtcttatattcacatggaaattattataagattttgcacttaacattcgtgtccctgctctttttttattctccacaacaaatatctcctaaatgtattacagaagagaatcactactgtaaatccaggtaatttgttgtcttaatttaattcaatcataaatagtgttcaagtcgacaatgagtactcaagcataaaatttgctgaataatccagccaaaactaaagataaatttccacagtgaaaatatgagaaatcagacaacacaaagtacccatatatcattaagaaaaaatgtatgttcctatagctctaatgacccaggagacagtcagacagtatgtctgtactgaggaagaagcggaacacaccacaatcaaatgtgaagttcatcctggtatgagttgtcactgtaaaactacatcttgacatgagcacagcaacttctgcctgcaatgcaaattctcagtggaggttttgtttcttgaaaaagaaatttcttctttaaatggatggtagttcactattaattttacattcatgcttgtaacaaaataagagcagaaaaattttaccttgtaaacaagcttggtgaaaaaaaatttaccatatcataaattcataatagatggaagaggattgaacatatacgactattgatctagatgaaggtcacagactggcagctatgtaatcagcatggtccagaactataaactgccagtagggcatttattaactggttgttgctgtcatgatgacatgtggtgtaaaggccaatgcaccttgaaatagccaggcaatagatggaacatgattcagcgattttgaaccgtatagcgccaacaagagaataacaaaaactcaaattttaacaaaataaatcgaagtggctaatggatttctatcaagtatcaacccaatcccatcctagtttcctagctgcaagttgcttgcagctatgttcctcagccaaagtcaagattgctagaagctaaaattgaagtaagatcagaaaactatgtaaaggcctaaaaccagttgcacttaccagtgtactaatattgaaaagtgttcttctttcaaataagatgtttgagaataatgtacaacacataaaactgggaaagaaatttctatacttactatttgtaacaaatatgccatgctagtcaaagaaacagataagtcgtgtgctcccaatttgtgatttcagtagtttgaagacaggatctcaatatgattcaccagattaatcaaaatgcaatgggttggggtgatcacccaaaaagaccgtatggagcacttctgctgctagctaaagcagcttcctcaaatatgcattgatagtaaagaagactcaactgcccagagaataagtgacgtctacttatatctgagatagtacgcagctatttgctcctggtgagtggtgacagaaccagagcttggttcatgccaattgcagcaaaactctctgccttctatttaccaaaagtgatgctctccagtttgatccagaaagaagattattagcaaacctgatacagttgtagaacaataggaagatcccctttacccatgttactgcagattattcacaacacctgatgaactgaattagactttttcagttacacttggaaaacggctgtaaaagagcactccagcgattaacttctcccataatcacagtgaagcaatgtcagcaaaaactagctgtatcttacacagttgttgccctatcaagcattgaatagccccagtacctagccacaaaaaggtcctgccacaaggactcaaggacataaggtcctagggtcccaactctcaacctttacacatgagctgcacaagacagacaagcaggcaagatcttcaatagttaagcggtgtgcaatttctttaagcaatcaaagggggtgtcctctatgattcatgcattcaatcaaatcatcaactgctgatctctctctctctctctctctctctctctctctctgctatacaacttaccagtccatcctgttcaaatggtaatctagtatttattttgcacatgtaggacgagcaacactcaactaagcacttctgatgctgcagtgttctacattatcttacccaatgtgcttgctctgtatgtctcatgagggccattaaaccgtcaactgtttcatatatctctttcctcctcttatgccttgtatctttagccaaaaactcatgaacctcactgcctacctggattgagctacttccaggcactttctcaattccccaattacgcatgcttgtgcgtgcatcgatcacaccatcccaccttccttccaaagcactacaattagaaaccaggacttgataactagaattaaatggttctagttcagttatcttcttactgacatattctataagctctgcattaccatgtgcaacacaagaacaaagcaacgtgacccatatgacaacactaggttcaagaggcatgctttcaataaataaaatcgcctcctgtaagttacctgctcgaccaagtaaatccaccatgcacccatagtgctccattcttggttgaatgttatatcgctcaaccatttcattaaatatactccaaccttcttgcaacaaacctccatgagcgcaagcagcgagtgcagcaataaaaactgtgtcatccagttgaactccttctctgcacatattattgtagaccaaaagagcgtctctacaaagaccattaaaagcaaagccagaaatcattgttgtccatgtaatgatacatcttgtttccattttataaaaaattgactctgcccttcctacatccccacactttgcaaacatgtctatgagagcatttcctagtgcaacagtgagatggatgttgcttttaccaatgaaagaactgatccagttgcagtattcaacactgcccaattgagcacatgccgagacaacactcactaatgtcgcctcatcaggtctgaaccgtccttcaagcatcatcagctgaaatgtgcgcaatgcctcatcgtatcgcgagttgtgattgtatccagttatcattgcattccatgaaaccaggttcttcacaggcatatgatcgaacaactcattcactgtatctagatccccaatcttggcataagcagaaaccatagcagtccacgaaaccacatccttttggtccatccgatcaaacacggaacgtgcagcctccacatcaccactcatcgcataacccgaaatcatcaaattccaagaaacggcattcctagaaggcatcctgtcaaacacagcccgcgctgtcaccatgtcacccatccttgccaacccggcaacaaca

SEQ ID NO: 86719 - DNA, 1066 bp, Oryza sativa
ccccccccctccccgaaattttttatttttgttttatttgtttgatatttttttcacgcttagggacacacaagaaccaaccatagaaaaattgaacttaaatggacgtaatatgtgacatgtagaatttttcctctcctctctccgaactagtgcagaggagagagatgtgcaacttttttatttttattttatttttttgatatttttttcacacttaggaactcacaggaaccaaccatgtaaaaaataaactcaaacggacgaaatatgtggcatgtgaaattttccaaagctctaccgaaaaacttctctcctcgaaaacacaatcttgcaagcggaatttggaggttttaatatcgccgaacccagcaaagctgaggagaatcggatgtaactttttctgtagatgtccatgcatatattatttgcctgattccgagtccgtatgagaaagttacgcctattttaatagatgacatattttgtccgtttcggtagagttttggaaaattctacatgtcacatattttgtccgtttgagtttattttttatacggttggttcctatgttctcctaagtgtgaaaaaaatatcaaaaaaatgaaacaaaaataaaaaattatatctctatgtactgtttaacttatatatgtcatttaatgtggttatattttgaattagattaagtaatttcatatagtggtagagtgcattatgtttaacatgctgatcaaagggttttactaaaggagttatggtctaattttagtgaaggtgcaaagtagactaagtgggtatgctagatattttcagacttagctaagtggtagttcgagtttaaattttttttttgtggttggttgtatcgtgatcctgagtgtgaaaaaacatccgaaaaaataaaataaaaatgacaccgttgtaactccatacagaaaaacaggatggaggcggcggcgccagcatgctggcgccctcctccctggggcggcgccagccatgctggcgccctcctcctgccacgtcggttcacgtgcgccacgatggcaggaggacggcgcca

SEQ ID NO: 86720 - DNA, 2956 bp, Oryza sativa
  unsure (1)..(2956): unsure at all n locations
cgcatatcaattatatgcaatgatctagatcataaactatacaaggcggctctgataccactgttgggatacgcgtaggctatgatagcatagatcaaaattttctatcgcgtaaaccaggaaccatgaagtgttagatcatagatcgttaccactcgacgtgctgcgcagcggaagaagacactgagaagttgaaggaactctcgcgaagtagcgcgcgtcgatgtagaggaagtagtcgatcgcaccggctcgaccttctcctcctcgtgcgttctcctcgccgtactcccacgccgatcagcaccgcaaaccagcggcgcctctaccggtatccacacatacagggacggaacgccacgcgcagatgtgctagcacccgcgcgtggctagggtttttctcggggagggaagtgatggctagggtttctcacgtgatgcaatgtatccgccggtcacacccctcacgaatatataggatccatcactcgggcctccaaggcccgtaggactcctattcggatccctatccgaattaagctcatattggatctctatccaatccccttattccggcccattaagcatgcgacccttggaggttcatatatactcgggtgaaacccgaaaactcctttttgtccacgcgtaaacagcagccnctagcataacgtattgacccaccgggcatacataaaaatcatattttctgaacctctagtgtatacttgtatgaacccctttgcatcacgattatcgattaagctcaaggctagatatgtgccatcctctaatagctcaatcattcactcgaatctgttgatggattatataacttgtgattgactcctcattcacctttggcatggccatgcacttccataatctacaacattgaggggcccagagatatctctccataggaggggcaaatcccatcttgattattcatatcccactacatgtttcatagcatacccgaaaactacttttataactacccaattatggagtagcgtttagcagtccctaagtaagctactacacatgttgagaaccatgataatctcaggtctaaggattcaacatcaacactcaatgagatcactgatgacacaatacatatggctcttgcagtgtctcatgttgggtctatccaacaacatattcaccaacatgtgtccacattattaatttggtatctttataccatgatccatgagacatgatcatcaattaatacatgtgctgatcatataaacacatttgttccacatatgatatttgatttgggatcctttagaaatagtaacaaacaacataaagagtctcatgaaagaatcacatattcattaaccaataaggagttatctatttcaaggaacaatgtcggataaatatgtaaacatagtatgtgatacaatcatctctatgattgcaactagggcatatcactaacagtctcccacttgcactagagtcaatcatgaatgtatcttacgcccattgccctagtgtgtgcctgatgcttaggttgagggagtggctttgtcaacggatctgcaacattgaaatccgtatgtattttgcatatcttcacaactcctcttcccactatctcgcgaatgaggtgataccgccataaaatgttggacttttgatgcgatctaggctccttggcttgcgcaatagcaccactattatcgcaatagaggtccatagggctagaagcactagtcatcacacctagttgagaaacgaatttctttatccaaacagcctcctttgctgcttcagaagcggcaatgtattcggcttctgttatagaatcaaccactgtatcttgcttggaactcttccaactcacagcgcctccattcaggcagaacacaaatccagactgcgatctaaaatcatctttgtcggtttggaagcttgcgtcagtgtaaccttttacaacgagctcttcctgtcctccatagactaggaacatatccttagttcttctcaagtacttcaggatattctttacagctatccagtgactctcacctggatctgattggtatcggcttgttgcactaagtgcatatgaaacatctggatgtgtacatagcatagcatacataatggatccgattgccgaggcatatggaatcacactcatcttgtttcgctcatcagtcgtttgaggacactgattcttgccaagattaatgccatgtgacatcggtaagaaacctttcttagaatcttgcatattgaacctcttcaacaccttgtcaatatatgtactctggcttaatccaattagcctctttgatctatctctatagatccttatgcccagaatatatgctgcttcccctaagtccttcattgaaaaactatttttcaacgatgtcttaacggattcaagcataggaatatcattcccaatcaataatatgtcatctacatataggacaaggcttttcttcgtttttgacaaagcccacgccttgactacttcgtcaaaacgaatattccaactccgagatgcttgctttaacccataaatggatttttgcaatttgcatatctttttagctgattgtggatcaacaaatcccttgagttgtgtcatgtacacatcctcatcgatatttccattgacgaaagctgttttgacatccatttgccatatctcataatcgaaataggcagttatcgctaaaacaatctgaatagattttagcatggcgactagcgagaaagtttcatcataatcaacaccttgaatttgtctgaaacctttcgccaccaatcgtgccttgtagatgtgaacatttccatctacatctgtctttttcttaaagacccatttccactcaatggcttttacaccatcaggtggatcaaccaagttccaaacttgattgacatgcatggattctatttcggatttcatggctcc

SEQ ID NO: 86721 - DNA, 1603 bp, Oryza sativa
attcaacatgaccgcaccaaacatatcgaaattgataggttcttcatcaaagagaagatcgataatggggctcttagactacaatacattaaatcttctgagcagctagctgattgtttaaccaagggattaggtcctagtgagagtgagtcaatgtgtaacaagatgggcatgattgatatcttttgcccatcttgagggggagtgctgatgtaatatgcacttgtattggggaccttcttgcatatgtagctaagtgaaatagtgtgtgtgtgtggctgtgaacaacacaccagaaaaaatccccaaaactgaactttactatctaaggattgtgaaagggtattttcaagaattaagtctatccaacatcatttcaagattttatcacttgaggatccttgatgtacggcaatgcagtggtcactttaatttaccgagtgatatgagtaaccttataaagctgcggcattttcttgacccaaatgattcttttcactctgccattgctaatgtgggaaagctgaaatgcttacaagaattaaagagatttgaagtcaaaggacaagctgaggcatttgcattaagacagatagggcagttggaagagctaaaaggatcactgtgcatttataatcttgaaaatgcacagacaggggaggaagcaaaccttttaaacaaaaggcacttacacaagttagtattagtttggtctgatgattcttcacaagcagaacatgttcttgaaaatcttaaaccacatagcaatcttgcccatcatggttgggtgttaacttgtctaccaaaaacttgcaagctcttcgtttggatagcatacagtggaacaaatttccccctctaggtgagttgtggttggttaatgcgtccggtgaagaatccttgggttgtacaacaagtcagagctttcaaaaattaaaaaggttagagctgcttggcataccacagctagcaaaatgggttggaaatgatgcttcccatgtgttctccctgctagaggtgttcattataagagattgcccagaacttatggagttgccattttcacattcaacttgccctcgatcaggacaggagatgaacttgacccaattccctacactaagggagcttgaggttgtaaattgtccaaagctgtcatcatttcctcacattccttggacaagctctccatgtcgtgttcttattgatgaagtgggatcagattttcagcggttggattactcaaaaaataaccaatctgaattttgcttgaaagttgtgggaaaggatggccatctagatatgtcattctggaatgtattggcatttagtaatctaactgaactgaaagtgttgtatttgaagaaatgtcctcctttgccactgaaacatctcctagtgctatcatgtttgaggagtccctcgatacatgattcaagtaatgtcttgttgaatgttgaagctgagaacactgtcggctgccaatttcagattgagggtctcagtatcgatgactgtaggtgtagcgggaaggaactgacgctgttgctgtctcttttccccaagctgtcaatggtttcattacacggttgtgggaagataa

SEQ ID NO: 86722 - DNA, 698 bp, Oryza sativa
aaaatctaaagactgatacattgcacatactccgaccggacaagacgcactgtctcatccgtgtcgtttgagaagcactcacttagttgcttttagaaaataattcaaataaaatcaattgcaaaaacaacagcctttccttgaagcctgcattaaacacttatttcccctggcttgctgagtactcccgtactcacccttgctctatataaatattcccccccccccctcagttgctgaagaagatgaagcggatcctgctgatgaagagttcttccaggagcaagccggctacgatgagttttaaggtttcggcctagttcccaagtcgcgcctgtgttgattggtccaagtcctggcttccgctttccttttgtaatgcagttgtgagctcgggatctgtccgcagcccaacatgactgtacatctactctataataaagagacctctgttgctgtgatattctgtctccctgtgataccagcactgtttcctgggactggtatcgattaacaggttaatttggagcgtcacgggctagttccggtcgggactagttcggggcgtgacaccaccccgccgcgcgcgccctcctccttggggccggcccaagccgccctccctctctccccgggacgccgacaggtgggccccacctgttgggcccgtctccttcctccagtcggcgccgccgcgc

SEQ ID NO: 86723 - DNA, 1679 bp, Oryza sativa
aattcctgcagccctaccagtcccaggaaacagtgctggtatcacagggagacagaatatcacaaccaccaaaggctttttgttattaaagtaaatgtccagccttgttgggctgcggacagatcccgagctcacaactgcattacaaaaggaaagcggaagccaggacttggaccaatcaacacaggcgcgacttgggaactaggccgaaaccctaaaactcattgtagccggcttgctcctggaagaactcctcatcagcaggacccgcttcatcttcttcagcaactagggggggattatttatatagtgcaagggtgagtacgggagtactcagcaagccatgggaagtaagtgtttaatgcaggcttcaaggaaaggctgatgtttctgcaattaattttatttgaactcttttctgaaacaactaagtgagtgcttctcaaacgacacggatgagacagtgcgtctcgtccggtcggagtatgtgcaatgtatcagtctttagaatttaaacaaggttggcacccggccaacagctttttcaacggccacccggctaacaacttttcaaacggccacccaggccaacaacttttcaaacggccacccgggcctagctgatcccatcagctgcagatttttcaaacaccgaaccccttttcacacagcaatttcacaagcagtagtcaaacaaaactacgctaggaatcacctcacatccgcccgtgaccgtgggcacggctgttcgaacagtttaatgacctctgaagagggggtacgctttacccacacgacattactaacccgggtcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctacccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacactcggtacgttccccggtccgcggttttggaaattcatttagttcgcaagcaccgacccaagtgtcgggttttccaagtcttttgtaaaactccagttttacccaacttgttactcaaattttaagtttgaaggcaaccgtcgatactcgaccaaagtgcccaagtttcgaggcgcacctgggtggttacaaggggacatggtatagcaattaacaatggaaggatcaaatgcgacaaattaagtaagtccgccaatctgcttcgcagatggaacaacagattaagtgtgatcctatcaatgcataatattttgcaagcaacataattgaatttcaaatataggctcaagatgttcaaaggtggcttgccttgctcgagatctggagcttgatcctcaaaatcctcgcactgcgggtttcgggctccgaaactacacgcgaaacggggcaactcaacaaacagcgaaaataaagccctattaacgacctctaagcgtgccattagatagatctcgagatttgatgaattttggaa

SEQ ID NO: 86724 - DNA, 786 bp, Oryza sativa
cccatgagcactttgcaccgatagaacacaatgatcaaacgcctgaggaaaatcctgaggaggacaacattgtagatactcgcaagcgtaagagacaaagggttgcaaaatcctttggagatgactacattgtatacctcgtggatgacaccccaagaaccatagaagaggcatattcatctcctgacgctgactactggaaggaagcagtacgcagtgaaatggactcgattatgtctaatggtacttgggaagtcgttgagcgtccatatgggtgcaagcccgtaggatgcaaatgggttttcaagaaaaaacttaggcctgatggtacaatcgaaaagtacaaggcaagacttgtggccaagggttatacccaaaaggaaggcgaggacttcttcgacacatactcaccagttgctcgcttgaccacgattcgagtactacttgctctggcagcctctcatggtcttctcgtccatcagatggacgttaagacagctttcctaaacggagagctggaggaggagatctatatggatcaaccagacaggtatgtactagaaggtcaggagggaatggtgtgtaaactattgaaatccttgtatggcctcaagcaagcaccaaagcaatggcatgagaagtttgacaccacgcttacatctgcaggctttgttgtgaacgaagctgacaaatgtctatactatcgctatggtgggggaaaaagggtgatcttgggcttatatgtcgatgacatactgatctttgggaccagccttaatgtgattg

SEQ ID NO: 86725 - DNA, 1832 bp, Oryza sativa
tattattgaaacagatgcatcgcagcagggttggttcctgtattaaaacaaagacctgctaaatactcatctaaatcagaggaaaagatatataggtatgcctctggaagaccatacagatcgagaaacctagaaatatcaacgcgataatgcttttaggttatatctagggtttaaagagtttacggttagaacggactgtgaggtgatacgtagatattataatcagcttaatagcaagaagaattctactaggaggtggatcttatttgaacaaatcattactggaaatgactataaagttgtatttgagcatattaaggggaaagataacaatttgcctgatctactttctcgtttacctattttgcaggtatgaagaaatctatgaattataatggagttgaattcttcacttttggggaagataataaactcagaatattcccaccaaactcttataaatttaaaccaaaggaccatataatcatatatgaagtgcaagaatgtattctggacaatttttggtatcaatataataatatgaagggctatatcctatcaatattaaatagtcttgctgaatattttcatttgataaatgaattaatgccagttgcaaaaaatattgaagccatacagcaaaagcccatttatgtggtttttgaaggaagagtaccaggcgtctatatatcctttgaagagataatatctcaaaaaatagacgcaaagctaacagtaggaatatcatggaagaaatataaagacattgaagaaccattaggacaagctaggaaaatattgggaataaattattatctagagccagcggcaaaggaatatattcaaaagtgcaagaggctagaaacaagaaaaatccagagcccccacattatacaaatataaaggaagaagggtcatccagaaaattgacatataaagaatgcttaacaaagggattagaccccttagatagtgaatatattgatttaaagataaatgaaaaaattgcagaagtctcgactcagtgaaagaaagatttaaaggaagaaattttcaaagaattaaagcaagaattaaatgaaaattttgaagctctgaagaaagcatatgatgagaaatttgaaatagccttttctgatgatgacactatggatatcggtggtcatgggcaaccagacgaatagttattatatataaagacctcattgataaggtattatcaattatacgggcatggtagaccatatatctatatctgttgaaaataaaaataagattacaaaggtctgtcgttatatcattttcttcaagagaagacgttcaaaattttgtggagaatattccaaagttcaataattaccaaagagcatcaaatatggtaaatattctctcatataatctaaactagcatgaatgcagaagacaacaagtcacaatatgctaaaggtaaaaatccaacttctcgggaataaacagagcactcgtgatcagaagaagacatataactctctgaagaacccatgatgccacagtatgataaaaaaatatatgagtgaagattgagctccctctccggcttctataaaaggggaagttggtgaaacagaaggataccaagaggcagcaaccctcagccagagtctcagaagccactctctaagctttagtagtagaaatttattaagagttcgccttgctagtatattgaagcaaggagtgcaatataaattgtgtaaggtaagcaaaccttgtttgtatcatcatccctcggggttcccgaaaaggaaaaccatatgtattctattttgtggtaatatagtagttttatt

SEQ ID NO: 86726 - DNA, 2032 bp, Oryza sativa
aactgagatactctcaaatcattggttcattgatgtacttggctagcgcaacgaggcctgacatctcatttgctgtaagcaagctgagccggtttgtctcaaatccgggagatgatcattggcaggctctggaaagagtaatgcgctatttaaagggcactacgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagtagaccatcttaacgaggtcaacaatggaagcagaacttacagcactagatactgcgacagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctggcagatcagtttaccaaggggctaccacgtaatgtgatagacagtgcatcgagggaaatgggcttgatacccacctaaggttgtataatagtggaaacctgtccattgtgatcggagatcccgtgaatttggatggtgaaacaaactattgtgtgactgagagaagagacccttgaaaggggctcattttcatgatgtgcttatcttctttcctgcatggtaggatggcttatgtattaatgtgatccgagtggcttttccaagcagagatgttgacctgcagaacatctcagaaggaacacacctatatgagttcgactgctagtcacagtctatgaggtttgggcgatctctagatactcatgaaaggcctggagtttgacttatatgctccaaacagaggggatacgaacggcagtccagtaccagtcaaggttctgagtgaaatctgatcacacaaaactcacaattcaaggcatagtccattgttcagttgtggtctgatgtagctcatttcctaggtggaagttcaacttaacagtctccaccaaaaccctggtatatcaaacaggcacaacattgagaacatttcttatgagccttgaaatttggtggggattgttagaataattgggctaggcccaacttataatattaaatctcaaaggcccataataagtgttgaggataataataccacctcaggatttaagcgagaaatatctcaacctaaatagggagttattggaggctccctgttgaccagttgaggcaggggtcggaatgccacacgcgcgcgcgcgctccgggccgtgggcgtgggcgagggcgagggcgagggcgtgggcgtgggcgtgggcgtggctggtgtcacaccctgaagttctcctcctaagcctaaaattgaattaataagagactctaagaaaacaccggtgcaaagcaagagtaaaccctgctaaatcaatgcaaataataatcggaattggcatgtggaatttttcttgagttatacatgtcgaaattcactaacaagatttttagtggaattttcagagctctcaaaataattttaaccatttaaaatcgagcttgcaatattttaaatcccagggaaattcttttcctccttttcttttgttttcctttcccctccttttcctcttcttgggccgtcggcccaatccacctgtagcgcccgttccgtcgtggcgcctaacgggaaaattatctcttaaaaaacctaattgcgaaatttgtttctttgcttgttgtctagtgtccgtgccatctcaagatctcaatccccgatctatcgtcgagttcaaatccaaatccaaatccttccaaatcaaattcctccgcaaaagtctattttgcctcccccgggggtcgatgggccgatttcctcccggcccatctacccctggggg

SEQ ID NO: 86727 - DNA, 1241 bp, Oryza sativa
taagcaagttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacgaacggaagacgtgacatagtttccaacccatcctagccatagacaagagtaccgacccaaccccacctacggccggaacccccgggacaggcaggcaggattgagccccctagcagcaggacacccgccctgtgccatgacatctcgactaccgggccgcagctcgtgtagccttcatttgtcctagagatgtccatcgaacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgaatccaattccacaacaatccaaccattccatagtgtccaagtgatatgaatattaccacagtctagagttataaaaccacctaatgttgcctaattaatcagcgaagcatctacctaaaatcatactagtgataccacgagtagagtgtccactagttggggtttcgtttattctagggtgagcaaagaaataataacaataacaataataaggtcataacaaaggtaaataggcatggctaattaaaacaatgataacgcgggaatttaaataaagcgataatgcattaatttaaatcaaattaattttataaactgggattcaatatgctcaaggatgatgtgacttgccttgctcgctttcccaaacaccggcttcaacttccacgaagagcggatcttccgaagctgcaacgtctacacgaccaacggaaaagaaaaggcttttactctaacaaactccatataacaagcaggaacaaagcacaaaaatgggttcttgacttcttaaggaaaaattagagacttgaacggtccaattccgagttcaaatggccaagttatggccatttgaagtttatatgctctttaattgaatatttgcgaatttcttcatttaaattttaatttaaaattggatttattgcgtca

SEQ ID NO: 86728 - DNA, 1308 bp, Oryza sativa
gtacgatgggagcgtcaaccccaccgagtttctccaggtctatacgaccgggattgaggccgctgggggtgacgacagggtcatggcgaacttctttcccatggccctaaaaggacaggcgcggggttggctaatgaacctgccacccgcgtcggtccactcctgggaagatttgtgccaacagttcaccatgaactttcaaggcacatatccgcgcccaggtgaagaagcggacttgcatgcagtacagcgaggcgatgatgagtcgcttcgctcgtacattcagcggttttgccaagtccgcaatactataccatgcatccctgcacacgcggtgatctacgcgttcagggggggtgtgcggcacaaccgcatgctcgaaaagattgcctccaaagagccccagactaccgcagagctttttcagctcgcagaccgagtggctcgtaaggaggaggcctggacctggaactcctccggttccggagtggtagcttcggccgcccccggatccgccgctcagacagggcggcgtgacaggaggaggaagaagaggccggaccgttccggcgacgagggtcatgtcctcgccgtcgagggcgctccacgggccactcgaaaggggaggcctgcgagcgacaaaaagaatgaggctggtacacccagcagggagcgcctcgccggcaggtggtgctctgtccacaacacctccctccacgatctcgcggactgtcgtgcggtcaaaaacttggccgagcgaacgaggaaatgggaggaggacaggaggcaggaacgccgtgagggcaagtccccggcggttccttccggcaaacggcgaagtgaggccaagcagaaggcccccgctgttgacattgatgatggtgatgatgacctaggtttccaagaacctggggccaccattgccaccgtcgatggaggagcatgtgctcacgtctctcgccggagcttcaaggctatgaagcgagagcttctggccatggcccctacccatgaggcgatgcgtcgggcgcggtggtcggaggtcgctctcactttcgaccagactgaccacccaccgtgcattgcccggggagggcaggttgcgatggtggtttcccccaccatctacaacgtgaagttgggacgtgtcctcatagatggaggagcggctctcaacatcctttcccccgcggactttgatgccatcaaggccccggggatggtgctccgaccgtcccagccgattatcggtgtgacgccggggcacacgtggccattaggtcacatcgacctaccggtcacctttgg

SEQ ID NO: 86729 - DNA, 5175 bp, Oryza sativa
gctccggcggtcggcgaccgaaacggagaggtggacgaggtcggcgagaatgcggtgaagccgaagaagtcggcgccgaggtgggaggtggtccggggcgacaacggcggtggaccggagctcggcggcgacagcggagagagagagcgacggcgcgagctcgactccggcggggagagagggcggcgagtggcggaaacggtggtggggagctcggggagggtttatatagggttgggagtgagagagggcggccggaggagggggaaatgggcgcgggagacccggccgccattaatggcgccggcgaggttaggggaacggtttccaaacgaatccgagggagagagggagggaaaaatggggggaaagggagagggaatcacggggaataattccccccactttattgcgcgcggggacggcgggacgcggcgggattcgcagtggcggcggcgctaggcgcgggcgaggcggcgggagcggcgggaggaaggggatgacgggtaggccccacccgtcagcgagtgtggcgggcgggcccgcccgtcagcggcgcgcgcgcggggagaggctttcacacggtttttaattattctaggcatatcttagaggatgtattttagagtcgttttgggacgtgacaaacctaccccccttaaacggaatctcgaccccgagattcggaagaactggcaaaaagatcgggatgggctgccttcagctcgtcttcacgctcccaagtagcttcttcctcagcgtggttgctctattggaccttgcaaaaacggattactcggttcctggtcctgcgctccatggtgtccaggattttcactggcctctccatgtaggtcaagtcttcgcgaacttcaatttgctctgggtcggcctgctcggacggcactcgaagacatttcttgagttgcgacacatgaaacacatcatgcacgttgcccaaggaagcgggcagctccaactggtaagcaacttctccgcgtcgagcaatgatacggaaaggacccacaaaccgaggtgcgagcttccctttcgtctgaaacctgtgtacacaaaatcgtccactgcgaattccagattacggcgtcggttatctgcataactcttctgccaggactgtgccacctttagattatccgaatggttctaaccttcgcttcagcttctctcaagatatcggtcccgaacacttggctttccccaacttggtcccacaatagcggtgtccgacatttgcgtccatacaacgcttcatagggtgccatttgtatgctggcttggtagctgttattgtaggagaactcggcgtaagggagactcttatcccaggtcttcccgaaatctaggacacatgcgcgaagcatatcttctaggatccgatttagacgctcagtctgcccatctgtctgcgggtgatatgcggtgctgaaatttaatcgggttcccaactcttcttggagtttcttccagaaatgagaggtgaactggcttccccgatcagatacaattttcttggggacgccatgcagacttacgatcctagcgaagtagagtttagctagtttgttccccccgtatgtggtctttactggaatgaaccgggctaccttggttagtcgatccacgactacccatatagaatcatatccgccttgggtttttggaagtccggtgataaaatccatcccaatttcatcccatttccattctggcacttgtagaggttggaggagtccggccggtcgttggtgcttggctttgatgcactggcacacatcacaaagggccactaactctgcaatttcccgtttcatactaacccaccaatatttctctttcaagtccaagtacatcttcgtgctgccagggtggatggaatagggactttcatgagcttcctgaagtatcaactgttttagttccctatcatctggaacgcagacccgatttccgttccatagggttccgtgttcatcctctgtgaaaccagcggctttaccctgtttcatgttcttgaggagcccatgcatatccggatcattcttctgagcctcgcggatttgatcgagcaaggtaggcttggcttccaacgtagccaagaatccacgaccaactatgcttagattcagggcttccatctgttgattaagttccggtggaatgccacggacgccaagagtgttgcaatggcttttttgacttagagcgtcggcgaccacgttggccttaccaggatgatagtgaattcccacatcgtaatccttgatgagttctaaccatcttctctgccgaagattcagatccgactgagtgaagatgtatttcaaactcttatgatcagtatatatttcacagcgattcccaatgagatagtgccgccagatttttagagcatgaaccacagcggctaactccaaatcatgggtagggtaattgccttcatggggccgtagctggcgtgaggcataagctaccacatgaccttcctgcatgagcacgcaccccaatccttggcgcgaagcgtcacaatacaccatgaaatccttgcgagtatccggtaagattaacaccggcgaggaaactagcttttctttgagagtttggaacgctttctcgcattgcgggctccacacaaatttctcttctttcttcaacaactgtgtcatgggtcgagcgattttggagaagttctcgatgaacctccggtagtatcctgccaaacccaagaaactgcgaatttgagtgactgtcttgggttgcttccaatcagtgacggcggtcactgtttcggggtccacagcgactcctttggcagatatcacgtgccctaagaacttgacttcggacaaccagaactcacacttgctaagcttggcatacaattgatgttcccgcagttttcccaacaccagacagagatgcttctgatggtcttcctctgattgtgagtacaccaggatgtcgtcaatgaagaccacaacgaacttatccaagtattccatgaacactttgttcattaagttcatgaagaaggcaggagcattggtcagaccgaacgacatcaccgtgaattcatacagtccataacgcgtggtgaacgcggtcttcgggatatcttcttcacgaatacgcaattggtgatatccggagcgaagatcaatcttggagaatacagtggcacctttaagctgatcgaacagatcatcgatccggggaagagggtacttgtttttgatggtaacttcattgagagctctgtagtcaacgcacatcctcttcgtcttgtctttcttctccacaaaaatcataggagcaccccagggggaagtactcggccgtatataccccttttctttcaactcttccaactgtttcttgacttcggccagttcatttgatgccatacggtagggtcgcttgtactggggagtggttcctggagcaagatctatccggaactcaatctctcgcttgggcggcataccgggtagttcttccggaaacacgtctctgaactctctggcgatggggatttccgacagtcctatctgatgaagttctgaactaccaacagaggttgggggtgcaaagaaaacaaccggttgttccggccctcggtacagagtgacagtgcgtcttgcacaatccactactccttggaattgagccaaccaatttatcccaaggatcacatccaagttcttggtgtctagaagaatcagatccgagggaaatggaattccctgaatttctataggaacggcagggctataataattcgttgtcataacccctccaggggtggtgatgagtagagggttcctaagcctttctacccccaactgatttctccccacgaatggcacagatataaatgagtgggaagctccagagtcgaacaaaatggtagcagggatggaatgaatgaggaacgtaccaacgatgacgtctggagttgtcagcacgtcctcggccgtcacgtggttcacacgaccccgaatgacatccttaccaccgttgctggagcggggaggcgcttggccttgctggcgcctcagctttgggcatttatccgcaaagtgcccaggctcgaagcagttgaagcacagacgctgctgaccttgaacgtccctgcggccttggccaggctgcacggctggcgtagggggacggggcgcacgagtcccttgctgactctgctgttgctgcgtctgtgggacgcgcaccacgaattgaggtcggggcgcggagcgaggttgctgctgctgttgctgctacgaggaggatcccctggatagggattggtgtagcggaccctttggttagccccctgttggttgccgaaattcgccaagcgacgcttgtgcgactctagttccttgtgcttggcttccaagcggatgctcttgtccaccagacgttggaaatccggatagtccccggagaccagacgcacagacagctcagggtccattcctgccaagaacttctcttgcatctcctcatcttcccgtacctcctccggggcgtaccgggccaggttgttaaactcatgcaaatactccatcacggagcggttgccttgcttcaactctcagaattcccttttcttaagggccatgactccggcaggcacatgggttctccggaaagcggcggtgaagtgggcccaagtaataggctgcccctctggctgcgtagcctggaaatggtcccaccatagagatgcgggcccctgcagttggtgggcggcgaagatgactttctcctcattgctgcactgcacggtgtctaactttttccccacggcatgcaaccaatccaacgcatccacggggttattggagctagagaaggtgggcggacggatgcggaggaactcggcgagtttagagtgttgtgggggtggtggtggagcattatgttgtggcggattttggatgtggtggaggaaagcagccatcatgttggtctgctgggcgaggatttgggtaaggatggcgttggtgtctggtggtggtggtggaggcggaggaggaggtggaggtgggctgccatggttgttgtggttgctaccttcgggttggttgccatcaccggtattagcattcctcctggttgtcaccatctgaaataccccaaaacaaaccagccaac

SEQ ID NO: 86730 - DNA, 2950 bp, Oryza sativa
gcagcggcaacagatgcaggggaccatcggcttctttcgctacccggggcatggcgccgccgcggagctcgcgcacgtgagggcatggtggtccccgacctcgcacgccgccgccgccgactgggacgacggcgccgactgggagctgcccctgcaatgcaacgggctcgtgctggtgttctccatggagaagagcctctcctcctctctgatgttcgtctgcaacccggcgaccaagaagctcgccgtggtgccgcccggtacgccggacgcgcacgggaaccaaagcgtgggcttcggcgccgacaaatctacgggcaagatcgacatgaaggtggttcgctgcttcgcccgctcagacgagagcgtcgggtgcgaggtcttctccctcggatcgccggcgtggaggccggtcgccgactcgccatgccccgtcagggccggcgccgcgtcgccgtgcatcctcggcgccatctactggatcaccaccgcagcgccaaccccagggatgctacgcttcgacgtgcgccgcgaggtgttcgacgatttcccgagcccgccgtgcgtgcatcacgacggcacttcgccggcgaccgcgaccctgacggagctgtccggcaacaagctgtgctacgcgcacgtcgtcgccggccataccgttgagctctggacgatggcggctgcttccgccgccgacgacgggccgcggtggtcgcggcattgcgccgtcgagctatggcgccccactcagctcgtcgtcccgtttgccgacgatcgccatggcggcatcttcttcaacttggatctcgccgtgattgacaggcatgacacccaacgccaagttgttgaacgtgtggtcgacatgaacaaggagatgacctacttccattcaagggacaagcagtactacataaatcgtggatttaggtggatgcaccatgtcattcagtacagggagagcctagtatccgtaaaagcgaattaattaagggattgtatcagccaaaggaaattaactagattgacttctgttacaattttatatccaggaaagttactgagagtggatgttcacccctttcatgcatttgagtgggaatgggttctaatacctcgcaggatgtctcgtttacctttcttcaatcaaaattcaatacaaatgagattgtgaaaaattctagaaaacttttgacaaggtagagtacaacgagatcaatgactccacctgtccaccagcaaatgttagaacgcacaacgtgagaatgcatcgccggccaagcggcagcgtgcccccgccggcgccgccgaggccgacatcgtggagcaaatatttgtttgcaatccgtgttgccggacacggcacgccggacttcttcagtgcccaaagcgtttcaacaaacggaggtctcaaagaatgtgatgacacaacagaagataaaccgaaatcagcagaacactgaattgccacaactgaatatcagagtcaggcatcataaatgacgtgttccattcttttcttttcgccaaaaaaaagccgaaatcagcagtacactgaattgccacaactgaatatcagagtcaggcatcatagatgacgtgttccattcttcgtttttttacaaacaatacaattttgtgcgatttgaacacatgtcccatcaaatatgtacaatatacccacaagatttataatatactaacactttgatcagccgaaatgaaccgaaaacagaattgtcagccgaaatcaaccaaactatattcgagcacagtctaatttattaatttgcttggatggataccaagctctcactgtactgaatggcgtggtgcatccaatccccatcacagcggtacagcttgcaccttgaactgtcgaagtaggtcatctcctcgagcatgtccaccactcgttccacaactctgcgttcgacgtcgtaccggtaaatcatggcgtaatccacgtagaaacatatgcctccttggtaatcgtaggtaaactggaagaaggtgtgaaaggagtgcggtagcacgacggtgcattgcagcgaccaccgtggcctgctgccgcctccgtcggcggcggaagctgtccagagctcaactctatcgtcggcgggagcatgcacatagcacagcttgccacccagctccgtcaggtccccacaagcgacgtcagacatcttctgccgctccatgaacggtgggcacgggaaactggcgaactcctcgctgcacacgtcgaagcgtacaatccctggggtggtgcagctgccggtggacggcgacggtagggcggcgatccagtagatgccgccgaggatgcacggcgacgttttggtcttgatgaggtagggtgggtcggcgaccggcctccacgccggcgagccgagggacaaaacctcgcatccgacgctgtagtccgtgtaggtcttgtcgcagtggcggatgaagcagtggaccaccttcgtcttgcccgtagattggtcggcgtagaagcttaccgcttgcaccccgaagtagtccagcgcacagtccggtagctcggcaagctccttggtcgccgggttgcaaactaacatctgagtggagtacttcatcgtcgagcgcagcaacacgagcccgttgcagtgcagatgcatgccccagccgatggcgccaacgtcgtcgtcccagtcgtcgtcgtcgtcccagtccgcggcggcgtccccgtcgtcgacggcgtcgtccaagttgtcggcggcggccccgtcatccgcggcatcggccccgtcgtcgacggcgtcccagtcggcggcagcgtacccgtctgcggcggcggcgacggtcgacttcgagttcgaggaccatgttatcctatgcgcgaagtccgcggcgacgccatggcccggatagctaaagaagtcgatcgttcccctccattgctctggcacacaccagtctgccagga

SEQ ID NO: 86731 - DNA, 2599 bp, Oryza sativa
ccgccgctgttgggcgtctacgacttcaccatcggcttgccttcgccgctgccgactggtgtttccgcctgcacggctggcctttatgccgccgttgttgggcgtctacgtcttcaccgactggcttgccttcgccgctgccgactggtgtttccgcctacacggctggcctattatgccgccgctgttgggcgtctacgacttcaccaccggcctgcctccgtcgccgccgattggtgcctccgcctacacggctggcctattatgccgccgctgttgggcgtctacgacttcaccaccggcctgcctccgtcgccgccgattggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccatcagcttgccttcgccgctgccgactggtgtttccgcctgcacggctggcctttatgccgccgttgttgggcgtctacgtcttcaccgacgggcttgcctccgtcgcccgccgattggtgcctccgcctacacggctggcctattatgccgccgctgttgggcgtctacgacttcaccaccggcctgcctccgtcgccgccgattggtgcctccgcctacacggctggcctattatgccgccgctgttgggcgtctacgacttcgccgccggcctgcctccgtcgccgccgattggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccaccggcctgcctccgtcgccgccgattggtgcctccgcctacacggctggcctattatgccgccgctgttgggcgtctacgacttcaccgccggcttgcctccgtcgccgccgagtggtgcctccgcctacacggctggcctattatgccgccgctgttgggcgtctacgacttcaccaccggcctgcctccgtcgccgccgactggtgtccccgcctatacggtcggttggtcacaccaccgttgatgggcatcgtcatcttcaccgccggcctgcctccgtcgccgccgactggtgcctccgcctacacggctggcctattatgccgccgctgttgggcgtcttcgctttcaccgtcgaccgccttcgtcgccgccgactggtgtcttcattgttattgatggacgactttgttcccatattggccacttctgccatcaccaaggggaatattacaaagctaagtcatcatttattttattctttatatgatattttgccttttcctctgcctcactacaccaattggtcttccattgagtagtgagtcgggggctacagatgttatatcgtattttttaaacaattttcataatatttatcttgattgcttgcgacataatctgagtacaaaagtacctatcgagttatggagttctatcttcctatgctttctgttcggtttgccaatggatggttgcctttgggccgattcctagcacccgggggctcgttggatggaccgaataacgcaaggtgctaagtattattcagaataaatcaaaagcatagagataagataatttattttctgctcttaataattgcaaaagtacccgagtagtaaactccgatccgtgaaactttgttccattaatgacgaactcatgacactcatatgcatgtttgggaagtgcttaggccgactcccagtgcttggtggctatgactagtcgggcagagtgcttaaacgtaatgagtcatctgttcggggaaatcaaaattgacaagaggagaaatacatatttataaatattttaaactgcttgaatttttctcgagtattatatttatatcagatactactcatcctatatgtttgttctgcaggatccagatccagatatgcataaaagggattcatggctttaagcttatctcttacgctccaggaatggatcagtcagaacaccaccaccggctcgcctcgaccgccgccgactggtgttcccgcctgcacggctggcctattatgccgccgttgttgggcgtctacgtcttcaccgaccggcttgccttcgccgctgccgactggtgtttccgcctgcacggctggcctattatgccgccgttgttgggcgtctacgtcttcaccgaccggcttgcattcgccgccgccgactggtgtttccgcctgcacggctggcctattatgccgccgttgttgggcgtctacgtcttcaccgaccggcttgccttcgccgccgccgactggtgtt

SEQ ID NO: 86732 - DNA, 6894 bp, Oryza sativa
tggtgtttccgccggcacgcctgccctttatgccaccgttgttgggcgtctacgtcttcaccgaccggcttgctttcgccgccgcggactggtgtttccgcctgcacggctggcctttatgcccccgtagttgggcgtctacgtcttcaccgaccggcttgccttcgtcgccgccgactggtgtcctcgcctgcacggctggcctgttatgccgccgttgttgggcgcctacgtcttcaccgaccggcttgcctttgtcgtccccgaccgatgtcctcgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggtcaccgcatccgccgctgactggtgtcaccgcctgcacggctggcctgttataacgccaactgatgctatcttcttcacggctggctacatcgctgtcactactaataggcatcaatatcttcaacacaagctgcctacgtttgccatggctgccgactggtttcttcacttccatggctacatgattctaccagtgttgattagccttatcttcttcaccgccggtcatctcgtctgctgttgactagtgccctcgcctctacgtctggtttatacagctaccactactgatggacatcatcgttttctgccgccgactcgtgttatgccgccgtcgactggtgcttttatcttcacaactgcgcgtcttcactaccggttcacttcatcacggcaacacaactttgtcatcatggtggaccgacttcatctttattatcttcggaaccagcaaactctattgctgctacttaacaagttttgctacatcaccaaccatgacgttgttgtgaatctcgacatctcggcatgcgatgccgtgttattttactacaacaagtggctctccaatattcaggatttctacttggacatcttcaacacatatcttcaatcaagcaataattattcgacgacaagatgctacagttctcgactctatgttcagttgtttcccaactaatcaaagagtcgggggctacacaaatacaaggctcaaaatttgacaaattttatataagccaatgagtcaactccaggagtcattatcttcatctttgcttcggaacagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcatcaacatagccaactctgctgccgttgatgggaaacttcgtcatcatagtcggctatctctgttgccgctaatcatcattaccgtcggatgcgtttgtcgccgccgattattttcttcatcttcatgattggtggatttcgccatcaccgttgatgcgcgtctacgtcttcatcgtcggtttgcttttgtcaccaccgactgttctttcgttgttgttgggcgcctacatcttcactgctagctgacctgactgttgccgactggtttcttcacctccgtggttatgcaacttcattacatttgattggtggcatctttactaccactgacatctttcgttacttctgatgagcaatttcgtcttcatgttggtcatttcatctccatgccgactgcatcagctaccatcaatggacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttatttttggagtatcccataagggataatcattcagatcagaagctattcatatgagctacacttggtctatattacccggaagatttattactcaggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctggcccgctgacttttttatatagtcatggtgctgtttgggtttttaagcaattgattggatacaatatcattgctttttgccacgtaagtgtgcatttttattgaccaatattatggcttaggctgattatatattgtggtcattttctaggcggttggtaaatcctttatgagtttatttactcggattttacaccacatatgccatatatttccaggtgtggtgaaaccatgtgtcttctagggacttaagtacatctgttaaagcagtgtgcgcatggcgtatgcccaatactttggaaatttctttattcacaatatacaagcttctttatagctattttgctatatcactcatcatattttacaaagcggttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagataattgaagcactcggctttggagtaatctggttcgagagaagattatcttttcgactgcgaaggtctcaggggctactgtggatattgtgggtaccccatacccatacggcatggttatccgactagtcataggggataacttatatctatggaatatgtaatagatcatgactcgggtattacgtttccttgtatattacggaacggcctaaagtcctggtttgataatattgtaaagtagatttaggaaaccgataccgtattggttaatgtttctatcttgtaatcctgccccccatcctatataaggtgggcaggaggccctctagggggcagatgacataacctgatcgtcagatcaatacacactcggcggattcaaatccccaaacaggagtagggtattacctctcattgagagggcctgaacctgtctaaatcctttgtctctgcatccatccacttttaggtctcgtgcgctacccccttttattattgccgaatccatgtttcgacagattcgtcgtcaacggcgcggcccgggccggggaacacctggggtacggcagtagtatagcatagcagcagtagtcaagcggtgttgggtgttggtgttgtacggcagcctgcaggggggccagagtggtgtggacgtgttggcagtgcgcgccatggttggtttgattttcgtttcttccagagggggggtggtggggttgagcgcaaccaacggtttttttctcttttctaaaaaggaagaaaacgattccgtccagcgattttgtgctccgctgcttttgggcgataattttgtgatctctgggtggttggtatgtcgaggttgtaacacgtttcttttcgtgtcgacactaaggccctccaagacgaaaaattttggcatgtcacatcatatatatggataaatattaagcgtagtctaataataaaataaattacatattccgcctataaattgcgagaccaatttattaagtctaattaatccgtcatagcaaatatttactgtagcatcacattgtcaaatcatgacgtaattaagcttaaaagattcgtctcgcaatttacacgcaatctacgtaattagttttttttcttgtctatatttaatattccatacatgtgtccaaacatccaatgtgatagggtaaaaaatttttgtttggaagtaaacaaggcctaagtgtccctttgatttggaggaaaaacgtaaaattttaaagtttttcaagcctataggaaaaatttatatgaattgattgaatcatatcatatcctttgaaattcgtatgggatagacaatcctacaaagattttggaggaaatttagcaaaagctcttacctcttggaaattttattttgagtctatctctcttatttgatttctatgtttttttacatgttttgcaattttgttttacacttaaattatatcaaaatcatatgtttaattctctgttttctcctatttatacttatgcatagggctgagctaaaatacatttgcaaattacatagtactagtatttttgtaagattagtattttaatagggattatggagtgactctaatccttacctatcctatgccgtctctgcccatggtttgatggacttaactgaaatggtggtagcaaatgtcagaagtagaagcacaaagcatattgggatgcctgttttaaacgtgggatttcttttctatttttttagttatttcatatgaaattctttgtaaactcgtgcactctaaatcgttttgtgagtcacatcacttctcaggcccgccaccttgttttaggtgattaccttaaaatgacaataaatctgtccatttcaactcgatttttttcaatatttctagttgacagacagtgaacccatttttggtaccagtcgagaaattgtggtggtgacaacattgccatatgaattatccagctcaaaaggaatttgaagtgtatacaataataacctgacaaaattattttgaggggatcaattccattgcctccttgagcaatctatgaccatgaattttcagttgcaaagttggtttatcagccacatgggatgggactgaaccctaaccataaactaggtggcaaacgcactgatgcagctgtctcctcctcctccactgtgtgaaccattttttatagtgcagcttttgagcctgaagagagagggcatcagcaagcaatcaagcactgaatcatcactgcacaacacaacaactctggctcacaaactctgaactttttaggttggataacgctgttggtttcagcgtttcagatgacaagaataacaaagaaatatctcctccaatttgcagtgaaaacgaacggcaagttgacagccacatcaagcaatgacactgcacatacatagaccactatgatcagtattgacaaccacagtatctacagaaaattttcaactttttttcgtcagagtgacacgctcttggttctttcttttcccttttgtttcacatcacaagagggaccaaatggaaagcaaaatcacaagatatcccaataggccatggttccgtgtgcaatctaccttgacctgttgatgcgcaagaaaatggcctcttaactgcagcatcaccagtgtctccccacatatattccaaagccaaatctattgcccagagaagggagaaaagaaaacagtaccaaccttgcataaaggttcaggaacccatgcacagatgtacatgtatgtactctctctgatctctgcttctgcaagaaatgcatgtccttttagtgcatatcatgtcaatcttctcaaaacattaagcgttaagcatcaatatctctttaaatatttagattggacacatgaaaaatttatgggtagattttatatcaccaaatgctactctttccatttcaaaatacttactttttaacatgttgtttaatgtgttgtataaatttctaaaaaagaattatagtcaaaattaagaatgtttggcttagcacaaaacaaatattttgaagaggagggagtaatacttttacgatatacattacaattttttccatgttatacatacatgttgcaataggaaaatggttagccaaagtttgtactccctccatcgcaaagtaatacccgattggacacattctattacgaatctggaccagtattaggagaaagtattattttgttaaccattattaaaaaaaatcagtctcccaaagctgccacctttgctggttttcttggtttgttcagtttgttgcttgtgtgtcccccagttgcatataaacatgggcatgtcacacctcacaacccccctttgctttggccattttctcaagcacctaatttgcttggatccttcttgcacttgcaacttgcaaaacaaccaaaggaaatactagtagcatcatcaagcgaagaaggtcagctcaaaagggcgttgtgtgcttcgcctcgcgaaatgagagtcgcattgctccggagatgatggtcgccggagtaatcaggagcaaccaggatggcggcggcggcggcgggacggtgtccggtgcggcgaggattagcccggcggtggtgttcgtcctggtgatattggctgtggtgctgttcgtgtccgggttgctgcatcttcttgtcagattcttgctcaggcgcggccgtgggcgagatggcggcggcggcggcgacgcggaggcggcggagggtgtggaggagtcggcgttgcaacggcagctgcagcagctgttccacctgcacgacgccgggctggaccaggacgtcatcgacgcgctcccggtgttcatgtaccgggaggtggtggtcggcgt

SEQ ID NO: 86733 - DNA, 774 bp, Oryza sativa
attttttttttcccccgccgccgccacggaaaaagagagatatttttccccccccccaaggaaaggattttcttgagcaaaacccaatggcaaagtcatcgtaattgtaataacttattcgcctcttgcgtttcgtgaaagtaccacctttatgctgctacaaggtacctacaaacagtccattagttctcaggaccacgtctaccattttattatcagacatcacgattggtgttcatttgtttcaggttgctacttgaaaccaaatatcgcagattgcttgttgttgatagcactggtaaattggtgagttgatctgcctttccttccttccgctttcgtttcagtagtatctagtcttaagtaaagtttcttttctcaaggttgggatgatcacaagggggactgttgtcagagctgccctcaaaataaagaagacagctgaagaaactgcttaaattagacagtgtagatgattctttataagtcatttctgggactgcagtcacttggaaatttagtccactgaaacattatttggtgaaatgaactacatcagccttacagatactgcgaattcgacagtcaattcttcttggaacatagatggatataggtattgtattgttgcagatatttggaatatagccgcaatctgtttggggccaccagatttggtcgcctctccttattaggtagcataacatggagaatgttattatttttatttttacttttatcattgacttgtattcaagaacatcagtgtattga

SEQ ID NO: 86734 - DNA, 5963 bp, Oryza sativa
  unsure (1)..(5963): unsure at all n locations
ccaaatcaacagcttccttaacaacatctacttactgctgctgctttttttttttttttggggggggggggctatatattcatcttttttcctctttttttgctggactacacaacaccgctcccatcccaaatagtactctatttaattagtgctttgttgctgctgttgttattgttgtgtgctcatctcaaattagtgcttcttctcaaatctcaaccatatgtgtacctttcttccttttctcttggaatttcatgaagctgtctgtattcctctaactgaaatatctattccttttcttttgtgtgagtgggaggaatatctattcattgtttcccaaaaattcgtcataaatgattttcccattaattctccaaactgatttattttacttcgaatatattcatacatactgtataggagtatgctaggagtatacatggatgaactataaagtttcaaattaatcattattaatttctgatgagatgcaccatcttcctccttcagcacaacaacggagtctacacagttggtgacttcatgaccaaaaggcctaatctccatgtcgttacacctgcaacctcggttgatgaaggtactaccttcttctctacttctataatatgaagtatgtcctaactatgcttgctgctaaaccaaatcgccaacttattattctgttcgtttttacagctctcgagacgctggtgcaacacaagatctctggtttccctgttgttgatgacaccggaaagttggttagtgcccatcaaaacttcactctattcaatctttttctacttactctctgcaatttttattctcaaaacagttatgcttacaagtcaacaacgttgggcttttctcaaggggaaatgatttattgctaaatagttatctcagtaacatgattctaggatattttctttctcaaacacggtttcaaactttatacctttttacatgctaaattcgaactagtatggtgattctacctaaaggatttagagatcttggaatgctcacatctagaatgtagtgctgattcataaaacggtgtccttgtccccatgacatgcgggccttttgatctcctctattatgttgtgtcttaagaaacattacattgacattatggttgaattgtatctgatttctcattctgccactcaatcttacttccacctgcaggtgggtgttgtctcagattatgatctgttagcacttgactcaatatcaggtattccttcttggaccttcaaatcacttgcttacaacaaattcatattactagtacaatattgcatcctctaaactgcataagcctagtatttgtcattaacacaccattgcactaccatctaaccatctgcttgcagtcatacatggtggtcatttgtcaatatcttgatagcctgataggcaggatcacaactagaaagaaccataagtagtggcggcttggaccatataatcttttgcatacctacaaccaaaccttgtttaaaccatagcaaccataactttgatctgaaattctgaatgcaacaaaagctttgcccacactgcaacttttctggaactctaagctgcaaagattaacttgagctatttaacttattttttgaaagtatactgttgggtagtaaatgccataatccttgtattcttacattggtggtattttaaatccattctttcaggaagtggactgactggcacaaacacaagcatgtttcctgaggtggatagtacttggaaggtatgttctaataaagatagaatgttacatgtttttttatatatattttctagctatgcaccattttcttagattgggttatctttaccacctactgccaggtgttaggatggaatggtctggtttggaataaaagcaatttttaatcatggaaaatccccagtttctatattcagaagcaatgatcctccttaaataaaatgttcccaccacaaagaaccttcacatgttatgacaaaatgctgtttgactaaataataaagtagaagtgtaccttgcatagtggctgatgtaatggactgtgttaggtccagcaaattgtcacttgttttccctatcaagaatgttgttacctctcaacttaggatgcttagtcagtattgggttaaatactaaatcccgtataccttacatatattttgtaacagtatttaccacccattttgtagcacaccccagtaatgatctttaaaatcttggtattcttcactcttcatgcattagtctgaaccacaatttagtacttcaatttggtaaatatattgtttctagcatttaaataaataattagtcatgctccacatattgtttgtagtagcagatcttttttttttatctttatcaattattttttatttcacacgttaatatattagactcattacgatcgctgtacagacatttcgcgagatacagagactcttgagcaaaaccaatggcaaagtcatcgctgatgtgatgacttattcgcctcttgcggttcgtgaaagtaccaaccttgatgctgctacaaggtacctacaaacagtccattagttctcaggaccacgtctaccaatttattatcagacatcacgattggtgttcatttgtttcaggttgctacttgaaaccaaatatcgcagattgcctgttgttgatagcactggtaaattggtgagttgatctgcctttccttccttccgctttcgtttcagtagtatctagtcttaagtaaagtttcttttctcaaggttgggatgatcacaagggggactgttgtcagagctgccctcaaaataaagaagacagctgaagaaactgcttaaattagacagtgtagatgattctttataagtcatttctgggactgcagtcacttggaaatttagtccactgaaacattatttggtgaaatgaactacatcagccttacnagatactggcgaaanattntncgtcnacaggtnnncaattctttctttggnaannncatagnnatgngnanntataggtnnattgtattgttgcangatnnatttggnnaatatagncncnngcaatgcttgnntttgggnnngccaccagatttggtcgcctctccttattaggtagcataacatggagaatgttattatttttatttttacttttatcattgacttgtattcaagaacatcagtgtattgaaatgtaacacttctgatatgatgataccttccgcatctgggttgaagtgaaaatattttccaatgtttagattatacaacgaacaaggttgtaaaaggtaaatttataagttagagcctacgtttaatttcatcatggtagttgtgtagtttttgagaatgaagttgaaaaagattatatgtttgtcagcatacgaagtaaaggccaccccttttgcgtcactgacgttctttaaaaaagaaaagaaaggttgtaagatcttctaagtatatttttggggtttatgttagtttgatagtttctaaaactgataagtcatcctcttgacttttgtaacaattcaatttactcctaaactataatactagacatttgacacccatccatgttcatgctacgtcgagatccttgatcatctactcgactgtttgacgccaccgtcatctttccgaacatgtgccatcgtggcttagggctcatggtgcttctagactcgtagtcggtaagattagattcttagtgagcaatgaactcatttacgaagggaccctacctccaatggtaagataccgaaaataaatttgataaaaagatgggtgcagtagttgatgcctatcgcaaaagtagggaaggggagggttagtcatttaaaatcagacgttaccctttttatgataatttgtttatagtggtgaaaaaataattcttgaaccagggtgaaaatcattgactaagttattaggtttgtcacatagtgatggtgtgatatgacacctcatactaataaaatatgttttaatagtactggttgtaaatgacttgtatgtttaatatgtgtttcatacttttaatagtaacaaccatggtaattgtgtagttttttactcttttgatttattttgctgaagttccactaggaaacaatgaagttggacgagattataagtttgtcagcatgtgaagcaaagaccacccttttataaaataaaaggttgtaaaatcttccaagtatttttttgagggtttacattagtttctaaaactgacatgcaatcccagtcactcttaaccactataacacagtttaactccacatacacggtacatccaaatacattcataacagtacatttataattgtctggtaatcatgtgcaatttaccccaatcccttgacttttgtgataatccaatttatcccctaaacaataataccatacatttggcatccaaccatgtccatgctacggcaagatcctttgtcatccactcgacagcttgatgccaccatcctcttccgaaaccgtgccatcatagcatagtgcttatgctggttctagatttgtagtcaataagactataatcgtaatcatagttaccaaggagctaatttacggaggaaccctatttccaagagtaagatgttgaagatgaagtcgatcgaataggcaggtgcaatagttgatgtctattgcaattctcaaaagtggatggagggagagttgtttaaaattggatgttacccttttcataataatttgtttatagtggtggaaaaataattatataaccaaggtgaaaaacattacggctaagctagctaatggatttgtcatgtagcgatgatgtgatatggcacttcatactaataaaacatgttttaatagtatctagctatgcttataatttagtatgtttgtcatacttttgttgttttcatatttattttaatttcaactgggccatacaagtgatattgttcaatccaaatcaataatcttttatgacgatatcaacgaagtaacataagacaatgcatttaagagctccttgtaaggctcgaacaacaaatggtaacaaatcaaattgaaaattttcaatataacaatattggtaaagacaatccattaagattgcgaataaccaacaacatattataagtttatgtggcatttttagtcggactaactctaacatatttttatctagtttcacgctaatagtgttgcctaaacatgatagctcgatagaaagaaaatataataaatttgctcgtacattggtccgttttagtctacccactctatttgtggttaagtgacatgattaaaatgttacacaaatttatataagtaggtataattcaactagttaggttccttgtggtagaaccgatccacttaggttcaagttctagatagacttgacacgagtgtttatatttttggctaattattctttcattaagtggtagacgacttactatgtgaggctgtattcgggagcgccacagaaaactatatatatgcattaacacatgattaattaaatattagctaattccttttttaaaaaatagattaatatgattttttgaaacaactttcgtatagaaaattaataaaaatgtatcgtttagttgtttgaaaaacgtgcacacggataacgagtgtaagcgcgcggtgaatccatacgcttgcgctgtgtttcttacaaagaaaaataactagaaaaaatgcccgtgcgttgtaacaggtgaagtctattttaatcttattattgttatatggtttagttaagataaaattcaccgtgggagttcgcttggatatatatatttttagaaaatcatgagctacagttaggagtccgattgtctcaagttagcatgcgagttttttaaaaaaagattcttatatgtttccttccgtattaccaaaagtaaacgatcttaaaatcgactcaa

SEQ ID NO: 86735 - DNA, 1676 bp, Oryza sativa
ttagatttgaaggagaaatactggtgggtcacatgaagcgggaaattgcagagtttgtggccctatgtgatgtgtgccagcgtgtcaaggcagaacaccagcgaccggccggacttctccaacctctccaagtgccagaatggaaatgggatgaaattgggatggatttcatcactggacttccaaaaacccaaggtggatatgattctatatgggtaattgtggatcgactaacaaaggtagctcgatttattcctgtgaagaccacctatggagggaacaaactagcggaactctatttcgctaggatcgtgagtctccatggcttcccaagaaaatcgtatctgataggggaagccaattcacctctcacttctggaagaagctccaagaagagctgggcactcgattgaatttcagcaccgcgtatcacccgcagacagatggacagaccgagcgtctaaaccagatcctagaagatatgctccgcgcatgtgtactagatttcgggaagacctgggataagagtctcccctatgccgagttctcctacaataacagctatcaagccagcatacaaatggcaccttatgaagcgttgtacgggcgcaaatgccggacaccgctcttgtgggaccaagttggagaaagccaagtgttcgggactgatatcctgagagaagctgaagctaaagtcagaatcattcgggataatctaaaggtggcacagtcccggcagaaaagttatgcagataaccgtcgccgtgacctggaattcgcagtgggtgattttgtatatcttcgggtcatgccattgcgaggtgtgcacaggtttcagacaaaaggtaagctcgcacctcggtatgtgggtccttaccgtatcatcgctcgacgcggagaagtcgcttaccagctagagttgcccgcctccttgggtaacgtgcatgatgtgttccatgtgtctcaactcaagaaatgtcttcgagtgccatccgagcaggccgactcagagcaaattgaagtccgcgaagatttgacctacgtggagaggccagtgaaaatcctggacaccatggagcgcaggaccaggaaccgggtaatccgtttttgcaaggtccagtggagcaaccacgccgaagaagaagctacctgggagcgtgaagacgagctgaaggcagcccatcccgatctcttcgccagttcttccgaatctcggggtcgagattccgtttaaggggggtaggtttgtcgcgtcccaaaacgactctaaaattcatcctcgaaattgtgcaaagaataattaaaatccatgtgaaagcctccaacaattaaaatgtgcaaagttaaaagtcaaataaggcttggaggatttttgtatatttcctaaaagcctaaaatgtgtaaataaattttagtggaattttcagagcacaaataataattgaagagaaataaacaaagttaaaaggattttataaaaagaaaaaccctaaaaagcctttttcccccccctttccttcttgggccggctcggcccagctctccctctctctctcttccccccccctcggcccatcggcctgccccgcgcgcgcgcgccgctgacaggcgggcccgcccgccactctcgctgacgggtgggacccacctgtatctccctcctcgcgccacgcccg

SEQ ID NO: 86736 - DNA, 842 bp, Oryza sativa
ttaattgttagctctttctgtttgctggttctgtgtggggttttcagatggtgacgaccaggagaaatgctgttaccggtgatggcaaccaacccgaaggcagcaaccacaaccaccagggcaacccacctccacctccccctccgccaccaccaccaccaccagacaccaacgccattctcacccaaatcctcgcccagcaagccaacatgatgactgctttcctccaccacctccaaaatccgccacaacagaatgctccaccaccacctccacaacactctaaactcgccgaattcctccgcatccgcccacctaccttctcgagctccaacaaccccgtggatgcgttggattggttgcatgccgtggggaaaaagctagacacggtgcagtgcagcgatgaggagaaagtcatcttcgccgcccaccagctgcaggggcccgcatctctatggtgggaccacttccaggctacgcagccagaagggcaaccgattacttgggctcgcttcaccgccgctttccggagaacccatgtgcccgccggagtcgtggctcttaagaagagggagttccgagagttgaagcaaggcaaccgctccgtgatggagtatttgcatgagttcaacaatctggcccggtacgctccggaggatgtgcgggaagatgaggagaagcaagagaagttcctggcaggaatggaccctgagctgtccgttcgtctagtctctggggactacccggacttccaacgtctggtggacaagagcatccgcttggaagccaagcacaaggagctggagtcgcacaagcgccgcttggcgaacttccgcaatcag

SEQ ID NO: 86737 - DNA, 844 bp, Oryza sativa
ttttatctttgcacattttaattgttggaggctttcacattgaattttaattattctttgcacaatttcgaggatagattttagagtcgttttgggacgcgacaaacctaccccccttaaacggaatctcgaccccgagattcggaagaactggcgaagagatcgggatgggctgccttcagctcgtcttcgcgctcccaagtagcttcttcttcggcgtggttgctccactggaccttgcaaaaacggattacccggttcctggtcctgcgctccatggtgtccaggattttcactggcttctccacatacgtcaggtcttcgcgaacttcaatttgctctgagtcggcctgctcggatggcactcggagacatttcttgagttgcgacacatggaacacatcatgcacgttacccaaggaggcgggcaactccagctggtaggcgacttctccgcgtcgagcagtgatacgaaagggacccacataccgaggtgcgagcttcccttttgtccgaaacctgtgcacccctcgcaatggcgtgacccgaagatacacaaaatcatccactgcgaattccagatcacggcgtcggttatcggcataacttttctgccgggactgtgccacctttaagttatcccgaatgattctgactttagcttcagcttctctcaggatatcagtcccgaacacttggctttctccaacttggtcccacaatagcggtgtccggcatttgcgcccgtacaacgcttcataaggtgccatttgtatgctggcttgatagctgttattgtaggagaactcggcataggggagactcttatcccaagtcttcccga

SEQ ID NO: 86738 - DNA, 1345 bp, Oryza sativa
tattgttcctcctgttactccctcttccccagtgactagtactcctcatgatacatcatctatgcctgcccatttctgtctcaccgtatcctttgcatgacactcgtcgtcctcaaatcactgtaggtgatcagtcgccctctcgtttgactaaatccagcgagctatcaattgatgattctaatgagctacctgttgatgatatgcctataccatcatcaccatcttctcctgcagcacgatatggtcttcgagatcgcagtaaaattatgccacatcctcgttacagttgtgcaatagctgatggtgttcaggagcctcgcacatatcaagaggctgttacaattaatgaatggaaattggctatgaatgaggaactttctgccttagagcacacgggtacatgggatgttgttcctcttccccatcatgctgttccaattacttgcaagtgggtgtttaaggtgaaaactcgctctaatggatctattgaacggtataaggcccgcttggttgctcgtggttttcagcaggaatatggtcgagattatgatgagacttttgccccagttgctcacataactactgtccgtacccttatagctgtagctgcaactcgtcaatgggagatctcacagatggacgtgaagaatgcatttcttcatggtgatttgcaagaggaagtctacatgcagcctccaccaggtttgacatgtccatctggtcatgtgttgcgcctacgccgtgctttatatggtcttaagcaatctccacgagcttggtttgagcgctttagctcagttgttctaaaagctggatttgttgctagtgagcatgattctgccctatttatccacacttcttctcgaggtcgtacaattctcttgctctatgttgatgatatgatcataacgggtgatgacgcttctcatgttgccttcgtgaagcaacgtctaagtgagcaattcatgatgactgatcttggaccactaaagtattttctgggcattgaggttgcttcaacaccgaatggttttcatttgtctcagcatcgatatactctcgacttactatctcgctctggtctaagtgatgataaaactgctgccactcctatggagcttcatctcaagattcgtcctactgatgggaatccactttcagatccttctcgataccgacatattgttggaagtcttgtatatcttgctgttactcgaccggatatctcacatgctgttcatgttctcagtcaatttactagtgcccctacatctgtccattatgctcacctattacgagtgctccgctatctacgtgggacaccatctcgtgggatattttt

SEQ ID NO: 86739 - DNA, 1722 bp, Oryza sativa
atcagttatcacaacggtcaacgggagtggattttgatccttgagaggatatcccctcattatttgcatattaatcaaattgttttaaaaaaattaaaaaaaattgagaagatgtattaacatgtgatatatcactccacaaacatacaagttcaaattcagcttctacatctcgcaacgaaaaaaataaatttgtctgtgaatatacattaactagttgtatagtttaatttattttttttccttgcgagatgtaaaaattgaattttaacttgaatgtttgtggcgtgatatatcacacgttaatacatcttctcaaattttttcacattttttaataaccatttgagtaacatgcaaacgacaaagatattgatatcccctcgagggatcaaaatagtttcccctatcactactttgaattaggtttactatcatattcatcacaaggtttccccaaaagaaaaggcaaaagtagaaaaaaaaaacaaggctaggaattaatcaatcacctgcagctgctgtagtgaaatactgggagatggtagagtgcgtgtaggcataatcaaaatcgtttacaattctttcggcgtcatacatagatacctcttgtagcctcttgtttgccatgtcaacggtgagcaccagcgccttctcatcggagacgtcaaccttacccatgatgtaaacaatgtgagcgtccaccaagctgagtgttggatgagctaactggagcgtctccgttgttgggcaaccatcatccagcttgggcaggaggcaggcgttccgagtgctgtcgtcaatcgagacgtcactggacttgatcttcaagtcctcacgccactcatcatccaaacaggtgactggcttgctccatgtggtcagatcccaagcgcagcaatcgtcgtcatcatcatcgtctgaatcatcatctgaatcgaggtaaaggcacagcctgacaacggtgagacggccattgacgatagcaatgtcacgggaaatggatgaagtgtaggtgttgtggatgttgaagatctcggatggcatcggcatgtagctgcttcccccaggtgtgctgctgttgtcgagcacgttgcagatgaccatgccccgccagggatcaacgaaggccactagtggttgttcatcatccaggataagtaccttctctgttaaatggagcacgatatctttgtctggcgcattgcggagttggtcaagaagaaggatgttgttgctccatttgcagtccatggaatcgtcttcgtcgtagaggcagagcttgaagtggccaatatcgaagcggtgatcccgatcgagcgagctaacatagaagtgaccgctgttgttgtcatcatcatcagcgccggcggcatggcggcggtcagggaggatgacaacgttgtcgatacgacgaaggtagtcgtatgggttgtaggggctgtaggggttgtggatgagcttgagagatgggcgagagctggcatggtagatgagatcgtagatttgatcgctatggacgcggaggaagacgaggttgtcgttgacgaacccgacggcgggctccttggcgaagaacacggcggggtcggtggcaggggaccaggcgcagatgtaggagacgagcggcggcggcgcgatgcagaatgtgatctggattttgcggccgttgctgaagacgatggtggcggtggtggagttccggcggtcggcgatgtaggc

SEQ ID NO: 86740 - DNA, 745 bp, Oryza sativa
cacttgcacatcaacattttgagcaagcaaaactgtcatggtattatgcaattggtagtagcgtagacctggacacatggccatcatctgaagtcctggaactcttcaataaagctgaagataacatggagaggggtacagagatgtgggaggaaatggaagagcaacgcctgaagaatcggtcaaaacctagccaggagaatgtggtgctggagaagatgggcttggatgaatatatcaaagatgtatccactgatgacgcagctgaacaagcttctaatatgaggtctcagataaacattttatggggtatgctactttatgaacgttcagttgtggagtttaaattaggccttccaatgtgggaggattgcttgatggcagctattgaaaagttcaaacttggaggggcttcagctacagacattgctgtgttggttaaaaaccactgtgccaacgaaactgcccaagatggtaaggcaattttaacttactttatctcatcatgttctcctgggaatagtatatacagtgttgattttgctagaaaataccagaactagaaaattatagcaactctagtgtcattaatattgcggaacaatgaattgcaaatttctcatataccttatgtaccacccagaatatttttttcaacttcttatgtttcaaatatatatatcatttaattctcaaaagcatacgcaacttgtttctaagtttgcatcttttcttcataggtttg

SEQ ID NO: 86741 - DNA, 1539 bp, Oryza sativa
tctaaactgaccatgaaaaaatacagaatacatatcattagactatatagcagcaatattttgtccatgcaaagatcaaatcaattgacaacatggtatgaactctccattggatgctaaacaagttactgcgactcaacaggttataaaacaaatattttcagcacattcagtttagacaatcatcaaaaccaagcagtgcaaggaatcaaaatgtggaccgcggtacaagtagtcataagatcctaattctgatgcacgtaaaaagacataaaaagatgcttcctttacacccaaatatttggcaatgcttaaaggccaaaatgagggctaaaaagagaaatgtcatgcacaaacgagggtatcatgtgcaagaagagatatatggtaccactataatgattctcacctaaaagagaaaactggtactgataacaatgctccggcattaaatatgtgctggagcaacttcatgtatactatatatgctccagtgcagtatgcaattgtggaactctccgcctaaatagtggctcaagacggaaggatggaacaccacgcagccaccgtttaatgtcatacatttcattccaggcttgcacaatttcatcaatcttgaagcccaaacctatgaagaaaagatgcaaacttagaaacaagttgcgtatgcttttgagaattaaatgatatatatatttgaaacataagaagttgaaaaaaatattctgggtggtacataaggtatatgagaaatttgcaattcattgttccgcaatattaatgacactagagttgctataattttctagttctggtattttctagcaaaatcaacactgtatatactattcccaggagaacatgatgagataaagtaagttaaaattgccttaccatcttgggcagtttcgttggcacagtggtttttaaccaacacagcaatgtctgtagctgaagcccctccaagtttgaacttttcaatagctgccatcaagcaatcctcccacattggaaggcctaatttaaactccacaactgaacgttcataaagtagcataccccataaaatgtttatctgagacctcatattagaagcttgttcagctgcgtcatcagtggatacatctttgatatattcatccaagcccatcttctccagcaccacattctcctggctaggttttgaccgattcttcaggcgttgctcttccatttcctcccacatctctgtacccctctccatgttatcttcagctttattgaagagttccaggacttcagatgatggccatgtgtccaggtctacgctactaccaattgcataataccatgacagttttgcttgctcaaaatgttgatgtgcaagtgcaagaaaaccttcgaaaaagtttggctttgccttcacggcttcttcatatctcctcccagccttattgtactcttcttttgcccattcatacgcttccttcacttgttcaagtaccgattcctgtggagagtctcctggcagtaacaacctcttctggcccgagacatatg

SEQ ID NO: 86742 - DNA, 4217 bp, Oryza sativa
acttccatttgaaatgccaaaccgtattatcattcaaaaaatgaatcagcacacaatattttgtactgatgtttctaaaaagtatcgcgcagtaaactctgcaggtaaaaaaataggcaaaatgttgcaccatatcagctgactcgagaacaaaatatgtatgatgtaataaaactgtaaaacttggctatcttctgtcagacagaaactcatatccactctaccgaatcatgcaggccatctgattcgtcagatgttctcttgattttctctcaaaacctggaaaacatcgcagttcctcatgaatggatcatgtggtgatgggtatttgaaatggtcactccggagcttttgttgcgcagatcatgtactggcaaccaccccttgctcagaaagaggtacagatggcctccaagttgttccgtcaggaccgtccatgagggcaattccaacagcagccaattcttttctgatttcatcggatttttcatactgttttgcctttcttgctgaagtcctttcttcaattttctgaagcacctgctcctctgtcatggaagctcttcttagtgctttttcccgcagctgctgcagagcctgagaacagagaattgttagtgatgtccggtgtgtgaaggagaaaaggtttggctaatcacagtcatgtttactagagtagaattataataaacagagtgcctatggaaagtacaacttaaataccgtgttggaatttgattgcgctagctgccctgttctgggcacggatacattaattaagcacctataacagtggttaccacagtatctctttcatttccaaaggaaacacaagttttgaagagatacatttgtcctggctattcaacagtatgacagttgaagctcaaacttgaataaggctgagtggtaaaccaaacctgaccctctattgccttttactttctggaaacaggaacttaacaaaacaggaaaagaaaatggcaggaatccagttccatttgttagcaaaaaaacaggttgtactggttggttctttaagatataaaatttgaatatcttgattttgcatatttgaggtcggatacttgagtagacattgcgtggagtttaagggggtggaatataccctagaagacaaggtttaataaaacggcctgctggtgtggttttctcaacttgtcaccggacagtaaactgtgactttctgaaccttggtttattgaataccataatgtctatgacaacaaaatacaggagatgggctatacaagtgatcgtatcaggacagacaatgcatattcacagaggaaagaaacaaagtgtgttcttcaacagacaacaaaatatattcaaactgcttgggcagagttgataaaacataggctatgttacatagcactcacctcataatagcttgatggtagtagccctaggacagaaagcaccatccttattttctcttccatagcagaaagtgattccagccgtttttcctgcttctttccctgctcaaatatcagagaaagattgaaacattaggtatgattttagtattttacttgtggcgtgcgagcagatcaaatcatagatccctgaaagtcactaactgtatctccacaaggttttcattcgatttaccttacgagtatgcagcaagtcattcataacttttaatggctcagaaatagcagccagtgctactgaagtgtgaagatcatcagacattgaagtctcaaattcatcatggagcttctggatacaatttgtagtattaacaggtaatggatctccagccttgctttggtgctgttgacaactttcttcacaatcttgtagtgtctgtaaattaaaaacaaaaaacataaactctttaattaagagttatggcattgaaatatctcctgaagaaacagcaaaaatgcagcatctccctttcagtgccaccaaaactcaaaagttctgactagtcattcaaattgaagcagcttcccagtctccaggcataaaggttaaaccagaacttaagtgatcttgctttggctagagattgagaagcagcaaaagccagggctgcctggtcagaccatgcgtgcaactatagctatactaagatgaattcagtgctaccctgtgattctaaatttcgggccaattcacaaccagtttttaatcagctaagacaaaaaaaaaaagttcaatggacatttcaatttaagcgaaccgacttttatttggagtactgcagcttagccaagacaagtgcagatggcaagttgtatggggttaaggaatgaatcatggtcacagactcacaggccatctgaataatgatatatttggctttcaaaagataaaaatatggttcatctaattaatatatctatagactaaatgtgtatcttaatcttgtaaatgccttggcataaacataacctacacttgttctcacaaaaaaaattaagtaatgttactaattcatgcatgccaatttaaggtccagtgtcattccctctttagtttttacagtagcatagacacttttggaatgtgaatttacagatgcttttaacaaggcaagccaaagtacaaaggcctgaataagtcctagaagccaaataggctcaggatcatctttccaccaccccaaggtccggcccgactgttttgctggtagaaataaagcataaggttagtaaaactaacatggatataagaagatataatatacctggtaagtgtagtacagtctgtctgatgcaacattaagctgttctatggtatagttgattggggacctgtagtgtgtaccaagtaaaaacatcctcaaagcaagtgggtggtacagttccgtaacctgagaaagttggaaatctttgagaaagataaagcgcaacgattagacaaaaaatgaaagttatatagtcttactttgcgtatagtgacaaagttgcccagcgattttgacattttctggctgtttacattgacaaagccattgtgtatccagtaatttatgctgctgtcacaacatgctgcacggctctgagcaatttcattttcatggtgtggaaagatcaggtcctccccaccgccatgtatgtcgaaagagtggcccaagtaatgtgcactcatagcactgcattctatgtgccatcctggccttccagggccccaagggctatcccaagatggctccccatcttttgcagcctggagaaacataaaatcagctaatttgaaactgaactctctaaagaaatcttgaaattaaaataaataatttcctcatagaacaagagtacataatagatacacaaaaaatagaagaaatctacaaattgagaacaagacataccttccaaagagcaaaatcagctgggttcttcttcctctcatcaacagcaaccctttcaccagctctattatcatctaattttcgaccagataaatccccatattcagggaaattttcaacagagaaataaacatccccgccaattgcatatgcacaatcattatcaatgatctgttccaagaaatgtcatagataaaacatcaagctgggcagcacataaaacaattatattgcacagagaattcaatagcagcacaatattgtcaatcaggtgcaactgttcgtaactgcatatatgtgataacaatcattttcatattttacatgcttaccattcttaataacaaattgcaaatttataatttggaattggatgttctctgtacacggatcctatgatgcattaacaatgaaagaaagcaacacattatcaggtatcgatttaatggtgtgtgatgaatcatctctttctagatagtagtagtcaaaataaggaactttcactgcctattacacgaaatggtggatttaataggagaacaacagaaagaactgcataataataaaaattaagcaccataggaaaaacaccaatgatccatactgcatgcatattttacctgtttaatcatgtttataatctgatcaatgtggtctgaaacgcgaggctccacagatggtggtaaacaatgaagattagccatgtctgataggaagtcatcagagtaccttttgcttaagctaaaaggatcttctcccaattgatttgctcttgcaattatctacagaattccagaagtgcaactcaggtatcctgtgcagattagcaattggcatataaattttctttctaggtttc

SEQ ID NO: 86743 - DNA, 722 bp, Oryza sativa
ttctttaacggccatactttagagggctgcataaccaaattgccacacatatgaaccttacataggtgaagtgttcatttcctataaattttcttattttaaaaaaatgaccataaggttggcatttataaattgcagcatgagcaaactagaggtttctcaatcgttgataggaacatcatgtaatttgtggcatgacagactaattatcggtcagccagacagatcgcaatagcaacagggtaggaggtgattatctccaccttgaactgaaattccaaacatcacacatgttttcagtaacacacaattgtgttgaacgaaaccgaacaagacttaaaaaagaaagattacaatatactacaataaattgttggatccaataaaattatgactggacagtacacttgctatcatccgtgtgcgtggtagcttgagaaggagctatggtgtgcatcgaaggcggacgatgaacaagagtgaagctttctcccacatcagccgacccatagatttttcgcttgatgtagactgctatcctactatggcctcggctgtatgggaattacttcacaaacatgcagatatcatgctcttgaatagctcatgtagttacagcatgattcacttgcagcatctccaggattagtcttccatatagttcatagatcatacaacctacaaggtttcaatgaatgaaatagttaaaacacgggggatcc

SEQ ID NO: 86744 - DNA, 515 bp, Oryza sativa
ccccccccccccccccccctcccctcgtcaatccccaaaccctcctcctcctctccggcgatccacccatcgatcggcgatgacgctggggagctccggcgccggatcgagcgtcgtcggtgagcgatcgatcgaatccccccttcccttcttcccttcccccccttttctcgcgagtgcctagggccttcggatcggaggaggctgaggaggagaatccacgcgggtttcgctccgttccgcgcctcgtaactttggcgctgtgtcccgccatggctgtgctgtgctcgatgtggttggtgatcaggcgagacgccgacgcgttggtttgtttgttggaattagcgatctgcggtttttgtaccatatgggttccatccatctggtgatttagcttggtttgcatgcgtgcagcggtcatgggatctctctagatggcctggtttgctcggtttgcgaatttatttacggcatgttgatgatggtttggctttggcagtaaatttgtggtatcc

SEQ ID NO: 86745 - DNA, 504 bp, Oryza sativa
tgtttggtagtcttgcatgtatagtcgtgttcttatttaggcatgctaatatttcaaaacaaattttacagggtctctattgttcattgaggcagcttcttgaagaaggctttttccatgcagacccccatccaggtaatctggttgcaactgaaggtggatcactcgcgtattttgattttggtatgatgggggatattccaaggcactatcgtgtagggcttatacaaatggtaatcattgctcccttttctcatgtgtaaccatatggttctgttggtttttcttcctgatttggtttttgtcggttgctaagaactgtttttgaccggttgcagtgcagtctggtgcatttctgcacagttttgcatcttcaaattttgaattgaaaattcgaaatgactggtaacaaacttcgaacgatttggttaccatcatattgtagagtggaaataggttatatcatggtacaaaataaatattaagaaatgattttcataatgc

SEQ ID NO: 86746 - DNA, 751 bp, Oryza sativa
cataaggatgtaacaccattcgagaaatgggaaaggaagaaattaagtctctctcacctgcgcacatggggctgtttggccaaggtaaatgtaactatagccaaaaagcgtaaacttcgaccaaagaccgtagattgtgtgttccttggttatgctatccacagtgtggaatataggttcttaatagtaaattctggagtacccgacatgcgtgttggtacaattactgagtccagagatgccacattttttgagaatgaatttcctatgaaaaatacacctagcacttctagtcaagaacctattttatcccctaagcactttgcgccgatagaacacattgatcaaacgcctgaggaaaatcctgaggaggataacattgtagcaactcgaaagagtaagagacaaaggactgcaaagtcttttggagatgactacattgtatatcttgtggatgatactccaagaaccatttgaagaggcatattcatctccggacgctgattattggaaggaagcggtacgcagtgagatggactcaattatgtctaatggtacttgggaagtcatcgagcgtccaaatgggtgcaagcctataggatgtaaatgtgttttcaagaaaaagcttaggcctgatggtacaattgaaaagtaaaaggcaaggcttgtggccaagggttatacccaaaaagaaggcgaggactttttcgacacttattcaccggttgctcgcttgaccacgattcgagta

SEQ ID NO: 86747 - DNA, 535 bp, Oryza sativa
tatatgtgaagtacttctcttgatcattgtcgacaaatgtaaaatttactataaagggtcctgccatctctggaattgagggaaagtattggccattccataccccgctagtcaaatatggtgtggatgagttcaacagtgtaaagatgtattgattcgcaccacttggatctaactcaacactgtatttgccaggagctaggtcaattgaattcttcctagaaaccagacggctattgagaccactgatcttgctccaaccaagttttgcaccagggaggaaagtatgtgttgggtagtcaaagctttgccacagcgcatcggatgaattcaagaaattctgtaggacgaggtttccgctgttcaatagcatggcaactgtgtcgctagttgtgatatttattcgggtagaccaaacgatggatctgttggatcgatctaagatgacgagcccgccatcgccagagatcgtgagctctgaattgttggggtctgtgactgggttatcaccggttggcacccatactggagttag

SEQ ID NO: 86748 - DNA, 614 bp, Oryza sativa
aggcatgaaggccttagaagaaagaaaaagaaaaaaagtaaagattggcgggggcctgggggctcattcaaatgcacccgggtcgctggcctcgtcgccaccgtcgtcctcgccgctggcgtcgccctcctcgtcggaactgggggcgaacgcgagccgaggggccgagccctcgaagccgttgacgatgtggtcggcagcatccccgacccgcgcgcgcgcgtcatcctcggtcccgggagggaactcctccagcgccatccagggagagaagttggggtcccgggcctggtaactcgctagcacgagttcgaccgccccccgggcgaggtccctcgaggatgccttaatggtcttctcgagctcctcggggagttgctcgagaacccaagccatcctgttgaggtgcggagcgaggccttccagattggtggggggcaccgacgtctggcctccccagagtcccgcttgccgaccggcgcgcttcatgcgggagaccgcatcccaaagcatgtcgggcccaatctcgcccgccaagcgaagggcctcggcctccccggtggaggagtccagcgctcgctgcatctccgcgacggtgtgttcggcagctgcga

SEQ ID NO: 86749 - DNA, 1455 bp, Oryza sativa
gtttccatcggaactcggaatcggtcgaaaactttccggaaattttctcggaatttctggaaatttcctcggaattaccataaattttgtgactgaaatacccttaattccttttttaagcactaaatagtgaataccatggtgtttggctgttattttttaaaaaaatatttgttatgcaaatctaaaattacataagaatattttttgtgctacattgggatttatcaacaacattactcttttaaacatagataatttatttaattagatttattagtttgaggggttttttattccgataaattttcgttaccgtattcgcgccggttcgttttcgctccgctttcgatttcgataatattcgattccgttttcgtatccggggtttccgattccgatttcgattccgaaaaaaaatatgaaaacgaaaacgataaagatggtttccgtccgtttccgtaccgttttcaccccctacatacatcttaccactatgagcatatctaactcttcaagaaattagagtgacatattttaagatcggtgaggttatgataaatgttattattgttaacatgctgctgaaagaataattattacaaatacgaacacccatttcatgtttaggacttgcggatgagcaagttccatcctaagaaatctgtaatcagctatgctatgttcagtttgcgtgagattttaaatattagaaaacaacgttatttttggtccagtgtattgtttaacctttttccaatcatcatgtacaaaaactacaaggttaaatttttaaatgaagtttattcaaaagataattttgaaacgagatatatctgatctattataattcttttatatatttagaaacatatggcacaagagttagtagtacccactagtacattagtacaaaagcgaactggtactaaaactttttaaactactcatttcaaaaccagcagcgacaagaacaaatggaaagacaagcatatcaacacaaagtactctatccgtcccataaaaaaccaacatagtacttactctgtttcacaatgtaagtcattctaacattttccatattcatattgatattaatgaatttagacatatatatctatctagattcattaacattaatatgaatgtgggaaatgctagaatgacttacattgcgaaacggagggagtatgaaatatgatacatactagtattttgaatctcgatatatctttgtccagattcattgtggtcttatttagatttcaacttttcttttcaaacttccaacttttccgtcacattgaacttttctacacatgcaaacttccaagttttcagtcacatcgttccaatttcttcaaactttcaattttggtgtggaactaaacacaaccggagctagaatgtgtcataaccagtcttatactatctccgtttttaatagatgacgcc

SEQ ID NO: 86750 - DNA, 587 bp, Oryza sativa
cccaaaaaaccgaaacattctttggcccattgcctttgggcggctccacaaagtattttcttaagtgcttctagattctgaccatttgtatgttggcccgccccatttgactgtgggtgcacgacagacgcgaacctaatttttaggttaagcccttcgcacatttctctgaacttatcagagtcaaactgctggccgttctcagtaatgaactctttcggcacccctaaatggcaaacaatgtttttccatacaaacttctgtactgctgccgaagtgattaacccaaggggttcggcttcgatctatcaagagaaatatttccatagctacaattgcaaatttatacccgtttcgcgccaccgggaatggcccaataatgtccagtccccatctggcgaagggccatattggtgcaatgggctgcagatcatactggggcacggcttggctttggccatgacgctggcaacttttgcacttcttgatttgctcaacacagactttcaacacagtgggccaataaactccttgtctaaacactttggaggccactgttcttgcagcctggtgcgaaccacatgata

SEQ ID NO: 86751 - DNA, 2373 bp, Oryza sativa
agcttatacctgatggtacaattgaaaagtacaaggcaagacttgcggccaagggttatacccaaaaggaaggcgaggacttcttcgacacatactcaccagttgctcgcttgaccacgattcgagtactacttgctctggcagcctctcatggtcttctcgtctatcagatggacgttaagacagctttcctaaacggagagctagaggaggagatctatatggatcaactagacgggtatgtactagaaggtcaggagggaatggtgtgtaaattgttgaaatccttgtatggcctcaagcaagcacctaacaatggcatgagaagtttgacaccacgcttacatctgcaggctttgttgtgaatgaaactgacaaatgtgtgtactatcgctatggtgggggagaaggagtgatcttgtgcctatatgtcgatgacatattgatctttgggaccagccttaatgtgattgaggaggtcaaggactatctgtccaagagttttgaaataaaggatttgggagaggctgatgttattcttaacatcaaactacaaataggagatgagggtgggattacacttgtgcaatcccactatgtggacaaggttttgagtcgctttggatatagtgactgcaagccagctctactccttatgatcccagcgtgctattaaggaaaaaccgaagaatagcaagggatcaactgagatactctcaaatcattggttcattgatgtacttggctagtgcaacgaggcctgacatttcatttgctgtaagcaagctgagccggtttgtctcaaatccgggacatgatcattggcaggctctggaaagagtaatgcgctatctaaagggcactatgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagcagaccatcttaacgaggtcaacaatggaagcagaacttacagcactagatactgcgacagttgaggccgagtggcttcatgaacttctgatggatttgccggtggttgaaaaatcagtgccagctatcctaatgaactgtgataatcaaacagtgattattaaagtgaacagttcaaaggacaacacgaagtcatctaggcacatcaagagaagactgaaatctggtagaaagcagaaaaactccggagtgatagcattggactatgtccaaacggctagaaatctggcagatcagtttaccaagggactaccacgtaatgtgatagacaatgcatcgagggaaatgggcttgatacccacctaaggttgcacaatagtggaaacctgtccattgtgatcggagatcccgtgaatttggatggcgaaacaaactattgtgtgactgagagaagagacccttgaaaagggctcatttccatgatgtgcttctcttctttcctgcatggtaggatggctcatgccttaatgtgttccgagtggcttctccaagcagagatgttgacctgcagaacatctcagaaggaacacacctatatgagttcgactgctagtcacagtctacgaggtttgggcgatctctagatactcatgaaaggcctggagtttgacttatatgctccaaacagaggggatgcgaatggcagcccagtaccagtcaaggttctaagtgaaacctgatcacacaaaactgacaattcaaggcatagtccattgttcagttgtggtctgatgtagctcatttcctaggtggaagttcaacttaacagtctccaccaaaaccctggtatatcaaacaggcacaacattgagaacatttcttatgagccttgaaatttggtggggattgttagaataattgggctaggcccaacttatcctattaaatctcaaaggcccataataagtgttaaggataataataccacatcaggatttaagcgaggaatatctcaacctaaatagggagttattggaggccccctgttgattggttgaggtgggggtcggaatgccacacgcgcgcgcgcgccgggccgggccgtgggcgaggcgtggcgtggctggctggcggcggcgtgcgtgcgtcacgtcgctattcttttgcagccactaaccacttcccacgactctcttcgcaacagcgcgtccacgttcccacgactgcctctctctcctgatagataaagaggccgcgagtccgatcggttcccgacgcttgcttctttctcggtgttagttcctcctcctccgcgccagtgcctgtatcggtttctcgcttttgatctcttgcgcgcac

SEQ ID NO: 86752 - DNA, 3529 bp, Oryza sativa
ctcccttgagtatctcaacctgggtggaaatgactttaatgagtccgaaataccatccgccgggttcgagcggcttagtaagctcacccatcttaatctctcctcgtctaatttcgcaggtcaggtgcctgtacaaagtattggccaactccatagtttggtctctcttgatatctcatttagttctgaccttattgagctattcgaccacggttatctcattaacccatggcaaatggacttaccaaacttgacagccttagttgcaaatcttagcaggttggaggagctacgtcttggccacttggacatatcctccaactgaggacttgagtggtgcaacgctctagtcaagtataccacaaatcttcgtgttcttagcttgccattttgtgtgctctctagccccatttgcgggtcgctctatagcttacgctcactaaatgtgattgacctacaatataattatttgactggtccaattccagagtactttgccaacttatcctccttgagcgttctccaactgggttataacaagcttgaaggatgggtctcgccttcaatatttcagaacaagaaactagtgactattgatcttcatagaaatcctgacttatctggtactctgccgaatatctctgctgacagtagtttggagagtttacttgttggtcggaccaacttctctggtagaataccaagttccattagcaacatcaaatctttgaagaagctggaccttggtgcaagtggcttttctggaaagctgccctcatctattggtaagcttaaatctttgagtttattgcaagtctctgggttggaactaataggattgttccccccatggaccacaaacttaacctccttggaggtccttgagttttcccagtgtggcttatccggaccaataccttcttcaatcggagatatgaaaaaaatgagaaaattagcactctatggttgcaactttgtaggggaaatacctcgacatatctttaatttaacacaactggataccatccttcttcattcaaataatttcattggcacagtcaaactctcttcactttggacactacgagacctatctgttttaaacctctcagacaacaacttaactgtaatagatggagaaaacaattcttcactgatatccttgcccaacatagatcacttgagtttggcatcatgtaacataactagatttccaaacattttgaggcatctaaataataatataatgagcggtgttgatctttcacataaccaaatccaaggggccatacccaattgggcatgggagaaatggacagattttgaattttcctttttgaacttatcacataataaatttactagtgttggctacaactcctttcttcctatttgtatagtgaggttggatctcagttttaacatgtttgaagggacaatacctctaccccagaactctagattcgtgcttgattactcaaacaaccgtttctcatccataccaacaaatatttcaactcaacttggatatactgcctatttcaaggcgtcaagaaacaacctctccggagaaattccatcatcattttgtagtaacaatatacaggttctagatctctcttataatttttttagtggctcaatcccttcttgcctatttgaggatgccaatgcgttaaaagttctaaatctgaaacaaaatcaacttcatggagagctagcacacaatatcaatgaaagttgcacattagaggctctagatttcaatgacaataggattgaaggaaatttgcctagatctttagtttcttgccgaaaattggaggtccttgatatccaaaacaaccaaatcaacgattcttttccatgttggatgagagtaattcctagactccaagtccttatcctaaaatccaacaaggtctttgggcaagtgacacctacagttgccgaggaaagcacttgtgaatttcctagtctacggatcctagatctggcctccaataatttttcaggcacactgagtgaggcatggtttatgagacttaagtcgatgatgattgaatctactaatgaaacattagttatggagtttggaggtgatcaacaagtctaccaagttaacattgtgctcacatacaaagggtctgccatcgcaattagtaagatactaaggacctttgtattcattgatgtctcgaataacgcattccatggaagcatccctgaatctattggagagctagttctgctacacgcgctcaacatgtcacacaactcactgacggggccggttccatctccactcggtcatctaaaccaaatggaggctttggatctgtcctcaaacgagctttcaggagtgatcccacaagagctagcatccttggacttcctcggaacgctaaacctatcctacaacatgctggaggggaaaataccagaatcacctcatttctcgttattctccaatagttcatttcttgggaacgatgctttgtgcggccctccgctatctaaaggctgcaacaacatgacattgctgaatgtgataccttcccagaagaaatctgtagacgttatgttgttcctcttttctggaataggattcggccttggatttgccattgcaattgtaatagcatggggatttcccattagaagacggtctccggcgaggcagagagccctctgaatcatgtattgaactgacctttttctgtatcaaaggttgtaaacttgtaaccagggccatgtcattgttgccacaatctactacgtatttgaactcttccgtctggatcaaatcaactatatcgtatacagagttacattacatactactagtagcaattttgctgaagtcgctcggattgatttgctggtcaagcaaagctgaaatctagctgcagcagcttagctcccacgagacagcttagccggcgccgatgaggccgctggtgtgctcccaccacgcgccgtcgctgctgcggaagccctcctgaagtccaggtagaggttgtctgaaatcatacaatgttatatactgctttggtaactataatagcactggataattggatatgtacaaaactggctcaatgaagattgccagactgcctaatgcacgttttcctggaggaatatgattagagtaaatccagaaagacaagactttgaatataagatatttttagagagaagtgtagaagtaattgtgaacatagtatcagtattgtcagatacgttcagtatagcaaagacaaaactagcaacgatcaacatctagctgcttcagatagagcaggatcagtttagcacaactatctggaagcatgcattagcaatttcagctgaaaaatcttaggtttccgagtcaaagaagtactccatccacaaatataagcacttttaaaacaatgctaagtcaaacattttacactttgactgtcaatagctgtagcgcccgttccgtcgtggcgcctagcgggaaaattatctcttaaaaaccctaattgcgaaatttgtt

SEQ ID NO: 86753 - DNA, 3327 bp, Oryza sativa
ttgtcccaagctccaccaaaatcaagagcgcaagctctcaacatatcttccaagatttgattgacccgctcggtctgaccatcagtttgtgggtgataggccgtgctgaaatttaaatgggtccccaattcttcctgcagcttctgctagaattttgaggtgaactgactccctcggtcagatacaatctttttgggtactccatgtaggcacatgattctcgaaaggtaaagctccgccaaccttttgcccgtatatgtggtatgtactggtatgaagtgagcaaccttagtgagtcgatccacgactatccagatcgaatcgtgacccgatgatgtccggggcagtcccgttataaagtccattccaatctcctcccatttccattccgggatttgaagaggttggagtaaacctgctggtctttggtgctctgccttcactcgttggcaaacatcgcagagtgcgacgaattcagctatttctctcctcatgctgacccaccaaaacttttctttgaggtcttgatacattttagtgctgcctggatgaatggagtactgggtctgatgagcctcggtgagtatcagatccttcagttccttgtcgtcaggtacacacaatctttctcccaaccagattgtgccatgctcatcttcgtggaaatcccgggcttttccgactctcatgttctttttcagctctgctatttcagaatcatttacttgagctgctctgacttgatccacgagcgtaggccatgcctccagagcggctacaaaaccgtgttcaacaattcccacgttgagatgctcaaactcctgccgcaattcttcacacatgccctcgatgcatagggcagtgcagtaacttttcctgcttaacgcgtctgccaccacattggctttacccgggtggtagtgaatgctcatgtcatagtctttgattagttccaaccatcttcgttgtcggagatttaggtccggttgggtgaagatgtatttcagactcttatggtccgtatatactttgcagcggttgccaatcagatagtgcctccagatcttcaaagcatgaaccactgctgccaattccaggtcatgagttggataattcccttcgtgtggacgcaacagccgcgaggcatacgcaaccactctgccctcttgcattaggacacatccaagtccgtgacgggatgcatcgcaatagacttggaagtctttcatctggtcgggcagaattaaaactggtgcggatactaatttcttcttgagctcctcaaaactcttatcgcactcaactgtccatttaaacttctcatctttcttaagcaactgagtcatgggtcgggcgattctggagaagttttcgatgaatcggcggtaataacctgccagtcctagaaaacttcgaatctgcgacacggtcttcggtggggtccatttggtaactgactctacgtttgatgggtcaactgccacaccctgagctgtaatgacatggcccaaaaatttgacttccgtcaaccagaagtcacacttgctgaacttggcgtatagctggtgctccttcaacttctcgagtaccaggcggagatgttgctcatgttcttctttggactttgaatagataagtatgtcgtcgatgaataccacaacaaacttgtccagaaattccatgaacactttgttcatcagattcatgaagaatgcgggtgcgttggtaagtccgaacgacataaccgtgcactcatataatccgtaccgagtggtgaaggccgtctttggaatatcctcctcccgaattctcaactggtggtagcctgatcgcaggtctatcttagaaaacactttagctcctttcagttgatcaaacaaatcatcgattcgcggcaaaggatatttgttcttgattgtgacctcgttgagtgcgcgataatcaacgcacatcctcttcgtcttatcctttttctccacaaaaatgaccggagcaccccaaggtgaagtacttggtcgaatgtaccctttctgcagctgctcatcaacctgcttcttgacctcggctaattcattagccgccattctatatggtctcttgtaaattggagcggttcccggtgccaagtcaatccggaattcaatctctctcttgggtggcatggtagtgaggtcttcggggaacacttctggatactcgcagactatgggtatatcttccaattccctcaagttcttctccacggtgtccactgggatttccgcttcaatttgattcaaagagacccctcgctttggtgcgtctggtgattcgtacactaccgtttctcccttctcgttggtcaaggtgacggtacgattcgcacaatcgatgactcccttaaacttggtcagccaatccatcccaagaatgacatttaggtctttggattcgagaagaatgaggttggctagaaatggtgatccttgaatttctattgttatagaagggctgaattgaaccgaagtggagctattccctggggtatgaacccgcatcggtgtgctaagttcctctcttattaacccatgcatcccgacaaacttctttgaaatgaacgaatgcgttgcaccagaatcaaaaagtactgttgcagggattgagttaacaggaaacgtacccagtacaacctctggtgctgcttgagcctcctccgcggacgcgtggttgacacgagcctggataaaccttggcccggcacgcctaggcttcgggcatttgtcagcgaagtggccaagctcgccacagttgaagcaagaccctggttttgttccagtctccttcttggcttgcgcggacgggcctgactgtgccgatgccgttggtgggcgtggagctgcaccgctgctgggctgacctccatggtggttctgactgcctctggcgccctggggaaagttgctagggttgaacgggcggtactggcggacgatcatggtggtaggtccaccctgctgcccggaagcgaagcgcggcctctggtgacttccctgaggtgccctgaactgagcggccttcctcttcctatccatcttgttgcgttgatcctcctgacggattgccttgtcaactagcctctcaaagtcagcgtagtccccagatatcagttggttggtcagctcgtcatccagacccgccatgaacttttcctgcttctcggcgtcggtgcggacatcctctggtgcatatcgcgcgaggcgattgaactcatggaggtactccgtcatagtcctgttgccctgatggagtgcccgaaattccctcttctcttgtgccacgaccccgtct

SEQ ID NO: 86754 - DNA, 1816 bp, Oryza sativa
tcatctatgatgggctttagttgtggcccgacacaggtcatctatgctcgatgagctgcacgcatgctgatgcagcatacatgaagatatactttcttcttatatatgtacagctactcacttcgtgtcatttacagctacaaactcacagttctatgatgccagatcaatcaggttgtgtaacctttggatcagcatgcatctgtaccaaacaaaagttcgaccaattatcctctcctatacaaaggctaaaataacaaaggacgttgcagccaacacacccttatttgccccttcagcccattcccagtttttcccaacacattatttttagataatggaatgaatcatcccggcttttgctcatgaaagctacagccaattattacaagaagtagcacactaaaatggcttagtccaaaattaaacaagcacatcaaccaaaaataaaagaaattctaacatgacaaggaaaacattattccattctattgatgaatctccatccatggttggtaaaaagttgcataaccgttgactcaaggttacgacatgcaacagacagtaattttccatcttcctcacacttttgtagttgggcccacagtcgaaaccaatatgttgccctgaaaattacctgcatataggaaatagatggtgatttgtcaaaaaccctatcatttctacacaaccacagagcccaacataaagccgaggcaccaaaaagtatcagtttactcttttccttgtccacaccctgaagccaactgttaaacatatgagatatacttctagggaggtataaaccaaaagaaaattaaaccgctctccaaataaactttgcataatgaggatccataaataaatgttgaatagactcatttttcatgtaaaaacaacatcgtcaacacccattccaatttcatcttgctaaattatccttggttaacacgacacccttaagcaagtaccacatgaagatcttaatcttaagtggcatcttaagcttccaaataaacttatttctgtcaatgtaaccattattaattaaagctaagtacattaatctaacagagaactagccattctgatgataattccatctaaaacaatcaaaagaatcatccaactggatatgagcaatagaagcacataaatcataccaaagggttaggttctgtccaactaaagctcttataaaagaaacatttagcggaaccaaggccataacactggcaatagtagcactcttccttctgacaatagcatataaagaaggatacttatctctgaaggccatgtttcctacccatttatcctcccaaaatcttatatgttgactataattcacaatccaagagcccatacttaaaaaggtgttttttattttcatgagccctgaccaaaaatgagaatcaccttgtttcctatccacttgggttatagagttattatgaagatacttcctcttcaataaatcttgccacacaccattctcattaattaacttatataaccacttacttaacaggcatttattttgaatctctaaattatgaacacccaaaccaccctgatctttgggttgacaaattatatcccatctagttaatctgtatttctttttatgatcatccccttgccagaagaaacgtgatctataataatcaatcttttgaagaacccctttcggaatctcaaagaaagatatcatgaacatagctaaactagaaaggacggaattaatcaaaaccaatctacctccaacagacatatgttttcctttccaactactaagtttcctctctattctttg

SEQ ID NO: 86755 - DNA, 2417 bp, Oryza sativa
tcaagctcgccctcgacggcacacggcctcaggtggaggcgctgctcgcgaggctccgcccggacgtcgtgctcttcgacttcgccacgccgtgggtcgccgacgtcgccaggcagctcggcgctagggcggcgcacttctccgtcttcaccgcggtcaccagcgcgtacctgacggtccccgcgcgccgtcgtctccaccacggggcggcgtcgtgcccgaccgtcgacgacctcgccacggcgcccgtggggttcccgccgtcgtcgtcgctggccaccgtgccgacctaccaggccgccgacttcacctacgtgttcaccagcttccacggcatgcccagcgcgtacgaccgcgtcgccgcctgcgacaaggccagcgacgtcctcgtcttcaagacctgcgccgagatggaaggcccctacatcgaatacgtcgccacgcaatacgacaagcccattctcgtcacgggtcccctcgtgccggagccgccgcatggcgagctggaggagcggtgggagacatggctctcctccttcccggacaacgccgtcgtcttcgcctccttcggcagcgagacgttccttccaaccgccgccgcgacggagctcctcctcggactggaggccaccggccagccgttcgtcgccgtgctcaacttccctaggagcgtggacgccgaggcggaggtgaagaagtgcatggcgccggggttcgaggagagggtgaaggggaggggtgtcgtccactcggggtgggtgcagcagcagcacatcctgcggcaccgcagcgtcggctgctacgtcaaccacgccggtttcagctccgtcgtggaggggctcgtcgccggctgccggctggttctgctgccgatgaagagcgaccagttcttcaacgccgcgctgctcgcgcgcgagctccgcgtgggtaccgaggttgcgcggcgagatggcgacggatggtttggccatgacgcggtgcgtgacgcggtgaacgcggcggtcgccgacgccggtggaggggacgacgacgagaggaagtggcgggagttcttgacggatgacgccgtgcaaaggagattcgtggaggagttcgtcagggagctgagaaaactcgtcctctgaagaaaatcaactttggccgagtttagttacaaacttttttttcaaacttgtaactttccatcacatcaaaacttttcttacacataaattttcaacttttctgtcacatcgttccaattttaatgtaaactaaacacacctaaaagtctgtcgtgaaataaggcgtgtaaaaatatggtgtcatgttattgtttgattttagtctcttttttttttctaagtctttgttgatacttcgtatcaaagtactccttgtcctaaaatataagtacttagttataaatctgtacacacagcttaaaacgtaagtatatttagttatgaatcttcatataaaaaatgtaagtatttttagctattaatcttcatattttaggtggtatatatttataaggtgagttctggtgtggtggcggcgtggcgttcatgggcgagccctcgagcacggccttcagtcgtgtatgtcactgaccagtggtagtggtcccaacgtggagtggagaagaagataagtcgtgtcatcacttaaacgcgacgcgacgtggcgccacttgtgccgaaggacacggtgtcgatcgagcaggttaattatgggcacgggagcaacgggggtgtgggcgcggcaacgtgcacgcgtgggctgattgacgatggaaggaagcggcgtacacggctttggtcgcgcgcgtgaaggatcgtcgggagagctcggcatgtccgttaggtaccgcatggtaaacggggaatttaactatttgctatttttaggttgggcaattatccaaatactccttttagatttacacataattttttgccacttttacgagatgacttcttaactatttgccacttttgcccacgtggcatgccaacatggcaacggagggtagaaaccggtgtgggacccactagtcagcctctcctctctctccttcctctctcccttcggtccgatgtggcagcggacgaggtagagcggcggtgccggcggaggtcgaagcagagcggcggcggacaggctcctcgcggaggcgagcagcggcggcggcggaagaggaggtgtagcgacggtggacgggcttctcgcggaaacggagaaggcggaacggcggcgtcggtggagaaggagtagtagcagcggcactggtggaggagaaggcatagcggcagcggatgggctcctcgcgacggcctaggaggcatagcggcggcgccgacggaggagcgccaccggaggaggaggcgtggcggcggcgccgatggaggaggaggcgtggcagcggttaaatt

SEQ ID NO: 86756 - DNA, 5494 bp, Oryza sativa
gatcatgagagctttgtcccagattcggagaaagagattctgtggaccacaatgctcgagacattcacccttcccgcgggtacagaggacaaagtgaaaaggtggactctgaagaaaatagcagaacagattcagagcttcaagggagagctgtacaagaaatatatcctgaaggggcagacaccgaacttcgacacattcccaaagctaagggatcactgggacaagttcgttgcatataagacaggtgaacaagggcaggcgatgatggaaagaaacaaagaaaatgccgccaagaagaagtaccatcaccacttggggtcaggcggctatagcgtcgcgatgccgaagtgggaggagatggaggctagcttgcttgagaggggtatcgaaccggccaccgctaattggccggaacgatcgaagttctgctactatgctcatgcgctcaacccagctgatggctcactggtcttcggcgatcagatacgagaggctgcgcgtcgactaacagacacagtggaagcctcttctcagggcacattccgactggatagagagagggacgagctgtcactcgccctgcagactccagagcatccaggacgaactcgagggaaaggggtgattccttggaagattgggttcaaggaggacatctacacgtacaggagtcggatgaggagcaagagagataccgaggcaaagattgcagatcttgagttcagggtatcgagctacgagctcagcattcaagaggaggtggcaaggaaggttgatgaacgcatggctgcacatcggtccaatgatccccagccgaccattcctcctgcaatggtgagcccgtcaggaaaccgtagcagctgcgcctcaacggggcaggtaggatcacagagcatggacgccatgcaaacccaggacgaatccacctgccccgttgatgacatcactcagcggacaccatgtgagctgcatattcctttcaagaacttatcaataaaggtaagctcatagtttatatattttagatttgcccattccgctagttgctgcttatatatgttgattactaataaataacctctcaccacatgaaggtggcgtcgggcatggccatcccaacggacccttcaggtacttaccactgcaggccgattccagtaggatactccaaggtcgaagttgagttggtcgaaggtgcgtatgacgacctcgaactggattaccctggaggagaccgtgagatgcatctacgagacacaagccatgccattattctatggcgtaggcggtacatcatcctccttgggcgacaagcggcgtctcgtgcaccatctcctccggctccgccatctcctccttaggatcctgcaccgtctcctcctcatgctccagcaccgtctccacctcaggctcctgcaccgtctcctcctcatgctccagcaccgtctccacctcatgctcctacaccgtctcctcatgctccagcaccgtctccacctcaggctcctgcaccgactcctcctcgggctcctcctactcaagcttctgcagtgactcctcctcaggctcctgcgccgactcctcctcaagctccttgtccggctccttccaagtcaaggtcccaccaagctccaccgcttgtccgcacaagggcaacaaagaaggtgaaagttgacgccgccgaaaacaaggacccggggtacgattgcacgcaagaggagcttgacgcttacatggcatcagaagtcaagagacaattcaagcctcgaagtctagaaaagaagattcctatagacccgagtgtcatgaacttcttcaggggtatgtctgcacctgccaaggaggccattaagctatcggactatgagcgaacgctgaagaaagcatcttctggaaagtccaaaccagtccctcagcttggagagcaaccaaaccaggagatcgagccgttggtgaccggtaaagaaatgatgatagaagaatttattactgacaccggtctaactacggatcaattgctaggagttgcaccaatcgaaaaggcgaaagtgaaatacatgtacgaactcggtaaaccgcttgtcaagcctgagctgctgcagtccctacccacacaaatgtacaagttccatcagctgtacatggagatgagcgccaccggtagagagatgattggagcgaggatcagggacacggacttcttgaaaggagatgacattctctggatcaatttcaagggaatctacgaattataccagctggacgccctcgacgtctctattatgagttgctggattttgtaagtatatcgttcagttagatttcttactacgtatcctttaattaattaggtccttgtatataagtagactatagaaaataatatactcccttttattgttgtagaatggagattcaaagggcccgacggtggggggttttcgatactggattcatcgaccctcggaaagtaaacgtcgcaatgctcgaccaatatccgcaagccacagaggacaatctcgtccatctcctgaaggcgcagcattacaagacgttcatactgttgccgtacaacacagagttagtttaatttactgtcttcctataccaaatttcattcccgtacgaacttgctaagtgtttcatatgtaatgcatcccacgcacattgcagattccactgggtgcttttagtcttcgacctgtcggcctgcaccgtcaacgtatatgactcaatggataaaaaagagtctacgtttgacaaggtttttgaacttatagacaggtaccgtcataaattcctctgttaattaagaaaatcttgttatgttaattgctactacgaatcatagctttaaactctatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagaagggaactaacttgtgcggctattacgtgtgcgagtattgccactgccttgcagaccaaatcatcaccacaagagagctcgatgtacgtacaaataaattcaaaatttcattacgtatcgatttcttgtttaattactaatcaatttcatacattcatatagtttattcgcatgagggataacctgaccacgcacaaggaatttatcgcggcggttcaagaacaactcataggattcatcaacgaacaaatccttgatcccaagggtaaattctactacgacggaaacacaattcatagatccttagcttctgagcaagcgactactactacgtcgaaatcgtagctagctaggacatataatggattgtaattaatacatgactacatatgtttctatatgcatgtgtacacattttctataatgtaaacatattttggtcatatatatatatatatatatatatatatatgcatatgcatttgcataacatatatatgtataaatacatatatattatgcatgtacatatgtattgaaacatatataaatataatataatatatatatatatgcatatattatatatgcatatatgtactgaaacatatatatgcatggtttatatatatatataaaccatgcagcaatagggccatgcaaaaaaaaaaaggtcagctcgatctttagtcctggttggtaacaccaaccgggacggctgagccatctttagtcctgattattttacccggattggtagtcccggtttgaaaacctattttacccgggactaaagatagcgatctttagtcccggattgatagtcccggtttgaaaaccgggactaaagaggggttacgaatcgggactacaaagggtttctccaccagtgtaacctgaaacggaagcgagtagaattttgtctagtaggtcagacatatactgttggcccaaaaccgggagaaacccttactacaccccaaaagcaagcttaagaggtgagggactcccccacttttaagttggttcaactccgcctaaataagcaatgtgggactattcacaacatatactgccgtgatctgttattcatactgaaacaggtgcttttttttggaattaatgcctacaaatatttgctgaatgtactataggaaacatataatgttattactggattatggattacctcataaagttcattggatataagtcccatgccatggagaaatggaattttaccaccttcatcaaattggcgttcggtccttggattgccagcaacgtacccctgcgtcatgtacacaaggtaaagaaattggtggaaggcaaaagttaattgcaggccacattggtactacacattagcaagcaatttatgtagactattgacgtaattaagattccaaatataaaatttcatgattgatatttatctgataagatcgatcagaccatgagattcaaaattggtttatctcctgaatcattgcctgaaaaatatagacacatggtccgtagttagtagttggaaacacacacaatattaatccacgcagaaaatgaacaacaaatttgttttaataattcatgaataaaaaatatatatctcagtcctaatatttagatggagagaattccatatatatcacttgaaattggctcattctcttatataccattcgaaattagctctttccatctatgccactggtttaaatttctcgaccctcttgtgctgttaccaccactccattatctgtccatagtttaattcctctttttcgtttccttgtgcatcttctgcctaaaatccaatattgccctctaacaatgctggatccatcaaacaaaagttgccaaactaggaaaaaagcaggacctcgctgaaacttcgtcacggtcacaaccaacttgttctatagcaactttcaagggcaactgcatctttctacaatggaattaattgtgaatagacgatggagtgatggtagtggcaaaaaagaggataaattcgaaccaatggcatagatggaaagagctaattttgagtggcatataagagaacgagctaattttgagtggcatataaggatttctctcatttagatgattgccaaaacaatagtatttagttagtaacaaaagaaaaatcttactagtaattgttgtgatagtaattgatatatggtgatcaccattacccatatgagagatggtattatttactgaaatatattccgaaactgcaaggtgatcaaatttaatgttgtgtaacactgtgaggatgtctaaggaaattatccattcacaatgcaagaagcttactttcatcaatcgctagcgcaagtgtaggtacaatataaccactatatgagtcacctccaatatacagcggattcagcaagaactggggatgatcatgaagccactgtataaa

SEQ ID NO: 86757 - DNA, 1148 bp, Oryza sativa
tcccggcgacgagaagcgaaggcgagagtggcgacgggtagcggcgacaccggggatcattttaaggggttggagagcggcggcgaaggcccacgacgaccggcgacgcgaaggaaacctcggggttcggaggaaagagaccgatccgattcgacctcgaatccacgaacttccaaaacgattttgccgatgattccaaaagagaaaaggtagaggagatcccgaagattgttttccctcaattgatttcaccggaaacggaaagacgcggccgaatttggaaggagacggcggcgccgctcggctagggtttcgggcggcggcggcgcgacgaagacgacgactccgacaggcgggccccacctggcagcgagcgagggcacgcgcgcggctgcggcggactgggccgacttgggccgaggagagagagaagggttttgggccgactttcggcccaaagccaaaagagacttttaaaaacctttttcaatttaaattattcatgaaatgcaattccatttattaaaaatacttccttagctcaaataaatcccagaataatctaggaattatagaattaagcaaagtatttaatgaaattttatctggccccattttatattggaatttattaattaaaattagatcttctcttctaggcttttaaaattatttctaaaaattccaattaaacaacaatttatatatttaggattttcagggtgtgacaggtttcacccccacccctcaaaaggcagctggacaaccggacaccccggccgacccaactccatcacgcccaccctcgccaccggtgcctaggaaagggttgagctatacctcagatcaagcagttacccactcccgcttgtggtaagcacggtaagtctcccagggtttcctatgaaccggtccttaattgccatgggtgcgaccagcaaaaccatgcacccacaacccaccattcggtgtattttaaataactaacaccattgcggtggcaccaatccagaactatgctcatagtcaaagtctatgtaataactaagcatggctgagcatttcctaaaccaacatctaatcattttgataccccagttatcaatggcatatggtaaatgatatatggctgagtaataggacccatc

SEQ ID NO: 86758 - DNA, 607 bp, Oryza sativa
tggggattatcctgatttccaaaagttggtgattaaggctattcgtcaggaagacaagtcaccagcatggagcaaaagaaacgccggattgctcaattcaaaacacaacagggaaataatcagaagccgcgtcttactttaggaccgcagtctatgccacagggaggttcttcgtctgttgttcgtccgcagcgtcagttcttcaaccaacaatgctggcaccaacatccgcaatcaagctccacgtcctgttgcagcttctacacagcaacaacctgccaaaagggagcaaggcagcaagcccgtggtgtgtttcaactgtggagacccaggacattacgcggacaagtgccccaaacctcgacgcgtgaaggttgtccctgcccagagcaactctaccgtaccagcatcaaaggctcgtgtcaatcatgtcgctgctgcagaagctcaagatgctccagatgtgattttgggtacatttcttgttaacttagttcctgcaacagtgcttttcgattctggtgctacacattcattcttatctatgagttttgcgggaaatcatgggatggaagtagaagatcttagacgtcctttgatggttagt

SEQ ID NO: 86759 - DNA, 1445 bp, Oryza sativa
tttttttttggtgtgaatgactaatgggtcccatgcatatattttaattctattgccccgtaagtgccacgtcaacgccacgtggaccgaagactcggtcaatatcgccacataggcgccatgtcagcgaaaccaccccaaaaccgccgaggaagtcaaattgcaccggttttgcaagttcggggtgtcgagatttctggtattgtagttgagggatacgatttagattcggtggtcagttgaggaagtcaaagtgatcttattcccctcctaattccccaagctgccaaccaacccagcggcagccggcgggccgatggaaaagctggtgatgagacgcgagcggcggcggagcgagctgttgtaacgcaagcggtggcgcgagtgaggtcggcggcagtatcctccgtcgtcgcctcgttgggagcggtcgcgtctcacggtcaggccgccgctagctgggatttgaggtgcgtattttgactgaattacatatggctatttcatccacgaaccatatggaatgagatgtgaggtgttatatatgatgcatgtttaagaacaacggttcaaattaaatttgtgtgtactttgcttgctattgttcccctttgacatgtcggataatagtacttgttaatcacggatcaaaaggaatactagcggtagcaaattactgttactgcttataacatacagactgctataactagtgttccaaatgctaacagaagttcagataacaattacaccaaacatgagaaacttaattgatcgatactagtagaacaagtagtgctgaaaagatcttgtgagctaatttacttcattcctcataaatcttctgtgtcaagctttggtggtttcccatggctgtcttgaaagtgacaacttatatgtttcctttgagctgcttccaagccattttaagcatcaccagttgttcggctacttctctcatttctggtcgttcatctatattatcacttaaacacttcattgctagaatgccaattgcttcaagggtggccatgttttcctcagcagtgatctcattgtcaaacataatcctcccactgttttctttctcataacaattgacatactcgacaacaagactgcatttcttactatctaaaattcgtttcctggtgatgagttccaagagaacaactccaaaactatagatatcactcttccgtgtgaaaagtccggtttgaatgtaccttcggtctatgtaattgatgtcagctgccacaacccatgtgctatcttctcctatctgtgatgatccaaaacctgagattttaggcacaatgttgtcatcaaaaagtatatgggttgttttgacatctccatgtagtatgggtttggatctactgtgcatatatgccagtccttctgccgacccaacagcaatatctagacgtaaatctagtgggaaa

SEQ ID NO: 86760 - DNA, 2035 bp, Oryza sativa
gatggaaactaacagcacaaacactaccaagtataaatttgctgcatagtggacaagagacatcacaagcacctggaagaccaagcctagagacaactcgaggtttctccggaggcaagcaaccctgaaagaataaagtaaaatgtacagttgtacacaaataaattacactgcttgataaatttatggaaaacatataaaatgtatgaagaacaatggcttctgcttgttaactatgaagtacaatcaactgcaatctgagactagtgcaaatgatagtttggagtatttaactctttatgatgctatgacatgaaaacaggttagaccgttagatataaccattcaacacttccttcaaaaagagtcctacaaaatagtttgatgctttgtcatgtaaaatcaacagttgttgactcccagagacatctaaagtaaatgatgttacacagcctaaaaaaagaaagaaagaagtagatgatgtgacattgaagttgtgctatagtaatattgcttagtatggctcgtgtcagcatggaagttcataaaggttagtgctgcattattacttttgcctgacttcacttttgcaggttaacatattcatggtctttttacatgtaaaatgcttccttaacaaatgatcagaaaatgcaagataggcgtagggacagcagctttgcacaaataccatccaagattgacgaataaaaagattccaccaaccttcggtacataaaaataacagattgcatgtcaacaatacattaagggcattatagaatcaaatgtgttacagtgattactgggtaaagaatagtattctcaccactgcagcatcgagtatactgcaacgttcttcaggactgtctccaaagcccaaccctcctatccaaaaacctgcataaaactttgcacaaaagttcagtggatggaacatataatggtttatctgagtaatttaaatttgaagtatcatacagagtcacatttactgaatcgacaatggtgcaaagctgagcaaatgttatactccatccttgtcgtaagaaacaagtaaaaaggaagtataactactgaaagttaatggtgttgagtggtaaatgaaaataacctgacacattcctctttgacacttcagtggcacatagcttccgtagttctatactagatccacccacaactacacctaaagtatttgcaccagaatcctgcatggatcagtcccacaaaactaaaacattttcagtaatgtaaagcaactgcatgagcttgatgatgatattttattaacacatgtaaaaaagaacatgtgtatgataaagacatcagattaagtaatattacagagaatttacattttatttcttattcctgtagttttgtgacaagatacttgcactagaggccttcaagcatgtagcagcatctcaattaattacattagtacttaggttctctaaacttaaaattagtctgagaagtttcacttttgacataactcaaaaggaagtcataaaatctaaacagacatatggctaaaattcaggaagaaacactaaacacttcagctgaatatagattaactcatacctcatccaaagcaatacatgcatcaagccagcgtaatgtgcgctcaacagagactttatttcgtttctcagtaacccaagctggaacctcatctgccaaacttgcccacaaattaggcttcatgcaggaaatcaattccatataatctgatggtttaaccttaaaaaaattgaaggaagttgattagttgtacataaaaagactctaaacatgcatccacaaaatttggagaaagaaattactagagctaccaaccagtcttcggccagctggtgtctcaaaggaagcaccaaatttattgcttgcttcacttgttggtaaactctcaatagaatcaccagctgcggctatgaggatatgatcaggaagacccaacatatgatgcaaaccaccaatatttgatattgtttttgatggagggccttccatactgaaaaaacaa

SEQ ID NO: 86761 - DNA, 6612 bp, Oryza sativa
cataatcgttatgcaattttcaaaagcgtgatgccaacaaaagagagataacataattaataaagaaaattcagcaggtctacatacatagatataaactggtgctccgacggatgcagatcttgtcgatgaacaacagcaaccacccattctataattgttgaaagttacttcagtctatcctctagcagctgatatcactaaaatttcatctctcaaagacctacacaaaaacagtcttatattggtgcaggaaaaacaaaagtacatcatgcttagaagataaagtatacataaaacgagatgacaaaaaagcaccaatcagtacacatgtataaaactgtgcagagagcttagcaagtgttgttcccatgtggaattatagttaacgattggttataatgatgatgatgaactgatgatttttgatatctcgctctatcaaaaatatagtacttcaattttgacaactccacttaccgcataacatcaaaacctgaaaatcagaccaggaaacaggaattcatctcactagagtgtgtactacagaaattgaccagagggtacattcaggaaccacaacatcacatgctgagttccaccacccaagcaagatgacacaaaagatcatcctctatagattatagaaatgtattatgttttgtcctgtctaatttgttttaccacaaaagggtaaataacagagccagcagcccagcacatgaggataaaaaaatgtacatactatacagggtaccagcacatgagcccagcatatggcatactcatattgtgaataacaaagtgggataaattgacagatttaaaattatacagggtaccagggaggggttcagggccaaagctttaaagccttgaacaaggaaaccactttctattggacaagatattgtctggaatttgaggaagcctgagaaactcatatggagtaccatcttaaagtagtgaaatttgtcacatatagcatttagtgtcttaaagtagtgaaatttgctctgattacactgctatcgctgcaatcaattatgtgaaggaactaaaatggcttagcactagaatgaataccatgatgaatctagtccctctgtttcaaggtttcgcatagcaaaaaaaaaactagtactcagcatcagcttccctggcaactataatcatctgactgatagaaataaaaatgtggcaaggcaatgaaaatttcctgtttcctagcaaaagaaatccttttccttgttagcagtatctagaaaataaatcctgcaggcagcaagaacatccaattcgataatgataaccttggcattttacttgcatccatcttcatagactgtcatacaagttacaaaaccaaaatacgtcctatctctagataccaaaaaatcagaacacactgagaataccacagcacacatcagtgaagaacaaaaatgcagatcgaaagcaaaaacagtgcaattcgtcgttacagcgggaagctgcactgaatcaaccgagttgatccgatctttcaacacaattcgaccgcagaaagcaatctatgtataccagtggcaaagaacgcaaacaaacttgatctgatcgcgcgagccgtggtccgttcaactaggaagcaatcacaattcacaattaagagttaaaaacaaaaattacaaacttactcaccaagaatattcatagcgcttggattgaagggagcaaaaactagaattagtagtagtagtagtagcagcagcagcagtagtaggagattcacacggaaacaaaaggaagaggagaagcgggccaccataccagcgaagaagagctcggcagctgagcgagcgagctaggttggcgaacaaaccccctccgcctccctcctccgaactgcgctgcttcacctaaagagaagagaaagacaagatcgcgtgagaagacgacacaagtcagggagaaaaattcccccacgcgagacgaactccaaagacagacgccacccgcccgccccgtggatcgaacagaaggcggccgaggggaaagggtgatatcagtagtactccgtactactcggtagtagtggtccgtacccgaggacggcggcggcggcggcggaggaggaggagaagctgagccggcggcggcggcgagcggtggcgtgggggagtggaggagacagagaggaggaggatagttttgtgcactttcccctccccaaaatccgggggttgtgggccccgatatgaggaatgcaaatcggaagattcatttaagcccattcttttcttatatatatttctcttttttccttgattttcgttagcacgattttcaaaactatactcccttcatttcaaattgatctacatattttataggtatatcaagaccaagaaaaactaataactctttcatactgtatgtactatagcaacaaactcgatgcatgcatcatccccactattttctagccaatagcaaatcaaaatattgcatgtaggttataaatacttgtgtgcatggatgcatgcatcaatgtccatttactccaatgcacaaataatgaatagccttagggcccctttgaatcaaatgatttatgtaggaatttcatatgattcaaatcttataggaaattttcttatttggccctttgattcaaaggattgaagcttttaaaattgtatgaaattcctatggaatagcacattgcatgtggattttggagaaaatttagcaagagctccaatctcttggaaaatttccttttgagtctatctctctcatccgattcctgcgtttttcctgcgctctaatcaaacgaccattcgtacgtgaagaggaaaaaatactttaaaaacacgtaagcgaagtcgaactcctcacggaggataacaaaccaaaccagttgaataaaagttatatataaattaattatatactataatttaaattccaaaaacttatggcaattgttagatagtctgttctaaaactacaatttctacatacctttatttgtctttcaaattttatttattaacttaacagtaatgtataaaatatgtaacttatacctataaacaggtatatcatccacttccaatatcctaaaatataataatatgtagcattcaaaatctatcccaaaatcacttccaatatcctaaaatataataatatgtggcattcaaaatctatcccaaaatatgaaatttttttcacgtatgttctcttctcagcaattacaacctttccctactttgagttcttatattttgaatggatttggaaggagggtagtataagtttttatccatatttcagcttaaaaaaaacatggcgacgacttcgaatagggaactggaattgcatttaatttatctattgcatgaaattaatgaaacttgttactactttttatatacttatcctactttactgcatttacactttttattttactttgcagtaaaattgattgaatttaaggattcacaagctcatgtgtcagtgaattaaaatgatcacatgtgtccgaaacacaccgggataaatcctcattagttttatctaaatggttcttcatccttccataaaaactagacttattctatattttggttttccaaataaattagtcatatttgtttttcgtgtatctaagacttaatcggaacccttaagtcattttaatactcattggttgcatgtatgtatatttttattttctttgtgtacatgtaagatgaattattctctttgggtgtatttggtttggagacaaagtgggataggttagacctatcctagttttgtgggatgggatgattccagttgtctgtttgttttttggtatgggatgattatagttttctgtttggtagaaaggattgaggtgtgatgggatggacggatttgtactcaccgttagtgccgtctgggggcggaggagctcggcagcacccggatctgagaggagcggacggcgctcgtggagatggcgccgctcgcggacgagcggcggcggtagtcgcagatgaggcaggggtggtggtagtcacggaggcaaggcggcggcgctcgtggatacgcggcagagctcgccgaagtggtggcactcgcggacgagcggtggtggcagtcgcagatgaggcagaggaggtagcggtcgcggaggctctcagatctgagaggagcggcggtagtgctcacggaggtggcggcgctcgcggaggcttccggatctgagaggagcgatggcggtgctcgcggaggtggtgctcgtggaggcggcggcactctcggacgcgtggcggagcttgcggaggtggcggatggcgaggtgacgccgttcgctggtcccaggtgggacgagttcatccgccatatttttgcggatcggttgatcccgaatataagaggaatattcctcttcagggaccaacccatcccactcacccctaaaccaaacacctctaaaagttggttcaccacatcctatccttgcaattaaacgctacctttgatggttataaaagtgatgtgtctgactcttgaggatggagcaagtattatactatcgtagcacgggcactacccatcatgcacgcacacaatcacatgattcacatggcatatctatgcatcacacgcccaatagacacaggtacaaaataacaatgttataaatcaaacggaaattctctaatattgtcaagaaaaaaaacatccaaattcaaaatcctgttacaaagttgtgccaaaaatatcatatcagaggtaaattgtcgccaattttccaatgcatgactcactagcgtgcggacaatttttatttatttttttagacctttttatgttttaattttattaatagaccattccaaaaaatatttctaaatctaaactttttggaggcgtgacctttggaggcgtgaccaaataactctgtcacaccgcgtgtagcaggcatgacagttttgttctgccacgctaggccaaataacgctgtcacaccaacatgagtgatgcgacagtattgttttgctacgccagtttgactgacgtgtccaaaaggttcagatcttgaaaataaattttggttgggtttatttttaaaattaaaaaagttcaaaaaataaaaaaaatacgtgcaaacatataccacatttttcctcaatcgacaagggagagatctgaaacttgacaagcaagatttttttttaaaaaaaaattctttaactgtcacgctgcgcctgctgcgaatggcgtggtaatgttatttaccatacttagagggctaaaaggttcagattttggaaataagttttaaaagagtttattttaaaaattaaaaaacaatgaagttcaaaaaataataaaaattcgacaagttgagtcaagacttcctaccaaaacagctataataacatgaacagttagcacacaaactgactaatgaacccgaaaatttctgaaaattcatccaaaggcaagttaataattcagccatctagcactatctatttgttcctttcttctttctttccagggatttgcaaaaagttgttcagtcacttggattttcgaagagagggattgtggatttgaatgaatctaacttgcagctttctcaatttagtttgatgcaagcctcaagaggtctaacagtgtacatctagggagaagttaatccttgttagatcacagcagctgcaagataagcacgcctgtcctgaacaaactgctgccgaaagcgatcaaactgtccggttttgatcgtgtctcgtatcaaccggaaaaagcaaaggtaatgatgtgtattgtgtctgcaaattttgcaaaagcaaacaaatgtcacactcataattttataaacctactaaaatgcgtcattgaacttctgacatgacttacatctccagtagaatctgagccagcatctcatggacattgagcaaatgattaaggtaagcacgagtgtggttctggcatgtgaaacagctacagctatcaactatccttgacgtgtctttcctgaaaaaaaggaacatatgtccaaaaaaaaatatattctagatgttaaaaatgcttcaacatctgtgaagaaatgataactctaagtgcctaattgtcaagcccaaaatctcaactcaaccacagatgggccattgaatcaaacttaaaatagttgccgatcccatggatgggccaggggttcgggcttcccaagcaggcctatgttgcctaattgggctgatggattcacatcaacagtggtggttaatatttagtgtacatagaagtcagtgcttccacttttcatgtgcaattcaattttagttgattttgctagattcccaattcaaattcagaattgattgtatgacaaaatttaaacaaaatatccgaggagcatttcttccgcaaacaacaacaatacagttcaaacttatgactaataaaaaagtttgtatgcccaatatataactaaaatgatttcttgaaagtatttaactgcatccttactaattagtgtgcataataaaatgtattttatgcaatttctatagagcatgggacctaccgatatgtcgttgcacgcgggctgcagga

SEQ ID NO: 86762 - DNA, 3055 bp, Oryza sativa
ttggcccacaacgccccacagccgcccgcgcgccgccgccaagacctggccgtcgcgcgggccctatccagacaaggggcgaccagattcagccacaaaggtgccggatccaccgcctccccgagccgccccgccgtcttcacctccggccgtggttgtgggcgtcgtcggcttaactctgtcctcctcgcgccaaggaagaagtcgcctaagtggagggcctcgccgccgccttcccggctcaccactgacgagctccggcagcggcgaggtggagagaggggcggggctgtggtggtgtgggcggcatctttgagtttcactctgctagtagtaattgggggaaaaaaggagggtccaggatggataaaaaaattgagtttcactctgctagtagtatacaagcttctgatcggcatctttgatgcaagaactagccaaacagatctaatccaagaactcgttgaacagatctcaccttgttgtttattgacaacaaattcttgtaacataatactagtgaacaacagtagagaaaacctagacagacgaactagctagtatatatgaatacagttaatttctctcttgagaaacgctcaccagtggccggctggtgtggaggcggcgtcgatggcgtaggaggagacggacactggcaccggcggagggaggggggaggcgactggcgtagtcaaccgagcattactattccacacaagggaggtgaatttatccagatatttgatggaccttgtactacttttctagctagtgacatgcaatgcaaggcaccacgcatagaaaatccaaattaacagtcaccggagcagtaattgacaagtgacactgcctcaagcactcaaatgttctcggaagataacaaaagcaaaaatatatataaaaaaaactttaacacgatactaacccaggagaaaaaagtggaccaagtcatcactgtctaataatccctatgggcactgcataaaccgctgactctcaacaagaatgagaaaaatagccaaaacaatcttagttaattcctacaagtccactccgtagaatgtctatattttgatccacatgaaccagcatatcgccgctcagcaggcagcagcaaaagttacattagcatcacacttgtgttgagtttataacgaaaattctcagtgttgtatcctttcagtttataacaagaactcatgtagcaaagcagtcatttgaaaagaagtgaacaataatatacttcctctgtcccacaatacttatctttctagcatttaaatattgtcccaaaatagttgtcactttggagtactacttgttacatcaaccactttcaattcaaatttcttcccattctacaaccaaccaccctcctacatccaactatacattatttattaaaggatattatagtatttttctcctaacattagtacatgctaaacaacctagaacgacaaatattatgggacggaggaagtaagaacagttaattcctaatgatattatagtatttttctcctaacattagtacatgctaaacaacctaaaatgacaaatattataggacggaggaagtaagaacagttaattcctgatgatattatagtatttttctcctaatattagtacatgctaaacaacctaaacgacaaatattatgggacggaggaagtaagaacagttaattcctaatgggacacttcagacaacaataaatggatgaaaggaagcagatttaagcatccaaatgcatcgattttgagttaggaactgttattggatgaaggaattagaattaagcatccaaacgcatcaattttgagttaccgacttggcatggtgttaaatagtagagatagagaaatgcacattgtattgaaactcgggggccagtatatataggagatacatggggtagagataagaaaagattacagatatgaaagaagtccacacaaatcaaccatatcctaacatatactctaacttcccctgcagtccaagcgtaaacagcgcggaggcttagactaaagaaaaactagcaaaagtgctcaacatggatgatagcccttttatgccgtaatcgatgtagccaaatcaaaggacgcgagggagccgtggtctcgatgaagccatgcatagaatacccatggtcgatgtagccgaagttattagatttagccatccaaacatagtcagcttatgagttactaacttgcctttacaatgtttcatgggttccttgctactttacaaacttctgtatctcaggatgagaaaatatattcattataaagctcccccccccctttctctatcgctggcacgtactagacgatcgtgatcaaataagtctttggatcgggatgatataataaactaagtttagagatctcgatgaacaatttactatttacaagctcaaacctacttacggactgttgatgcgatttactcatttttgaattatagaattgcacagattgacacttcagattaatgcatcgggatctaaacaaccactgtcactgtccagaaaagaacacgttcacttcatatcaacacacacgttaccctttatgaaacggcactcccactgaagaaaaaggcctctgaagaaaacagcaaaaaggctccatcttaaacaagtcgcttcataagagtatacgaacaagggctaattaaagaaaaagtgtgctatccccagtattgagtatttgccatgatggagatataccatcgtaaacgtcgactttagagcttgtggataggagcaataagcaagcaagtaggatcaacagaacaaaaattaacgatactaaccagccgtaattaaaaagcagatgctattgtattaattaatggaatcagccactctaacaatccctactggcattacatgaacgacactctcaacaggaatcaatgagcaaagcagccaaaacatattgttaagtcctacaagtctactctttagaatgtctaaactttgatacacatgaaccagcgtcatatgccatagcaggagtattttggaagcagtttc

SEQ ID NO: 86763 - DNA, 3134 bp, Oryza sativa
aacaaatgactcaacaaggcttacatgtactcaatatcagaaggtcttgtttaacgaatagacagtacttagttaattgaaacatatggattcaagaaactttatgatccaaaagaaataattccttcaattcatggactaagaatggctcaaagttccatttctccaattgattgctttttttggttgatttctttacagtttattctattcttcccctcgtatctatgcagaactctcttattaaaatatattaatcagagggattttggtgctgaacaaactggattgagcaattgagctggctattgagaatttgagatattgactaatattaaaatactctgtaaacaagcttaatagtcaatattgatgtatagctaggttgtgcattagaacagtaactggaaggtaaaagtgacttagaaaccaccacgaaaagctctattccatttctattgaatatgttttattttttttacatattgtcctaactttgactaaacaattttattctgctctgtttaaagtaatatgcagggggtttgtttggtgcccttcaagctttcagaggatggcattgagctgcatattgcaacgaatcacgttggtatgctccactcttccagtccttaaaatgcaaactaaaacatttgattgcaggcaggttttgctaaaaccctaaaccctaaaacctaaaaccttttttttatgtcaatacagaaagaaacaaggttagcaccaaagaagcatcgtactcgaaaaactgcaattgaataagctaataacgaaattttaatagaagggaagcagatcaaatcaattttcaatttagaaatattgctcattggaactcacaaatcagcaacacatcagcctttcaaagttctcattatccaagatctagcaggtaagagatccacaaatcaaaatcaaaatatagcttaccttcatcaggtatagtttcacatgagggtgcggcagcattgccttctactgttcctgctcccttcggaggatctgctgagttgctgtcatcctcatcaaatcccataatttcggagatggtaccaactcttctctcggctcttggcaaatcacccactagatgaggagtgatgttagattggggagaagggatataaaattataaatagcaggagatgattggctccttataaaattacttgttagttcattttatgggttataaagtcattacatccccaatggccatactactttggacagagtcatagaagccagcaggaactaaaaaaacagtcatgactagatataattaaacatctaaaacttttacggacggataaacacaaaaatactgctacatccatccaagctactcataccctgtttcctgacacatatggaactctcaataacgttgacttctgttttgaaagaaagggacgtgatccctctccaatttctattactagaaatgaagattagacacacagcatccacaacctcaaaagcaaagcaacctaactatcagccttttagttctgccaatggtgccagaaactctaaataactgtgaccatgtaggatgtggattgtggaaaacgatagaaagaatactgatatcaaagaagaaaaaaccaaaagaaagggccatgttttgcacattaaaagggttcaagccagttcaatccttctgacccattaacattgtaactctatttatttgcatgatcggcaaaactttttaactctttcctttatctcatttcttgcagcagtgttattaaatccataaagaaatactagatgatttgccgatggataaagataaacgttatcttagaaattaaagccattactaaatgaaagattatcatgcaaacaacagcaagaataattagattgttcttgtttccctgtagtgtaaagacagggagttacctgcggtgcagaaagcactgtatgcatgaaggatgccgtcgaagttgtcttttccaagattcttgaactgcattgactcaaggtggatcatgaagacaccattgatcgtccttacaaaaataagctgatagtcttcatcatatgccactattaaattttgccatccccccatatggccgagccctaggatcacgcccaattcaatcttcttcagcatcgtccattcggcgacaccgacaccatcagagctgatcttcctctcccacaattccatgatctggtatgacagaatggcaaggcaaataccaccatcctctgccggcataatctggaagctgcgatgcgaattataatgcagaaattcagatggcatctcgattgtagctagactctgcctacccagatcaaactccagtatgccctcctcctcgccactgaacaaccagtagagcgaatatccaatgagggtgctgggcaagcatgtatcatacacaggaggacactctaatgtgatgagatcgccccatacgtcggcctgcgacgagtagagcgaagcgtagacgggtttgtagtcggtgtggatgcctatcaagacgacctggaagggctggagtggcagtcgccatggacgtggccttagccggaggcggcggggcagatcacggcgccgttgaagacgatcttctccttgtcgtcgccgagctccggcggggcggccgcgcagctgcggtggccggtggcagggtcccacacggtgatctcgttccgcgtccggttgtagacgaggacgcggccatggcggcagccgaggacgtcccagttgcatcgcccggcgcccttgtcgcgcggcatgaggaagtgctcgggcgggatgcggtcgggggcgtcgtggatggagcggaagactgggtagccgcagtggtcggcgaagaagccgaggaggaggggctcgccgtggtgggcgcggtagcggcggaggaaggccgggtcggagacgacgcggcgccactgcttgcagacgagggaggcgcgcgggagggaggacggcgaggtcgggaggcggacgaggatctcgcgcaggatgtcgtccccgtccagcgccgacgtcggcgacggcgcggcgcggcggcggcggcgtcggcggcgagccatcggatgatgtgggagcctagtgggagtggataggtctggggggggggggggga

SEQ ID NO: 86764 - DNA, 525 bp, Oryza sativa
atacacacaacaaatagaattgacacaaaaaatttcctctttatttgattgcagattaaattagtctatataagaagggggcccgaaggcctcggaagaagaaaagaagaagctatttaaagattggcgggggcctgggggctcactccgatgcacccgggtcgccagcctcgtcgccaccgtcgcccactccgccgtcatcgtcctcctcgtcggagttgagggcgaacgcgagccgaggggccgaaccctcgaagctgtggacgatatggtcggcgacgtcccggacctgcgcgcgcgcgccgtcctcggtcccgggagggaactcgtccagcgccgtccatggggagaagtcgggatccctggcttggtaactcgccagtacgagctccaccgctcctcgggcgaggtccctcgaggatgacttaatcgtcctctcgagctcctcggggagccgttggagagtcccggctatctccgataggcgctgggcgaggccccctggttggcggcgtacttcgcagt

SEQ ID NO: 86765 - DNA, 649 bp, Oryza sativa
tgcctccacggagctgagattcagcacccgttggaccactatcttgaagtcctcaggagcccagtcccatctgaccccctggtgggtcctcatacagtcctcggacccggtgtactcccaggcgccccgggcgcgccgctggagtggcgcgatccggcgacgaagatagtcgccgaacaccatggcccctgtgagcccctgggatcgcaggcccgccaagcggttgaggacggcgtcgtagccatctcccagatctaccggcgcccgccagttggaggcctgcgctggaggctggctcggaagtcggaggcgcgcttcgtcggcgaggggggtgtagaaccagtcgctcttccagtcatcccacttcttgcggaggacgcagggaatgtagcggttcagcaccggcccccgcgggtggaagtagcaaccaccaacccccgacggcggcgacaccggctgtacggtgaagaaccaccggacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccatagcaaaagggg

SEQ ID NO: 86766 - DNA, 1054 bp, Oryza sativa
tgcatccattggctatagtagcagtggaaggcggggacaccatgatgatagagaatcgcatagtaggcgtgatgaacgtgagagatctacatccgttgactacatgaacaagcgaagtcggcatgagcatagctcaagaagctcaagaacacctggtatcatgtttgtatctaattcttttcatgcttaggctaattggcttgtcacttgctgataaaattgtggctgtgattgcaaattgttagcaagatctgattgggacagtggccgatgggaatgggaagatacacctcgtcgggagtaccgtgatgatcgctcaaattcccatagacaacatccttcaccatctcctatgcttgcagctgcatcccctgatgcacgcttagtgtctccttggctaggtgggaatacgccacgttatgcaggtaacaaaagctcagctattcaatgttgtttgcacttttcttctttaatttaaatcaaataaatcatacttctattgttgttttgaatatccagcatccccatgggataacgtatctccatcacctgcaccaattcgcgcttctggttcatcaaaagggtcttctatccacgttctggtggaagatcccaccagcttactttttcgtctacatctgcatcaaatgtaagtcaggattctgttttcacaaaacatgcctttatgtaggaaaaatcaaaacatgcctttatacaggaaaaatcaggtgttttttttttttgcattcatctcatatgttgcaagttcggtatgattattttaagacatccatacacccaggaggtgaagtagagtagacgaagattgtagtcctatgggctatatacattgtagagagttggaagccccattcatacattcctaaacactatcacatctattgagaaattaatcctccttttagcacgacagtcttttaatgttgaatctcctggaatgccgatttttagaagtggtaactctgctggtaatttaattcaaccatttagaccagtgctcgaaacaatgataaatgtaatgaagcatgtattt

SEQ ID NO: 86767 - DNA, 738 bp, Oryza sativa
aacttcccaagccttacatgaaaaactcttttctcagtaactgttggttcctcatccatgggcttcttctgtctggaagattggaatccatcctcgcattcttccgacagccggcccttctccaacctctcatcaaaatcaaacatcaggctctctatggtcaatccggggacatagagcgtaccacggcaaagcgggcacgtcgaattggacagcagccatgtatctatacaatgcagatggaaggcatgaccacacaccggcaacaacctgagcctgtcctcaccgtcgaactcacacaagcacactgcacaatcaaacggctccttgtcaccaccaacaatgtcgcggtaggcaaacaccggcagcgcgtcgatgaacgcctggtcgagcccagaatcgtgcaagtggaacagctgctggagctgccggtccatcgcggcgtcccgcccgacatgccggctgtgcggcgacggggcggcattctcggctccaccacggcggtgctgctttttcatcagcagcctcaccaggaggtggagaaggccggagatgaagaagatgaccgcaagaatcactatgatgaacaacaccgcggggctaatcctccctccattaccaccgccatctgccgtcggcggcggcggcgggggtcgggtggtgtacgccgacgagtccctgacggcgggatggataccatgggaaggagagcgataggcggatagaggtgcgagagat

SEQ ID NO: 86768 - DNA, 3304 bp, Oryza sativa
aggctccaagtgttcatattgcttgctaacagcagcagttgtggcaacaactgcagctgcagtgactgttgcagcagctgcaacaggcacgtcaaagttcacatcattgtttgatttagcagcagcaacaaccattgaagacgcaaccactgcagcagttgcaacagcagcagccgtaacaggcaattgctttgtaagctgcgatgaagcttcctggggaggtgcagaaggttcatactgagaaataaaagatgtgttatcttggatgtcaggggggtggtcaatgcccaaaccctcaactggcttaagtgagtctagaggtgcccggtgaggaacttttgatgggagttcatgtccaggatgatgaggcaataatggaccatgaccacgatcagcatattccctcgacccaagttcattcatcctctttttcatttcatccttgctttgaaaaagggtggtgtcatacacgatgaggtcctttggctcttccatggaatcttctgaaaacaagtcaggtggtgctacaactccattttcaagtaaaacctcatggatcttctgagctagttgtggattctctttggcagcattaatcatgtactccgaaatatcctttactttcatcctccggacagctggagtactgcctacttctggggaagaaggtgaaggtgaagttgacgaagaattaattgttacacttgatctttctttgttctttgcggcagcaatgtcgtctgtacttcttgattcatttgtaataggcctattttcactagtgaatgtgctaacagataaaatcccgaatgaatctgatagtgtattttgttgattgtttttacttgtctggctcgttgtagctccatcactatcagaaggaccaacgttgatccatgtagatcttctgtcaagtaactcacactcaaaagaaactacatgcagaattcgataaactatttgaagatcccaactgcctgatgtcattatctttgttaaaatgatgattatttgagaaggaactttcttcaaattctgtagacaaaacagcaccatctgaaggaataagtgtaccaggatctgcgacaagatcaacaatgaactccctgcaaaatgcagcacggtttagatggttatgaagtgaaatgtgttcttattacatctttcaatcctcagtgcaccaacacttaaaagtgaatgcatgaagatagaaagtccaatactatcaggacagaacacacttgtgctatctcatgtttatttgtccaacacaatcctgttcatgttgtaaaggatgcaataccttccatcatcaaatttcacaatattcaaagccccatcgtccgatccagtgtactgccttcctttcaggagtcgacaggggataccaatgttatcggccaaaacctacatgtaaccattaagaaaagtaattgctatcatagatagatttgtgtgtaatgtgtcttataatggtaattgggtcacccttctattgtattagggcaaagagaaaatgtatagaacttatacactgaatttgaagtagagaaaaatatagaaagcattataacagatggcattcaatgttcagtgtccatgttgggcaaattctcgttgtcaataaagttcaggactagagcaacaaagatagcttggagattagccacactaatcttaaatacttaatatgtcttattaagtaactaaccttaaatagcagtgcacgatgacgtgccagaccaatttttaattggccaagaggaacaactacacttccaatactggttctcaggtatctcatcattttctggtatttcaccaacatgccctcagaatcaaaaaaagttccacccatgtgtctggctactaggccagcaagtttctgaaccaaatcatttccaacaaattctgaaggtttagattcacggagttcaaggctcatgattagagccgtctggtcaagtttcataagctcaggatcttcacctctgtgtaccaatacagcttcccagttgaccctatgtgatagtgactgcgctcgcaaatctttaagagagggcatggttattgaagccgggccattcccagtcacatagagatcataaaacccatctgatattctgtcatcatagccaagggcgttgaaattctgtgaggcataaacaattctatcatatgagagacaccagaaaatggaccatgttaagaaaaaaggaatgtacagaactttggagtgtgttgagtagaaacatgaggaatgcttcatctatttaaaaatgttgattaaatgtgcgattcataccaatgtatggtctcttttacgtatggctacaattcattactgaacaggcctcttttacatatggccacaatgcattgctgaatagcaacaaataacatttagttttttttcctcaaaaacacaatagagctgtgtttctttgtattatcaaataacaattacttcaaaaaagtaaggcccaatcttataaaggatatactagaatcatactccagaacccacacaagcagtgaaaattatactgggggtgatgttagtcacaagataagaaagtttaacttatctgacagacagacactaggtttcagcaattaggcagtcagactgcagaagatcattgtatgtaatgtaatgtaccacagaaagtacaactaagctcgtgctaccaaccccaaaaatcacccaatcgatgcaattgcactagctatgaactccagcactgaatcactgcccagccagtcaaagatgtaaagtcaaccggtttcacagcatggagtctattccactatcagaattgcaccatggaaacagctaattagcgatggaaatgaatcagagtggctaacccagtatcgggccgcgagggcctctgcagtagagctctgaggcgggcagaagcccaggctgatctgcttggcaacttcaatctccatctcttcaggattgtcccgcgcgctcatctcaagcacaagctgcagctggaactcctcaaggtcgtcgtcctccttctccctgacccgcttcctctcctccgcctccgacgactcccttatcactcgctcctccacctcgtcctcctcctgcgaccgcctcatctccctcacggcctcttcctcctgcgaccgcctcctctcccactcctcctcctgcgatctcctcctctcagccgccacggattgcctcctctcctccgcccccgaccctaccgacgacgagaacggcgacccctccgcctccgacggcgtcgacggcgtagggggctgaggccgacctgggacg

SEQ ID NO: 86769 - DNA, 2458 bp, Oryza sativa
aagaaagcagaatccccacttcaccctgggacatgattgctgagacctgaagcccgtggtcccaatgtttgtacaatgatatgtacaagtagagtctaaaacttgcaacaagaaggaatatttgcatgaattgaccaaatctggcttttccaaggaaccattctctgaacagctggtaaacaatgtactactagcaagagatacaaaagaaaaaaaacagcggctactggaactgctgtaaacaatagttctgccgaatcggcatctcgctatgattgcagtagttgcctgcagcatttggtactggttgaacactaatcatttgcacaccaatgattttagtagctcagatctcaaaagcaaaacgctggaaatcttgtcggtagtacacatattgtttaatcagtgtggtgtgggtgtgtgagggctggcacttcttcattgctctgtgattaaatatgctaaagatgagagactttataatttagtatggcactatacaagtattgtaaaccactaacagctctctaacagctagtatcatgtaatataataataacatgataaatatcaatggcactcaaaaacctagtcatcaccacctggcgcaataaccaaaagctgaaactattttgagttggaaacctcgagcgataagcaaaagcttgggcacaagcaggattgacaaaagacaatggttgctacttgtctgatattatcaaacaaatagcagcggtaataatgagtttttaacggacaaggaagtcaaaggaaaagaaaaggaggaaggacatgaccaacatttgcaacaatgaagggttacacctttcagagtgatgaacaatagatatcactgcaatttattgacatgtaaaatactgcaaatcccaaatagttaccattggtataatggaaatattaattgaaaacgaaggtatctggctttgaataaagggtttcagacttatcatggatgaagaaagttatcatggacgaagaaagctcatggaatgctttctgcgatgccaaaagagaaaaaaaaatatggttctaccatgcaagttaagagattcttgaagatggtattgtaaaatccagaaagcatcttttaaaagtaagaacattaatctctaaggtatttatttggatttaaatatttagtacattgctaagagaatgcaccctgagtcatgcaaagtaaaggccctccatgcatctttctggttacttatcaggaacaacaaagtaaaagaaaaaaattaacttccagcaagatgtaaaaactatatagttatttaccatcagtccaaattggtagctaaagcaagttagaacttcaatcctccaacaattatgataagacgtccaaaagtgcactttataatgatattatcattcaaaaacaagatgtcgttatagacccttcttgttcagaaacatatgccttcctatgttttgaagaaaaaaatgctcacaatctttccttccatatgctctactttttaaaaatttcccataatgaattatcatgcacatgcctatattgttatgctagagattgaaataaaatttatgtatgagggagtagaagatagtaggatacaggcactgaagcacatacatcactgcgatatgtgagttcttttttgggggggttacaatgaaatgactgatgggtttactcagactttatgcaatcatcccaggaaattgcaggtcgttaatcagaggtttctccttaaatgggtactcctgcgacttaaatcccagatgtgaccaaaatgtccaaaggtgacactaagggaatatgttctattagtaaattgatgatgcaagcaatctgtgcagttgtctggttattacatcgcagcacaggttcctatttgatgaacataataaaaggaaactgagtaatctagaacacctattatcatatactgatacaagaaacagtggaaactgcattaatcctgaacaatcacaagcagggtgaaatatgtaagcctgtcaaaaattatctttcgatggggatggtcattctagtgaaaaacatacacatgtgaaattagaccaaaagaatagctatagttaagaaattcaacaaccagcactacaaaagaaagaactatagacagtgtcacatatttgacttatctccagtagcatctctcttcatccacggaaaactcgccgtttctgagcaattgtctgaaccagctggcagcttgcccttcacattagaccactgccaaatcttcgacatggagaagctctcacctttactctttgcacaaatcctcttgccctccataatttcagcattgacagagcttatgccagtagctcttcccttcaacctgctgcccacgccatttttgttacgacctgggtggagagccactcgaagttcagaagccccaagaacatattggtaagtgcccatggagaagcacctcct

SEQ ID NO: 86770 - DNA, 3552 bp, Oryza sativa
tgaggaagagaggagggtttgacgaggttaatcctcctccaactcccaagatcccctccccctatcagcgcaaaaccatcgcaagaagaaacccccccacccccagcaaccaaaatccgcagacgaaaggatccaagctcccccacctaaaaaaggccaaatttggtgcaacgcggacgactccaaagcactagagcccaaaaccgggcgcgcgcgcactttcgtgcgtggagccccggatcagcagatcgggggaagggagggagggacgaagcggatggggaacaaagcacccaagaattgtgtggccggttgggttcacctccgaattcctcctgtgcgatgagagaaccaggcgaggcgagaaggagagggacgggagcggtagcttttggctccgtgttgtgttgtgttgggctttgggtgcgcgtcgctttcggccgcgctagctttcgtctccgtggaaaggaggacgcgagcccccgtgtaggtgtagccgcctcgttcggtttccgctttgacccgcggaatctcagctcaaaaaaatcatcagcgccacgcgaaaagacgagaaaaattcatccgatctgctctcaaactcccagattctgctcaaattttaaacgtggacgaaaatttgcagtgcgagtgcagggacagatcaatggagcactggaccgctatcgttgtcgtccaacctgtcgacaaaattaagaattctgacctttgtttgaatctatcgggcagttcgtcgctgcgagagattcagacagggggacagcgagttcacaacaacagttctgcatggggcctcgctctgtgttgtttagcacggaggaggggggaccagattgggctcgtgccatgtgagtaagtcttggcatttgttcgtagcaagtgtaggcgccagtgacatcgctgtgcggcacatggccatgcagatgagtgtcctggaacaagtaggcggcagcactgtagtcctttgtctggtgcagctgggactccagcaacggtacgggagaaatcaggattgaagtaacgagtcgcgcagaattaggccctatttagttactaatttttttttcccaaaaagtcacatcgaatatttgaatatatgcatgaaacattaaatatagataaaaataaaaaataattgcacagttatgagagaaatcatgagacgaatcttttgaacctaattagtccatgattagccataagtgctaatgacggcttaattaggctcaaaagattcatctcgtggtttccagtcgagttatgaaattatttttttaatttgtgttcgaaaaccccttccgatatccggtcaaacgtccggccttaatagttggaatcactcgggagtatttgggagggaattggaagatctagttcgccacgtcatgtgtttgatttattactatagctatgatttgttgtagtttcttaatatttactttctaactttgttacaatcatgattataacaatttattgggcaaaaaaaaaattgacatccttgcccagcacgagttataacaatggtagacgtgactaaacaactcttaaagtggtctaatatatctatattcctaaaatgaagtagtgctagttgcagtaaatttgttcctgtctaccctgttttctttaaaaaaaattatctcttgaactccttgtttttttttaaaaaaaatcgaatcttaatggatagcatgtataaaatcatataaggtcaatattccctatagtgaaaggatacaaaacatatattaaaaagtacaatttaatttactgtaaaccattttttttttgtgccaatagcaaagtacggacatttattagtaaattcttagaagtatgatagaatataaacatatttcatatgtaaattctcgtgacatccagaaattttaactatgtataattgtaccacggataatctagaatggtataatgcttatgttgttctgcaattgcaaataatcatataaggggaaaactatatttaaccacttaaaaaatgtggttgtgctacttaaaaccataaaatatgatacttactacaacatggccaagtgtctagactccaccttgaaagaatctttatatcgtctatagggtagtgaataggcatttcctgaaaatttaaaactcttttacagcggattagtagcactcggaatctctaggcctaggagattggagtctccgagatgacaggaaaatacccccaaaggggaacaagccatcaacacaactagtacatagaaaatatagcaataatggatgtaaactagtagaaaacaagatacacaagctatcacaagtaactcgcaaaagagatatctatcaatagcacaaaaacggtaaaagagtgcgaggagacaaacgatttgttcccgaagttcggattctccttcgagaatcctacatctccgttgagaggctccagggagccagatctcacttgatccctttcctcaccaagctagcaatcacaaggaagactaggtttccaagcaaccacttaggattagcaagtctttaaatgaccccaatgtttgtttagatgatgagccccaatccaccggtggcacttgctctaccaagcataactctttccttgttgagatgagggaaaccttcacaaactttccgtggttcaccacatggttggaagctcaccgggtgatgccttgtcgtcaaggagggttgacctccaaaagtattaaacacaatcgaagatttgcttgctatgaacttaaatgctcaaagtagctctcaacttctattctcaacctctcttcaatcccaaatccttatattctcaaatccccttctcaaatcacactcacaaaagagttctaccacaaaggtatgatatcagagagtggctctttggttttggatggttctactcttgtccaaagttagaaaccatggatggaggggttcaaatacccgagctctaaagaaaatagtcgttactcatgtttatgcgcataccccgaagtctcctggatttggcctggagccttcggtccaccccaagaactaactgctaacacacgggaaaccttctcgggtgcatggatgttatttccagagcctcttggaagcctggcttgcataggcccggagtctccaagtcccggcccaaagcctcagggaagccttcttgagtactcgaagtctcatggccacctgacaacaaccaagaaaaaaaatgtgtaacttcttactccggagtccattttcgacgatctgattgatacacataatccatagcttcaaatggtctcctacggcccgtacgacaatgtcttcacttgtccttctccaccggattcggtttgtcgacgccaagtcccttgcttgcccttcatcaccacacggtctatcatagccatgcttcgcttgcgcttcaccgtattgtcataggtagcctttttatactccgcgtgttcaggggccctttggatcaaataattttatgcaggaatttcatatgattctaatcctataggaatttttcctatgtggccatttgac

SEQ ID NO: 86771 - DNA, 921 bp, Oryza sativa
tgtctcagctcctgtagccgacctacctctgtcctagctctgacacgtcacagaaacgttaacatggtcagttagtcacgctgatacataggagtcgtagtacacagccgcgcgccgacccgaccgagccaaccaacctcccaccaacccgtccatcgcacggcgcggcccacgccaacgcaggcaagtcatcagtcaggcagccggccgcccgcgcgcgcccgcaccgtagcgtgcaccgaaggtgatccggttgtttccccgtgatcagctgtgcctgtgcacgctgcccctgctcgatctgcatgcgcgcgcgcgctgcagaggcagagcccgatcacatggccagcacggggcctgtagctctccacatgccgttgacgggatgacgggtcggcgcgcgcgatcgatcgatcgcggcgaaacgcatggtgatctctgatcaaaaacccgtacgcgcgatagggtttggtggtttgctgctgctgctggctgctgcggctgtgcaggggggcgcgaccacgcacgcaccggccacgcgcctgcggaccgatcgatcggtcgatcggcggcggtctcgcgcgcactcgagcgagcggcagagcgcgcggcaccgttggtttggttgggtgcgtgggtggttaacagcagctgggtggttgtgattggattggatggtccctgcagctggagctggggtttgtgcggggttgggtcgttggagttagctgggttcgctgctgttgtcgcccgcttgctggctactaggaggagtacgtactaggcgtggtcaccgtgggcgtattgtgcagcgagtagtagggttgtagggcatgcacgcttggacagtacgggtgcccgggtctgtaacacgcgcgcgcgtggctataattaacagggaggaaccaaatagctatagat

SEQ ID NO: 86772 - DNA, 571 bp, Oryza sativa
caactatatatagcttattggcactcaaaatcacatccaactgagttgagttaaagagtactcgaaagaagtgggaagggcaatgatggatgaacattacatatttgcctgacttgatatcggagtagatcacaatgaaatcaccctcctgcagctcgtttgaacgaacaaaatcacctgaaaaaacatatgacaacgattaatcaacaatacttgagagccacaaattaaggatggaagttattggcatggcttgtgactgtaaaatttgaataattcaaaagtttgctattcacctgtgttttcgagaagatacatcctgcttttgttgttgggccaaaacctgtgttcatgaaaatcaatatccattaatgtcagtgaatcaaaatctaagccatcatgtattcgaataacttgggcatatataatattgccaatggaaataattaaattaattaatcaaaaacatgagctcagcagaaccagcaaaaatcatatgcataatgttagtactgaaaacagcaggaaaagatcacttttatttttttgttgtatgcacttgagcatcaac

SEQ ID NO: 86773 - DNA, 600 bp, Oryza sativa
ctgtatcgaattcagcaacatcaaaggtgatctgttctgtttggaagttgttggcttggccgaaagtcacgggcaacgtaatcttgcccaaaggtctggacgatgattggggagtaattccatggaagggttgatcagttggtgtcaactcgttttgtggaattcccatcgcgtccaaagtgctggcgaaaagaagattgattgagctgccaccgtcaatgagaactcgcgctaccttgatgttccgaatagtaggttcgaccacgatcggatatcgtcctgggataacggcggtcttggggtggtcttcttccgagaactctatcttctgctcagaccacttcatcttgggtgtagccccctgtcatgtcgaacagacttcatgttccactttcttgtattctcgcttggaggagtacgttgtggaaccgctgaagatgtgtgagacgtggaggtcggagtctggatacgctaagtccggttcgtgaggagccgtctcttgattcgtctcaacaacgcgtactcgcttgcctttttcaaatgccatgtgcttcttcagcgactttttgaaaacaaggcaatcttccacagaatgtctgt

SEQ ID NO: 86774 - DNA, 1333 bp, Oryza sativa
ctggcttgatgatataggccgagttacagtgaagaacaggtgagtaacttacaaacactgcatatgaattcacgtcatgtgcatagaattttttgtcaaaattaactaaacctgtgatcaacataggttaaatttgcgagaatgcccgttatgaaggaaagaacacccagaaccatagccattatatatcactccagatgaacacaactgtccactcgaatagttactgctatatagcttgctattagtctacaaaccgcataaacaaggtaatagagatacaacacactaaggattacacaagctttacacccccaaaatcgtggcacggcattgcaaacagaacagaattgaaaagcctagttagttttccagaactatacaaccaaactaacggaattatggacaaggtggggagccccaactgaaagaatgaaccattcaaatgctacctacttgccagcttgctagaatacagtatagctctgaaagaattgcaggaatatagtgtgaaagctcagctgtgaacgactgaaagccattgactagttgagtgtggaattcctggtcttcttcccctatcattctaaaatgcacacggattgcgcgcttgcagactgccatgaattccagcaatgcagcgatgagctgctgcagttcttgagatcggagcctagttgcgggctcaccagataagaatgcagtgcacacacttaatacaccactatttacctgcatcgtcaggtttttgtaaaagtagcaaaagaaagaaaatagaggagcatatactcaaggcattcttaaaaaatggttcaaattctgcacaagagttacaggcttacagcttacctgaacagccacacttccttggagtatcctctgcaggctttggagtcttgggagttggtcaccttccgaactgcgtggttcttctagttcatttcgcaaggcagctgtccttgtctcgatcattccaatcgcattctcaacaggagaaaactctagagattctgatttgatcactaacagacgattcaccaaagcaggaaaggaaccctctgtctggagtactgtgcgcctcttccactgatcttcaaggccaccttgtgtttttccattctttgtgaatggtgtatcaaaaagaaaacggtcgaacacacgggcccggacagtaccagtagataaagagaaaatcctttcccttctactccctaggtcctcatcctccattacaggatcaacagcagttatctgcagatagcagacaccaggttgcaactcatcagcgttgacttgtctcgaatccggaatgatgtgtaaggtgtgattgcca

SEQ ID NO: 86775 - DNA, 666 bp, Oryza sativa
aactgctgatattcaacatgctgagacaacaatactccctccgtaatcatattatgagttgtctgactttattaaagtcaaatctcttgaaatttgaccacgcttattgaaaaatataggaatatttatatctctaaattagttattttagatccaacatttttttgtgcaaactattagatccaacgattgaatatgaagtagacaggagctttaatctatgttaaaaacattgttatatcgctctatgacatgtggttaaagttaaacacgcttgatggataaaatagtcaagcacgactaataatatgacacggataaaatacctcataacgggccatctcgacatacatgctgcgaccacgaaatgcaattcttgcatccacactcttatcccgtaatttagcaaggccattctcaatcaattccacaaacttgacactgctaccgtccaacacagcacggccatctgtaagtatatgaacccgtatccttttcgctccatgctcactggctccttttagaagcagttgcaagagccgaccaaaagaaccattacaagagaaactgatatagtgtgctactactgacctcgactgatcgacggatgaagttagaaattgaattatatcaacctcgcactgatcaatccttgaatggactcct

SEQ ID NO: 86776 - DNA, 710 bp, Oryza sativa
gaagcccccaacttgagtgcgaagcgcgagaattagaccaactagctcggcttcctaactgatgatgcgccgaggtggtgggttaccgactgccactataatcgtccggaagtgttgccgcgatcatggccttcatcctgttgagagttggcgtcacgtagtctggggcctcaggcaggatggtgtcgatgagggtgattgccccgactgcattctgctgaggtgtgagaaacacgttggtgtcatctacaacagtctgaccaatgagttgtcgagtgcgacgtccacattgagccaaatctctccgccttcccttttctctctccgtctttgttcttcttcctctcttgtacggcgctcctgatccagacgctcacgttccaatatctgccactcctgctcctagcgttcttgttctaaccttgtccgttcttcgtctgccagtcgtgtgccctctgctcgtctgtctcattgttggtcataaagacgccgaagtacagcgaagtgtagtcatcgttgaggtcaccgtagtagtcgtcgtagtagtcattgtagcaagcgaagttatcgaagtcgaagtcattgttgtagttgacgatttctggtttcgcttgagatccgatgttaggggagctaagatagctggcaatttcgtccgtcgagcaagagctgagtggttggaggatgactccgacctccctggagctaga

SEQ ID NO: 86777 - DNA, 676 bp, Oryza sativa
ataagctgtctcaaagtcggcgacttcaaagcagacattatctgtatgaaagttttccccagtgccaaaggtaaccggcatagtgatttggccgagtggtgtagatgaaaacacaaggaagactccgtgaaagggtgcattcctcagccgtaactcgatcctcgagatctgcatttcgtcgagagtcttggcgaagaggatattgagcgctcttccgccatcaataagggttctcttgagcttacgttgcgaactactgggtctagtactgggggtaccgccccgggtggaccactcggttgggatgatccgagcgatcgaatcgattgcaacctcagaccattgtaggaattgtggtacttctggctggactgcgttgatctcccggtcggtcagcttctgcttcctcttggactcgtaggcaagtggccctccgaagatgtggttgagctccttccttgaatcctgcaaagtgccttgagctggctcggtgtcgtccttcttctatgttgacgtgtcagtttccccttaagtcggcttcttgaattgagcgacgtactgcttggcaaactgcttgtagacgaaacaatctttggcagcgtgcttggagttcgggtgaagtgaacatggcgcattcatgatcttgtcttaggtgttgacacgaattcgctgatgc

SEQ ID NO: 86778 - DNA, 932 bp, Oryza sativa
ctggtctttttccatacactccttcagatattttatcaaatttggaatagtccttaatcatagatcttttccaaactttaattattggtgtatcaagtaatactttttgtgaaccaaagttgagaaaatccaggtaattaacctatgaaacattgaatatagaaattaaatgaatagtcatttagtacaaaatataaattagtataaatggagggaaaaaaatttaccgctaaatggaataaacaaccaccaaaagttttcgatttctcaatcttgctaatgtgttccatcaaccagtcaaaaactaacttgcaccagtccaaactttcaattaagtccatgtcttcaaaggcacttaggtattttgtacttggaatcaaagaagagtttggacaaaggaagcaattcaaggaaacaatcataaagcagatgagaatttgatcatcgggaagttcttcatttttaattaacttttctccaaagaacttgacagaaggaatagaagttttcccaaaaatctgaagaatcttttgtttgccataatcaaattttgaatggattgtactaccaccaacagggaggcctagcacaacatggacagattgcttgttcaatggaataagtttttggcccaaaactatatcagaacagttcacatctacttgttttgtaatccagagagcaaaagaattgggaacaaaacacttgtcaaatagcagcatgctttgaaaacaataattttcaatgactgttttgtgatgtggacttaaagaatcaagaacttttgagaaatatttgactgagaatctagagaatgcatcagacttcaaatcagtgtcaacatttttgtcctgacaaaaagaaaataaaacaatttaatcaataaataaaaaccaaacatacatagatataaagggcattgcaaaaaacta

SEQ ID NO: 86779 - DNA, 568 bp, Oryza sativa
tatagataaaaagaaaaactaattgcacagtttgcatgtaaatcgcaagacgaatcgtttgaccctaattagttcatgattagccataagtgccacagtaacctacatgtgctaatgacggcttaattaggctcaaaagattcgtctcgtggtttccaggcgagttatgaaattatttttttcattcgtgtccgaaaagcacttccgacatccggtcaaacgtccgatgtgacacccaaaaattttcatttcaccaactaaacaggccctattattattgtatttcaggtggtttgatccagttgaatcacgggaggccacaacctcttcagtatgtggtgaacgctgcattccttgcttctttgtacggtgactatcttgaggctgcagatacccctggctggtattgtgggccccatttctacccaattgaaactctgcgcaattttgcaagaactcaagtaggtttgcagagtttaaaatgttggaatcttgtaattccagcaggttttaactcctgatactaattcactacttatttcagatcgaatacatcttaggaaaaaat

SEQ ID NO: 86780 - DNA, 526 bp, Oryza sativa
cagcggcggcataataggccagccgtgtaggcgaggacaccagtcggcggcgacggagtgaataggccagccgtgtaggcggaggcaccactcggcggcgacgaaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcgaggacaccagtcggcggcgacggaggcaggccggcggtgtagatgacgatgcccatcaacggtggtgtgaccaaccgaccgtataggcggggacaccagtcggcggcgacggaggcaggccggcggtgtagataacgatgcccatcaacggtggtgtgaccaaccgaccgtataggcgaggacaccagtcggcggcgacggagtgaataggccagccgtgtaggcgaaggcaccacttcgcggcgacggaggcagccgcggtgaagt

SEQ ID NO: 86781 - DNA, 541 bp, Oryza sativa
ctccgtcgccgccgactggtgtcctcgcctacacggctggcctattatgcccccgctgttgggcgtctacgacttcaccgccggcctgcctccgtcgccgccgactggtgtcctcgcctacacggctggcttattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacaacttcaccgccggcctgcctccgtcgccgccgagtggtccctccgccacacggctggcctattatgccgccgctgttgggcgtctacgacttcaccgccggcttgcctccgtcgccgccgagtggtgcctccgcctacacggctggcctattatgccgccgttgttggatgtctacatcctcaccgttggctcacattcgctg

SEQ ID NO: 86782 - DNA, 606 bp, Oryza sativa
  unsure (1)..(606): unsure at all n locations
tcccacatgccagccgataatcttctcccacctatctcccctttcttcccgtctcaacccaaacctccagggcagtcagcaacaggtggggagaagagtggcgactgacggctgcgtcatggacctacacggcaaagagcgcgaagaagcgaagtaggaagggctcccgacacgtcgtcccctcgggttacaccaccacatcgttgcgtggcagctcgccgcgcatctgcgccgcgtccgcatcatggttgcatatcagccacaccgtcgggattggcgggaggatctccaagagttgggagatggagtacgttgcgacgcctgagcatactcgcgagcaccactgactgcatgagtgcccgtgcatgcaagcgaagaggacgccagacgctgaatcgcgggaaaggtgtgtggtggcccgtgaccaacanggagaatggtggtgggtggtgggcggcggcggtagataaaagcccgacgacggcgcttggcgatgggtggggagaaggctatcaacgaacaaaaagcttggcgatggcgacccgtggggaaaagggcgcatgcatcgaagacaatgctaccgcaacgtggagtagatggaagttg

SEQ ID NO: 86783 - DNA, 618 bp, Oryza sativa
tccagttcactgtaagtaaataagttgtttattatcatacatgcttatttgcgaccggatgagttttttgtactaacatttcattcttaattgtagggggacggtctgcaacctgacgctgatgattactcggtccgacgctcccttgaggcgtacctgttgtggttgttcgggtgggtgatgttcactagaacccacgggcacgcgggttgggactttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccatagggcgaccagtggtggacagcgcaccctacggggttggtcgcagcgcgcagtggccagaggacggtcccacgatggggacttactggtgtcgatgtgggttagtgcaacttcgctgcgttataagtttaacagtcctcttcttttttttttcttcacataacatgtctaattccaatcatgtttattgcagcgtcgttacgcttga

SEQ ID NO: 86784 - DNA, 757 bp, Oryza sativa
  unsure (1)..(757): unsure at all n locations
ggatgggntttnnattggaaattcgagctcggtacccgagatgatactagtagtaatttttcggaccaaaaagataaatatagaactaaatgtgacatattttactacaacgaatctggatatgacagaggtatgtttaaattcgtagtattaggatgtgtcacatacaatattagattgtttttgtagatggaacgagtagttacctagtactagttgcctgatttgcatggttgatcttgatagaaaggtgagggagtgtatgaagaaccaaacgaaaaggagcaaaatcgagagtcgcgctagctaggctccaaagcaacggcgagcagttggcaagctcatctgagccactacggtcaccaacttcatcggcacctccttcatgctctgcctcctcggcggcttcgtcgccgacacctacctcggccgctacctcaccatcgccatcttcgaggccgtccaggccaccggcgtgatgatactcacgatctccacggcggcgccggggctgcggccgccggcgtgcggcgacccgaaaggggcgagcgcggagtgcgtggcggcggacgggacgcagctcggggtgctctacctggggctctacctgacggcgctgggcacgggggggctcaagtccagcgtcttcggcttcggctccgaccagttcgacgagttcgacgtcgacggcgagaagaagaagatgatgcgcttcttcaactggntctacttcttcgtcagcctcggcgcgctgctt

SEQ ID NO: 86785 - DNA, 518 bp, Oryza sativa
  unsure (1)..(518): unsure at all n locations
agtgtgtacgtatntcgctgaaacccgcacagaaanntttgagaggcaagagcaaaatgaaagtgagaaatgtataacagtagtactaacagtagtaggatgcatccatctgataaccaagaggaaggcgatatgtcccgttgagcttgctgccattctcaggaggggggaacattggtctatcaagcaagtctgggtagcaaccgacaagaaacccttggtcagcaccatcagagttggcacgggcaatctctaggtcatgaaacatgcctttgaagacatccatagaaggctgtaaatggaaaatgttgccgatgtcagattactgtaacaggaaatagtaccagcatcagattacttgttgtgcactacatatgtgtgagcagaagatattttcaggtgtgacaacttaacactgattatttattaatgacatgctatttcatcgtagtacttccctaacggatactatattctaatgaatatggaaggaaaatatccagtttgtgacctgccaa

SEQ ID NO: 86786 - DNA, 629 bp, Oryza sativa
tgtgtataagaggtgccgtgatattttgtttagactgctgcgttcccacagcacatcttacgtggtgtgatggtgtgttccagataacaagatccattggagatgtgtatctgaagaaaccggagttcaacagagaacctttgcatagcaaatttcggcttcaagaaactttcaggaggcctcttcttagttctgaaccagctattgttgtacaccaattacagacaactgatcagttcatcatttttgcatctgatggactatgggagcatattagtaatcaggaagcagttgatcttgtccaacataatccccgcaatgtatgtgttcttatcttatgtaaattaattatttcaatggcgaagtgcttgttcatattattgcttgtccaataaaagaaatcttgatacgtttttgtaatagttacatgctttgattgttattatcattagggtaaatagatgattggatgtcaattgtctgagaaagtaagaagatcatgttgaatatctttagaacttgctgttctaagtttcttttaaatgtaccaaatattcagaaagaccttgttaggtatatgttaatacgatcccatatgaaattatgaaggcacctttacattgtgagtt

SEQ ID NO: 86787 - DNA, 557 bp, Oryza sativa
ctgaatcttctgagaggatttgctcatggagggtatgcagatctgcagagagtcacccagtggaatcttgacttcttgagggacagcacgcaaggggacaggtagttgttagcttagctcaagtgctagacattttgcaattagttttattcaaaactctttacgcatattagtggttgtttcatatgaatgcaaatgtttattttccaaacaacagacataggaattgcattatttagtacagatggcatgtacgcatcagacccttaatataatcatggtgacgtggcaaatagtagctagggatttctagtaagtatcattgataataatcctttatacaatggaaaccaagatcatgtcctcttttgtttttttctgtgagcaggtatatggagctgtccgagagggttcacgatgccatcggatttatggttgctgctggtctgactcctcagcatcccatcatgacgacggctgaattctggacatctcatgagtgccttcatttgccatatgagcaagcattgactagggtggactccatttctgggctt

SEQ ID NO: 86788 - DNA, 552 bp, Oryza sativa
atcttctgagaggatttgctcatggagggtatgcagatctgcagagagtcacccagtggaatcttgacttcttgagggacagcacgcaaggggacaggtagttgttagcttagctcaagtgctagacattttgcaattagttttattcaaaactctttacgcatattagtggttgtttcatatgaatgcaaatgtttattttccaaacaacagacataggaattgcattatttagtacagatggcatgtacgcatcagacccttaatataatcatggtgacgtggcaaatagtagctagggatttctagtaagtatcattgataataatcctttatacaatggaaaccaagatcatgtcctcttttgtttttttctgtgagcaggtatatggagctgtccgagagggttcacgatgccatcggatttatggttgctgctggtctgactcctcagcatcccatcatgacgacggctgaattctggacatctcatgagtgccttcatttgccatatgagcaagcattgactagggtggactccatttctgggct

SEQ ID NO: 86789 - DNA, 756 bp, Oryza sativa
  unsure (1)..(756): unsure at all n locations
ttattcaattttatacctgtaggtgtacaaaagctcaagtgaagtattaagnacattgatggtgcaagaatgaaagatacnaatttctgtgtgtccgttcattaccgcaatgtagcaccacatgtaagcntgcattaaaatctttaatttcacacagnaaatatgtggtgtanaatgtntgctgaatattattctcattgttacatcttaggactacgnagaagttcatcaacgtgtgctgccgtcctaagaattcccccccccttttttnggnttnntttttaaaagggcctttaccccaattgggaagaaaggttaaggaatatacacanccgcacagctgtttcgaagcactggttaagtaccattgttgtatttgtttttaattcaactgcgctcttgaattcaggttcttgaggttcgacctgtgatagactggaacaaggggaaagctgtggaatttttgctggagtcacttggactatgtggaaaagaaaatgttcttcctatctatgttgaagatgacaagactgatgagaatgcattcaaggtaacccataaactggtctgcttgctcttacctgcaaaatatcaattactacttccatgtcttgatgtataatattgctcacttggctcaaataggttctgaaggcaaacagcattggctttggaattttggtgtcatctgtgcccaaggatactgatgctttctattccgtacgggacccagctgaggtaattcgtcttctatct

SEQ ID NO: 86790 - DNA, 685 bp, Oryza sativa
agaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagagctcagcagctg

SEQ ID NO: 86791 - DNA, 676 bp, Oryza sativa
  unsure (1)..(676): unsure at all n locations
tgctctacgtagtgttcttgatgccttgcgtaaatctatcgattcaaaggtttaccattgtcaatcaaatctttgtgttatctgcattatctcaacttttatgtgaattttatgctgacttatgttgtttgcagatgtttatgttcggaacaacagcgctagagcagtttatggatcgtctaatcgagtggccacagtactgtaaccatatattgcagatatcacatcttcgtgcaacacatgccgaattagttgctgcaattgaacgagtgctcgccaagatatcgtcaagtcaaaatgagccaaatgtaggcagcatgctttctgcagatcagcatggttcatcatctattggaaatatggaggtatacttacatccaagtcaagcaggcaaacttttgttttttaatacttgttacacttggtattaaagagatgcccttcgtatgtaggcttctgaagcatcgtggcagctcatcaatccaactncaacacaacttgaacggtcacaccaacagaggcaccagggttttcttggggagaggtccaagggctctacnaacatcattcaagccaaaacatttctttctagtgggcaaatgccacttgcttcatcacctggtgattgggctgtcaatctaaaggtaccagtgttgaaattattattttttatgtc

SEQ ID NO: 86792 - DNA, 1531 bp, Oryza sativa
tccgaccaccaaacaaaagctcagaatcctacctgactagtactaccactactagctagtagcgagctactctctctggtcatcaagctttgagtggttggagtggtggcagctatggctttttccatctccaagaaggctgcagttgctgcactcttctccttccttgttgtcacctgcgtcgccggcgccaggccggggaacttcagcgcctccgacttcaccgccgatcccaactgggaagtcgccagggccacctggtacggcgctcccaccggcgccggccctgacgacgatggtacgtttgccggtgcacctcggcgactgatcattccatcgagatgaaccaattacgttgtataattgaactgttataaataagtgtggtgttgatgctgcaggcggtgcttgcgggttcaagaacaccaaccagtacccgttctcgtcgatgacctcctgcggcaacgagcctatcttcaaggacgggaagggctgtggctcatgctaccaggtacactaaagattcagctcaaatttgcaatgacgacgggcgttgagccgttgatgcgaagcgactgatcgagacgtaggtattcacagtgttgttgactgtttgttgctggtgcatggcttctttttttcttcagataagatgcgtcaaccaccctgcctgctccggcaacccggagacggtgatcatcaccgacatgaactactaccccgtttccaagtaccacttcgacctgagcggcacggcgttcggcgccatggccaagccgggcagacgccagctccgccacgccggcatcatcgacatccagttcaagaggtaatagtttagtagtaggctagtagctcctgcaggctgcacgaacagaagcatcatcatggccaccccttgccttgcagttgctagcttgtgccgtcgtggagccctcgtacttttgggtgcaaacccgacagcgacattgcttgtatgtcctccgggacccaagcagattatgatcgcacaaataccactaaaactcttttaattaagtacatgcagccgctttacaatttgtcgcctctgcctgtcatcacctactactatactgccttgcatactcactctgaattaatctgataagaatgtaacactaacacatggattgttgggggtttggccatgcagggtgccgtgcaacttccctgggctgaaggtgacgttccacgtggaggaggggtcgaacccggtgtacttcgcggtgctggttgagtacgaggacggcgacggcgacgtggtgcaggtggatctcatggaggccaactcccagtcgtggacgccgatgcgcgagtcgtggggctccatctggaggctcgactccaaccaccgcctcacggcgcccttctcgctccgcatcaccaacgagtccggcaagcagctcgtcgccagccaggtcatcccggccaactgggcccccatggccgtctaccgttctttcgtccagtacagcagctaagccaatgatcaagaacaagggctgcagga

SEQ ID NO: 86793 - DNA, 1057 bp, Oryza sativa
atctcaccacttcggcaaatgcggcaaaccgaggtggtggtcgtggtggacgcggcagcagcactggaaacagaggtggcagacgcggcggcttcggtcgtggcggtcgcggccgcggcgcccctagcggcgcaagtcagggacgcgggcgaggcaatgatactcgccccgtgtgccaagtgtgtcacaagcgagggcatgttgcaagcgactgctggcatcgttatgatgactcatatgttcctgatgagaagcttggcggtgctgcaacatacgcctacggtgttgataccaactggtatgttgacactggggcgacggatcacattaccgggcagctagacaaattgacaaccaaggagagatacaagggaacagatcaaattcacactgcaagtggcgaaggtatgagtattaaacatgttggtcatgctattgttcctactcctagtcgccccttgcatcttaaaaatgttttacatgttcctgaagcggcgaaaaatctagtatctgttcataaacttgttgcagataattatgcttttcttgaaattcatggcaaatattttttgattaaggacaaggccacgaggaggacaattcttgaaggtccctgtcgacgaggcctgtacccacttccagccagattgtctttgagacaggccttcgttgcgacgccatcttttgagaggtggcatgggcgtcttggtcatccctccaagccaattgttcttagaattctcagtcaaaataaattgccttgtcttagtaattctgtcaatgagtctgtgtgtgatgcttgtcaacaagcaaagtgtcatcaattaccttttcctagatcaactagtgtgtcaaataatcctttggaacttattcattccgatgtgtgggggcctgcctctgagtctgtaggtgcaaagaaatactatgttagtttcagaagtttcatgaatttcagaaacttgttgaaaggcaatttgatcgcaaaattctttcgatgcaaactgattggggaggcgaatatcttaagctgcacactttctttaatgaaataggg

SEQ ID NO: 86794 - DNA, 1088 bp, Oryza sativa
actgttctaactcatttgcattcataattatctccaccggaatttgctttagttggtggaatcctttctaatattttttacctttcctttgtttcagctagcggactgcagtcctgatggatgcagtttgctgcttcaagtttgtttggatgaagtgctgctgaatgccgacgtggcaaagagctctcgattgaaacctgagctcttatcaactgttttcaagtattgtctggataaaccatacttcagcaccagtttttgtgaagcactgaagacagtacatgtcagtgatatgttccttgtaaaattgtcaaatgaacttaatctatctgctggagagagggttggagttgggcttgccctatcagattctggaaatctaggcttgattacgaaaggtaggtgcttggtagatcaatttccctggcttagtcatgtgtcagttctcattgaaatgcttaattacacctctattctttgctttatagggcaaaagttctcaatcgctgaaatcgaggagatatgtgcaaatccagcccatgttttaacaaatgatcaaattcacgatattgttgtgtttcttcaccagactgatggcctctcaaagcatatggattctttcactaacatcatctccctattaaatgtcaaagagatgccattctatgttcctgccccaattaaggaaggcaacgctcggccaacaatttcttcaaggtttgaagagttccttctatttacattatgcttcattttcaattttgctttactcatgcacatttcattgcctttttggcaccttacaggcacatggaactatacactggtagcttggatgatgattttgattcccttctatctgaaattgggaaagaaataagcatggctgacatcattactgaattaggctacgggtgtacttcagatattgctcattgtaaagaaatactgtcactatttgagcctcttgatgatatgggaatctctaagttgcttggagcagttgtttgcactcatgttggtcttggtgaagctcataatacatattcaacgttcatgtcggccgttggcaacagccaaccaagtga

SEQ ID NO: 86795 - DNA, 686 bp, Oryza sativa
tttcatctccatgaaaagcctttttttttttgggctgccatgcctatgttttccttttgttgttctatgctttccatgtgctgagattgcttgaacacttgaatgaggccgttttcaattgataatgacatggaaataagttttaaacattcttatgtcatcaggtatccttgtctgaaaaagccgaagaaaccttagaggaaactatggctggcgaaaataatgaggatgttatatactactgggcaccaatggatatggatcaaacttcaaacttttggtcaatgtgtgattggctaaatgctggtcgttgcaggtgcttttttaagtgttccctttcagtttcttttatgtcaaattcgaggaatagactgaagaactgttgtctaactcattacatgcttcttagtgtagtatagcttcaaaattggcctgcgagcaaggagtagtgatgttggttactaattttcctattgctgtttgatgtaatatacagttctatgatgcactagttgagctattttctacaatattccttttcttatcctgcctgcttagttttcttttattttgaacgcattgtttttttttccagaacactttttgaagacgcattcagaactatgtatgggctctcagatggcatcacagccctgccaccaatgcccaatgatggtgattattgg

SEQ ID NO: 86796 - DNA, 1714 bp, Oryza sativa
acgggatggcggcgagcgacgcgcgacggcacggcggtaccgccggtgcgcggcgcaaggcgatggacggcggcgcggtgacgcgacggaaacgacggcgacggcggcgcggggttaggggcggccaggcatggtgatggcgacggcgtcggcagaggggaggcggagcggcgcgcggcgcgcggggcgcgacggcaacgcggcaaaggaggggctagggctaggggacctcgtcgaacactttaggtgcaatgaacagtgccgttttctaattaacccgattttggcccatttattatttaaatttgattctttaattcccaaattttgcataaatgaagtatactcaatatttgtgccattccaatccatggattcattctagattaatttattccatgttttacatattattattgtaatttacttgaacttaattagagttaattctcattccattgcttttaaatttgatggatataaatatggtcgtaataatattttactcatttctatcctcaccaaatcttattttaagttgcactttaattatttactttttccatttactttttagggtttattcctaaccaattatctattattcgcgatttataaactcagaacccaaactccaataaaataatcgaataaaatcggcatgatgcaatttatttaaaaagtttttaaaaatccgcatttttagagtttagatttttgtcgtcgaattttcagggtgttacatcctctcttctctgttctttcccatcctcatctctctctccgttctctccgacaggcgacagcgaccggcaacgcggcttcccctcttctctcacttctcctctcgggcaactaccggggcgggtggggaggaggacgccggggcggccggcgacgtggtgacgggagcacgaggcgacgcggcggtgggagccggggtggcgccgcatccatgacctccggacggaatctcactgaagccgccgccaccacccaccgcagtggctctccagcggcgccatcagctcctccgcccgcagcgctgcctcgtcgaggtcgccttcgccgttgtcgaggacggatttgagcttgccgacggcttcgtcgatggcgtccaacgcggtgggagcatgaggcgacgcggacggcggacgcgaccaccactgtgagcgaggagacgatgtcgacggcgaggaggatgcgcgtgcggccgccggggcaccgccgacttgctggcaccctgcatagacgcgatcgccgctgtgagcgaggagacgacgttgatggcgaggaggacgcgcgccacggccgccggggcaccgccaacttgctggcaccaccgacttgctggcaaccaaaccggatcgagtcagatcgagcggaggaggagcgggagctgccgcggcggtgaggaggcgacggctccagtggaagcatacacttacgacgttgccaagcgcgacggcgttgaggaaggtggaggggcggcgcgggctggactcgtcggaggggtcgttgtcacccaggaggagggaggcggcctggcacatggactcggcgagctggacgagcttgtccatggcctccatggccgacgacgacatgggcggcgacgatgccgaggcggcgcgggcccccaagggaggagcggcgcgcggacacccgggggcggagcgaacgacgcggcgacgggcccggacggggctgcagg

SEQ ID NO: 86797 - DNA, 2856 bp, Oryza sativa
atatttcataaaattttttgaataagatgaacggataaacatgtgctaaaaatcaacaatgtcaaatatttagaaacggagggagtacacgtcattcaaatggttataaaagatatgaaaaaaattaacaagatatagtaatacgtgacaaaccactccacaaatgtgcaagttaaaatttattttttataagataaaaaacagattaatctatgcctcgttaatatatattcacaatcaaatttatttctttcgttgtaacatgtagaagttaaatttaatcttatatgtttgtgaagtgatttatttgattaatttttcataactatttagattacatgtaaataacgagggaatatccctcgagaatttagaattgtttctagtacatttatccctgtgatcattttggaacatgagctaattagtggtacatgtgtatacatatcggcggggtttatttggtaaaactttataactcttaaatttaactttatgagcgtagttttaagtgaaatgtgaagcggtctaaaccatactccacttctctagtgtattatttcctcactacttcaatccgctcaatttgctttttttttatgaagctgaaatcagcttaagttctagactttaagcctgtgttcgggagggaaccctccctccccggcacgcaaaataaagcagcatttagcgcgtgattaattaaactttagctattttttttactaaaatggattaatatgattttttaagcaatttttgtatagaaacttttttttttaaaaaaagacacacagttcagcagtttgaaaagtgtgcgcgtgtaaaacgaggagagggagttggtaactgctgggaacgaacgcagcctaagagtggagctgaagcaagagaccatctatcatatgatacagcacgtacttagcacttagcagggtttacattaccgtcggtaaccgcgccggtacggtaaatagaaaaaccacggtaaccttctcaaattcaaataaatttaaaaaataatatacatttttgataaattttatacagttacgtacggtttttcacggtcaccgcgcggtaaccccggcttcaacggtttgggaaaaccttacacttagcaggagaaggaaatggttttgtacgcccatcgtcctctcccttttgttagaacacttgcattttttttcttttccttgcacagagaaattgttagattcgaatgcgtccaatatataagcgacataggcattctcctctcctcgttagttattggcgcgggatggattacagcaattaccaaaattaagacactgcacctttgcccctcgtggcctcgtcgttagttgtggatgctagctgcttaatttctgtctttgcgtcataaggccgacgcaaatcaacgatcagctgttgatgagctagtatatcggtcatctcaatcgcatcgagaaatcacagtcgttcaagagtggtgtttagttccctaaaaaacttgaaagttttgaaaaagttaaaagtttaaaaaaaattagaagtttatgtgtgtagaaaagttttagatgtgatgtgatgtgataaaaagttaaaagtttgaagtagttagaagtgaactaaacacgatccatccagatagaaaaagaagcccttttttttcccgatggcccgaatacatcacgaactgtccttgacggcttgaccagcttggttcagtgaacaactgtcaaagaagataagaaccttacgcaactggtaatttaggattggaaatttcttgaaccacttgcaagtcagattatttctccttaccgcaggaatttggaatttgtttaccacacctcttcgaagaactgtataggaaggagtctacggggcgtttgaatcacatgcagagagcaatgtaaccaaccaagggaccgagaacggagatatgtaagagaagaatgaaagggttgcaatctgagttcggatgggggagattggaatctaacacctactcacagaaaacggagcggtacattaacacgtgattaattaagtattagctatttttttaaaaaaaatagattaatttgattttctaaacaactttcgtataaaaactttttacaaaaaacgcaccgtttaaccgtttgaaaagcatgcgcgtggaaaacgagggagagaggatgggaaaaggtgcatgcgaacacagccgaataattgacggaggacagagatataattgtgttttggggagaattgacggagagaaatggaatggtgttaattttggggagaagagagcgacctccaattttcatataatcgatgaaattatacaagaagtgagaacttggagcacgggtggagcaaagcgccaaatagcgtatcacaacattattaggataagtttttcgtaagcgctgagtgctgtgtgatttagccgcgtttccctgtacataacaatgatttttcgttgtttttctcattctctctcccctatccataatataattaacgtcggcaatggctgacttttcgttcaaaaatgatagcatcaacctgatgaaaccactgaaaacggcacgcgagaagcaacatcgctgcatgtattatatcattgctgacgctggagatattaagctccattgcgaggccaagattttgcaggccaaaggaccacacatcacacagttcacacatgcatgcaaacacatggacaacttctaactttctgtcgagaaaattacctgcccaaaccaaaaagatgtcatcgcgctgtgcgctacccagctgtatggaccacgacgtccgtttttatgcattgatgagtttggggtgaatccaagctggtcgatctgatatgatctgatc

SEQ ID NO: 86798 - DNA, 1192 bp, Oryza sativa
ttaaatatacatattgatctatcttattcatattttttcaattttttttataaccatttagatgacatgcaataaacgggtggacatccactcgagctattaaaatagtttcccctgggtagagtgtaaaaatggaggtaggtcgatcgcttacacgctcagattcgttatggatggcagcggctcggctcctcttggtagaaatagacgatctcatcgccccttcccctctgatcacgacgtgctcatcctcgtcgcacatgccacctctcttttaatttttcaatgcaaactctttcagcgaattattgataaatacaaacgcaagcaaacgaaatctgcgctctgaatacgagagtgaagatgagaagctagctatggtactcgacgtgcatgaaaaagctagctactatctgtgcttgcctgcgattgcgagcgacggctgaagcaacgcgagtcgctggcgccgccggcgatgctggtgttctccgtctccggcgagcccttgtcctccgtcctgtcctccagcgaggtggagttgttggtcgtcgtcgtgaacccgcacacgtcgtcggccgcggtgccgcagcaggcgtcgagcgtgagcagcgtgctctcgccgcggcgccccggcgcggcgctcccctggctggcgcacgcgcgccgcccgtcctcgccgaccacctcccgcggccgcttgctccgcccctccgccgcgtcggcgtcgcacggcaccagcgcgtcggccgccgccaccaccccgacgctgccgagccatggcgcgggcacgggacgcgcgcgcgccgcgaggtgcgacgactacgacgaccgcgcggtcgcctgcggcaccaccgtctgcagggtctcgcggtccctgaccacgccgccacctcctccccctcccatggcagcctgcagctgctgatgcggcgggaacttgggcggcgcggggcggttgagcatcaggccatgcgaggagatgttgcccttctcccacgtcagctccgccacctcgttgtatggtccgacgtcggcaccgccactggcatgaaccctcccccgcctcccgacaagacgcggtgcccgccgccgccgccgccgccaatcccgccgccacccaccgggtcgtccagatcccagctcggcacgccctggttcatgatcgatcaacggagtgcacgagtgaatgggg

SEQ ID NO: 86799 - DNA, 2365 bp, Oryza sativa
aatgagaaaacatctgatcaagggggagaggaacatcatgatcatctgtttaatatctctatgccaaatgctactgatatttcatgtgcagaatctcccagaaatgtgaattcagatataccgggggcatttggccgggtacatggagcaaatggcgacttggcgggagaatccgcctcagattcagcgtcggtctaggcgcagctgcagcggcaggcctccggatctgcgacgcaaggggagtcggagcagcagcactcgggcatccaaccagcgcgcgccacgtcgcctgctgcatcgcctactgctgctcctccatcgcctgcccgtgctgtcgcgtcttcgtcaggtggtgcgcagcagtcacatcagccaggatcatctgcgccgtctgagtctgcacagctatctgaggtaatgcgacctaaaacaaggttacaaagtggtattagaaaagagaaaatatacactgatgggacagttagatacagttgttttacatcttctggagaaccacaaactttgcatgaggctttaggtgataaaaattggaaagaagcaatggatagtgaatatcaggctcttatgaaaaacaaacctggcaccgagttccttctaagaaagggcagaatataatagattgtaagtgggtctataaggtcaaacgaaaggccgatggcagtctagatcgatataaggctagacttgtggcaaaggggttcaaacagagatatggtatagattatgaggacaccttccgtcctgtagttaaggctgctactatcagaactattttgtccatagcaatctctagaggttggacccttcgtcagctagatgtacagaatgcctttcttcatggggttctagaggaagatgtctttatgaggcagccaccaggttatgaacagaaagatggctatgtgtgcaaactagataaggccttatatggtttaaagcaggctcccagggcatggtattccaggttaagtactaagctgcatgagttaggttttaaatcatctaagtcagatacatctttgttcttttacagtaagggagatgttactatatttatgttggtatatgtggatgacattatagtagccagctcatctattgttgccactaatgctttgcttaagaatcttaatcaagaatttgcactcaaggatctaggaagactgcattacttcctaggcattgaagtgaaagaagtaaatgatggcatagttttgacacaagagaaatatgctatggatgtgttaaagagagtgaatatgagtgactgtaaagcagtcaatactcctttgtctatttcagaaaaattaagtgctcatgaaggtaatcctcttggaccagaagacagtaccaggtacagaagtctggttggagcattgcagtatttgactctgactagaccagatttatcattttcagtaaataaggtgtgccagtatttgcatgcagcaaccactaagcattgggtggcggctaagaggattttgagatatttgaaacatacagttaagcttgggctaaaaattagcaagtctaattctcttcttgtaagtgctttctctgatgcagattgggcaggatgtttggatgatcggcgttctactgggggttttgctgtttttatagggcctaatcttgtgtcatggagtgcacgtaagcaggctactgtatccagatctagtacagaagcagaatataaggctttggctaatgctactgcagagattatgtggatacaaaccttacttcatgaactgggaattcaggtacccaaaattgctaaggtatggtgtgataatattggtgcaaagtatatgacagctaatcctgtttttcatgctcgcaccaagcatatcgaggtagattatcactttgttcgtgagcgggttgcaagaaaacttttacaagtggaatatatatctaccaaagatcaagttgctgatggcttcaccaagacactgtcagtcagacagttagagatgtttagaaacaatctaaaccttacaggttcagattgagggggagtgttagatatttctcacatatgataatgtaacaaatagcgaaggataagagttgttgggatgtttagatagataagataagtttcctatgttttagtagatgcacaacaactctatccgagctatatatacctgtattctgttaagcccggttttgtggcaagtaattaacacgtaaactcctcgctgaaggagttctctccacagtccctcctgaggctctcgtcaaatatgacatcgatcgcgagcgagatgcgcatgtacacgctgtatccttgcatgaaggacacgatacccccatctcatctttgtggccgatg

SEQ ID NO: 86800 - DNA, 711 bp, Oryza sativa
ctgcagccccctttttcatccaaaattaagctgaatgaaaactgaaaactgtcacaataccatacctttataagctcaatgaaagtaattagtagcccccacgggtgagggcggttaactattagccgttccagaagtaccctagttatttgctcctggactatttcctgcgatttcagattagttcccatcagaaagggtgtatatttgcatacaaacaaaaaaaggagaccacatagtaagtaatcatccgatacctggtttgcctcagaaaacaagtaaagaattatgaaggaaaaatagtgtgtgtggttgtttggatagcgcagctggttggcaatcgcatgaggaggaggtagcgaccttctgtatccgaattcattacaagatttctgaagagctctgtagctgtctcaatctggacatccagttgactttggttcatttgctgcgccgacgctgatgcattcattttattaagctgcaactgttgcacagcctgaatatatcaattgtatcagattagtgttgtcaggacctcaagaatgtgaagaaacgttgacatgcagcagagtcaaacaaagcttagccacgccacgactataattgtgaatcaatatcatatgatgcatccagttaaacatggtcaggccatacgatagaataccaagtatgagcatattacatgagtagaaggcgaacacaaatctg

SEQ ID NO: 86801 - DNA, 690 bp, Oryza sativa
tgcttggtggagtactcatcaagcacacactccttcatggccgcagcggtcaccgacggcggcgaagatgcgaacaacaactctagtgtgtacttcttcgcgagcggcctacagaacaagcgaaacacttatgacagcaacaaaaaaacggatcacatagctaaggtcggcagattagggacctgagcataggcaccatcaacgcaacgtgcgcgccattgcggagccctgaagccgtttgtattcccctttaatttgtctttacatttttgtgaacattgcagctagatttctgctctaaaaaccaaaaactactgatttttgtaaataaaacagagaggatacaatataaacttctaaactactctaaaatttagatgcaaagaaactcaattttcagatgctatattacttgcaaaaaaaaaaacttgagatgtaaacctgagatgcaaagaaacgcataccgggagcaggcacagcggtcacggtactgcaaaccgcgcagcaaaccgacgttgctctggctggacggcacccaaagcagacgagctggctttgggcccctgaaattgcacaattatggctcttcagagttcagagactgactgaatgtcacatttcagcagctaacattttcattttcagacaacaaaagaatctaccatgcattaatttcatttaagacaacaa

SEQ ID NO: 86802 - DNA, 2340 bp, Oryza sativa
gatgggcccacgtgcaaccacatggcgcaccgtggtctacgcgcgcacgtagggggaagcgaggctagccggtttgactcggtctagccgagttggcaccgacgtggcgcctacgcagcggccacgtgggccggtaacaggaggaagaaagggggcccggccgaatggacggcggacggcggccgagttcaccggagcttgtcgcgatgattcgagagagagggagcacaccggaacgatgagatggaggagatagagtgcgccaccggctcggattcaccgaagggagaccggcgacgacgaattgcggcggcgctcgccggcggcgagaaaaggggcaaacggcggaggggcgacgaggattcaattcgaggcggtggaagcatctccggggttcaaggagtccgtttccggcgtcggatggggcggaagagcaccgaggagggccggcgacgagcagcggcctccaagagcgggcggcaacggcggcgaggccataccgggcggcggcgggtctaggggcgacgtctacgcgcgttcgggagtgccaccgagctatcacgcagactagagggggcgagggagagcaaggaaggggaacgggaggaggcactaccgagctgggcgggcagtgataggcggtcgacggcacggggcgagctctccggccttggacggggaaggggaagaagaggggtggctggagtcttattcggctcctcgcgcgccggcttctaggcacgcgcgatggcgaggaggcgaaagcgacgagcggcaacacggtaatggcgcgacggcagtggaggggcaagagcagagagagagcggggggcgggagtggcttggcttttataggcggagaagaggcggtttgggagggggaaccgacatagggcggtcaaggcggcaactggctctggtgctagggcgcggctggtggccacgggcggcagaaggagacagcggcagaggccgggaaaaggaaaaaagggtgaggaaaaggggactctgctccttgcccaaaactggatgagggacaaagggagagagagtgggggcaaggagggagaggagctctgcctccattgtttggaaggacgcggcttggagcagcggacagggggtgacgccggtggtgaccacggaggtctctgcctcccggttttggatgctagcggcgtgcagcggcagagcggcagcgtgcgatgcagctggagccagggcagtcggccaccgcgcaggagcgcgcgcgcggagcgcgggcgcgggttcaaattgcggcagcgggagttttggcgccgaggtgagaagagggagagagctcggctcggcgatggctcacgcgcacgcgcgtgtggcgcacgtgcggagcgagggaggagaaggctgagagagagaacgggccgagagagatgggccaaaggagggaattggtccatccaaaatagagggatgcaaaatagacttcttccaagaaactgatttggagaagatttgaacatggaatttgacttggacttctggattgggatctggatgagaggaagggtctaggaagagatcaaaaggggaaaatttggatatttttggggtcgggcgaaaatttggcgaggattcaaagagaggacttgaattttggaatttgatttggagacttgaatcggaattggaatcttgaggtggacgattttgatggcgacgagagtgaacaacaatggagattgaattgagatccatgacacgacttagactcacactcaaagaacgaaattttcgcaattagggttttgccgaattagtttttaacgtctcacgaaaagcggagcgttacaggccgcaagctcaccgccacctagcttctatctccgatccgtgctgtaaacttgccaccgagcttcacacgtcaccaaggaaaggggtagcaggtctggcgagctcgatggggcagtgggtgatatatggagatggcaacggtggttgtgaatcgagcgaaggagggagcgataacaacgatggattggctaggagtggtagactagttgtcagcagcgccgattccatggggaagaagagaggaggatgtggaatagaaagcgaagaaatgatgggtggatccacgtaggttgacataatcatatacaagatatttgtgggtggactcagggacgtgttttttatttggtttctagcaatgaagttctcattgtaaaatgtttcaacagaagtataaattaaaatagtttaggagctgatttgaaaaatatagtgttgaactggaggcaaaaaatggattatgagcccctagaaatactatgcaacgtgaaatgtgtatcttttcag

SEQ ID NO: 86803 - DNA, 549 bp, Oryza sativa
agaataggaccatataaataatagagcactaaataatatttatctttcgcagagggctattgaagaaggtgcggattttatagaaacggacatccttgctagcaaagatggggccttgatctgctttcatgatgtaacactggatgctacaactgacgttgccagccgcaaggagttttccaatagaagaagaacctacgaggtggaatggttcaacgctactggctggtttgtaggtttgcacattacaaccaaacctaattccatccctcgttcttgtaaatgtttgcagcatcaaaagtcagaaataggaactaattgtgcatgccatttgattatttcttgagaccttagcttgaacttattacagttgaaagtagtgcatgcaagattttcttaaaatcattacctgtagtgttatgcctgcattagcaactggtattgtgccattttcagataatgccataaactatctggtgtttgctactccctccattttaaaattacttgtcgttttaggcttttaccttttgtcctaagtcaaacatt

SEQ ID NO: 86804 - DNA, 625 bp, Oryza sativa
catggcctcttcaaccctgcggcctttaattcatcaaacacctcatctttatcttttttgttcttaactttagcaacataaatatgacgactttcaccaacagctataccactagcaaatcccttgctgcctataagtctatctaaataccttatttggagaccaccaccccaaacagaggaaccctgcatacatccatatgcatgaacagcatgcattatgttcccgtactcaaccaaggcaaaattctttgggggataaaataagaagtttgctaaggggccaaactcctcaaatttcgatctaactagtgactctgcagcactatttcccagtgaaccaatccaaagttcctttgaaactgaaatcacatccctcgagaaatgagcaccataaagatcagatggttctgaatatgaatgcttcgcctttccaaaattctgccccggagaagtgagagttgcagctcccccagcagaatcatgtgttgattttggtgtgtgcatatcaagtcttgcagcttgatgccctgcatcagaaattacatttccttgcttgcagacatcgagtttgacatctgctaacttctcagttttcacctcatcagtatgcaccatctgtgcat

SEQ ID NO: 86805 - DNA, 675 bp, Oryza sativa
ttatacaaagtttgtagaaacaagacacgtcgtcttcttggaagacgaaatgattagggggagctcggtaattcgagaaattgatcttgaggagaggcgggtgtctgtacccgctccgtcgactcaggaacctttctaatgttgtgccagcaatgcatgacgttgcggtaccaacacctgttgttatctctcctgtggcaacaatgaatgaaagtgaagaacctattctacaggattcaacagaaattattgccacatcagaggaggagctgcaccagcctcaaacatataatgtgccagaataggaggcccctagaaggcctgaaagagtcgcatatcgaggatgatcccatctcatatgaagaggccatgagaagccatgaaagatgaaatgaaatcaatgaaattaaatgatgtctgggatttagaagaaattcctaaaggagccaaaacagtaggctgtaaatgggtctacaaaaccaaatatgactccagagggaatatagaaaagtttaaagtgcgacttgtggcaaaaaggcttcacgcaacaagaagggattgattacaatgagacattttctccagtctcttgtaaagattccttcaggattataatggcactagtggcacattatgatttggaattacatcagatggatgtaaaaacagaatttc

SEQ ID NO: 86806 - DNA, 659 bp, Oryza sativa
tttcccaagtttataattgacatggtcaggctatcatgtggcctttacataatccaaaaaaaaatgttttgcagtacgacttcccaactcaagagattgtaatacagtttgttatcgaggctatccaagctgaagctttcaatccaaagacactttttttgattggcagctatacaattggtactgtctctgtgtctcatctttgatattctggatattgtagtgggtatatacataaatcgttcatggatgcaggtaaagaaagactgtatatggaggttgctcgtttgcttcagaagaaaatatatgttggagctgcaaagttgcaaatattaaagcacttggggcttcctcaggaaatcatgcactggtttacagccaatgaagctgaaagtcacatacatgttgttcctatgtggactctggcaagcttcaagcggatgaagtatttgtccactcaatatgctgtaagaaaagtacttgatcctaccttcgtttgtaagataggggttttagcttgtttgatatgtccctattaatctgatgagttaatttaagaaaatcatggtctttaaagttgaagttgctatttctactccacctaaggataaggactaagatctgagcatcagagcatatatttgtaatctggctcttta

SEQ ID NO: 86807 - DNA, 672 bp, Oryza sativa
ttgtagaaagcatgcaatcaaacatctttaactttgactactgccaacaaattaagaaaactttgactgctaacatattaagaattatttagattatagggaggagtagaaaggccatcaacactaccaacttaagcattttaagtattgaagatgtaaagattgtttaatataatgcaaacagacattgatgcacaagcaaatgttgttgcatcaataatatcacctgagatctgatggtttggatgcctttcaagaaggcgtctcttgaagcaggagtgtgcaatggccccagtaacgtaccattctccaaaggatccccaattcggacttgtttataaacctcaacaagttgatcaagaaatgttcggtatatgctttcgtgaagaagctgtgttaacaaaacaaaagcatttagactactcatacaccagccattggggcagataagaaaaacctatcttaccagcctacgacatgtagtgcagcgttgtcctgctgttccaacagcagcaaacaacactgaacggacagctagctgaatgtctgcatcatccattacaataatggcattgttcccactaagttcaagaaggcatttgccaaatcttgcattcacttgctgctgaaccattagaccaacctgcattgagcaatcaggggctgcaggaa

SEQ ID NO: 86808 - DNA, 4727 bp, Oryza sativa
tgaaggagggttgggaaacccttctctccgccatgtataacgaagcactcattagcatataattaatcaagtattagctaatttttttttaaaaaatgatcaatatgatttttttaaaaaaacttctgtatataaacttttacaaaaacggcaccgtttagccgtttgaaaaacgtgcgtgtaaaagacaatggataggagttgggaacaaagtgcaaggaaaacagcctcagctcgattcatttgtttacgatgtaggagtagtatggtttcagtctttcagacccaaaagagcagagaatttgcactcgaatacttgcttactccacgtttttagggcctattcaatttgatgtcattttctatcatactatttttttttttggtaaagttgacaaaaaaaatatgtctacgtttagtttgttgccaaatttgatcaatatataagaaattctgccaaaattttagtgccaaaattttggcattgccaaaacttggtaaggtttattttggctacaatctaaacatgcccttagtatgttaatggtgaagagattgacacgtctgaacgtgataaaggagcatgagtctgaccaggtggggtccactgtcatggacccacaagtcaatggcccatgtccctgtttagatttcaatgtttttcttcaaactttcaacttttccgtcacatcgaacttgtctacacacacaaacttctaacttttttatcacatcatttcaatttcttcaaacttctagttactttttcgtaccagccataaccaaggtatgtcggcgacgtgatcaaagtggaacgaacacaacagcacaccaatcaaacgttgtttcactctgattggcccccaacacgccgctgaaccatgtgagcgacaatcagacggccaggcaggcaggcagtaggacgcagttccagttctcgcatgtgcacgcataggcatagctagccccccctgctgctccaacacacacttgagaatcggttgacggcaacgggaggttgcctatgcacacgctactactactccagtacctccacatggcgtcccgtcccgacccgaccccaacgcgacagatgtgcctccagcctccggttgccgcctgcctgcggctgcgccgacgcggacgcgaccggcgccgcgcatgcagcccgatcgcgtgattccgcgtcgtctaccaccgactcggacaaccgctgctggtcgcgggatgcggttggttgcaaaagcagtggctcctgtctctgctgcctccccgcgctgctctctgctctgctcacgggacgcacggccgccgcggctcacgggtggtcgcactgtcctcgccgtcgcctcgtcgctgtctttgatgctgcctcctctcccggcagggcaacagctccggcgcgtgcccgcccccgttgaatctcaaacttttgacaaatggggacatgttttacggtgatcgaaaggcatcagaaatgaaacgcctccaccttacgaaatactgagatgtccctgttttttttatatttttaagccatgttgtcgtaaggaaaagggggacatttcctgtgaaaaccatcaagacataaaagtattgtagattcatgaaaaaaataaagataagttttgtaaattcctgaaaggaaaaaaaaatagagatatgtgtaggtatgaaatatattcttaccagttttctctcaaatgaagttgagtttgaactttaaatttggtatgaaagtatttcatgcctatacctatctccaataattttttcgtgattttatataacttttaaatatggtttttatgagttttcacttattcgatggttgagatataagatatgcaagcaaacaaagaatgcacaatgttgatcgattcaccaacataaaaaaaaaatctatgaatgagtattggccaacagttaggttgagcaaacgagaactaacgtgtgagcacatacctcatagatttgtgtgctgatgaacttgaaataaaatagtatgtgaaacagtcatgtgtgcattgcaaaaagaatatccgaataagcatgtttgcccggtccataaggaaggtttaccggctaaagtttgcatgtttatagaaaaatatgaagaatacatttcagaaaattattccatgcctgattcccatgacatctgtcagggagccagatgatgctcatggctgatgacatgatctgccgaaccaatagctggttcacctatactttcaaaccatgaaatcggtttatagatccatcattgtaccttaactactgatataatggacctatatataccaaaatacaggtgtaacaagcaacagatcaggcagcaactgcagctatttttgctgtcaggagtcagttgctgcagaaactccacatattccatgcatttcaggcttcctatgacgtgttgagggagcaacaaaatcacacttaaaataactcaattcaacataagggtcctaggattagtaatgtgaaatatgatggttattgtttttaacaatctgaagcaacacttctgacagcataaccgtgcaaagattagtaagatgcagctaaattattaatataagcgggagaagaatggtgcaaaaccaaaatactgtcaagcgagaaaccatcacacttttaatgccacatccatacagctcactgcttaacagcattacagcgagtcagcgaccaaacattactcaatagagaaccataacagaaatctgaattacatcatcatgagcaaccaatcattacatcgcaccatagctatgtgaagcatatagttatatcgaagaaatctatgtgaagttttatggtttccttattcctcgacacataaccaatacaaacagccctcaagtaatgagtaggaagaaagaattacatgcaaaattttcttatataaagacttgttagtccacaatttagaaactcttataaattgcttagctcaccccaactgaacagaatctgaattatcaacgcagtatctttttggtatgataatatctaaactactactgaaaagataacatctctcaatgataatcattgaagcattttatcagaaaataaattatgtgcctcattcaatagtagatcaaggagtaggcaatttgccatgcacaaacagaaaactacatgctttacctaatgctgatacgataatgcatataatgcataacataagtgcattgctgttttaaaatgggatgctactgtcctttttttttcatgttagcattagcactagtccaaactaggaagttgccttaaaagagactttggtcgtgtttaattccacgccaaaattggaagtttgactaaaattggaagtttaaaaaaaaagtcggaagtttatgtgtgtagaaaagttttgatgtgatgaaaaagttagaagtttgaagaaaaaattgggaactatacaagcactttaaaagagacctgatgtggtaacctcaaaagtcaaaactgatactttaaggcagaacatggtcttgcataggtaaaacccagtaacacagatttgtttttacatctaatctatgaagtgcaatcttaatatatatctgaacaaccaaaaaggtgacaagacactcagttaagtgtcaaacaaacaccatgatgttacaacttacaactgcgaaacattctgaaagaacagacctatatgaacaatctaatcataaaagatatgatgatagtgtaacaaacgaacaaggttggctataaaaggaagaaccactaaggaatttgacagtttcaataagatcctgatcctgtttcagattacctctagtagaagaaatcatcaccaactatacccttaagtcttgcttttcccgaagcattgtagaatactaggcaaccacactcatcagtcaacaatagagatcttttgagtcttcaagccacctctcatccatgggatcttctcctgttatgtagcgaaggtggacaaccctcaaagaaatttgtgacggacgtctcaaggtcctcaactgagtatttgatgtacaactctgggtgccttccattctctatgtgatgccggaaccgaccaaggaaggatcgatatgctggaagaagtttctctgctattgatatcctaagctcttctctcagctgcgtgtctggcacataccaagcagattgaaccctatgtgcctcctcgaatgcagcattgaaagacttgaaacgctcccggagtgctgatttggatacccctgatgaaaagcccccactgacatgcagaccttcatctctcagacaattcaggatcttcaaccatgctgtccgttgatagcgagtggctgcgagccggaacttacctgtcagctgcttcaaatactcatcaccaataagcccccggagctccggtgaatcctttatcttgtgtgcaatatagtgtacattgttcatgacgaacaaatgagagagtgccgcatccttgtagagtgatgctttgctctcaagattgtgctcaagaaccacaataatccagataagatgagcagcaaggggtaactgactgtcagggtcggcaaggtcaagatcagggaaggatggggcattctcattgccctcaggagcaattcgggagcaagccaatggccgcgacacaatcagctcagacagtgtggttttgtagtcagaaatgaggctactgtaattcatgacatagcgagtgagaggatggatggtaccaccaggca

SEQ ID NO: 86809 - DNA, 664 bp, Oryza sativa
tagccacaaaccgtccttgtatccccttgcacgtctgcatcgttggtgtggcttgctgagtacggtggttgtactcagccttgctatcattcccctttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttggaactgtatattacttgtcgttttgtgtaccctggctggtcctggacagggatttaatacacaaaatagtctggaaatttgggctaaatttctgggcgtgacagcctcccccttgccgcctcccccttgccgccgccgcgccatgtctcggccgagccggcttcatgccgtgcccgtgccccagccgcgccgccttgtggccgtccgatcggctttgggccgatccgggccgtcggatccccgtgaccggcggtggaccgccttcgtggtcccggtccacggtggaccggcgcctttgtgccctgaccggggggcccgcttccggcgccgcccctccctttgatgaccgtagacagcctttttctttgagaaaataaa

SEQ ID NO: 86810 - DNA, 608 bp, Oryza sativa
cgtaaccatgtgtgaatagattttgagctagtagggttgcagccacgagtaagtcttcccttgttattgggtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttt

SEQ ID NO: 86811 - DNA, 3526 bp, Oryza sativa
  unsure (1)..(3526): unsure at all n locations
ctctctgcttctgcgttagctttgtatatatttgaggttttcagtatagggtgaagtatggcaaggcttggagggcacgagaggaggctatgaagctcatttacggtgaatggggtgaagcgtatgtccgtttgcccactttgctgcaagccattaagcagaggaatcccagtatggtctaccacatcgatactcatcctgatagggttgtcaatgttgatggagtgaccaagaaaatttttatgcgtgcattctgtgctttggtccttccattgaggcttttaagcattgtaggccagtactagctatagatgcaaccttcctaactgggaaatacggtggtgccttgatgactgcattatcagctgatgcggaggaccaacttgtacctttagcttttgccttggtggagaaagagaattcacgagactggtgctggtttatcgatcttgtccgacgggttatggttgggccacatagggaggtttgtattatctcagatcgacatgctggtataatgaatgccatgacgactcctgttccaggattgccaccggttcaccaccgatggtgcatgaggcacttcagtgctaatttccacaaggccggtgcggacaagcatcagacaaaagagctcctaaggatatgtcagattgacgagaagtggatatttgagagggatgttgaggcactaaggcagcgtattcccgaaggtcctcgtaaatggcttgaagatgagttggtggataaagataagtggtctcgtgcatacgatagaaatggccgccggtggggttacatgacaaccaacatggccgaacagttcaatagcgtgctagttggtgttcgtaagcttccagcgacggccatagtatcatttacgttcatgaagtgcaatgactactttgtgaacagacatgatgaagctttgaagcgagtccagttagggcagcgttggtccaccaaggttgatagtaagatgaaggtgcaaaaaagtaaggcgaacaaacacactgcaaggtgtttcgataagcagaaaaagacatacgaggtcacagagaggggtggtgtaacgcgtggtggtgttagattcggcgcaagagccttcaaagttgaagttgaggggaactcatgttcttgccaaaggccattgctctaccatatgccttgctcacatcttatacacgtttatctgattcatgcaattgatgaggaatctcccaaccgaatgccgtatcagttctcttcaagagccgttgtgaacacatgggcaagtcgctttgagccatacctcgaccccacacagtggctaccgtacgatggtgaagaatttgttgctgacccaaatttgaagattaaaacaagagggaagaggagatcgaaacgattcaagaacgaaatggactcgggtctgggtggttctggaaggaaaccaccttcatgcgttaaacttgatgctgcgccggtgcaaaatagatgctcgttgtgtcaccaggagggtcacaagaaaactaagtgtactaagcgtctaaaaaagaataagtccaaaaaaaatataagtgttaggggcgtactacgaggcccgtcatcgcggggctgcgatcgaggcggggagggtatgaatcggcattgattcacttgtgaaaaagtattggtagcgtgtatttgacattatattaactaattgatttacaattgctaatgcaggtacttcaaccgctccgagtcagagctcatgcccccctagtgttcgacgatagacagctctgtgaggcctgttgtcgtcaggcaccatcatccaacatgagtggttgtgtgctattgatgcagctgtggatgtggttaagactaccggttggaaggcctaagtggaggcaaagcttcactccttggccctacaatgagccagacatggagaagacagtggcctacctttttgagagtactgccactgcacatgctcaccgggatgtggcatacaagcattatgtcaatgagatggactgcttacagcctcaacatgtaagtacttccaatatcacttctagttagacatttacttctttaattgagatactaaccaacgacatctcttcaacttttatagattgagtggttaccataccacacaaatgaggcttcaagcctgaccctgaactcgatgtgcaatcgagactctgactatttcatgtaccagtgcccattgatttgtttctgggcagttgagtaccaccttccgcaccgtgtcatacgacagttcgggaagaaacaagactggccggttgaggacatctcaactggagttgaattacacaagtaaatatttcttatctctgtttgctttcattgtcaatgttcaattttgtaccatttaacccttgtcgatgctcactattgtttcatcaccttctacttgtctaggtatgacagggtgagaacaaagaaggtgaaagactggaggctagagcataatagatacattgatgaatggaggacagccggaaggaacgacaggtacattgagcccatacaccaaaatcatcttttttcagagtaccttcgttggctgcataggacatatagactgttcctccgcgctacttggacggaagcggacatagagcgncccgcggacttcgatgaggggcggaatccctatgatgtccggactagagttggatatcagatggagcacgccccacttacagacagagtcgtaacttttcttgcatttgtcaaagttatttccatttgcaccctagactctaacatatatcttctcacgctttcagtcgagagagctcctcaggagtgtgaatcaaatggggcatgccctccaagctccgaggggtggtgaggacacggagaacacactccgcaatgttttagaggtaaaatttatttagcactttgcattacttgagttatgcctaacaaacttctttttttttttttgaaatgcagaaagttcgtcaaaggtgccggaaacttgcagcaagattaggttacaggtcggttggattggacgacgtgtaccaaccgcggagactaccaccaccactacctcaatccgggcgtccaagtaccgctcgacactccatcaggatagaagagcgtgaaggagttggtggctcgtcgtcgtcacgcattacgcaaggaaggggaaagggaaaggcgccggctccacctagcgatgacgatgacgacgaggacgaggaggatgaggactacgtcgcaccagacgccgaggagatagacatgtcgcagcttcccgacgcgcctcaggggacgcaacccacgcaatacaacttgcgatccactcgggcagcgaaaaagaggtaaaatgagcttaccattctcaaatgttatttgatttcccttattttgtttttaaaatgttttaaacattggattttcaaatgtaggtacactccgggctcgcaagcaattcggcgccaacggaagaagtgatttgtatgaagttaatctattggttggtagtatgacatatgtggtgcactttgtg

SEQ ID NO: 86812 - DNA, 1237 bp, Oryza sativa
ggcgcttccacgttcaatcacaggatcctagatattttatccaatcataactaaaatgtgccattttaattaatatactaactaataattagataatccctccgtttcgaaatgtttgacgccgttgactttttagtacatgtttgactattcgtcttattcaaaaaatttaagtaattattaattcttttcctatcatttgatttattgttaaatatatttttatgtaggcaaataattttatatatttcacaaaatttttaaataagacgaacggtcaaacatgtgctaaaaagtcatttttatgtaggcaaataattttatatatttcacaaaatttttaaataaaacgaacggtcaaacatgtgctaaaatgtcaatggtgtcaaacatttcgaaacggagagagtaattactactccctccattccaaaatatttgacgccgttgactttttaaaacatgttttgaccgttcgtcttatttaaaaaatttaagtaattattaattcttttcctatcatttgatttattgttaaatatacttttatgtatacatatagttttacacatttcacaaaagtttttgaataagacgaacagtcaaacatgttttaaaaagtcaatggcgttaaatatttagggaaggagggagtacgtattgcacccggtaatttttgttatatgttcgccactccaattgcttttgcgtcgtcgtcctcctcctgcggccgcggcgcgacgggagtccagccgtgccggcgcaggccgtcgcggacgaggtcactgtcgtggtagccgtcgcggaagctctccatgtcgtcgaccatgtcggagagggacgagaaaaagatctccttcttccactgctccatccgcgggaagccgcaggtgcgctcgccggagtcgtcgcagcgttccaggtccaagaacatgtcatgcgtccaccgcttcggcaagccggcggcctccatgccgcggctgtgctcctcgacggcgcgctgcatctcctcctgcgacggcagcgtcctccgcccggacagcacctgcgccacccacctcgcctgcacctcgatgaacaccggcagaagcaccttggctgggatgcccacgaacgacagcgacggcgccagctccggcgggaacacgtgctcgtacagcggcccgacgcggttgtcgtcgacggtgaccttcccgttcgtgtccaggaacgggaacgagtaggtgttgccggtgca

SEQ ID NO: 86813 - DNA, 705 bp, Oryza sativa
tcttcctacttcttggatgctggcatgcagtgagaccctcaaagcctccagctctcccctcagcttcaatggaaccaggtttttccactgtaagaaaaatgacaatgctttataaggcacatacgtacatatatatagtacaagcttaccaagtaaattataatgttcgcatctattttttatgtatctttaacgatgatacaacagtgatattaaacatacgtaatggccacgctactactgtctaacagcataacgtcatgtcagccttcacacataagcacacgcatacatacgtccaacaagcaagtaccagcgagcattctcccaaaagtttttcttcttaaaggtggggtaattgtcacgcccagaaattcccgaatagaattccaaacagaatgtgcattaaaatccccgtccaggaccggccggggtacacaagcgacaaagttgacatatagatccacgtcttacaaacattataaaagtcttacataaatgcagcggaaaacttaaaggataactggagctaagccttgacttggactgcagcgggaacaccactccacaggcatcctcgacagcacggacgaagcctactcctcggagaaaccatcatctgacgcatactcaaattctggggtttggggaaaatagagcaagactgcgtactacccactgtactcagtaagtcataccggaata

SEQ ID NO: 86814 - DNA, 1140 bp, Oryza sativa
tggtaattgaggcataatttctgagcaaaactgaggccatatctttcatagtataccccttattacattggatctaatgctatttggtataatggtaggaaatttataagctttttcgtaaaaattagaccatgacaacgcccggggcaaacccgccctccccaacacctgcgaggatccaggaagaagcaaacccagccacggagacagttgccgaaggtcatccctcgacaacagcggtcgaacaacccgaaattcatggtaatttataggacaaattttcaccacatgaccacataaattttagctagcaccctttaccaaatgttgccttctgtttgtgctgcagaattgccgtaggaacaacatacgtcgatgtcgggcgggacaagtgcaagtaggtcgagtagaaatccccggtcacaaaatatatggccgaccacagtgcaagttataagagaggttgacgctagtggtaggcccacggcgcccaggactgtcattggaagatggtctaactgctgcgggctggcggcacgtgagaacttcgggatcctctataaagatatcggtaaggtcacagaagccgagaaagaacgagcttggacggcaatggagaaatggttcacatttccggctgaagcaaaggttaggctcaagcggaaggcattccataagatgtgcaaagcttggaagaattggaagtcgaagctcttcaccaagtttgtcaacccgcccagcaatcatacgccgttcgatgaataccctcaaataaccgaagcggtgtgggaggaattctgctctctcaagaacacccaagagtttagggaatcaagcgaggcacatcgcctactgcaacagcggaatgagcacccgcatcggctgggcaccgcagggtacatcggcaaggaggcaatatgggcccaagaagatgcatccgcagcagcaacgaatgtccctcccccgttttcagacatccctgaacaaagagctcgcaactgggcgcgggcaaggggtaaggtcaacccggacggctctgtcacatttgagaacaaaattgatgccgtcgtctatcaggaactggtgagttcactacttaacctaactaatttctgttcgtataaagtacaagttcgtata

SEQ ID NO: 86815 - DNA, 6445 bp, Oryza sativa
gaatttcggacatccatttctcaatctaacgatagttttcaagtttccactacatatatagtttgcactacatattttccttattgaaaagactcttcacagtagcaagctagcatagacatcgtgcgtcgttcttctccaatcctaaggttatacatacctttgggttcgtcttcaaggctcttaattggtcgttggttccgcgagtctttgagacaaagttaggtaaaaattttcacactttgcatgcaaattagtttgtttagtaatgcctcatagagtcaaagcatgaactattttctccatattttcatatatacaagcatattgcttgtgcgttaaatatacagtacatgttgtacaaacgttaaattgtaaatgttgtgtatacttaaatgtacataaaaatattttaaaaaattgtgagatgtgcaacatgcatgtacaacacgtaaaaatgttactcaaaattatcatatgcggcatgttttgacttagtttctacttatttttaagtctagctaactctcccttagtctcaaaataactttactttagcctctacctcgtgtcaaaataagtttacctttatcaacttacctatatcatgctctaattcacaattcgatgattttttttattccatcaatatcttttacctatccttacctacctatctacctatccacacatactagtttcctattagtgagtgacactttggtgttttttcttctatattgttttgaacatccaagtctaaacttaaagttattttgaaatggaaggaccgaagggttattatcttattaaagtgtaatagcaaagaaataagcttttatgtttgctctcaaattacatattaatatgagaaaaaaaatctaaaccattaattatagggtggatctaaaatatagctgtgtggatttattggatgcgctcttcatgaaaaacaaactccatatctccaatctatattcaattcaaataaaaatctcaaacgatgccatacacattacataaacattttcacaccacccacaattatatatgcatattactaattattatttatctaattacattacttagtttgttctacggaaggttaattatataattactcaacaaattaacaagcaaaacaagggctaaaccatcacttctgtgaccatagagccaaagcaacacaactctatagcagaccttatctttcgtggataataaactactaagccaatccgctcacctctaacggatcatcaatgacggtttatgaagttatctatgataaatagtctatgaagttattgttcggttttgtgcatatagtttttatatctaataaggcttgttcaggctaaaaaaattcatacgcacgtcactgtttgaatgcttttcatctcgagagcaaatagatgtttcttgctttatatatattgacattatttttaaagatactccctccgtccctaaatatttgacgacattgacttttttttaaacatgtttgaccgtttgtcttatttaaaaaatttaagtaattattaattcttttcctatcatttaattcattgttaaatatacttttatgtatacatatagttttacatatttcataaaagtttttgaataaaacgaacggtcaaacatgtttaaaaaaagtcaacggcgttaaatatttagaaacggggggagtaaaaaaaaatactagcacaaaaattttaacatcttttgcatctccaagctaggatggcgagcatcatcacccactcctcgcacccagaacaccaattacgaaagatgaagctcaaatatccatttacttgcaacttatgcaactatcccggtgctatcagttgctcacaacaatcacctatataaacacacacatcttactgtagcgcatttaggatgtccgtaatatcattgacaatcaaattcaccgccagttgccgggcaaacatgatcagaaacctcacgatgggactgccaccgctgccgccccagccgccgccgccgccgccggtggcaggccaacccctcgtaccagctggagcaccgccggcgccggccggcgaaacgcagccgatgtggagcatgaacaagcataggccgcaccggtaatgccagatggagcagtccaggcagcacgccgcgcactccccgcgcgccgggaccaagttgaggacgtggcctccggggcacccggcgccggcgcgcggccgggtggatggtcatcggcagcagcgtgcacagcgggtgcacgtcgaacgcgcactccgcgcagcggtacacgaggcgcccgggctggatcggtccctggcacaggtcgcaccacccggggttcgccgccgaggcggtggccgcggttagcgggtgccgcgggtgcgcgaagaagccgtcgatcgtgtcccgggcgaagcggtcggcgcaagcctcgtggatggcgaagtcgctgcagtggtggttgcagcggtagccgacgccggtgacaggtagctcgcagatgttgcaggcacggtggctctgatccgctggttgtatgtgcacctctgaagctggtgctgtggatgagcaaagtgccagcggttttccatggcaagcaagtagtcacacgacacccggtgggaagaaaattatgtcgggccgaggtcctaccctcctcggaaagacttgctcctttatgtgacacctgtcccacacgaatctcagaacagcttactccctcgtctttccagttccccattctcttcctttgctcggtgaggcggcaagctggcgtccgaccagcgagctttagcccgaccgttcgcacgggcgcaccccgtggcgtcgagcagcatcaagtccaagctcgcgctgtcaacttgcgtgccggtagtctgctagaagaactctcatgatttggacgagactgcgctgtcgacttgaatttgttacatgattattcactcattcgatttttcttgcctcatagcgaaattattcaatgatttgatttttcttgccattgaatttgttctgtatggtagtactgcactgataatcattgcttgtgttgacttgaaggatttcttctttttgccgggtgagcattttaggattatagcgttaatgtattgatgtttcttctcgacgagcgcctcatgcgagcttggatgctttcacgttactgatatcgtttgattccggcgacagcgacagcctgccgagcttcatgccgctcacccgctggtcggacgcgagctcgccgcctcaccgagcagaggaagagaatggtgaactggagagacgagggagtaagctgctctgagattcgtgtgggacaggtgtcgcatagaggagcaagtctttcggaggagggtaggacctcagtcctacataattttcttcccgcacggtgcaggagcagcgtactgtttttacgtattactgtacgtgtttctgctcttcgtgttgcgcttgatattccggggtgcgattgcgaatatatacacagtaacacaaataacttgtttttttttctttccgtttttcttttcgttttttttcttgttttttttccctggtttggcgtttctcgttttttttttctttcggttttttcttttcggtttttttctgggtttttccccctggtttctttcagttttaaacttatacgtatataaattttgtattcgtgcatatacaaagtttgtatatgcactactttacatacgtacgcatacaaagtttgtatacgtggtgcttttttcttggtttttggttttttaaatatgtatgtatttacgtatacaaagtttgtatatgtgctgtttttatgttttttcttcgttttcgggtttttaaatatgtatgtatttacgtatacatagtttgtatacacgtacacaaagttttttatactccagtgtagcagtagtactagtagtatactagtatagtaatagcaactgtgtacgatcagtagctagctaccagttccccaatccacgtcgctctcgaatcctcgcctgctacagttttttccttctcgattccggcggcctcatctcccgcggagggagggaaaagggtcctcccccctcccctagtatagtttaatagccgggctagtctcgttaggtcgggttcttcctgttttttcttctcgttggtgtggtatggaggttggagacagcggcggcgttacggatgtagccaaactcggcgatggcgacacgaatacgaccgaagatgacggtggtggcgcggatccagttcgcagcgacggcggcggcttggaagcggtctgcagcggaggcggtggctcggaggtggtccgcggcagcggcggctgctcggatgcggtctgcggcggcggcagtggctagaatgcggtgatccgctgcggtggcggcggcgtggatgcggcccaaggcggcggcggctgctgacgttgcccgcggctgcgctgttgctgcctttggcagtgatgatcgcgccgtttggcctacgtcggcgtcggtggtgtgagtctggtgcttctgctccaccttgtgcaagtccgctcttccccaacgttgtgctatagagaacagttcattcgtcgatggttgtgctcttcactgcatcagggtggctggatctgggatccttcttcctctttgtctccgggcagtggcatccacgctgggtgtgccatttgggttgagctcaagctcctcagattcaatggcgaactcgatccatggtgaagtttggttgagtccggtgaaacctacaccaaaatctacggctcaacagcaaatctccaatttgtgcaatttctatgaaggcgaccgaaggggattactggttcgtcaagcggtctgcatgctaaaggagacccaaggttgcaatcgtcgcggcttcgccgctgctccctgtcgattcgcgccttctgcgctgcctagtttcaggaggttgtttatgttcttggtccagttttctattctgtgcatcttgctgtttctgttgacgatgttcgggggcttgccctcttgatctgttgctctaatataaatgtttaagtttcaaaaaacagtgtagtagtactactagtagtagtataggagtagtagtatactgtagcatatgcctgaccgcgtgagcgactgggcgcgcgcccagtcacccattagcagtcccctaactagtgatctataaatagaggctaggaggggaatgaaacgggacttgaattgtaggccttgtttagtcccaaaaacagataaattaaaaactaattgcacaatttacatgaaaatcgcgaaatgaatcttttgagcctaattagtccatgattaaccgtaagggctacagtatcctacatgtgctaatgatggaataattaggcttaataaattcgtctcgtggtttccaggcgagttatgaaattagttttttcattcatatccgaaaactccttccgacattcgatcaaacgtccgatatgacaaccaaaaattttcttttcacgaactaaacacacccgtaatctaaatctatcactatacttaaatctctcctcctcgccaacttgtctctttctcgttcaactcctctctaaattctatctcgactctttcttcctctgcaagttggtaacaggagtttacgcggttcattcttcctctgcaacttggctctttcgctccgacctgattcagtttcgatcgggtacgtacacgacatgttgaaatgtggagacgtatacattgatttgaacctgtaaatactaaatacggaacacgccatggaacgtaacagaagcaactgtgacatgtgttggaattttctcatcgaaaattcagaaaatttacaacttgcgtggtttagagtagaaagtcgaatctgaaaccttaggcaccgttcctatcagctactcggttgagcgctactactacgttttctgtcagagtttcctgaaccagaactatacctctccgttcccggccatccagcggcgtggactcgggagttttagtcgtctccttcggctccgatttccgcttctgcccccacgcggattcggttggcagcgcggactcggggaccgctgtgacgctgtcgtctcccctcggtgccggccggagaaacgcgcgcaggcgatatggagcacgaacatatacataggccacaccggtaatgtccaggcgatatggaacagtccaggatgggaatggttaggatatggattgaacttaaactgttttaaaccgttttaagtgagttcattcatccataatttaatagagtcaatccatcatgagtctattatatcaatatgctatccatagatatccaaatggatcatctattctagtagtaaaaaaaaattcttattatatgtatgtaaaactcgggtccaaaattttaaaactcgcgttcacattataaaaactatatctcatttagg

SEQ ID NO: 86816 - DNA, 2365 bp, Oryza sativa
caataagaaatgggatgagaaatttgattagttcgcagcaaaaaaagaatcatgagctaagtttaaaatcaaatactagcagtacgagatctaaattggaacatatagttatatcctgtttaaattcagaactagtttactaatttacatgatttcttatatgtggatacaaggttacaagtcaaattacaatacatttctgataaaaattacagaaaaaaactattgtaatttttggttgaaagcattttacctgaaattacaaattttagcagtgtacattttgtgaaaattagcaatacaatcaaaataaacttgtaatttcaaacaatgtttacagaaagaaaattataagggttgccaccaatcatagttgatagattatttagttgataaatttttggttgaaagcattttaaacacataaggtttagtatatttgaaatttgcaagttgataggtgctaattggcacactctaattagtacactagaatatagcagatcttggtgctaaaaagaaatcaaacagtttttttttttaaaaaaagtacgtttagttgaaatgccacaaaaggtaagatttgtggaaacatttggaagatttaaagttgttggaacaactaaaaaatacagttaagttgttggtaacaatatttgagtacatcttttagttttatcccaacaaatattcgattacaatcgcttaattatttgaacattacatccataaggcgtacagaaaacacaggacacgaacaagggatttggatccggtgcagttggtagtgtgactgcaacttatgcagtccactatcagctgttagatccggatccaagggctaacatgcgtccgggtactgtagataactgtagcaacattgtttagtactgcttttacattcactgtagctaaggatctagtccgttcatcaacaaaatagatggctccttttgcttgcagtagcttaacttgcagtccatatacaaactgcatgcgatcccaattcacgaagaagatatactaacagacttgccgatcgattcgatgagcatatacggttgacttgacttagcctataaccccggtggatcgaacaacgggttactacacattattggaggaaaagaaagttcaaaacggaattgaaacgacaggtgatcgcacacacatacatatatgacccaaacaggcctggtgatcatcgacgtggcaattaatcgaggaccgcttgaaggacgtcgagcaccggcgatgccagcccgccggttgctaggtcaatcgctatcatgaagcttttcttgaggagaaacttgctgacgctagtgctgcggctccgctcaacaacagcagtagtgttccgagcatcactggtagtttggttggcaccgctgctggtgttgccggtgccctggccacggctgctactgttgttctggttggtggtgctgccgctaccctgaccgacaccgcttggcgcgccagagacgcacccgatatgtagccgataagacggagacgtacaagggccacagatgtagtgccacacgggcaaacgttcagggcaagcattgcagtgccctgaagaaggtaccatgttgaggtcgtggtgtgggtgaagcgggctccggatcgtctgagggagcaacgtgcacagggggtgcacgtcgaacttgcactgtatgcagcggtacacgaaatttcctgggggacaatgctccatgcagaggtcacatacccatcctttattctcaggaggcatgcggcagagcgtaagggtgtgccacgggtgggcgaagaagaagatggtctccttgaagtagtcggcgcacgcctcatggatgtcgaagtcgcaggcgttgcagcggtagccgacgaggccggagagcttggcttcgcagatgtcgcagacatggcgcgaggcgctgctgtacggggtcttgagaaggcggtgttgtggatgggcgaagtgtgttatgtgggcatcagttgccatgtctttggctacgctcagaacgcccaatctctctcttggcctagtttttggctacagtactgtgttctactacttagtatttctatagatcgatcagactactccacggttagtgtctgcctgtctggcttcggcgtgcctctaggcgctcagcatacatttataccatcttcacaggctcacagtctactgcagtaattaatgatgtggtgttgtttgactcagtgcccatttctgtatggaaaaaagtccaaattacacccgctaaattattagacgagtgcaaattaacctcctagacacaaaaatcatacatttttcactctcaactattacaccctctaaattattggatgagtgcaaattaac

SEQ ID NO: 86817 - DNA, 7081 bp, Oryza sativa
cgaggatgtcgacaattctgagctagcagttgttgatggaggagtaacatacaatggcatcatcgatgcaatgggagaggatatcattgtgcatatcattttcaaactttctcttcggcattgcttactcaagttctaaccaaattatttgttttgttgaatgattgtaggttggaccgtaggaagagcaagaagattacggactggcatgctcatcatctccatcttattgagcggggggacaacatagcagctaacgtagtgcctcacggagtggagcacaacaagacatacttcgacgagtacctagcttggctcctgaggaactaccgccttttccttcggccggcatggactctagctgacatagctacagatcccgaggatgttgaggagatgaacgagtatgacacccacactcgagcaggggcgacggtcgagtacgggcctgtacgtgaccgagtggtaagtattaaggctcagagttgttcatttcacatacacctacatgttctcacaatattaaatccacttgcaggcacgtgagctgatgaggtccgtgaacgacgcgggtgttgcccttggcacacctgctgggtcagagaatgaagttgggatacttcggagcgcacttcaggtaattaaccaattagttcaatccatgaatcatttcacttgcctctaacttatttgttttgttcttgcagaggctaaaacaacgaagtcggatgttagcggcaagacttggttgtaggtccacaaacgcagtcgacccacaaccaagactaacgcggacacaggccggagaaacaagtcaacaaagagctgaagaggaagggtaggaagaacatgatgaaggggaggaagaacatgaggaaggggaagaaggagatggacagagtgacgaagaggaagaggaacaacccgaagaaatcgggtcatctcagcttgcaggtgccccgcagccatcgcaaccttcccaaggtcgcccgcatagaaagagagcaccggtggaccggtacacaccttccactagtggccggaggggtcggcactagtggattactttgtacttaacactctaagcagcgttagacttatatcaaactttagatgatggttgatggatgtgttgaactctatattttgtgatggttgatggatgtgttgaactctaaatgctgtgatggttgatggatgttcagttgctgtgatgtcttaaatactatgtggctgtcaattttatgatgctgtcaatttctgtgtggctggctgtgctatgccagccactgcttgacctcagcgccaaatagaatggcgctgagattgtgcaggtcagcgccagagcagttggcgctgaggtgcacaagatcagcgccaaggtctttggcgctgagatgcagcccactcagcgacccagccatccctcgggtggcaacctcagcgccaaatcggctggcgctgagattcagcccccccaaacgtcagcagacggccatacaccgaaggaaacggccgtcaagtactcagcgccgatgcggttggcgctgagttgttcaacctcagcaccgtcggccttggcgctgaggtcggggtccagatctggtgatagtttttgccagggaccaaatttgcaaatagttttcaaaaagggccaaattgtcaaattttcggttgatcactgtattgttgcaatatccctccacgatcaaaggcttactttgggctcggtcgctccaatcaattaagagattgactctgaggttgatgatatacaatgttcaattgcgagattagctatcgagactaacgtatatagatggtgatacttggaaaaagtctatcggtccctatctttttcaagataactagcctaaagccgcacgttcacgcgactataaccaccctcttttattccatgtgtttacatgtttacatcaattagcttaattttataataactactccgtattaacattgtgaataagtatgggtagaatataattgcatgaaggaacattaacaaatttatcataatttgtaactaagaatataatcataacaataaataatttagcatacattaccgtgacatttaccacaatctgctgaatttctaaatgtgtcatttgaggtcatattgtaaatatgttgtaatatgaaaagcccaacccatcttttggttgaacgaaacattgagtgcaatggctacagttatggtttttattcaccttctgtgccgctgttttgtcctgagcaatgctacacgtacaaaatttttcttactaaacatttactaacaatcatctcaaccgtttgatttaagtagatggaagttataaaaaatctagatgcactcatagcatgacatatcagtgttagtaagaatttagtaagaaaaagttagtacgtatagcattttccttttgtcctatctgtggaggcgcagccataactgcccacttcgctgctgcttgagctccgaccttgacaccttgttgccatctccccggctgttgcatgaccggatgaaccccttatcccctcttatattcaacagtaaacgatatactactaacacatagttaattaaagaggaatatgcaaatggtatcgcacatccagccataattttaatcactaactacgatttactttaaaaacgactaaagtaccactctagtaagaaaatgggaaatttagttgtgtggtaattgcaatgtgctcaaaatagagctaacatgttaaaagagcagaataaagtcagttcgggaggattattatttctatttctcacttcttctagctactttcttcctgtaagcagaatgaaacgattagtatttgctcctcattttttatagtcaaactaaaaattgaaatatatcgttgtgttaaaaaacaatgaaaatggctggtccaacatgatagaatatattgtgttcctataagctgcaaaagcattaacatatcttaaaaatgcagaacaatgcttctaatttgtaaactctaaatactacggtcattaattattatctgctatgattcaagagtctcacttcggtgccttctacctagagtagaaaaaatctgaaccgctgatctcatttgatccaatggttcagatctatttttactaccaccacacttaatggtagtagaatcgtggagggtacttttgcccaggaaaaattatctacggagggatattttcgtcctttccccccgaatcgcgcatctggagccgacacggagagaaccccgcggctcccatcaccgccttgacgacctcgcctgctccactgccctcgatgcctcctactccctcgcccccgccgcactcgccgcctcagccgccctcgacgagttcgcatctctgtccgggatcgccagagctgcgccctctcctaccgctcccccgcgtcggcccaccttccgacgagttcgcctctcggatctccgcctccgatcccagcaccgcgccaccggccgccgccgagacctcgtcctcctcgctatccccccttcctcgtcgtcggcctcctcccccatgcttggctccagccctgtccatctccgcccgccgttgatcccacagccgcgagggcaagcccccaatccatatcctcccaagcggaacccgcagcctccggagccaatgaccaccaatctctcgacctccgaatcatcatccaagactcctctcattggctgtagcgctgctctccaacggattagctgacatgagagactctttttctgctttgcaggtcagatttgatttgtttttcttgctgcttgcaggtttgcagatcgaacatctgcactgaatcttcttttttcgttggcctctaattctcgaacagtttttctgcttgtctgcagttcttggtcataatttttcctcctaaaagaagggattcaagttgaatgccagtaaactgaatccggagcaagtgagcttgttcaaatgactgagcatgacaaggtggacaagctaatgatcactacgtcaatcaacgcttgagagattcctggtgtgctatgtcctgtaattcctgtgaattcattatctcaagatggctttgggtggctttggcttgttacttatggccatgttttttttcagaactatagcttattaacagcttgtggttttgaaagtacccatctgtgtatatcatcgtttttgtggttcaatgtatattacttgttgtaattgcaattgtaaagtctatgtaaaaaacataccggattattcttccgttgccttgtatctgtcattgctggattggagtgtttcgatttgtccatcgtgtgtaatattcagatatataactaatatatttaaatttcatatgaaacaatcaagctgaatggaaaccaaatacctacagcaagaaacatctatggaacgcgatgcacaagcgccggcggtggccggacctcacgatctacttttctttttctttccctgcgctctcctttttgattaatgaggaaacggcgactctgctgttcgatgaagagggatcggcgacgcttgaccataggacgcacaaatgagaaaaaaaaattaagtgccagatttacccctattcggttttagcactttactaatctaccctttaaaataaacggttgagattaattctacttggagtagaatactgcaagtagagggcaacggagcgtctctcatgattcaaacatttataatttgatcttccaatttttcagaaggtaatttgtcatgtctaacacttcagcaactccttaatttccgaatacctattattagcaaggagaaagaagaacagggttacctaacaaggattaaatataatttgaaggacagatctttgcccatctctatatagtaaacagcatgtgtgcattcatgacaacctaaactttagtactgctatataaattggcgtaaagagattccacactgaggattaaaaataattttaaggacagaggtttgtccatctctaaatacttttaaggtaagtttatgacaattcaaagatcaattaattaatttagaccagttccaatgtcgatctatataattggcaagagatatatatgaatatagtaacacctattgctccaaacaaaaatgtgaaactctgaattaaggatattatatatctcttgcccttgactaaatcataggccacgatcagtgagctagctagtgagccagtgagcgtacacgtcgaatcattttttttttataatgaaacaaattttgacctttattttgaagaagctataaccattatgtcggatcgattagtagtgcacgtatatatgctcacctgtcaaatcttgatttggtaagtaacaaaaacacataaacataaattaatatgtcaattagcaactattcgcaataattaacctattggcttagctaggggacagaaagtggtggagctagaaaatttataaatcctggacaagcctaactaaaacggtaaaatcactaccacttatttaatgtttatatgctcatttcactatcaattgagagacacaacaatattctaacaaaaaaaacaattcaatatcatgctaacaatttcactataggctagaaacagcacccattattcctattataaacatacaccaattcatatccatgctaattcattcggtcacgtcctccattactatacacgcaaatcaacaacgctgtttaagccctaattgtatgactactgaaaattcacccttctcaacttgtcctgaagtacacgaatcgatcagattctaaaatacataaataactctcatctctatagctcagcatgcgcagcccgggcaactgcccatgttggccaggtagttaattaatctgttgctggacagacaatcatcatgggcaatctggcagttgacaattaacaatgcccactagcattctactcctaattatatagcctacttgtctctcccattgcggattttgctcaaaagtactccctccgtctaaaaaaaggcaaaccctgagtttccgtgccaacgtttgactgcccgtcttatttgaaatttttttataattagtattttcattgttgttagatgataaaacatgattaatactttatgcgtgacttatctttttaattttttcttaattttttcaaataagacgaacgatcaaatgttgtacacggaaaccatggtttgtctttttttggatggagggagtatgcatctatgagcaagttcaatagtatagtccaccactagctccaatttatctatagccgatctaatagccaattcatacaatagttgcttactatactattaacatatggtcccacctgtcatacacacattacatcttggagtccgtgctgtagctggctacagatctgtagcccgctgctcttctctctcatcttttatctcattaaaatatgtttataactggctagtagcccgctattgtacgtgctctaaaaagactcttcacagtagcaagctagcatagacatcttgtgtcgttcttctccaatcctaggttatacatacctttggttcgtcttcaaggctcttaattggtcgttggttccgcgcgtctttgagacaaagttaggtaaaatttttcacactttgcatccaaattagtttgtttatatagtaatgtgtcggtgatatgggaccgggagtattgcgcccggaggcttgaggcagatggaatcgcccacgtggcctggcaccttcggggacgtcgggcccgagggtgaggtgtccgccctcctcctgatttccccaagggggggtcgggttgctcctgccccggccccgagggacgaggtgccccgaccccctgtggggtttgcactatgtacataggttgggtgaacacggtagggctcacctaaccgcatttattgcggtctggtcaagcgtgtcacgctgcatgcagcgcaatgcagcgcgctcttttatccggtctgtgaccagtcacagaccggtcggatcaacggttaggtggcggctggcagtctgacgcacgcctcgccccgtcctgtcaagacgagagccactaggc

SEQ ID NO: 86818 - DNA, 714 bp, Oryza sativa
cgtggtggggctcggcgggctcggccacgtcgccgtcaagttcgccagggcgttcgggatgagggtgacggtgatcagcacgtcgccggtgaagaggcaggaggccctggagaggctcggcgccgacggcttcatcgtcagcaccaacgccagtgagatgaaggtaattttaaagctagtttgatcaagtcaagagattattaaatgaactttaagaacggattacacgatagtaattacaatctacaactcctgtacaagtagtaaattaataggaccactttggactgagttaagaagagatcaatgaactattcagttctacattaatcgtgtagtcatatggaaggacatcctactgatgcagatgcagtaatatggcacatcacaaacatacaatttcaaatttgacttttacaagttgcgtttgatatgttatttttgttacaaattatagaagtcgaatttgaatttgcatgtttgtggagtgttatattagtagatgtcaatctattttttcaatttttttaatatttttataatcgtttaattaacatgcaataaacgggttaacatccactcaagtggttataatccatctccatcaatttattgatgtgctgcagtgcaactttgcaaggctatgcaagccgaagaaatctttgaatacaactgatgcacctcattgccgacagagcatctgggctgcaggaa

SEQ ID NO: 86819 - DNA, 528 bp, Oryza sativa
gttctaaactgttcctcaactcaaacgtgtgatgaactgtcatacttgttgtatctttgaacatactctaatgcccgtaaagagatagataaatttatgagtttgttgaagaaagtcataaaatttatgaactcataagcactatatactgtattgttacctaattgatatactaattatagactgcatctgccactgtgtgttttcatattggtaacttgctatctgaattttttaagcattttcttcattcttaggtgtatgatggagctgtatacatgcatcagggtgtcaattacttagttgaggaacttgatttgtcatcaaggacagcattctgtaggaaagctgatttgaagtattacacaaaaacacgagactacacagacatcaatgtccttggaggagagtttgtaagtattcaaaaggattgtgcattaacctcatatacattctgcttataatcgtctatcattataatattaatccctgccaaattttattattagcaccatttttttgtttaaa

SEQ ID NO: 86820 - DNA, 645 bp, Oryza sativa
tttaccatgttttcttagctaaacttaccaaaggtgaggccatcaaaatccaagccacactctagccaacaaaatgaaaccatgccacactttttagagtcacttacatgtgggacctagattacaaaagaggaatcttgccacatttgtgggagtcaaccaaacactaacctaacatgatcaaacttgcctaaccttaagtgtgacaaagtgtagcaacttatggctatcattcctataggaatttttcctataaagccttttgaatcaaaggaatgagctctatggaatcttatgaaattcctatggaatgcctcttcccatacaagttttggaggaattttaacaagaggtagaacctcatggaagaaatcctttgagtctttatctctcctcaaattcctgtattttttctgtggtccaattaaacggtcattcctatgtttttcctatgttttgcaatcctcttttttacacttacattcctgtcaaaatcctatatttttcatattcctccgtttttttattcctgtgattcaaaggggcccttagagtggttttgatcctacgtggcagactagtcaatattttttttaaaaaaatggtagtaccctgcgttcacgaaagttggtaggacccgtccat

SEQ ID NO: 86821 - DNA, 621 bp, Oryza sativa
aaggaatacgctgacttgaatgtctgccctgtctgtggggcatcaagatacaaacgagcaaagagtgaaggtgaaggaagtaatgtcaaagaggggaggcccagcaaaggtggtgtggtatctcccaattgcggagcgcatgaagagaatgtttgcgaatatggaacaagctaagctagtgcgctggcatgccgaagaacggaaagtcgatagtatgctgaggcacccagcagattcagtacagtggaggacaatcgataggatttaccaggaattctcaaatgacccaagaaacatgcgtttcgcaatgtgtacggacggcattaatccatttggtgatttgagcagtcgtcacggtacatggccagttctgcttgttaactataaccttcctccctggttatgtttcaaaagaaagtatattattcttgccatgctcatgcaaggaccgagacaacctgccaacgatatcgatgtgttccttgaaccgataatcgatgacttcgaaaggctatggaatgagggcacacgaacatgggacgcatatgcacaagagtatttcaacctccatgtgatgctgttttgtaccatcaatgattatccggcccttggaaactttct

SEQ ID NO: 86822 - DNA, 1231 bp, Oryza sativa
agacgacagggtcatggcgaatttctttcccatgggcctgaagggacaggcgcggggttggctaatgaacctgccgcccgcgtcggtccactcctgggaggatctgtgccagcagttcaccatgaactttcaaggcacctatccacgcccaggtgaagaagcggacttgcacgcagtacagcgaggggatgatgaatcccttcgctcgtacattcagcgtttctgccaagtccgcaatactataccttgcatccctgcacacgcggtgatctacgcgttcagggggggtgtgcggcacaaccgcatgctcgaaaagattgcctccaaagagccccagactaccgcagaactttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggtccattccggcgacgagggtcacgtcctcgccgtcgagggcgctccgcgggccacccgaaaggggaggcctgcgagcgacaaaaagaaagaggctggtactcccagcagggagcgcccagccagcaagtggtgctccgtccacaacacctccctccacgatctcgcggactgtcgcgcagtcaaaaacttggctgagcgaacgaggaagtgggaggaggacaggaggcaggaacgccgtgagggcaagtccgcggcagttccctccggtaaacggcgaagtgaggccaaacagaaggcccccgccgttgacatcgatgacggtgatgatgacctaggtttccaagaacctggggccaccattgccactgtcgacgggggagcgtgtgctcgcgtttctcgccggagtttcaaggccatgaggcgagagcttctcgccgcggcccctactcatgaggcgacgcgtcgggcgcggtggtcggaggtggccctcacctttgaccagaccgaccacccaccgtgcgttgcccggggagggcagattgcgatggtggtttctcccaccatctgcaatgtgaagttggggcgtgtcctcatagatggaggagcggctctcaacatctttcccccgcggcctttgatgctatcaagaaaaccggggatggtgctccagccgtctcacccgatcatcggtgtgacgccggggcacacatggccgttaggtcacatcgacggggtgcag

SEQ ID NO: 86823 - DNA, 2094 bp, Oryza sativa
catccaggagtatctgtcttgcccgtcacggcatgcccccgtaatgggagggccaagatcatagccacatcctgtagagtgatggtcatctcaccactggggaggtggaagctgtgtgtctcaggcctccatctgtccacaagtgctgtcaacgcaggagcgttgaacactggcattcctctgctcacgaccaaggccaccccgagcaacccggcagcccttaggtacgggatgtacctatcgtcgaacactgggggggcatgagctctgactcggagcggttgaagtacctgcattagcaattgtaaatcaattagttaatataatgtcaaatacacgctaccgatacttatgcacaagtgaatcaatgccgattcataccctccccgcctcgatcgcagccccgcgatgacgggcctcgtagtacgcctccaaggctgggtaagtcggcggttgtccctcctcggccatcctacatgaaaaagtaataaattcaccgttagttaccaatgtgacatatattaaaagaaaatgaatgcgagaacatgagtaggaaaacaaaatatttacctccctaacacttaaattttttttggacttcttcttttttggacgcttaggacacttagttttcttgtgaccctcctggtgacacaacgagcatctattttgcaccggcgcagcatcaagttgaacgcatgaaggtggtttccttccagaaccacccagacctgagtccatttcgttcttgaatcgtttcgatctcctcttccctcttgttttaatcttcaaatttgggtcagcaacaaattcttcaccatcgtacgatggccactgtgtggggtcgaggtatggctcaaagcgacttgcccatgtgttcacaacggctcttgaagagaactgatacggcattcggttgggagattccttatcaattgcatgaatcagataaacgtgtataagatgtgagcaaggcatatggtagagcaatggcctttggcaagaacatgagttcccctcaccttcaactttgaaggctcttgcgccgaatctaacaccaccacgcgttataccacccctctctgtgacctcgcatgtctttttctgcttatcgaaacaccttgcagtgtgtttgttcgccttactttcttgcaccttcatcttactgtcaaccttggtggaccaacgctgccctaactggactcgtttcaaagcttcatcatgtctgttcacaaagtagtcattacacttcatgaacgtaaatgatacgatggccgtcactggaagcttacgaacaccaactagcacgctattgaactgttcagccatgttggttgtcatgtaaccccaccggcggtcatttctatcgtatgcacgagaccacttatctttatccaacaactcatcttcaagccatttacgaggaccttcgggaatacgctgccttagtgcctcaacatccctctcaaatatccacttctcgtcaatctgaccattaatatcttttttaagggggaagagctcttttgtctgatgcttgtccgcaccggccttgtggaaattagcactgaagtgcctcatgtaccaccggtggtgaaccgatggcaatcctggaacaggagtcatcatggcattcattataccagcatgtcgatctgagataatacaaacctccctatgcggcccaaccacaacccgtcggacaagatcgataaaccagcaccagtctcgtgaattctctttctccaccaaggcaaaagctaaaggtacaagttggtcctccgcatcagctgataatgcagtcatcaaggcacccccgtatttcccagttaggaaggttgcatctatagctagtactggcctacaatgtttaaaagcctcaatggaaggaccaaagcaccagaatgcacgcataaaaattttcttggtcactccatcaacgttgacaaccctatcaggatgagtatcgatatggtagaccatactgggattcctctgcttaatggcttgcagcaaagtgggcaaacggacatacgcttcaccccattcaccgtaaatgagcttcatagcctcctctcgtgccctccaagcctt

SEQ ID NO: 86824 - DNA, 758 bp, Oryza sativa
ttgacttctattaagacagaattgtgaccacccctcaattcgacataaaagtaatcatctggattcacatattggcctgctacttctgtcgggaatcaagggttgactccgtacgacgaccaatgaacactcgccgacaaatgttcacttagatcaagcccctcttgtactaactcccttttcatcaccctcgctgcatccacatcatcagtaccgcaatgtctctttgatggtcctgcctcccataaatcatttccaagcaaaggtctcttcttctctccttcaccctccaagtcttctcgtaccaactcactcttacttgcaccccctccacgacgagaataatatgtcacaaaattcttctcaacgtaatgataagaatgagatttgtttagatccaaattttctacggtacgaactaactttgatgcaaacacctctagagatctaaactgagactcttttaccaaatcaaagtaaacttcccattccaactgacctatcacatttaatatatacttatgcccttgaccaacatcgtatctcccataaaaacgaatctccacattatcctcggtccatccaagaacttctttcactcgtgaccttagttcatctagagttgggtgggtgggaaacaaaatagtcttcaatgacatatcctcaaactcaacatgtccaccaacataaggttccaccactctaccaccatagtaaacacgaacaagtctatccatctacaccaaaaaatcaaatgt

SEQ ID NO: 86825 - DNA, 534 bp, Oryza sativa
agcataggtgattgttttaagtccgttgagctgccagaaaccttgttttgttgatacatcatctcactatcaggtgataagtgataactgattgctcacaattagtagaactcatcagtgggacattttcttgattcagcactatcctaggtgatataataaagtggcgtcagtcgcatgtttggtggcatctttcttcacaaactgatcactatttagtttcattataatgtgttatttggttctaatcattatgtctcgtgaatgcagaaagcacttggggccaatatttcagaaatgcagaactagagaaaatgttgaaccaagatttgtctcggctctaccctgaattgggaaatttcttccaaacaaccatatgtcagtccatgcttggacgtatactgttagtttggagccttaggtacccagagctcggttacaaacaaggtaagccattgatgtgtacacttctcatgtgacctaacaatcacagattccatctaaagacacaatcttgcaatatgatgttcctaa

SEQ ID NO: 86826 - DNA, 891 bp, Oryza sativa
  unsure (1)..(891): unsure at all n locations
gcaggttcattagctaacaccgggcctgtccctacagggccatggtaaagaaattcgccatgaccctgttgtctcccccagcggcctcgatcccggtcgtatagacctgaagaaactcggtggggttgacgctcccatcatacttctcggtgatggtgggccggaaccttgggggccagcgcacattccgaagactcgccacaaaggctctacagccgacaccaccaaccgggggcacggagggctggtcctcacgtccatgtcgaggtgacaccctggacgaagaggcaccctccgttgcgcggggagcacgccgatcactacgtcggcgctcgatgtcgaggcgggcatccggctcttcatgctgatcctcccgagtcggaggcgccgacgagggagtggtagccgaatggcgtgcagcagccgccgctcgccgcgccctccgccttgatgacacagagccggaggtggcggcgccggaggtcctggtggtggcggaccgtccaccagcacccaggcgctgctgtgccgtcatgaccaagttggccacgtcgtccagccatcgctgggctggagactccgggtcagggacgacgggcgggtgacgtaggagcgcgccagcagcctgaagcgctccctggggcgtgctgccgtcaccgtagacgaggaggcgacgctccccgtctcgccgctctcctgcatcacctgcgactggtgatgctgtgggtttttcaaccctctcgagcgccttcccccgcttaggacttttgcgcggaggaggtggnggagtaccagctcgatggcgcgggtttggctccccgtcgtcgccgctcacacttcgagagaagtcgtgcgcctttgcttgctcggccattangctggacaagggaa

SEQ ID NO: 86827 - DNA, 841 bp, Oryza sativa
  unsure (1)..(841): unsure at all n locations
atatgacataaatggatacacctttcacacggtaaaacaagacagcaaatgcaccatgcagaacagtgggttacgcatcgaggctgctagtgacggtggtcgtcgtgatcaatactatggtagagttgagcaaatattggagctagattacttgaagttcaaagtcccgttgtttcgttgtcgatgggtcgatcttcgcaatgtaaaagttgacaatgaaggtttcaccactgtcaacttggctaacaacgcgtacaaggatgaaccgttcgttctcgctaaacaagttgttcaagtgttctacatagttgacccgtgtaacaagaaactacatgttgttcgccaagagaaaaggagaattgttggattgcacaatattgcagacaaggatgattaccacccagaccgtccacggataagggaatgaaatacctctagacaggaggaagaagagatgacgtcaatatgcacgcgcgacctgaggaggattatttntgtatttatgacgtagttatgctacatgcctgtatctatatgactctgatatgttcgcaatgatcaatagtatattccttatgaaatagtcaaataaaataattaagtgaagcacccactagaagtgaaataaaataattaagcaagtataaccattggaaataaaataataaaattagtaaaataatgtagtgcaattactactgttagtgaaataaaataattaagtataacaaaatatgtagtgtatgtggaaatatgttaaagaaaataaaagaactaagtgaaataaaataaaataaaattgttgtaggcaaactcatctgtgacgggctctaactgtggg

SEQ ID NO: 86828 - DNA, 1942 bp, Oryza sativa
atttagttgataatattttcatttgaagtcatttagggtgttaaatatatgttaaatgattcagacaagcatagacaaaataataacattgggttagtagtcaatatgtgttaagtaggtgagttggtaagggagctctatatggaggttgaggtcttaagttcgaatctcacttgtagcatacaagttatattgtgtgaaaaattgtgaatttgtaggtagtgatgtgtaaccatgtataggatggctagtaaaattcaaaatatttttttgaggttttttgttgcgtttaaaattcaaaaattgtatttcttgctttgtcatcagtgacgggtcgtaagttacaacccgtcagagatgagtcatcagtgacggtcaggtagttacgacacgtcactgatgactcatctgtaacgggtgacaagttttaacccgtcagagatgacttatataccggtcagagatgggttatctgtgacgggtgtttcatccatcacaggtgattttgtcatcagtgaccactaatcactgaccaagaccaaacccgtcaaaggtgagggtttgggtccgtcagagatgacctggtccggcgtagtgcgattcgatgggcatatacggttgacttgacttagcctataccgcttgtggatcgaacaatgggttactacacattattggagaagaagaaagttcaacggaattgaaacgacaggtgatcttacacacatacatagatgagccaaacaggcctggtgatcatcgacgtggcaattaatcgaggacagcttcaaggacgtcgagcaccggcgatgccagcccgcctgttgctaggttaatcgcgaccatgaagcttttcttgacgagaaacttggtgataccagagctgcagctccgccgaacgatggcaatgctctgagcatcactggtagttcggatggcagcgttgctggtgcaaggctctttttagttcccaaaacaaaaaattccatgctgtcacatcgaatgtttagacacatgcatggagtattaaatgtagaaaaaaaatcaattacgcaaattgtatataaattatgaggcggatcttttaagtctaattgtgtcataatttgacaatgtgatgttaaagtaaacatttgctaatgatggattaattaggcttaataaattcgtctcgcagtttttttacgaaatctgtaatttattttgttattacactatgtttaatactttaaatattcaaatgtgtgtccgtatatccactaaatctaaaaaaatttcctgaactaaacaaggccttactccgctaggcccgctaccctgaccgacaccacttggcgcgccagagacgcaacggatatgtagcttaaacagacaaaagccacactggtagtaccaaaggtccaaatcttcacggcaggcggagcagcggccccatgaagggaccatgtggatatcatgctgctggtgaagcgggctacggatcgtttgcgggagcaaaatgcagagagggtgcacgtcgaaggcgcactggatgcagcggtacacgaagtttccccgggggcaattctccctgcaaaggtcgcacgaccacgtggtgcttccatcgggtatggagctcagagtgagggtatgccacggatgggcgaagaaggagatggtcttcttgaagtaatcggcgcaggcctgatggatgtcgaagtcgcaggcgttgcagcggtagccgacgaggccggagagcttggctcggcagatgtcgcagacatggcgcgaggtgctgtcataccgggtcttgagaagcaggtgctgtggatgagcgaagtgtgttatgtggccatcagttgccatgtcttcggctacgctcagaacaccccaatctctctcttggcctagtttttggctacagtatttctatagatcgatcagactactccacggttagtgt

SEQ ID NO: 86829 - DNA, 3208 bp, Oryza sativa
ccacctgggcgctgaatccatctagcaccgcggtgttggcggcggccaaggcttgcagaaggggctcggcactcagcggggcggcagaagacgaggagaagagccgccttggagaaaatgcgacgcggctcggcccgccagaagacgcactgagcttggggatgtcccccggacccgtttggtcctgggcgtcgcccgagggagcgggcccaggcgatccgcccgcggcctcgtcgcgagccgtcccggaggctgtcgcctgagcgtcgcccgagggagtaggcccaagcgacgcgccagcagctttgtcgtgggctgcctcgaaagacgccatcgcctcagtttggcgggctcgggcggcctcctcccgagcggtttcctcggcttggcggactcgggcggcctcctcccgagcggcttcctcggcttggcgggcccgggcggcctcctcccgagcggcttcctcggcttggtgggcccgggcggcctcttcccgagcggtatcctcagcctggcgagcccgggcggtttcccgggcggcctcttcagcttcccgaaggcgatctgcggcctctcgccggtcagattctcgcctccgttcctctgcggccgccggatcttcggcttcggattggccggacttgggatggcgggaggaacgcgacgggacatcactgaagcagaaagaaaaaccagaaggcaaacaggatgggtaagaagaaacttgcttttggaatagaagaaaagacggtcgcaatgagcatgggacgaacctgcgagggggtcggttaaatgaccaccttggaggggaaattaggtttccccgggatggttctgtctcccccatcttgcgcagccgcttcttcttgcgctccccctcgggctgcgaggttggcgcggccccctccgggcgcctgctgctggcacgcaccgccccgccccctcggggaggagatgggggaggtgttcctcccagtttcctcttcccccgggcgtcggtagggcggttgctccccgagcccccgacgcggggcccagaagcacggccccctcctggggttgattcttcctggtggctcccgccggcgccgtcgtggcccttaggagccacctcctctgaggccccgacccccatcatgatggtcagaatggaggcgcggtctggatcgcagcagagggggaggagtccttgaggaataagagacgcctccacggagctgagattcagcaccctttggaccacgatcttgaagtcatcgggagcccaatcccatctgactccccggtgggtcctcatgtagtcctcggacccggtgtactcccatgcgctccgggcgcgccgctgaagcggcgcaatccggcgacggaggtagtcgccgtacaccatggcccctgtgagcccctgagatcgcaggcccgccaggcggtcgaggacggcgtcatagtcatcccccagatctactggcgcccgccagctggagaccggagccgggggctggcttgggagtcggaggcgcgcttcgttggcaaggggggtgtagaaccagtcgctcttccaatcgtcccacttcttgcggagggcgcaggggatgtagcggttcaacaccggcccccgcggctggaagtagcaaccaccgaccaccgacggcggcgacaccgactgcacggtgaagaaccaccggaacagccgaagagatgggcgcaccccaatgaacatctcgcacaggtgcgcgaagatggccaaagtcatcactgcgttgggggtgaggtgcgccatctggagatcgtagaactccagaacatccataaagaaagaagaaaaaggaggaaccaacccggccattgcgaaggggaggaagaagatggaccgccccgggtaatctggtgctgggcgcgcctcgcccagcatcactatctcccggccggtggcagattccggcatgaagcggcgcggcagcccagcctgcctctcgctcacaatgcgggaaggtggtagtacgctaccgtcgagcagagcggagccccgtgccatgtcgtcggagaaagagagggttgagaacgagcgtgtgtggcgaaggtgaggcgcagcaaagagagagtttagggcgcaaacggcgaaggaaaggggaatagtggcgaaaggaagggagcaagtcctttcctcgatggctttatacccttgccatcgctgagtccggctcctcgtttctcgtgcccactatctcgccccctcgttactcgctatctcgctccctcgtttctcgcgcccacgcttccactaattccattcgcccgcttgcggcgcatgaggtggatatgcggttgtggcagtcgagatagatcgtatcgtgtgcgcgttaattacgctcgccgaccgaagcgacgttaccatgtctccagacgaaacgaatctgcacgcccagattcgagcgctgctcaagtgatgtggcagtcttgaagagaccgcccatgactgacggccaagacaccgttaccgatatgcgtggtttgagaccgttgggtttctgcccaatcacggagaccggtcccacctgtcaccaggctttatgagtggcgtcatgcccgaccgcttcccttgagaaggatgatcgccctgacataacgccgggggctactgtcggtgatatgggaccgggagtattgcgcccggaggcttgaggcagatggaatcgcccacgtggcctggcaccttcggggacgtcgggcccgagggtgaggtgtccgccctcctcctgatttccccaagggggggtcgggttgctcctgccccggccccgagggacgaggtgccccgaccccctgtggggtttgcactatgtacataggttgggtgaacacggtagggctcacctaaccgcatttattgcggtctggtcaagcgtgtcacgctgcatgcagcgcaatgcagcgcgctcttttatccggtctgtgaccagtcacagaccggtcggatcaacggttaggtggcgactggcggtctgacgcacgcctcgccccgtcccgtcaagacgagagcctctaggcacacgtctccagccggagctagcgtgttacctcttagagatggcacgttagccctggttagatgaataccaggcttcatcccaaccattacaggcaagatgctaccaaaagaaaggtgatcatgcagatcggtgaactgacgcatagaggacaagaatgaccg

SEQ ID NO: 86830 - DNA, 562 bp, Oryza sativa
ctacacaaaagccactttattttaagggaacaaacatgcatcgcattctgaaagggtttatggctcaagtactgaaaattaaaccaaatgatccaagtcctctggccactggatatttctttgtatacaactcacagggaagtcctttgcccttttatgggatttcaaaggctgaactctacataattctagaatgtagatatgaatggcttgctagttatacagcataatcccatatttttttttgttccattcgcaggatatatgtactctagattgcattctagcatccattttttccctaactatactcatattatcaaaattttgaactgcagggtggtgatttttcaagaggagatggtattgattcattatcccaggcatcttctttcaactgacttcttgctgttgtacactttataagctcaacgctacatgctgtttccaagacgtggtggagagagcatatatggggcaaaatttaaaggttaacgactaatgaaacttgtggctgccataaaatttttttaatacaattagtgtaaatgcattaatatgc

SEQ ID NO: 86831 - DNA, 561 bp, Oryza sativa
cgccggtgaaacaccctaagtacatgacgatgactctgtttgcccattccgtctggccgtgtgcttgaggctggaaagcctactttatgtacaacttggcgcccatcaacctcatcaactcgcgccaaaacagcgaggtgaacaccgggtcacggtccgagaccatggactgctgcataccatggacgcgcacgatgtcgttgaagaacgcctacgccacggtctaggcagtgtaccggtgccccagcggtatgaagtggccatatttgctgtaacgggcgacgactgataggatcaccgacttaccgtttaccctgggcagcgcctacacgaagtctagccccatgtcaatccaaacgacggtgggaacgggcagtggcagcattagtcctgctgtgtggaggcgctacgtcttatatctctggcacgtgatgcactcccgaacgaagtactgcacacattgacacatgtttgaaaatggaaatctctgtggatgcgatgtactggtgcgctggacccctttatgcccatcgttttggaccgctgtcactatctcaggca

SEQ ID NO: 86832 - DNA, 530 bp, Oryza sativa
aggatggatcgggtagtatgatgtttaccaaaatgctgcttgtcaaagagctttctagcttcatcttctgccaaattgtgaatcagctgaagtttatccactgatactggtagacccactctttccattctttcattatacaactttaagcagcgctcaagaattgccttattgaatacttctacaagtgatcctgttgatggaatttcacctttattcaacgcctcaagtatctaaaataaaggtaagcaacttcagataacagctcacaagagtttcaagattacctgcctaagatgcataaaaaaaaacaagccaagaggtattacctgccttaggaaagatacaaactcctttccatttagagttctaccctgcaaaagttttggttttatcatggaagtaacaatttgcttcaactcatctctcctttctatatataatgggtccagttcttgatcgtccatgtcacatagctttgttctttgaagcccaggctggcaaaaaagttcataatgtaataacttagt

SEQ ID NO: 86833 - DNA, 646 bp, Oryza sativa
tatagggcgaattcgagctcggtaccccgccggctgcgagcttctcagttttctggattgctactcggggtatcatcagatccgactgaaggaatccgactgcttgaagacttcattcatcacgccctttggggcatactgctacgtcaccatgccgttcggactaaaaaacgcaggggcaacttatcaacgcatgattcagagatgcttctcaacacagatcggccgcaacgttgaagcctacgtggatgatgtagtcgtcaagaccaagcaaaaggatgatctgatctcggatctacaagaaacctttgcgagcatccgtgctttcaggatgaaattaaaccctgaaaagtgcaccttcggagtaccgtcagggaagctgcttggcttcatggtgtctcataggggcatccaagccaacccggagaaagttactgctatcctcaacatgaaaccgccaagcacccagaaagatgttcagaagctgactggatgcatggcggcgctcagccgattcgtttcaagacttggcgagcgggggatgcccttcttcaagctactgaagaagacagataatttccaatggggacctgaagcacagaaagccttcgaaagattcaaacaactcctcaccaagccaccggtc

SEQ ID NO: 86834 - DNA, 648 bp, Oryza sativa
tgtgctccttccatcgacggcctcgaatgacaacatgccgaaagacagaagatgatacctcctggcttctcaagggtatgttgtcaagcaactccgtaaatgtggagctacgcagattcagcgagaagctaatcgcgtccaagacctcccgggaaaccttcccaagcaccgaaaacatatcaggcaacccggacggcggcaattccgccacaccgttcggctctaccggcgtgatgccgggcctgaaatcatacatttccagccacatctgaggatcagcatagtagccagacgtcttgcaccactcccgggcatcacccgagccgccgccaccgccgccgccgccggcctcgccggatccgtaccctcgctggtggaagaagaggcgtgcggagtccagccccgacctcagcagggcgccgtcggccggaggcatctcgacgacggccgccgagtactgcgccagcgactgcatcagggccgacacgcacatcttgtagccgtcggacgggaggccgtcggcggcggcgaggtcgcagaggcgcacgcggccgagggacgcgaggatgttcgcctccgcgttatccatccggggaggggatggttcttggatcttcttggaattcacctcagggtcaggggcaccat

SEQ ID NO: 86835 - DNA, 3821 bp, Oryza sativa
ctctggcttacgaatccaagcggaagcaaaagctgaccgaacgagagatcaatgctgtgcagcccgatacgccccaatatcttcggcggtcagagacagctaccaagtttgaccgctcggatcatcctgaccgagtggtccacctggggcggtaccccctggtgctagacccagtggttcgcaacgtcaagctctgactgctacatcaccatgccttttggattgaagaacgcaagagcaacttatcaacgcatgatccagagatgtttttcaactcagattggacgcaacgtcgaagcatatgttgatgatgtagtcgtcaagaccaagcagaaggatgacttaattgcagatctagaagagacctttgcaagcatccgcaccttcaggatgaagttgaatcctgaaaaatgtatcttcggagtaccgccagggaagttgcttggctttatggtatcccataggggcatacaggccaaccaggagaagatcaatgccatcctcaacatgaaaccgccgagttcccaaaaagacgtccaaaagctaactgggtgcatggcggcgctcagccggtttgtctcacgactcggcgagcaggggatgccctttttcaagctactaaagaaaaccgacaatttccagtggggacctgaagcgcaaaaatcctttgaagacttcaagaaacttctcaccactccaccggttttagcttcgccgtatccgcaagagccgttgttgttatatgtgtcggcaacatctcaggttgtgagcatagtcctggttgtcgagcgtgaagaagatggccatgttcaaaaagtccaatgaccaatttatttcgtcagtgaggttttggcagactccaagacaagatatccccaggtgcaaaagttgttatatggtgttctaattaccgttaggaaattatctcactattttcaaggccactcggttacggtggtcacatcgtttccactcggggacatacttcataatcgcgaggcaagtggacggattgcaaagtgggccttagaattgatttctttggatacatccttcaagccgcgaacttcgatcaagtcccaagccttgacagactttgtcgctgagtggactgagtgctaggaagacacgcgtatggagaagatggagtattggactatgcattttgacgggtcaaaaaggctttcaggcaccggagcaagagttgtcctgatttccccgactggagaaagactgagctacgtattgtggatagatttttctgcgtcccataacgtggcaaaatatgagacgcttcttcatggattaaggatcgcaatatctttggggatccggcgtttgatagttcgtggagattctcagctagttgttaatcaagtcatgaaagagtgttcctgtcttgatgataatatggctgcttatcggcaggaggtatgcaagttagaagataagtttgatggcctcgagctagcccatgttcttcgacataacaatgaggtagccgacagactggccaatttcggttcgaaacgagaagcagctccttccgatgtgtttgttgaacatctttatgaaccaactgtaccaaagaaagaagtaaccgaagctgcggacactcaagaagtaaacatcattgaagtcgacttgagggagcccctcatcaagtttctgactaaacaagaactccctcaggacaaagacaaagccgaacggatctctaggcacagtaggctttatgtcatgcatgagaccgagctgtacaagaaaagtccttcagggattctgcaatgctgtgtgtctttggaggagggaaggcaattgctaaaagatatacactcgggcatgtgcggcaatcacgtcgccgcacgaaccattgtcagcaaagcttatcggcagggttttttctggcctactgctgtgttcgacgcagacaaaattgtgcgaacgtgcgaaggttgtcggttttttgcccgacagactcatttaccggctcaggagttgcaaaccatcccattatcctggccgttcgtggtttgggggcttgacatggttggcctattcaaaagggctactggtggttacactcatctttttgttgctattgacaagttctccacgtggattgaagccaaaccagtcgtcatgattacagcagacaaggctagagatttcttcatcaacatcatgcaccggtttggggtacccaatcgaattatcactgataatggtactcaattcactggcggagtgttcaaagatttctgtgaagacttcggcatgaaaatttgctatgcctctgtagcgcatcctatgagtaatggacaagtcgaacgcgccaatggtatggtgcttcaaggaatcaaaacacgagtcttccaccgactgcatccttatgctggcaaatgggtagatcagctgccatccgtaatttggtctctgcgtactacgcccagtcgggccacgggtcagtcaccgtttttcctggtctatggtgtggaagcaatgttgccaagctaggtaaagttcgaatctttgcgatttctcaacttcaagaggagcgctacggagaagaccaagttgatgatctcaaccgactgtaggaagcccgggaagcagccttacttcagctggctcggtatttacaagggatgcgacgttatcacaaccgcaatgttcgatcgcgggctttcttagtcggagacctggttttgaggaaaattcaaactacacaagatcggcacaagttatctcccttataggaaggaccgttcataatttctgaagttactcggccaggttcttatcgactcaagcgtgaagacggtactcacgttgacaactcttggaatattgagcatcttcgttgtttttatgcttaggcattacttttgtatcttttcgtcctctttgactgctaacattaagttgctccttgagttaccagtcgggggctgttataattataatggagtgtgattcttatcaattcaacttgcttacttgatttatcgttgccctgttcgattttttggcttagtcagtgaggactgaaagtttttaagaacttttgcgggttttaagctcaataaggtttgacaaaaaattttaagaaatcaggagctgagtttaaattatcaagcacatcataaattcatcaatattgtacaaattgtgcctccatcatcataagttatactatacaatgtcaatcccactcagtttttcatcatcaagatcatcagacccagtcggcctgagatcggtgtcctgaaacctctcaattacatcagcagcgatcttgtcggcagccttctgtgcatcattcatgaggtcaagggtgtcttcttcactttcccatccgcaaaaccatctatgacatcaatatcaatcttcgggtacaaggatttggtcatcgccagtgccatgctctcccccatactttcagcttccttgatgttcttgaaatatgtatccagagcagctctcagcttgtcgaagatttccacagtgtcgaacgaactcggaccattaatattaaaaaacatggcctggataagtggtgtagcagcgttggcaacttcatccctagatccttcaagcttcttaattttgttgaccaagacgtcgaattgagctcgagatttaattttgcgatctgcatgaatggtttacatcaatgattgggtacgaagacaagaatggttctgaagtttcagttacaaatacattcgacgtctttcaaagccgagtccctctatttggtcaattcacccttgtcttttttcagagctttgattcgctcttctagctcggatatcttg

SEQ ID NO: 86836 - DNA, 690 bp, Oryza sativa
ctagcacagctgtagaaccaattggtgttgaaattggcttgcaattctccatcttgaaccgtctcaaaagatcattcgtatacttcgtttgatgcacaaaagtaccttgaggtgtttgcttaatttgcaatcccaaaaagtacgataactcacccatcatgctcatctcaaattccttgcgcatagtctcagcaaaatctacaaccaaagcgtgagtcgaacaaccaaagatgatatcatccacatatatctgtacgaaaagttgattatcaccatgcttaagaacaaaaagcgttttgtcaacctttcccattgtaaaacctttcgcaagcaaaaagttcttaagcctatcataccatgccctaggagcttgtttcaaaccatacaaagctttagacaatttaaaaacatggttgggaaaatcaagattttcaaaacctggtggttgtttgacataaacttcctcctatacaaaaccatttagaaaagcatttttcacatccatttgatacaatttaaaaccttttgaagcagcaaaagccaacaaaagtctaattgcctcaattctagcaacaagagcaaaagtttcatcaaaatccaaaccctcaacttgtgtaaaaccttgagcaacaagtctagctttatttctcacaatcaaaccatcctcattttgttatttttgaaaaccca

SEQ ID NO: 86837 - DNA, 791 bp, Oryza sativa
ccaattgaagaaataaaccacgaaagtgttgaaaagcttcgtccttaattgccataaagaaaacctaagaatatcgagaaaaatcgtcaacataacagacacataccactttcctccaacagattgcactctagctggaccaatagtgtccatatgtaatagctatcccggtgcatccgtcatcactgaaacaataggagcatgtgaagaagcaaccatcttagcatgacgacacggtgtgcaaaccaaatcaagatctttcttaagtttaggcaaactacgaacaagatccaaaccacttaatctagtgagatgatcaaaaccaacatgtccaagtctacgatgccaaaacatcacatctttatcaaactttgcaaccaaacatgttatcacaggtgaaacaggattatcaaaatcagctttaaacactcttccatagcaagaaatattcagcatagaatcaccacaagaatcaaaaactttacttccagttttcttaaagtgaacctcaaaatcttcatcaacaatttgtgaaaccgaaaataaattgtactttaagtcctcaaccaaagctacattcttcaattcaaatttctcatttacctttaccaaacttgtagcgagaacggcactagtagaagcatcaccaaagataatcgattcagtcttggatgcctttttgagggaggagaaccaatttttatcaccggtcatgtgccgcgaacaaccggaattcacgatccgcacgttctcctttcttgccaccaaagcacataaacagaaaaaggaga

SEQ ID NO: 86838 - DNA, 1766 bp, Oryza sativa
gtcgacctgcaggcatgcaagcttgcagaaggtaatctagtgagcccacacatgatcaaaatgattggttacaccaagagtctggataaacttggctttccccttagccgagagttggctactgatttgattctccagttgctccctcccagctttgagccgttcataatgaatttcaacatgaacaatctgaacaggaccttggcagaattgcatgggatgctaaagactgcggaggaaagcattaagaaaaattccaaccatgtgatggttatgcataagcgcaagcccaacaacaagaagagtggtcaaaagagaaagctaaactctgatgagatcacgagtactagcaactctaagaccaaggttcaaaagacatggcccgctaaggatgcagagtgcttcttttgcaaagagacaggtcattggaaaagaaactgtaagaaatacctagagcagctcaagcagaagcagcaggatggaaagagttaaacctcaggtattaatgttatagaaattaatcttgctacttactctactgattcttgggtatttgataccgggtcagttgctcacatatgcaaatcgttgcaggggctgaaagaagtaggagcttagcaagaggcgaagtggacattcgcgtgggcaatggagcaagagttgctgctgttgcggtcggcactatgccattatctttaccgtcaggattagttttggagttaaataattgttattgcattccagctttgtgtaagaacattatctctgcttcttgtttgcaagcagagggttatggttttagatctgtggacaatggttgttcagtctattataatgacattttctatttccatgcatccatgatgaatggcctatacattgtgaatcttgatggatgttcagtctataacattaatgcaaaaaggcaacatcctaatgatttgaatcccacttttatttggtattgtcgcttgggtcatataaatgagaaacgcatggtgaagcttcatagagatggacttctacacttgtttgattttgaatcatttgagacatatgaatcttgtttacttggcaaaatgacaaaggcacctttcacgggtcaaagtggaagggcaagtgaactattgggactagtgcatactgatgtatgtggaccaatgagctcaactgccagaggtggttttgggtactttattacctttaccgatgactttagtagatatggttatgtctacttaatgagtcataagtctgagtcctttgaaaagttcaaggaatttcagaatgaggtacaaaatcatttgggaaagacaatcaagtatctacgatctgatcgtggtggagagtacttgagccttgaatttggcaatcatctaaaggagtgtggaattgttccacaactcactccaccaagaacgcctcagtggaatggggtgtctgaacggaggaatcgtacattgttggacatggtacgatcaatgatgagccaaactgatctgccgctaagcttttggggttacgctctagagacagctgcgttcacactaaacagggttccatcaaaatcagtggataagacaccatatgagatatggacagggaagcgtcccagtttgtctttcctaaagatttgggctgtgaggtctatgtaaaacgtttgcatcggacaaactcacacctaaatcagataaatgcttctttgtggggtatcctaaggaaacgaaaggatattatttttataatcgggaagagggccaaagtgt

SEQ ID NO: 86839 - DNA, 1017 bp, Oryza sativa
aagatgtgatgttttggcatcgtagacttggacatgttggttttgatcatctcactagattaagtggtttggatcttgttcgtagtttgcctaaacttaagaaagatcttgatttggtttgcacaccgtgtcgtcatgctaagatggttgcttcttcacatgctcctattgtttcagtgatgacggatgcaccgggatagctattacatatggacactattggtccagctagagtgcaatctgttggaggaaagtggtatgtgtctgttatgttgacgatttttctcgatattcttaggttttctttatggcaattaaggacgaagcttttcaacactttcgtggtttatttcttcaattggatcttgaatttcctagttctttgaaaagaattcgaagtgataatggtggtgagtttaaaaatgcttcttttcaacaattttgcaacgaaagaggtcttgaacatgaattttcttctctcgtgttcctcaacaaaactcctagagaaccgtgttttggttaagatggctagaacaatgttggatgaatataaaattcctagaagattttgggctgaggcaattaacactgcatgctatatttcaaattgggttttcttaaggtcaaaacttggaaaaacttcttatgaacttcgatttggacgtcaacccaaagtttcacatttgcgtgtttttggttgcaagtgatttgtcttgaaatctggaaatttggataagtttgaggcatgttctaccaatggattgtttcttggttaccccacacacactcgtggctatcgtgtacttattttggagactaacaaaattgttgtgactagtccaggtactagacccgatattgtaggttcagtgggaggatggtcgtatttttaaagacgagagcgacgatgacgacgaggttggctcggccggtcagactgggcgccaggccggtcagaccgccggcacaccgccgatcagaccgacacaggtgttgcggtcagaccggccaggctcg

SEQ ID NO: 86840 - DNA, 508 bp, Oryza sativa
ttcctttttatcttataaacccatttgcaatcaatgacatttctacccttctgaggaggaactaaatgcgatgtattatttttaatcaaagccatatactcagcatccattgcaagtttccaattcttatctttcaaagcatcttgtaaattttcagacacaccagttgaggtcaaaagaccccattttactgtaccatcagtgtagattttctccttgcgaattccactttgcagccatgtgcgaagacgtgctgctgcgtcagactcctgattccgatctgcaattccaagtccgcgcctcgccgtcggatcggcggcagcgataattccaagtccacgccttgccgtcggatggccaccgctgccaccgctcctccaccggctaccgtcgcctcgttttcctctctcccgtttgtgcgcgtgcctgtcggtcccttgccgcgtgcctgctggcccttcccgtgcaccgctaccatgcaagtcttgccgcatattgccgcgccgtg

SEQ ID NO: 86841 - DNA, 1804 bp, Oryza sativa
taaaccctgtagacgaaaaatcactctcttaaatattcattgcctcataggttcatctattccgtcctgttttgtctgatatgtgtgcgagatttggaacaatgttttgcctctggaccctgatgtcatagactataagcagcaaattattaaatgccacgtcttaaaagtggcaaatagttaaatgccccttttctccagccaccgaatgctacaaagtggttcttggtgacatttggtacagagaaccgatgtttttttttttagaaaaaaaaaagtcagtaagaccctctttggtatagctcttgtttttttttgggagccggtattcccaactctacaaattcatggatctaaatccacgattacgtcgataacatttggataaattattttgtttgaatagatgaaatttaagattttaaaccactatattttaacataaaaacttcaaatctaccgtggaattgagaactggaattgtaccaaacaggtttaaattaaccctttttatgaaaattggcagtttgactaatttatgggaagaacaatgttcaattccctccgatttttttgtttctcgggcaaatgctacttgtctatgaaggatgagaatagcatgtacaccgataaatcgatcattcaagcataatattattgcatcgataaatcgataattcatgcataaaaatagtgtactctatttcatgttataaattgttgacttttttcttagtcaaacatttttaggtttaaccaatcttatagaaaaatatagtaccattttcaacataatgaaactaatttagtatgatagatattgctaaacttttccataaaacttggttaaacctaaaaaaaatgattatgaaaaaaattcaaaatgattataatatggaaatgaagggagtacatcattaggggcattgattgaggtctccttttttctccaacaatagttggatgattaagattttcgtggcacgcttttcaaactgctaaatggtgcattttatgcgaaaactttctatatgaaagttgatctaaaatagcatattaatctatttttcaagtttataataattaaaactcaatcaattatacgttaatatcacatcactttgcgtaaaaaatttaatcttcagaggaaaagaacactacctgagtatacaagtatacaacacattgatgcattcattatgcttcggtgcctgccgtcctgcagtcgcaccaaggtatcatccaagttccaacaaatgccccagcactgatgaccgcaccagctactatcgatgccgtcttcctgagcaacgcggcgacgccggactcatcagcgtcagctccggcgaaccaccgatgcctgagcgcggcggcggcggtcagcctctcgccgggatcgaacgtgagaagccccctcaggacgtcgaacccgtcccgcgacagcaacttctccgggaagagctcgggcagccagccgcgcgcctcctgctccggctgcggccgccgcagcgcttgccatcgccggacctcgtaggctaggagctcggacttggacttgaaggcctcgcgtgtcttgttccccgggacgccgagcatgtcgaagatctggtacagctggtcgctcgtgccttctccccggaacggcgcctcgccggagaggagcttcgccatgacgcagccgagcgaccacgtgtcgacgcggccgtcgtagtcgggcatgccgagcagcacctccggcgccatgtacccgtcggtcccgaccgggcggtacggcgccgccgcctcggccggggacatgtccagc

SEQ ID NO: 86842 - DNA, 529 bp, Oryza sativa
tttaaatgggcggcaatgtcgggttgggagaggggaaccggcattggacggtcaagccgcgagctggcgctccggctagcggccaaaacggcgacaggaggtgacgccggcgagagggaaaaaggggaaaagagggagagaaaaggggagctcgccccttgcctctttgggaaaaaggaggaggggagcgggagcgtcgcggcagagggaggagggctctgcctccgtcccttggcggcttgcgcgcggggaggcggggccgaggtgatgacgacggccatgacggcggggcggtttggagcggcgcgacgacacgagcgacaggcgctgacgacggcggcgaccaggcggtcggccaccacggcacgcgcgcgcgggaaacaacgggcggcgcggcggatttgagcggcgcggctgatttgagcggcccggcttgggcacgcacgctggcttgcggggccgggcggctgcgcggctgcaggcgcggcaggcgagcggggccgggcggcacggacggcgcaaacggcgc

SEQ ID NO: 86843 - DNA, 1251 bp, Oryza sativa
tggtaatggagtcattgtcagattgagttgacgtgcttcatgatgattgccacgtacggatcgagtccgaagaaggcagttgtaactattaattaggaatagtttgttagtttcctttttatccttaggaaagtgtgtttagtgtccgattatgactttatgttttccttttatctttaggaaagtttctttcttgtcctacaaggactagtatctacccatgggtataaatatgtacacccgtggtcattgtaatctatcgctacgatcaatacaattcggcgcatcgccaccctttttacttctacttttgtttttacgttccggcagaacttggcacccgacgcggggctgcatcgtcttcgatctccggcgaagggataagtctaatgttccaccggtccaggcaattgtatcgtctacgtcggcatcgttcaaggctgcatcagtacattcgacctcttggattactctggtttggataatatatttgcctagctatttatcatatgtctatgttaatctagtcctagcatctcaatttagctctatcggctgtctctcgctttagggtttctgccggtatcggctaaatcgccttgctagattagattagcctaggcatctaccaccctgaaaatcagtcaacggcttgattgtctagatattgtgtttcttttcatacttagtgctgcatcagttaagtttgatctactaagtcgtgcttagaaccataatctctagcctgcgtcttgattgccaataagggtttcatcggggtttcagctaatgagttatctggacgttgtatcggcttacaaggattgcatacatattggatttagccgatcgcaacaaaggttttactgtttaatctaatcttgtggattttatgatatcggaccaccagccgatgtatgctttaaccttcagatcagtgcttattatatcttgttctagccaattggtttctactcgactatattgttattacatcatcaacagccgattgcatttatatcattatctacattggacatatagccgattgcttaaaccctatcactatcggctggtatcggcgtcggctggaatcactacatcggcttgtcagccgatcggctgttttatctgttgtttacatatattgtcagttgcaggatcaaactgactggcacacccgcatctcatcaatctttggacctgcacaggagttaatcagatctcccaggctggtgttttcgatttttt

SEQ ID NO: 86844 - DNA, 703 bp, Oryza sativa
atagtcattcaaagcttctccagtttcatctcaaatttaatgtactcctttttaaaaagatctcgacgaagctctttaatgttatttgttccttgatgaaaattgctcaaagcaacccaaatctcatgagtagtttgaagatgagcaacacgatcagaatccgaacgagaaataccactcaaaagaatgttgcgagctttgcaattttgttcaaaaacagttttttcagcagcagtattaatagcttcaagaatcacataagcatgagaaacttttctccaaatatcataatcttcagccataatataagattgcatcctactacaccaatgagaaaaatccgttccatcgaaaacatggggcttagttgaaaacctagcgggagtagccatggcaaaaactctagatcaataaaaatccaaagaagaaaacaaggctctgataccacttgtaggatcgaatcacaagaactaagccaaccagaggggggtgaatggttggtatacccaaaaactgaaaacttttagcggaaataaatgttaccctcaaaattgacggatcgcggtctgaccgagattgatctgccggtctgaccgagtggatgccgccggtctgaccggtgttgaatctccggtctgaccgccgagatcgcctgccgcgcctgtcgccgccgccggtctgaccgccggtgagttgccggtta

SEQ ID NO: 86845 - DNA, 1028 bp, Oryza sativa
tcacatctcctaatgctgaaagtgactggtttatgtactgtgcttctttcagcctgtctcctacaacctcagacttatcaactctttcactaccagctagatccacaagatgcatgcaacctctcaacattgccccagatgttaaatattttccttggacatgaacagacaagcagctgcatgtagattcctcagccataagtacagagctcaaatatgaagttttctggacgttctcagtatgaaacaattgcatacctatgagagcggctacttcgatcgttgatggctgttgaacccactgcacgattcttctggccttgattcatcaattcaacaacatcggccgtagatgtgacaggaactatgcttgcatccggaacagcaagccctttctgtggagtatttcttatttctaatgtagattaatgttaaggagatacaagatatgcttcatagtaactaagataaaaaagagaacaacagaaaaaaagaagacgttttactggtaaagaaaaacacaattcaatggaaaaggatatctcctgtttccaccatcctgaaggagatccctcacttgctcattgtagatctcaatcatctgcacagaaatttcataatcgattgtcccctttctctgtgctttaatattaaataagtcatttagtgctctatagttaacaccgaggctttcctctgtcaaaactttcggtccactctgcacaaaattcataaagtggtttgaacaattttgaaaaggttatcaagacatatggaaataatatttttttagtacagttcattaccatggtaaaagtctttcctgatccagtttggccatatgcaaatatgcagacattgaaaccatcaaggactgaacggatcaaaggctgcatgtctgaaaagacctcttctgcattaacaaaaaaaaaaaagaagcaaagttcagtggtccatacaaatcaaagcagtttgagaaaaaaaagggaaatccagagcaacttataagttaaccttgagtagatgct

SEQ ID NO: 86846 - DNA, 644 bp, Oryza sativa
cgccgccgggaattggcccctcgtgacctcgtcgccgttttccccttctcccgccgccggttgccgccgccgcgattcgccgccgtcaagcttcctccggcgaatccgagccgttggctcgtctcccctcgtcacgtgcaaccacccggtgtgctcgcttttgcctgtatcgccgtggttcgctccgccgctcgccgccgtcgtccaccgtccgttccggccggcgtcgtcgtctacctcccgccggcccgcgtggcagccacgtaggcgccacgtcggcaccagctcagccaagaccgggtcgagccgaccccagttagcccctccccgtgcgcgcgttccaccgcgagccgtgaggctgcgcgtgggcccgctgcatccgcgtccaccgcgaaccgcgcacgtgcaccgcgtccttcccccaccctagcgccgcgccgcgtgctccctccgcacggtgagccgagccgctgacaagcgggtcccacccgggaccgcgcgtggtgagcccggtccaccggctctctctctcctccctcccgcgcgcgcgcgtcttgggccgctctgggccgccttcttgggccggccggcccgttaagcccggccgagccgccctttctctcgggccgctccctagccacccg

SEQ ID NO: 86847 - DNA, 506 bp, Oryza sativa
aacataatcatccattagcaacagcagagatgtcagggtcgatgaagcagaggtgctggtgatgatgtcagtgacaataatccatcaaattaatgttataactgttgtagatgcttcacttggaggagagttgatgttgttgctcaactcgtctaaaccgaaatatttgaagttgttgaagtagaatgtctgctccgaagcaaagatgaagataatgactcctggagttgactcgtgggttgatgaattgatttcttcagcttgacataaaatttgtcaaattttgagccttgtatttgtgtagcccccgactctttgattagttgggaaacaactgaacatagagtcgagaactgtagcctcttgtcgtcgaatagttattgcttgattgaagatatgtgttgaagatgtccaagtagaaatcatgaatgttggagagcctcttgttgtagtaaaataacatggcatcgtatgccgaaatgtcgaggctcacaaagacgtcgtgg

SEQ ID NO: 86848 - DNA, 595 bp, Oryza sativa
caaaatatgtgaaagatgggtgcaaatcattcagttttaacagggtctttggtccagcatctactcaaggttaaacttataagttgctctggatttcccttttttttctcaaactgctttgatttgtatggaccactgaactttgcttcttttttttttttgttaatgcagaagaggtcttttcagacatgcagcctttgatccgttcagtccttgatggtttcaatgtctgcatatttgcatatggccaaactggatcaggaaagacttttaccatggtaatgaactgtactaaaaaaatattatttccatatgtcttgataaccttttcaaaattgttcaaaccactttatgaattttgtgcagagtggaccgaaagttttgacagaggaaagcctcggtgttaactatagagcactaaatgacttatttaatattaaagcacagagaaaggggacaatcgattatgaaatttctgtgcagatgattgagatctacaatgagcaagtgagggatctccttcaggatggtggaaacaggagatatccttttccattgaattgtgtttttctttaccagtaaaacgtcttctttt

SEQ ID NO: 86849 - DNA, 846 bp, Oryza sativa
caggcgtcgttatagaagtccgagtcccatgtcttcgccaattatgagacccaacctacatggcaatggatttgggccttggaatggcatacaccaagaggtatgtataatgaattaattactgaaaagtgcaaaaggaaaacaagcttttaattactacaagaatcttcttgtctatacatttactcattgttttcaacttctgattctgaagaaattttcttcaattgtatatagaaggtcatcaaaactctgtaccattgattcttatgttctttggctggcgtacattaggttgtgtctttgtgagcaatactaataagatttgtttatatgacagagattaggctttcctcctcctcctcctcctgggacaagtatggactggcaaggcgcaccgccaagtcatggctcttatattgtcaagaagattgtacgcatggaggttccagttgatgcttaccctaatgtatgtgttcctcttatgcgatttatcatccagcagataaaatgtcttgtttttaatgtctgctattttcgctttgctccagttcaatttcgtgggacgtattctaggaccgaggggtaattctctaaagcgggttgaagcatcaactggttgtcgtgttttcattagagggaagggttctatcaaagatgctgataaggtaacaaacgtttgtaaatgttaattactttacatttatatactcatataacatgcgttatataaattaaaactaagtattacagctagctaggatgataaacttttttgttatgtttaatttaatatcctttgtagaaatcttggaaatccttcattggactcttccctgattagta

SEQ ID NO: 86850 - DNA, 886 bp, Oryza sativa
ttttgctatttagaaaatcaggtttctccaaattacttgggttccgaagttagtaataagacttgatggtttggtgtttttgttgacctttatggttaggacatacaaactttaatttgggtaagaaaaacatctcaggttaaattcataggagattgtgtaggttctgtgtcatgttccagattatatacaccatcagaagctgaaaatgcttctagttgtgaccagatgagggtatattatttatttgagtaaatttcacatcatttattctaaatctgtggttgctacactctactcaattttttggtactttaataactgatgtttgttatggtgtatatgaagatggatgaggaggagcaaaatctcttgaatatcacggaacaggtcaaccatgtagttgtaaatggtgatggtgaagttaaacagttccaactagaggcacagacaaattttgatgtgcaacaaaaacagatccaggtattacttttgtgttccctattctttgtttgatcttttataacctggattcccatgaatattatttctaacagtttatactaccataggaattgaagggtgctctttcttttgtcaagtctggcatggaacaactgagattacagtactctgaagaatttgctaaacttggtaatatacagttctatttgcgttcatcttttttgtcatcacagaagtatttaatatatccatttttttaccatgttgtaaaagggaaacatttctacactctctccaatgcggcttccagctaccataaagttcttgaggaaaaccgcaaattatacaaccaaatacaggaccttaaaggtataattttgaatgttgaaggaacagatgcctgttatctatggtattttat

SEQ ID NO: 86851 - DNA, 531 bp, Oryza sativa
tctttctcaccctctggctaatttgttctgttctttctttttcccaatataggttgaagcttacggaattgtgctaatgtaacaggaattggaacagaagctcaaggcatcttcgaaccagcgtgaccatgatgaactctaaattatggggtgagacaataatgaacttgctacaaggaaaacaactctcaccatacagccatactcacaagagaggtttaacaggtttattatatgaatagaatagcatatgaaactggaattcttggagttcagcactcggattgccaccgaagcagcattagtttggcaagaaaaatttttgaacaaaagctgtaggatatcgcgaaattcctcaccctgatttgtcggtagattttcttttaccactcttccctgtaaacgtatttgctcaatttttctatgccaccccaaagatgctagactgttgtttgtaacaatctgagtgtttctgagttatgaatagtatatttatgaactacatcctggatattcatcactctggatgta

SEQ ID NO: 86852 - DNA, 1089 bp, Oryza sativa
caaatgtgccatacctcatctcaatgatcttttgtttggctctccaggcctttgcatagcttatggtgtacttgaatttgttctcgatgtgcctaataattgattttggttcaaagccagtgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatccttcttcatgcacctcacttcatacacataatttgttgacttgaccaccctaaactctctctgcaatgaaactgcccaatgcttcaccgcctcctttatctcatccttatgagcataccttgcaccctcaatgacctcgtactccttatactcccagggtacatgatcacactctgatataacaagaccagagaagtcctcatttgcccaatcagtggccattacatcaccttcctcatcggatgatgcgtcgtcctccgcttgctcattatccgaatcttccctctccatttcatcaacaattataccgactgtctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaaca

SEQ ID NO: 86853 - DNA, 715 bp, Oryza sativa
agccggagcttcgctagattttattttccgctgcagttttcttcaagatgaggactaagtgccttataagtaagtatttatcgttttagttaatttgatgaatctgtatattaaattgtcagtttgtgtacctcggttgattcctggacgaggatcttatgcacaaataagttcggaaattactagtgaatttccgggcgtgacaggaaccatgtggtgtacgtgcaggtctaatgacgacggggtcgtgagcggtgaacataagggtattcatagtgcgtcccacacaatacaatacaactatcttaacataccaatacaaaacaaaaagactagaatatccttactttatcaaattccaatacaactatttctcactttatctattcacaatacaattattctctactttcacaaactccaatatactttcacaaactccgatgctacgattactctaaaaatgaacttttattttgggacaaatgaaagaaattaaaaatgaacttattatgagatggaagaagtatatagtaaccaacaggatgttgagagcccaaacgtgtataaaatcctcgtgtactgttttgtttgatgtccatgcttttgctgatcatgaccttctatcaatagaccaggacaccaatcctcaccaggtataatatgcatgtatttatactacccaagtgagagagccatgcatatataattgaaa

SEQ ID NO: 86854 - DNA, 1041 bp, Oryza sativa
gataactgttgttgtacgaaaattctgcataaggtagattcttatcccaacttccaccgaaatctaaagccaagctctcaacatgtcttccaaaatttgattcaccctttcggtttgtccgtctgtctgcggatgataagcagtgctaaagttcagcttagaacccatctcttcctaaagtttcttccaaaaatttgaagtaaactgactgcctcgatcagacactattttcttagggacgccatgcaaacacacgatccttgccatatacaattccgctaaccgacttccggaataggttgtctttaccggaatgaaatgagctacttttgtaagtctatcgactatcacccaaatagagtcatggcctgatgacgttctgggtaaaccagtgataaaatccataccgatttcttcccacttccattcaggaatcttcaaaggctgcaacaaaccggcgggtttctgatgttctgccttgactcgctgacaaacatcacatactgctacgtattctgcgatttcacgcttcatacttgcccaccaaaatctttccttgagatcctggtacattttggtactaccagggtgaatagagtataaggtatcatgagcttttttcagaattgcatcttttaaatctttgttgtcggggacacagattctctcgcccaaccatacagttccttgctcatcctccaagaaaccgatagcttttcctcttctcatattcttcttgatttcttgaatatcaggatcccttaatttgggcttctctaacttgatcaattagagtgggcttcgcttctaaggctgcaacgaaacctctactgacaatccccaaatttagtctttcaaattccttgcataactccaatggcaactgtcgtccttccgtagcattgcaatagtcttttctgctaagagcgtctgctacaacattagcctttcccgggtgataatgaattcccatgtcataatccttaattaattccaaccatctcctttgtctcatgttcagatccggctgagtaaagatat

SEQ ID NO: 86855 - DNA, 642 bp, Oryza sativa
tacccccgttaaacggaatctcgaccccgagattcggaagaactggcgaagagatcgggatgggctgccttcagctcgtcttcacgctcccaggtagcttcttcctcggcgtggctgctccactggaccttgcaaaaacggattaccccggttctggtcctcgcgtccatggtgttcaagatttttcctggctttttccccgagggcaagtctttccgaaccttaatattgctctgagtcggcctgcttcgatggcactcgaaggcatttcttgagttgcaacacatggaacacatcatgcacgtgcccaaaggaggcgggcagctccaactggtaagcaacttctccgcgtcgagcaatgatacggaaaggacccacataccgaggtgcgagcttcccctttgtctgaaacctgtgtacaccgcgcaagggcgtgacccgaagatacacaaagtcatccactgcgaattccaggtcacggcgtcggttatctgcataacttttctgccgggactgtgccacctttagattatcccgaatggttctgaccttcgcttcagcttctctcaggatatcagtcccgaacacttggctttccccaacttgatcccacaatagcggtgtccggcatttgcgtccata

SEQ ID NO: 86856 - DNA, 582 bp, Oryza sativa
aagcgcctccccgctccaacaatggtggtaaggatgttattcggggtcgtgtgaaccatgtgacggccgaggacgtgctgacaactccagacgtcatcgttggtacgttcctcatccattccatccctgctaccattttgttcgactctggagcttcccactcgtttatatctgtgccattcgtggggagaaatcagttgggggtagaaaggcttaggaaccctttgctcatcaccacccctggaggggttatgacagcaaagtattatagccctgccgtccctatagaaattcaggggattccttttccctcggatctgattctgctagacaccaagaacttggatgtgatccttgggatgaattggttggctcaattccaaggagtagtggattgtgcgagacgcacggttactctgtaccgagggccggaacaaccggttgttttctttgcacccccaacctctgtcagaagttcagaacttcatcagatagtactgtcagaaatccccatcgtcagagagttcggagacgtgtttccggaagaactacccggtatgccgcccaacagggagattgagt

SEQ ID NO: 86857 - DNA, 1229 bp, Oryza sativa
aaaagaaagaccatacccagagaatgtgtgtggattatcgtgcattaaacgatgtgactatcaagaataagtatccgctacccagaattgatgatttgtttgatcagcttaaaggtgcccttgttttctccaagatcgatcttcgatcaggatatcaccagttgagaatcaaagaggaagatatacctaagacagcttttaccactaggtatgggttgttcgaatgtactgttatgtcttttggacttaccaatgcccctgctttcttcatgaacttgatgaataaaagcgctgtttaaatggaaatacctagacaagttcgtggtggtctttattgatgatattcttatctactcccgaaccaaagaagagcatgaagaacatcttcgccttgcattggagaagctacgagaacatcaactgtatgctaagtttagcaagtgtgaattttggttgtctgaagtgaagttccttggtcacgtcatctcagcaggaggagttgccgttgatcctagtaatgtggaatccgtaactaattggaagcaaccaaagacagtttcagagattcgcagttttctaggcctcgcaggatattatcgaaggtttatagagaatttttctaagattgctaagcccatgacacgactgcttgtcacgaccggaaataacccaacgggcgttccttacgtgcgtgcattaatccttgtcccaggaggcaaggtacaccaaaagttgatacatttcagagtttaacaagcggaagcgtaaatagttaatttattacatgggcagcgaaggcccagcacacacagagacaaacgagaaacagcggaagactagggcgacgaccacaggcacttgacggcaggcacgagctagacaccaaagccttcatcttctaggggctcctcttctggggttgggaaaaattgagcaagactgagtacaaccaccgtactcaacaagacacacccacaagtgcagaataaatgcaagggagtacaaaggagttatactataaagggttagggtttgcagtaaacagcatttaaagatatttagttgctcaaagctattttgtaaacacgattctagaactatacaatattattaatcaaggccgtgaacccacacgaacctgccttaacccaaggcctacgatgattcagaccgaactggcaacccgaccctgggtcccagctcgtcccaagccaacccaggccaaccat

SEQ ID NO: 86858 - DNA, 1652 bp, Oryza sativa
ccgcccatgtaataaagtaactatttacgtttccgcttgataaactctgaaatgtatcaacttttggtgtaccttgcctcctgggacaaggaataatacacacacgtaaggaacgcccgttgggttatttccggtcgtgacatttgtcaaccgtgggtaataaatcgactagttcatgttacttatgtgacctagctagaactatatgcttagccctgcttaaataacactagctcagttgatgggataattacaatattagacctttttagtatcagaatgagctgcgtgctcgagacacctggccatgcttcatggtcgtaattatccaactaaaatgcgactgcatgctgggctgtgggtgcatggtttcgctagtcgcacccatggcaattaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgcctgctggggacgggggcgaacccgaaggtgtggtgcgatcggttagagggggttatgcgaagggtcctgtcacggcctctttccggtatgtcgtgttggcatgtcggcgcacggaaacgtgtcgtggggctgtgtcttgtgggtgtacagttgtacacctctgatcagagtaaaactattcgaatagccgtgcccgcggttatgggcggtcgaccagattcaccgtgattagtcccaccttaataaatcgactcaatgcactgaagttcaggtgggttggttgggcctgttcaacgtggtgtagcgttgatcagtggagattttaatgttactttaattactcaacagctttactgttttgctcaataaaatgttttacaaccgcctttatgcaaatagccacaaaccgtcattgtatccctttgcacgtctgcatcattggtgtggcttgctgagtacggtggttgtactcagccttgctattattcccccttttcagaagtgtagtgcttctgagctgaagacgaagttagaagaccaaggctcagaccccagttgagtttttcctgtggagtggagctgaagtctcgctaggatcgcctttttccgctgctgtcgttctgtttcggtgtgaggactaagtgcctcttctgtaagtattttacgctttatttacgtttggaactgtatattacttgtcgttttgtgtaccctggctggtcctggacagggatttaatacacaaaatagtctggaaatttgggctaaatttctgggcgtgacaaagaagcaggatgcagattgttgtgtaacatggccaagctaagctaaatgtggaggagcaaagcatatgctctagtctctctattgcttgatgagaagtataaagctgaaaagatcgaagatgtccccttgtgataatgagaaacttgaaaaagggatagtgcgtggcctcgtgctcgctgcatgtgcaccgtggagcggagcctcgcggcgcctgttgttggtgcgcaaggacggggacgaggcgaccacggcggtggaggagaagaacgt

SEQ ID NO: 86859 - DNA, 2650 bp, Oryza sativa
  unsure (1)..(2650): unsure at all n locations
cctaaagcagcagctcaatcgatttatgagaaggaggcaatggctattttggaggctcttaagaagtggaggcactatgtgttgggcatcaaacttattatcaaaactgatcaacaaagcttaaaatacatgatgaaacagaggttagtagagggtatacaacacaagttacttctgaaactgatggagtatgattacaagattgaatataaggctgggaaggaaaatgttgtagcagatgcactatcaaggttgccccaaacagaacatgacaatgaggattgtcaggccatcactgtggttattcctgagtggatacaggacatccagaatagttatgaaggagatatacaagcacataagatgctgagtatgattggaactgacagcgaccctgataggagttacagtctagaatctggaatactatgatacaaggggagaatatatgtgggagactctaattccattagaacaattctgctccaggattatcattcttctgcatttggaggacattcaggaataagggcaacctatcagaggataaaaagtttgttttactggcctgggcttaaaaagaaggtggaaaattatatcagagaatgtcctatgtgtcaagtcaccaagtctgaaaacattcacatacctggcttgctaaacccattagaaattccagacatggcatggactcatatatccatggactttattgaggggttaccaaagtcacatggaaaggatgtgatattagtggttgtagacaggcttactaaatatgtacattttgtggcaatgtctcatccttacagtgtggagcaagtagtagaggtattcatgaacaacatacacaagttatatggtatgccgatggctattgtcacagaccgggacaggattttcaccagtcaatttttccaggaagtgttcaaagcaatgaaagttcatctcagatttagcacagcttatcatcctcaaaccgatggtcaaacgaaaagagttaatcagtgccttgagtcatacttgaggaacatgacttttaaggaaccacaacactggtactcctggctcgcgctggcagaatggtggtataatactacttatcacacatcactgcaaatgacaccatttcaggccctgtatggatatccacccccacgaatcaatgaattttcactcccatgcaatgtgtcagctgaagcgagggttaccattgagcagaaagaggaaatcttatagaaacttaagacctgtttggctgaagcccaaagaagaattaagcactatgctgacagaaaccgatctgaaagaactctaactgttggggatatggtgtatgtgaagctacagccttacagacagacggtttttggcattagaggatctcttaagctgagatctaagttttatgggccattcaaggtgatagaaaaggtgggacaagttgcttatcggcttcaattacccaatgatgccactattcatccagtcttccatgttagtcaactaaagaagcatttgggaaagagagcaatacctatgcctaatctgccatcggtaggtcctgagggacagatcaaaacccaacctactgcagttttacagaggagaatgatacccaggaatggagttgcagtaactcaatggttgattttgtgggaaaatttggggccggcagatgctacttgggaagacgctgatgtcatcagaagtatgtttccaaccttcaatccttgaggacaagaattgtcttttggaggggatattgtcaggactctagatcagaaatgggaagtgagaagaaagtctgaagaaaattcagagataagaagattcagagaagttcagtgaaatgggagagagatatatcgagtatgcaaatccgatggtggcggatcagagcaaagcggtatcaacatcatctggccatcatctttgtcgggggccactgttaatgtaatcgttgtcnntttcctgaacttaattacgtaaacatctgtctgaaactgaggccacgatgaatgtggtccttacccttttttaagactatttaagtgttcgctggagaaaggaaaaggatatcaaaaagcatattctttgtcattaggagtagatagatctagaaccctaatttcgtcttgcggcatccactgaaatttgcgattctgatctgaattttttgttgaaatttccatttctattcccagctcttgacagaggggaaggggaagaagcccttgcagacgaagtcagactcagaggaggaaacatcctcagagtcggagacggaggagcagtacatggagacggacgacgacgacaactacgacgacgacgacgagtatggttttgtaaaggggaggttttgcaacggtctaggtgagctctctcagttgacatctccttaatcccattcccacccactctgaccggaaggaaacccctaaccctaaccttgtagttagtgttcgggaattggatcccaggattaggggagtgcttaattgctgcaccgggtgtcaagggtttttgtgattaggctgtgttttgttggcggatctggtgagggctagagagcctttggccagcgttttgatttattttgcttgtaattctgcttgcctgaatttccttgatgaattctatctgt

SEQ ID NO: 86860 - DNA, 7610 bp, Oryza sativa
caccctttgttctctgcatgctctgatcacacacctctctttttagtgggtaatgagaagaggagcaaatctcccatcttcagatttgaatcttactggcttaaagttctaggttttctagaagtggttcaacactcttggcaaaagccgattttgtcgtctaaccgactagccatctttcgcctaaagcttcggcgtttagcccgtgaccttaagagatggagccgctgcaatgtgggagacatcaaattgcaattggctgttgcagctgaagtaattttccagctggagctagctcgagaatccaggtcactatctgatcaagagaacctactcctctccaatctcaaatcaagatttctaggtctctcaacccttaataaaattaaaattaggcagcgctcgaggctcacttggctcaaagagggggaggtcgattcaaaacttttccatatcaaagcaaactctaggagaagaaagaattacatccaatcacttcaaactcccttaggagtggcaatatcggcacaagacaaggaagacgagctgttccgttttttcaaaactagacttggggcaaatgtgcaaagatcgttgggtctcaactgggctgctttagggctcccgtccttggatctttcagaactagaggaggatttctcggaggaggaaataaaagcgacgatcttctctttacctcccaaaaaggctccgggtccggatggttttattggatcctttttcaaagtctcctaggagattatcaaggatgatatcatggcggcaatcaattcgttcatgaaccttaacacatatcaactggaaaaactgaattcggccttcatatgtctcattctaaagaaagatgacgcttctgacgctaaccactatcgacctattagtctgatccatagctttgcaaggataatcactaaaactttagcgaatagattagctccaagacttaatgagttggtttcccagaaccaaagcgcatttctttggaagagagcgttacatgacaattttctttatgttcaaaacacgatacaactgcttcatagatcaaaaaaaagcagagcttattcatcaaggtggatatatcaagagctttcgataccgtttgttggccctacttacttgaagctctacggaatttcggttttgggaacagatggataaactggatcactcatatcctggcaacatcctcttctcaggtcctgctaaatggttcgcctggtcactcgatcaaccatgctagaggactccgccaaggcgaccctttgtctcctatgctcttcattttagccatggaacctttccatcgaattcttaaagcggctgaagatgcttctgttcttcaaccggtaaatggacgcaatgcaagattcagatgttctctttatgcagacgatgtggcaatttttgcaaatccagatagtgccgaactgtcttccctctcacagttcctggatttctttgcaaaaatttctgggctccatccaaacatcaacaaaacagaaatctttcctattagatgtgatgagatagatttgaacaatcttctttcaagtttcccggggatgattaaatccttcccttgccgataccttgtacttcctcttcactatcgaaaactaaggaagattgatttcatcccgctaattgataagattgggtcacgtctaccgggatggaaggggcggttcttcacctctgctggccgtaaaacccagtccattcggttctaagctctataccgattcaccatctaacggccctccgcgctcccaagtggagtgggttttcaaaaggattgaccgttttcgcagatcctttctttggaaaggcgaggaccctgatcatactaatcccggtgatagtttgattaattggcaactagtttgcagaccacaatctctagggggggctggtcttcctgaccttgaaagatttgcaagggccttgcgcctccgctagctgtggttttcttggaaatccgacaacaaaccttgggttggcatgaatattccctgcgatgatttagacaaaaaactgtttcaggcggcaactacaatctcggtggagaacggcgctaaaactagtttttggcatgataattggctgcacaagaggtgcccaaaagagttagcccccctctgtttctctttagcaaaaagaaagaatagaagggttcagttcgagttgatgaacaataactggcttttatcctttagacaaattacttttgtcgaagagttacatgagctggtgcaattgggaggcctgctccaataggttcaactcactcaaaatgtcaatgacatagtctgtaattggactgaatctggaacttatacaaccaagagtgcttacttataccaatttgctggttcatacactacaagcgattttacctcactctggaaagcccccgctgagcctaaaatgaaatttttcgggtggcttgtcctccatcaaagaactttgatggctcaaaacttgctcataagacattggctgtgtaattggatttgctgcttgtgtacctccgccttcgaagacaccaatcatctgttcgcggaacgcccgtttatgagacaagtatggtctatagtacatttgtggcaaaacttgccctcagttttcaattcccttccatcccgcgtctcaacctgctgggatgagcttaaggacgcaggaacagaagatcaaaaattattcgctcgaggtgctatcctgacaacttggtggaacgtttggctagaaagaaatagtagaatctttcaaaatttatctagttcggagttgtcagtagcttatcgggtaaaacaagacttggatttgcgcaaagtggctttcaggccaccctaattctccttttgttgtaacctttcccatgccttcctgggtgaatttttttgactccttttaattaaattccggcaggtcttctgccgtcgttcacctcaaaaaaaaattgaatcatagaaatgcttttggtttggaacaaggggaatattagttatcttagaggactattttccttgaaataactccatagttttgaattcctcccaccttaccctactaaactcctaatacacatttaattggagcattataatattttttactccatcatatctccaaaacaaactaaaatctctcttatatttgagaacgaactagatatctggcactagtacagatccttccatctgtgacggcccataacaagactggaatttgcgggccgtcacaaggaagtaatctcaatcgggccgaagtttcgcccgattgagatatggtcgcacaaccatggtatatcggcataaaactaaagtccgtcacggatgacacttatctgtgacgggctatagttgaggcctgattgagatgagggttccatatctcaatcgggccctaaaagaagcccgtcacagatgagggtcatctgtgacgggctccaactagaggcccgattgagataagtttattgcccgtcatagatgacactcttttttgacggccttttattaagacccgatagagattacttgtatgcccgtcacggttgattgttttagggccgttacagatatttgttgcacaatataaataccccccaccacctagtgtaactgtatcccactgttcactattttggtgggaggctgtagggggcgattttttgtcctttttccaaggaaaacagaaattaaattcccaaaagtgatcaaaatggatcaatcaagtgagtaatataaatcattaattgagcaatttcatcacgtcttacttttgcaatactgatcttataatatgtgcctctaatttgttttttttgtagcaattgatcgaagttggatgtatgccaaaaatttgaaacgtcattctacggagtaccgaaagggcgtaataaattttatgaacgccgcggaggaggatcggataagaagaaacagtgattacatgtgttgtccatgtgcagattgcaagaacgagaatatgtttgatagcggagaggacgtacacggtcatctgatacaacgaggattcatggagggctatacatgttgggtgaagcatggagagcaagaatcaggaagtggagcagcagcagacagaagtggtgcgcataatcaggaagatgaaaatgagcatgacatgtttataccttctccattgggcggtgaaatggttgatgtggatcacgatctgctgcaagacatgttacgtgacgttgaggacccagtccagaatgagagagatggaatgaaattcagcaggttggtaagtgattccgagacgcctttgtacgctggatgcaaagcaaaacacactaagttgtcagttaccttggacctaatgaagctgaaggcaagcagtggatggacagacaagagtttcacagatgttttaggaattttgaaggctatgcttcctgttgagaacacattgcccgagacgacatacgaagcaaagcaggttatgtgtccactggggttagaggtccgtagaattcacgcttgtcccaatgattgcatattgtaccacaagcaatatgcggacttggatgcttgtcctgtctgcaaggcttacaagcgaaagaaaagtgctgacgaaggaaataagtcaaagaggggtggtccggcaaaggttgtgtggtatctacctatcattgatcgtttcaagagaatcattgccaacccgaacgaagcgaagttagtacgttggcacgccacagaaagaaagaatgatggtatgcttagacatccagcatattcgattgaatggaggaatatagatcgaaaacacaaagactttgctgccgaccctagatacatgaggatatgcctttgtacggatggcatgaatcctttcggtgatataagtagtactcacagcacttggccagttcttattgtgaactataacctcccgccatggttatgctttaaacggaaatatattatgttgtgcttgttaatccaaggtccaaggcaacccggcaatgatatcgatgtattcctggagcctgttatcgacgatctggagattctttggaaagaaggtgtggaaacatgggatgcatatggtcaggagaacttcaagctaagagttctattgttctgcaccattaatgactaccctgcactcggtaatctttccggacaaactataaaaggaaagaaggcatgctccgattgcaaggaacatacacgaagccggtggctaaagaaatcacgaaagatggtatacatgggtcaccggaggtggctcccgctacgtcacacatttagaagaaagcagaaaatttttaatggtaagagataactttagcctgctcccaaagatttgtccggagatgaggtccacaatatggtcaaggacataagcaatgagtttgggaagaaaagaaaacgtagcaagacaaaggagaagggtatgtggaagaaaaaatccatattttggcggctaccttactggaaagatcttgatgtccgtcattgcattgatcttatgcatgtagaaaagaatgtgtgtgagagtttggttggcctgatgttgaatattcccgggaagacaaaggacgggttgaacgcgcgccttgatctacaggacatgaatattcgcagcgaactccaacccatacgagatgcagagacaggtaaagtgtacctccctccagcctgccacacactgtcgaaggatgagaagatcgcaatgttctcatgcttgaaggatattaaagttctatcgggctattcagcgaggataagtaagtatgttaaattggatgatctaaaacttgttggaatgaagtctcacaattgccacgtgctaatcacacaaatcttgccagttgctatcagaggcattctaccaccgaaagtgcgtcacacgatccaacgtctgtgcgccttcttcaatgcaattggacagaaggttatagatccagaagatctagatgggctgcagaccgatattgtgaataccctctgtcacctggagatgtttttcccactgtctttctttgatataatggttcatctccctgttcatctggtgaagcaaacaaaactatgtggcccggcttttctaagggaaatgtggccgtttgaaaggtacatgggagttctaaagtcgtacgttcgtaacagagctaaacccgaggggagcatcattgaaggttacacgaccgaggaggctattgagttctgtgtcaattacatgtccgatgccgatcctatcggagttccagcgtctcgtcacgagggaaggttgttaggtgttggcacaatcagaaggaaaagaattaggcccgatcaagcgtcgtacgcgcaggctcattacgctgtgctccaacatatggcagaagttggcccatactttgaggagcacttagcgaaaatccgagatgagaacttggggcgatctgatgcatggattaacagagaacataattctcggttcaacgaatggttcaagaatcgtgtgacaatgtctacggatgtcccaaatgagacagtacagttgttggggatgggaccgtcttggaccatagacacatggcaaggatacaatataaatggatacacattttacaccgtcaaacaagatgacgaaagcacagtgcaaaacagcggcgtccgtatagatgcattccaggatcaagttgggtcaaacacatactacgaccgcattgaggagatctgggagctaaactacgtcaagttcaaggttcctttgttctgctgctgttgggtgaatctacgcactggtgtcaaagccgacaaggaaggtttcacttcagtagatctatctaaggtgggatacgccgatgaaccatttgtacttgcgaaataggtcgagcagatattctacataaaagacccttcaaacaagaagatgcacatcgtgagggatggaaagcgccgaattgtaggagttgacaacgtcgtcgatgaagaagaatgcaaccataatcttcatgtaagacctcacattgaccttgacgatgatccccaagagcttgtggcatatgctcgttcagatcataccgaaggcataaccttgtgactgatgcatttgtacttatctattgtaatgaatgaagtattttgttttattgcaaagagttgatatgtgtagtcattaatatggctaattttgttttattacaaatgaccaaaataaaagttgtagatcgtgatgagaggatcaactttgttgttgaccatatttcaatttgaaatcatttagtatttacaaatgctgttaattagatttgtcatattgtcgaaatcaatttcaagctgttgggaaaaaaattatatagaataatgaccaaaataaaaatagtagatcatgaaaggctttacaactttgttgttgaccatatttccatttgaaatcttttactatccgaaaatgtattatgactaataaaatgaattattacacagctgctatatattttgcactcacaacaaatgaaagatggaaaatgagtcatcggtgacgggccttagtttacggctgatagagattaatctatctcaatcgagctttgccgtagagcccgtcacagatgactcatc

SEQ ID NO: 86861 - DNA, 1124 bp, Oryza sativa
ccccccccccccgaaattttttatttttgttttatttgtttgatatttttttcacgcttagggacacacaagaaccaaccatagaaaaattgaactcaaatgaacgtaatatgtgacatgtagaatttttcctctcctctcctctctccgaactagtgcagaggagagagatgtgcaacttttttatttttattttatttttttgatatttttttcacacttaggaactcacaggaaccaaccatgtaaaaaataaactcaaacggacgaaatatgtgacatatggaattttccaaagctccaccgaaaaacttctctcctcgacaacacaatcttgcaagcggaatttggaggttttaatatctccgaacccggcaaagctggggagaatcggatgtaactttttctgtagatgtccgtgcatatattatttgcctgattccgagtccgtatgagaaagttatgcctattttaatagatgatatattttgtccattttggtagagttttggaaaattctacatgtcacatattttatccgtttgagtttattttttatacggttggttcctatgttctcctaagtgtgaaaaaaatatcaaaaaaatgaaataaaaataaaaaaattgcatctctatgtactgtttaacttatatatgtcatttcatgtggttatattttgaattagattaagtaatttcatatagtggtagagtgcattatgtttaacatgctgatcaaagggttttactaaaagagttatggtctaattttagtgaaagtgcaaagtagactaagtggtatgctagatattttcagacttagctaagtggtagttcgagtttaaattttttttttgtggttggttgtatcgtgatcttgagtatgaaaaaacatccgaaaaaataaaataaaaatgacaccgttgcaactccatacagagaaacaggaatggaggcggcggcgccagccatgctggcgccctccttcctggggcggcgccagcatggctggcgccgccgcctccattcctgtttctctgtatggagttgcaacggtgtcatccttattttattttttcggatgttctttcatactcaagatcacgatacagccaaccacaa

SEQ ID NO: 86862 - DNA, 707 bp, Oryza sativa
gctatggatgaaacccgtgcggagactgtgttagcagctcaagatcgtgaagatcggaatcgtggtaagatttgcaagctagaagacaaggtggatcgtttggagaaggaactagccgcattgaagggagaagcaccaccgcagaaggccaggattcatctcaccgcaaggaagagagctctatttgtccctcgctaccaattggcgccaaaggttcgtgtggtggagaaagaagttgccccaaccttagcagatcctccgatcatcatcataagtgatgatgaagaagaagaatccaagcgcacccattccaagattgagtgggtagcaactcaaatgatgaagacagcagaacgagccttcaatcgacctccgatgctcggaagaactagagtgacttgtcaaaccgttgtcttagatcgttgtgttagtttgcttgttttaagtttgcgtgtgtgtggctcgcatgtgatttacatcagtgggggggatgtaattgcatgtgtttttttgagtttgtttgctttcgagtgttaggtagttggtgagtttagtggtgtgggagtcttcagtttgtaataatgaaactcacttaagatcaataaaagttaaagtaattctcggtcctaagtagttttccccgatttctcttcttgtgctcctgtccatgccagatggtgctcactcgcagcaacgggaatggcccc

SEQ ID NO: 86863 - DNA, 1361 bp, Oryza sativa
gctgagacatacagcaacaacggctcctgcgggtgtggtgaggctaaaaccggcggctcgggtgaggagttgtttgagatcttcgaaggccttctgtgcttcgggtccccattggaaattatctgttttcttcagtagcttgaagaagggcatcccccgctcgccaagtcttgaaacgaatcggctgagcgccgccatgcatccagtcagcttctgaacatctttctgggtgcttggcggtttcatgttgaggatagcggtaactttctccgggttggcttggacgcccctatgagacaccataaaaccaagcagcttccctgacggtactccgaaggtgtatttttcagggtttaatttcatcctgaaggcgcggatgctcgcgaaggtttcttctagatccgagatcagatcatccttttgtttggtcttgacgactacatcatccacataggcttcaacgttgcggccgatctgtgttgaaaagcatctctggatcatgcgctgataggttgctcctgcgttttttaatccaaacggcatggtgacgtagcagtatgccccaaaaggcgtgatgaatgaagtcttcaagcagtcggattcggattccttcagtcggatctgatgataccccgagtagcaatccagaaaactaagaagctcgcagccggcggttgagtcaactacctggtcaatgcgaggcaacccaaaaggatctttagggcaagacttgttgaggtcagtataatcaacacacatgcgccattgccccgttttcttccgaactagaaccgggtttgccagccagtcgggatgatggacttctttgatgaagcctgccgctaacagcttggttaattcctccttgatcgcgtcttcctgtcttgtgcgaatcggcggagtcgttgtttgataggcttggcatcttctttgacatgtaaggagtgctcaatcacctctctaggaataccgggcatatcagatggtttccacgcaaagatatctttattattctgaagaaaggtgatgagcgcgctttcctatttacaatctaactcggcgcctattacagcagttttagtaggattagaaggatctaggggaatcttcttagtcttggcttcgctttctccactttttgaagtcttggtagcgggcacttctccttcgctcgccgtggctgcagccagtcggatatcctctcgggcagacgccatctcgcgggtttgggccatgtcgcaactctccttgtcgcatgtgacggcttgcttgatgtcgctccgtagggataggactcctcggggaccaggcatcttcatcatcatgtaagtgtagtgcgggacggccatgaacttggctaa

SEQ ID NO: 86864 - DNA, 1211 bp, Oryza sativa
tggagaaagattaagctatgtgctttggatacatttttcggcgtcccacaacgtcgccgagtatgaggcgctccttcatggactgcgaattgcgatttccctagggataaagcgtctaatagttcgaggcgattcacagctggtcgtcaacaagttatgaaagagtggtcctgccttgacgacaacatgatggcatatcgacaagaggtacgcaaattggaagacaagttcgatggactcgagctcagtcacgttcttcgacacaataatgaagccgccgacagacttgccaattttggatccaagcgcgagacggcgccctcagatgttttcgtcgaacacctttatacaccgaccgtacctcataaagataccactcaagaagcagacactcgtgacatagctatggttgaagccgactggcgagagcccttcatacgatttttaacttctcaagagctccctcaagacaaagatgaagccgagcggatttcaaggcggagcaaactttacgttatgcacgaatctgagttatacaagaaaagcccttcaggatttctgcaacgctgcgtttctttagaggaagggagacaattgctgaaagacatacattctgggatatgcggaaaccatgctgccgcacgcaccattgtcggcaaagcttaccggcagggttttttttgcctactgcagtgtccgacgccgacaaaattgtgcgcacgtgcgaaggttgccagttttttgccagacaaattcatctaccagctcaagagttgcagaccatcccactgtcttggccgtttgcggtttgggggctcgacatggttggcccgtttaaaaaggcagtcggcggttacacgcacctctttgtggccattgacaaattctccaagtggattgaagctaaaccggttgtcacaatcacccagcagataacgctcgagacttcttcatcaacagtgtgcatagatttggagtgcccaatcggatcatcactgataatggcagacaattcactggcggagtttttcaagacttttgtgaggactttggaattaagatttgctatgcctcagtggcacatcccatgagcaatggacaggtggagcgagccaatggcatgatacttcaagggattaaagcacgtgtttttgaccggttaaaaccctatgccggtaaatgggtggaacagttaccatcagtactttggt

SEQ ID NO: 86865 - DNA, 745 bp, Oryza sativa
atatttttgttttggctcacatatatagttctataagtgtcaccgcttactcttgaccaaaaaagtattaactagaaagtgattgcacctttaatcgcgtctgtcctgcaattccttttacaacaccaagcggataacgaagggcttccaggacaggcccttgttcaatgtgaacctaaccaaaatagtaatgaaaaagaatggtaaatgctaaatttcttatatctgttatacacctagattaaaataatacagtcttgtatacctcgacataactcccgacagactccgggctgtaccttacttcaccaagagcattagcagtgccctcaagagaattcagctttaggacatcttgaactgtcgtgccactgaagaagttgaatgcaaaatatatactgaatcagcaaacaatttcaaaaaacagttcggttgatttatgcgaaaaaagacaacctcttgtcagatacttgtaaaattgattcaggtagtgtaccagctacagcggcgcttcccagaaaagttgtttggaatctaacaccctcctcatcgctgaatgcaatcacctgaggtttaccaggcaaccgtgaggcccaacagctttatgaattatagatatcagaataaggtataggttcttctctacataagcagggaaacagccaactgagtaaagagacattatataatggattcatcctggattaaatatgtctatatctgtagtctttctgataatctattg

SEQ ID NO: 86866 - DNA, 950 bp, Oryza sativa
aattttcatcgttttatttttttgctgctcagaagaagatcatcgtcaaaacatgtcgctcatttcgaagctgcggttgatcactgtggatgtcaccggtactctgcttgcctacaaagggcagcttggtgattactactgtatggcagctaaggctgctgggaagccatgtcctgactaccagcgaatgcatgagggcttcaagcttgcatacaccgagatggcaaggcaatacccatgctttggatttgcagcgaagatgccgaatatcgactggtggaggatgtgcgtcaaggattcttttgttaaggtgatgccactgttttgtaggtctgaagcttttcaggaactagtgatgtctttgtgttcagaggctaagtgcttcggttgcttgatatgtgctgtcttgtaggctggttatgagtatgacgaggagacatttgagaagattttcaaacggatttactcttcttttggctcgtctgctccgtactcggtattccctgatgcgcagcccttcatgaggtggcttcgcgggaaggggctcacggttggaattgtcagcaacgcagaataccgttacaaagacgtcatcttgcctgctctaggactgaaccaggttcgatattctccgcataacaaattacacctcatgctcctctaatgttatcatcttcacaagtaaatgttgtggttcatgacttctcttgatttttttttaaccagggctccgagtgggactttggggtgttctctggaatagttggtgtggagaagccagatccaagtatctacaggattgcactggaaatggcgggcaaggtcgcgccagaagaggcgcttcacataggcgacagcatgcgcaaggactacacccctgcacggagcatcggaatgcacgcgttgcttctggaccgattcaagaccgccgatgctgagagctggaggaa

SEQ ID NO: 86867 - DNA, 2258 bp, Oryza sativa
cgtagtttttgcatggtcttcttgagtttgttgaactcttgatgtctccttctcatttagtttcttccacaactctacagcttcagcatctattctgaagcgacataaacatattagagtaacaaaagtatttaagtttcaaattgtccacaagaagtatataaattcctaaataaatgcataggaccccccccccctttctcccccaataagagtctagatgcttgttagtagatttataactacctcataatgtcagaattcctctttagtccagaaatggcactttgggtaaactgaagcaactcttcacgtttcaccttcatgtgtacagaaacagagaatcattgacaagtcagattctgcatagtttagcaatttgtgcatcagagttaatttttctcctagtggaaagacattaaaggggggatatactgaatactacattctttctacataaaggaacaatggccttcctgtctagaggagtgaagcagcattccattcagtactccaatcaagtgatgcattgcatgagcatagactcatagtgagtttgtgactgactacatttctaaataatcctatgcaaggaaggggtcaccttctgtcttaataatatcttcccccttttggtaggattactttatatatcgttactgaaataaagaaacttcatgtgcagtaaactcagcaagacccccaaagttatataatttagtcctaaaaaaatgggtagtttacaatatcattaaatgcattttttctaaaaaaaaaaaaaggttatgtgagtttttggaagaaaaatatgcaagctaagtgtttatactaccaagaaatatgtaaaacctaaagaaacaccaatcacctggaaagaagacatcaagaaacatatactacagctgcataccctagttacataacaatcattgaataatcaggaatgaatttttgcaaagagttacatgttatatttatccatccactgattcaatactcagcatagaataaaagtgcaagagacaacccaaaatgtaccaggacttcatcatggtaatttgagaatgattttgccaagtcctgtatactgctcatgatcgcattattgatttctttccctcctgtaagacataggctgcaggaaatgactattagtaataacggtaggttgctaagcttcattcaaacatttcttattcaaggaacagaaaataggattgcaggatgcctgcatacatgatgtggtttctcagaacacatcagtatggagcatctataagtctataactaacttaaacagggtgcagggacatatcaagtgaaaatgcagtttttatgcaaatttcattttcattcgacataaaagcgccaaaagtttctatccggaacagctactagaaaggccatgctatacgtctctacaaaattttatgatcaaactctgcagaattgtatgaacacaggaaactggaaaagacaaactctgcgatgaatagttaattagaattgtccatcaaatattttatatttttgaatcttgtaaatgcaatttgagtttgatcataaacttttgcataaggatgtcaaatccatgtagtgaaatacaggaggcatttacaaatagatcatgtaggcaataagctcacccgaaaatttccaaaagcaggggaacctcttcttcattaggagcttgaagaatctgagaatgataaggattactgtgcttaacttctatgagtgctttagcaaaaaatagcattgccttccaaaaaaaaaaaaaacacaaaggtgcttttatgctctcctgaaggaaaaaaattgcctgagttttaaaacttcagagttaagaagccaacattagtttgtgttattttcattatctttttgaaaccaaatttacaggatgcatgccacccatgctacacatctatgtgaaaaggtaccaaccctgcagttgaaggtgtttatactatgtgtccttcaaatgttgcacaggtgagaagactaatagtatgaacagatcagtttattagctgtggacattgagcgaacacatggaagaattagctgaggtacacttagttttgggcataggcacagatttggatgagttacacaacccacagcaataactaatttaagttgcttagatattggtgaacgctttttctaaaggaacaccaaggcactcctcagtcctcacaatagcagtatataacaaaaggcacaagcaggttcactcaaaaattgaattagtt

SEQ ID NO: 86868 - DNA, 887 bp, Oryza sativa
tgaaacaatggtttcaaacagtttatatatcaaaccaaataccttgaatgtagaaaggtgatatttagtcaatttcaggaaattgtctgtacatctctcaagctcatcactacataaacaaaagataaagctgaatttagtaaacatatgttttagccacaggccctaatcaggcaataaccactacatacttggttctcttttccttctgttcattatatgatgactgaagctgccacgtatcctcaaggaaattgatccaagtcttgactacgccagcctccacattacatgaggtaatagattttgaaagttcattatcctgattgatgccagggaagagaacaaaatattaagttgatcaatattttgataacaaacagcactaatcaattgcaagaaatataactgaaaaaaaaaattgaaaccagatcaacaaataaagtatcagcaccttcgcttttaaactaaatatcatttgattgtttgcttcatcaaattgatccctctcttcccttgtttgcttgagacgtccaatggcagcattcagtgaaatgttgacctgttggtggagagatatagaaagaacacaaacctaatgtcaaccttaagcagaacaataataattcttatagaaacaattcagcagaaatgtaactccaccagcccactatatattgataaaagtaacgcgattgaatggtgctggagtatatttgtaaagcaaatttccaattttgtcatttttattcatatttttaaaggaatataactctttaaacttatttacaagatggcatatcagttgattaaatatcttacattttttagatttaaaattgatggcacataacaactgcatatccacatcaaacctagcactggaa

SEQ ID NO: 86869 - DNA, 1039 bp, Oryza sativa
agatgaaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtctaggtcgtagaaacattatatggacttaaacaaggagaattatgtaacatgaagaaatagtagtacaatttgaacatgatacaactatttgcattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccctgtattgctctggtagttcaagctgcacaacacggctaggtggagttagaacccttctggtgtctatccattctctgtattgacatctccttggtggttcctgggaggaaagaatagatgtaaagcaagcaaagttagtaaatattgtgagaaaataaggaatcatgtaatcaaaatatttttaccatgaaatcgtcgtcaagaatatttggacaaacaaagaaccttcgacccaatgttgtaggatttatggaacgaagaacctgacaacgatcaccacacctgcatcttggacgggcttcccatggagggagtgccgtagttagcacccgccagtcgctctgttgttcacgacattggcgttcataagccgcttttctctataagtattgctcagtactttcggatgcgaaataccagcgaccttcttgtaaacaagtggttaggtcgagaacgggattttctgtatcgacccactcgatgtatgcgcaagccgtagtgcgggtctgccgaatagagtagtgttacgaagaataaagcgattgcccatacggaa

SEQ ID NO: 86870 - DNA, 5194 bp, Oryza sativa
taaaatgtatgtaaattgattgtggaagtaatgttgtttttttaagtacctgtggggggcacaacagaaggcctagccgaggaaggcggggtgctgaacggtgcacgaaaccctgaagcaatcggcaagtgaaacggctcacttatatgtgcgaggcatgtacagaagtagtaataaaaatacttacctccgtgtggagggggagtcggcctaggaatgtgcgcagctggacggggaccagtcggtacgggtggccgctgtacagctgcgtctgcccgagcaacgtcgtctgcacgacaggtgagcactcggagaatcgagcgcatcgactccaccatccgcgtgtacgtcgtcaggtgctcctctacggttaccggaattcccgcgtctaaacgttggatcgtcgttgaaccgtcaacgacgacccggttgatgtcgtcgacctgcatggttaatttgttcataaatattcgtaaaatttgacgataagaaagacatgaaaacataaaggaatggtgcgatgcagggtactcacaacacgagcgaagtcctggtcgcggtgcctggcgtagaggtctctagtgctcgcaacgtggggctgctgctccaagggagcgaaggtgaccctagtacgggtgcgtggctggtaccagcgtaggtaggcctggtacgactcctcagtgtgtgactctccctcgtggtccacgacctcctcggttgcgagcaaccagtcctcaacaaaagtcgccaacttggtgggctagtagccagctgaatgctgacccttgcgcgagtacctgcgaattaatgtgtaatattagtgtgaaacgacagatgttacaaattattgtaaacaggcagattttaatgcaacaacggaaagcgtagtgcaagatcttaccggtgaacagcagcttggacggtggtcggaaacggtactggaaagggctgacggaagccgaactgccgcatcacgcggaaaggggcgtgaggctcaacgcagatgtcgaagaccatcggaaccgtagtcatccagtacgcctggtccctggtgcagagtgtggacagacccaacggcgcacgagcctgggtagccgcggcactgtagggctcccacacgacgtcagtcgtcagaaggcggtcgaacaccataacaaactcaggatacgaccgcctaacctggacgtgagcccatcggcgctgcaatacgagacgattgatgtgatgtacaatgaacttagcaattaacttaacaatacgttaagatcgatgcaacgtacctgacgacggcaccacagagtacccatcgtagggtagtcgacctctggtcgctcctcgtacagtgactcctcgtacgcgtgctggtccacctcagggcggccgatcgcaatcctctcagctacccagatagaaagaaagagagggcacccaccaaaggtcgcgctgggatccgtcttcgtgcaagactcacaaagtgcacggtacagagccgccaacaacgcggaaccccagctccactgaggcacctcgcctaccgcggcgtcggcgatgctcctggcgtagtgcacgagtcccttgtcgaccgcgtgcccgtgaccgccacagaacatcacccagccaaaaagccagagcaagtacgcctccaaacatcggctgtacgagtactcgtcggcgtccgcctgtagctgctcaacctgcaagcagtcgataaaatgttaggcaccttaactgcggactaaatatgtaatacgattgtcatttcggtacaaaaacactcacggtgaactgaagcagccacctcttcgtaggtccggtgttgcggtggtgtcccaacggctcgagcgggaggtgcggtgcgcgctgtactagtgcgaaacgtgccgtcagatcgtcctgccagtccacagccgtggtcactggcccaacagcgtctcccgcgagcggtagccccaacaagtacgatacgtcctgtagggtaggggctacctcaccgcacggcaagtgaaaagtgtgcgtctctggcctccatcgatcgaccaaagctgctacgagcgacctgtccacggtccatcgtctggccgggtccgcgtcgccggccgcagcctccaccagccgacacatcggtaggaggccggcctcacgtagcctgcaataacaaattaatatgtcattataaaaaatattgcagtgcaactaacttatagtaaaacactgttcgtacctctcgacaaaggagtcgtgaaccgtgagtagctcaccgcacgtccgtgcccggaacgtcccaagctgagccccatgcaccacagtaaggtgagaccggtgtcggtgatctatcgccgggtccaacaactgaggtgtatcctgacgtgccatctctgaaaaatatagtgtttcgtgttagaacaattcaaaaaatagtaatgtaaaacaaaagataacttgcaaaattatgaaatagtaataaaatcatacgcgttaattatgtacaacaagagtacaggctatttaaatatagcaaacgttactaatggtacataacgatgacgtgcaatttaacatatatgtagagttcaataatataacataacattacgtgtcgaagtccgacatacatcagcatacataaagacgtttggcgccttagtccgacgttacatcacgagacctaaagacatgacatgccgaagtctgacattacacgacgaaacataaacacatcgataagttcgaaacgaattacaagcaaatccacatgccgacatagaacataagaactacaccacgtagccagacgtggcacgacgacgcctaggatgtggtcgagtggaggtagtgctttcacccgtagggcgagctccatctgctgctgatcctgatagtcctgcctccgccgcacttgatttctccttgtctttaggacaatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttactgaagtactatgacacaatattgtatctggtatgccacactccacagcggcagcaatgacatgggtgcatggcctgtggagcagcttcggctttgcacaagagcaatgacatgtgccgtcgtctttgagaacacactcctgcttcactctcttgcagtagatacccctgactgccttatcttgacatagtatctcaaacctgtgctgttgggtaccttgcactagagctcgatgtttcatggcctttttacgcaactcctctagctttttctgcatgaaagctccaaacaaaatgctgttgttcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttccgaatctccaatctagttcttctaaccaatgttggactatccgttgggagaggtccaagagcttgaggagggtcagcaacggcggtcgatggagccgctgcacgctgatcactgcatttggctgtcaactcatctaatctcttccaaagctcattgaattttttctcctggttctgattgcacagcctcttgaacatgttcatgagctccttgttcttgaattgcttgaagaaattagctcctatatgacgcatgcaccacctactctgtacatcttcccaaacaccggggtatcctcgttccatactcccaaactgcaactctcctatcgctcgcagaatgccagcgtgcctatcatgtatcaggcatacatttggcctcataccaacaacttttgttttaaccaatttcaggaaccagtaccagctatcggtattctcactctcaacaaaagcaaatgccaagggcaatacctgattgtttccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgccaggatgttcaattgaggggaatttcttcacttcgtaagagctcccagggtttctttcctcgataacaccaagcaggcgtggcaaattgtcatacgaggcttcgtaagttccaaatctcatctctattattttctgtttggccctccaggccttggcatagctaatagtatacttgtatgtctcttcaatgtgtcggattattgaccttggttcatatgtgagattatcgatgacatgcgcatacatcttagatgcaacaaatgcacatgtaatgttcctatggtatttctgaacaccaggtagaaaacatgtatgcttggtaacaactgacactgtccaataatccttccatttccccttatatgcgtgcactctccagggacaaccatctttttccttaacacaccgaacttcatattgcgaccggttcgacttggcaacccaaaactctctatgaagtgacactgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatccgtctcatcatctgacgaatcaccttcctctacacgctcgttgtcagaatcctccctctccatttcatccacaatggcaccgacagtctccccctcgtcagccactccacctggttgaatgcccactggagctactacgcccccgtcctctcgtgcgttgacctcctccacagaagtctcgtttacttcagcacttggtccctcgccatcatccatgttcgtctgcacacctggatccttcgggtgaacaaacgggctgcagga

SEQ ID NO: 86871 - DNA, 2831 bp, Oryza sativa
ccgcctccgccgcgcccgagacgccgccgccgttcttggcctctccctttcatcggggattactgttaaccaatataccgcttctcagatattgttctctcttgtcaagattcggcagttcgctcttgcccgggacctgtttgataaaatgctccagtccggtgttcatctggatgagtatgtttacacggcaggcattcgagcttattgcgagtccaggaatctggatggtgcgagagggttggtggtaaggatggaaagcgagggggtcaaggccagcgctgtgccttacaatgtattgatgtatggcttatgcaagaatatgcgcgttcaggaggctgtggaggtgaagaatgtcatggtgaacataggagtgacagccgatgaagtgacataccgtactctggtctatggtttttgtcggatggaagagctggaaatggcactgaggataacacatgacatgatcaggcttggttttgtgccatcagaggctaattgctcatttatgattgacgagctacgcaagaaggagctggttgaggaggcattcagtttagcttgtaaattgggtgatttgggcatggtaccaaatgtgtttgcatacaatgcattgattgacaaactgtgcaagaatgaaaggtttgacgatgcagataggctctttaaagagatggcgggcaggggtctggagccaaatgaggtgacttatgctatattgatacatgccctgtgcaagagagggatgatagaagatgcactttgtttgttcgataagatgagggataagggtatcaaagtgacagtttatccatacaattccttaatcaatggttactgtaaacagggttctttggatcgggcaaggggacttttgagtggtatggttaaggagggattgacaccaactcagcatcatattctcccctaatagctggtttatgtaggaatggagatctgtctagttgcatggaactccacagggagatggctgagaggggcatcgcatggaataattatactttcacagcacttatcaatggtttctgcaaagataaaaaaatggatgaagctgctaggctgtttgataaaatgattgacagcaatgtaataccaaatgaagtgacctttaatgttatgatagaagggtattgccttgttggaaatataagaaaggcattccagttatatgatcaaatggtggaaatggggctcaaacctgataattacacttatagatcattaataagtggactttgcttgaccagtggagtgtcaaaagcaaatgaatttgttgctgatctagaaaatagctatgctgtgctaaacaactttagcctgacagcgcttctgtatggattctttagagaaggaaggttcactgaaacataccatctttgggatgagatggcagtgcgaggagtcaagcttgatcttgtcagttttaccataatcgtgtatgctgctctgaaacagcatgataaggaaaaatcatgtgtctatttagggagatgaaagaacaaggtgtcaagccagatgatatattctacacatgcatgattgatgcactgtcaaaggaagaaaatatgatccaagctttaaactgctgggatcagatggttgtggatggctactctccaaacactgtaacacatacagtcttgataaataatctctgcaagccagggtatttgggcagtgcagagctcctctgtaaagagatgttcactgggaatgttcttccaaatgaatttacctataagtgttttcttgatcattttgaactgaggggacatggaaaagggcaagaatctccattcagccatgcttcaaggccatctagctagcatagtgtcatttaacatattgatcaagggcctctgcaaggctggaaagatccaagaggcaattgaccttatgagcaagatcactgaaagtggtttctctccagattgcatcagctattctacaataatacatgagctctgtaagatgggtgatataaacaaagcatttgagctttggaatgaaatgctctacaagggattaaaacctgatgttgtagcatacaacatttttatacggtggtgcaatgttcatggtgaatctgataaggctttgggaatatacactaatatgattagaagtggggtgcaaccaaactgggatacgtatagagctcttctctcaggaatttctctgatggtcagcaaggggcaggcattgctgcttaccacctgatgtctagggcagtgcatttcaggctctcatctaatggcataagttgctatcattcatctagaacaggatccatgaaatagttccctgaactgtagctacattatgacttcagttgcttcagagggacaaaacaatacatacaaatttctgtatatgagctcatggattctacacataacaagtaagcaatttaagacaattacttttctaccaaatgtatgttgtccacaatcttgcagatagtattgtaccatttgtacatttgagctatcagattttaatttgacagtacctttactgctttacattctttacttcaagaaaaagtgttttttgttaatgaatgtttttttttcttatttcatgccatcttactattgatgtttcctgttaagactgaaatagtgttattaagacacattcgtcttggtaaaagttctatagattccaagcttaaaaattcattatcaactgtttggactttacattcaacattgctaagacaacaattatttccaactttgcaattttacataaccttgtctgaaaatataaaaaaggagattacacccttttaagggatttatttt

SEQ ID NO: 86872 - DNA, 718 bp, Oryza sativa
actagaaaagaagtcggacaagcagggtgaggaagacaagataaaggagcatcagttggagaagaagcgtgagttgttgctgcttgttgaaatcttggctgcaacactcacttaccaagccggcttgaccccaccgggtggcttctgggaaaatgatgagtttgggcaccgtgcaggcttccctgtcctactagacaagttccctatccgttacaaggcatttttttattgcaatgcagcaagcttcatggcatccgtggctctcatcattctccttctcaaccgaaatctgtacgggccgggcataaagtgctatgcgctctttgtctgcatggtagcgggcatgttcggcctcatcgatgcctatgctgctggaagttcgatgcatctgcgaacctccatcgttgtcttaatattggttacggtagtttttgcagctgtagtctatgtggcaatcatcggtcgtggacaacgtgcaaacataaatcaacatcagtcaaaacaaacacaaaatcaacaaaccaacaaggaagatggcatgatggacacaccaagacaaacacaagatcaacaggaagctgacatgaaaaagaaagccgacatgatggccaagtacttaatgctacaggaatattggctgcgagtgtggcctacctcacgggcctaaaaccacctggtggcctgtggagggatgaaggtaatgggcactctgctggca

SEQ ID NO: 86873 - DNA, 734 bp, Oryza sativa
ccccctcttttccttgctcgatctcggagtttccctacacctgcctcggcattccactgtcagttcgcaagctgccaaaagcggccctgaaaccgcttgtggataaagtctcccatcggctcccccctggaagggccgtctcaccactctggcgggtcactcggttctagtccagttggtctctcttccattccggtctatgtttctgtggcgatcggcttgccaagctgggttatcaaagccattgacaagaagtgtcgcgccttcttgtggacgggtacggactcggccaatgggggacagtgccgggtgtcctggatgagggtttgccgtcctagggatctcggtggaccgggcattccggatctcaggatggctggctttgccttgagtgttcgctagctctggcttcagcgctcggggcatccctactggtctgatctgaaggcccctattaagcggagcgtctccgacatgtttgtagcatacaccttctctatcctgggagatggtcaatccaagctcttctggattgaccggtggatcgatggtcgctcgatagcttctatagctcctgacctcctccacgccgtgcctccacgcttccggggatcgcgcacggttgctactgggttagcgaactactcctgggttggtgacatacgtggcgccctcactgttccggtcatctctcagttcctgttagtctgggacgcggtgcttcctacccagct

SEQ ID NO: 86874 - DNA, 746 bp, Oryza sativa
ggattaccagttgctggagttggaaaggtaagtcttgtgtattgcatcgcacaaacattgaagagcgtctgtaatctttctaatgtacgacctttccatccaggttttcttggagtatgcagatgtggacggcgccaccaaagcaaagacggcaatgcatggaaggaagttcggtggaaatccagttgttgcagtgttctaccctgagaacaagttttctagtgcggaatatgacgcgtagattatcccgctatgtaaaacactagtcttttgtttttcttttgcgccagtttgctaaattgtaacaacaatttctctttaagttgaaccttccaatagcttggatttatgcagagcgaccgattaattaatattaaaagatgtgatggatttcctaaagttaactgaagggcttggagtatgatctgattcttgtccgtttatcctgatagacctggattatttgttaactctgttaggcggtagctcttgtcaccggagacgaaggagaatggtgggggcgaggacacctcatcagtctgtccctctggcgtagacgcgagcgaagaacgcaagtggaaggaaattaaaggatgcgggcgaagaacgataggaagaggattatggaggtttggatgtgatctgagcagttggattgtgatctaatggtctaaaatttgcaagatttggacgcaggttttctggcaaattacatgtaggtaggcccctatgatctagtaattctt

SEQ ID NO: 86875 - DNA, 572 bp, Oryza sativa
gcacagaaagtgcgcgctgagtatgaatcgcttgcgttccgcggtgatgagaccgtggaagatttcgctctacggctcacaaccatcgtcaaccagcttgcaaccctcggtgatcctgaacctgctgataaagtcgtcgaaaagtaccttcgggtagctcgtcccaggttcaatcaactcatcttgtctattgaaactctctcgatatctctactctgtccatggaggaagttactggcagactgaaagccgctgaggattctgggcaatcctcgtcgcacaccgccggtgggaagctgtacctaactgaggaggagtgggctgaacgtcagaagaagaaggatcaagaggcaaagcggggtgactcgggcggctctggcggccgcggcaagcgccgtggcgggagagggcgcactggtggcggcgggactgcgagccccgagagcacgaactctggttcggcgcgcaagggagacaaatgccgaaattgcggcaaacttgggcactgggcgaaggactgcaggaacaagtccaagcgcgaagaacaggctcacgttgcccaggaggatgaa

SEQ ID NO: 86876 - DNA, 712 bp, Oryza sativa
gatattatcaacccaattctacattatcaggtaagacaaacgcggatgaagatgaagcactaatttgggggctacaaggaagaagttcaaaattcactatttatgacttttcgcaagtattagaggccacagataatttctcaaagaaaataaacttgggcaaggaggctttggtcctgtatacaaggtacataagacgaaaaatctgacaaaagttatacacatatattattcgttaatttacatggagtattatgcaattcactctctgctttggccgattatatcttgatcataatatttgtcaagtgtcaaaagtcaattgaaactgcaaattaactcgtgtcactcatccatctcttttgcacttgtctctagggccgatttcctgatggggtggagatagcagttaagagacttgcttctcattcagggcaaggcttgacagagttcaaaaatgaaatccaactcatagctaagctccagcacacaaatcttgttaagctcttgggatgctgttaccagggacaggagaaaatactaatatatgaatatttgccaaattaaagcttggaattcttcaattttgggattaacttcttgctgtaccgaaccgcaaataaaagatttggttcactaactctaactgcaaaatgtatatcctttgttatatctatgttgaattgatttgcagatgaaacaagaagagctt

SEQ ID NO: 86877 - DNA, 630 bp, Oryza sativa
  unsure (1)..(630): unsure at all n locations
aattactctgaatgttttcctgtcaaataaccatctgcactcagaatcagaaaattttaacatataaatagttaccgtcacacttcgctttctctgaaactaattgaataggcacgtgcaacttttggtatgttctataaatgtacatctatatttcctaattatacaaccatttaatgtaaccatcaaagttgcttgataaatgaaaggtatttcttcgtttgattgctcatattgtgcatttattgggagcatgtcgcaattcttccatgtttacctattttttccttccgccaagaactatatatatttattgtgtctctgtgtaatgtgaatgtccagggcgatacgcattcacgtgaagacggattatcaaaccaagagataaagatagagaaagagaaaaagacaaggacagggaacgccacagggaccgtgacagagatcgaggaagagaccgagatcgggacaaggacaaggaaaaagacagagacaaagaaagggacagggatagggacagggacaaggatcgggatcgccaccatangcatcaccgtgaaagaagagaacacagagatcgctctgatgatcatgatcgccacagaagccgtgattctgaaaggtattctt

SEQ ID NO: 86878 - DNA, 677 bp, Oryza sativa
gtcacccacaatcggttctggcagtgggaactcagcttctgttacagaaggccgattgacaaccttcataaccatcaggtttaaccaagtttgcagtagccaccagggtccacctgctccaactgccgaccgacggctattctagccgatgtgttgttcaacatctggtacagatagccgagaaggattttgcccaaagggaattctttctttgactccagggcttcggctacgaactgccagttggttgtagggccacaactggatccacagaaaaggaacttttccagccacatgagcaaaaaggctacgtgctctcgaggggtaacggatccttgacccatatatgctgccacatagccggaccaacaacctatgctcttggttttgaaatcgaattggttcttggtattcatgctcatggggttggccgatgaagttacatctagtccggtgatcatagtgatgtcaattaaggttggagtcatcggcccttggttgaacaggaaagcgttgatggtgtttgaccaaaagtaggtggcggcagccatcagaggttcgtctttggcagaattggctatggtgagggctagtgcttggccgattccaatctcatccaagtgaactttcttactagccgatacacgttgataccaagtggaccaactcctgtcggg

SEQ ID NO: 86879 - DNA, 1124 bp, Oryza sativa
gtggtacgccaccggaccaccgttgcctccccgaggagcccgcccccggcttcctcgttgtagtctcgccgtcgccggcctttggtgagcatccctcctctcctccccgcgctgtcgccggccgtcgccgcgggtggccgcgccgccgcgcgccgtcgtttggccagccggctttgtgccgtgctgtgccccaaccgcgccgcccctggccgcccgatcggtttgggccgatccgggccgtcggttcccgtggaccggcggtggaccgcctcggtggtcccggtccacggtggaccggcgcccttgtgccgctgaccggtggggcccgcttgccggcgccgcccctcccctttgatgacgtcagcaaccgtcttttcctttggaaaaataaataataattgcgtcataattcgttaataattatagaaattcatttaaatggctcaaaacttctaaaattcatatctaattcattcgaactccgaattgggccattcaaattgcaaaattcatctaaaattgagctctacatgtttgtttactttttatgtactgttttcttagtttttattagagtttttcctcgttttgcgtgtcagcgtgtagaatccgtcgtttcggaagtccgcggtcgcgaggaaaagagttcggaagatcaaagtgaagcagcaaggcaagtcacacattccccttgagcatgttgatcccaatttataaatgttttaccgtttacaaataaatatgcatgttttactaattacaagggatccgggtattacctatctgctcgcttgttccatgttaacttgatatctgtcatttgtcaaccatgggtaatagatcgcctagcttgtgttactttgatgacttagctagaactatatgcttacccatgcttatttaccactagctcagtcgaaggaataattgcagtattagacattctatatcttgttgagctgcgtgctcgagacatctggcgatgtttcatggtcgtaattatccaactaaaatgcaactgaatggtgggctgtgggtgcatggttttgctagtcgcacccatggcaattaaggaccggttcgcgggatgccctgaagaacttatcgtacttaccacaagccag

SEQ ID NO: 86880 - DNA, 1704 bp, Oryza sativa
gatctcggggatcattttccctcaaacaatttcatcggatcgagaaagggacgagcgaattttgaagggcggcggcggcccggcttggctagggttcagccgggcgacggctggaggtggacgacgagtccgataggtgggccccacctgtcagcgagtgggacgcgcgcgcgagcggcgtctcggctgcaggccaacttgggccggggaggagagagagagggttttgggccgactttcggcccaaagccaaaaggaggatttttaaaacattttcaatttaaattattcatgaaatgcaattccatttattaaaaatacttccttggctcaaataaatcccagaaaaatccaggaactataaaatcaagtaaagtatttaataaaattttatctagccacttttacattgaatttattatttaaaattagatcttctcttctaggcttttaaaatcaattctaataattccaattaaacaaccatttatatatttaggatttttagggtgtgaccaacctatccccctaaaacggaatttcgtcctcaaaattcggaaaaactggcgaacaaattcggaaagctgactttaattcatcttcttgttcccaagtagattcttcctttaagtgattactccattgaacctggcaaaaacggataactctattcctggttcttcttcatctgtttccaagatacggattggtttctcaacataagtcagatcctcttggactcctatctgttcaagattagctttttcggtagggacccttaaacactttttcaactgcgacacatggaacacattatgactcctgccaaagattgaggtaactccaactgataagcgacctctcctcttctactgacaatcttataaggtcccacaaaacgcggtgccaattttctttggtgtgaaaacgatgaacccctcggagaggcgtgacacgaaggtacacatgatctccttcttcaaaacttaaatctctgcggcgattgtcggcataactcttatgacgagactgagccacacgcaatctttcttgaatgatctttaccttctcttctgcttcccttaggatatcagtcccgaaaacctgacgttctcccgtttgatcccacaaaagcggagtgcggcacttccgaccatacaatgcttcataaggagccatttgaagactagcttgataactgttgttgtacgagaattccgcgtaaggcaaattcttatcccaacttccaccgaagtctaaagcacaagctctcaacatgtcttctaaaatctgatttaccctttcagtttgtccgtctgtctgcggagataagcagtactaaagttcagcttggaacccatctcttcttgaagcttcttccaaaactttgaagtaaactggctacctcgatcggatactatcttcttaggaacaccatgcaaacacacaatccttgccatatacaattctgccaaccgacttccggaataggtggtcctcaccaggatgaaatgagccactttggtaagtctatcgactatcacccaaatagagtcatggcccgatgacattctgggtagacagtgatgaaatccataccgatttcctcccacttccattctggtatcttcaaaggctgcaaaaaacctgcgggtttctgatgttctgccttgactcgctgacaaacatcacatactgctacat

SEQ ID NO: 86881 - DNA, 1519 bp, Oryza sativa
caaacaattagcggattttatatttacaaatggcagattacatttttaaatttcagaatgtacagattccaaggttgcaagatgtgaacctttctttgaactgctcaaagtttcgaatatgtgtttttattttcttaccaagaaatattgctgattttgcaaatgtttctaaaattcaagacatgaatgttgaattaggattttgggatataattttcatgcgatgggattataacttatacagtgtacattgttaccttttgaattgattaggtcaagacaggaatgctcccttcaatcggagtagtcagagttttatgtgaaagtctaaagaagtttccagtcaaaggtctgggaaaactatctgcatgccttgaattaacgcatagctatgctagactgccagccatatatttattttgtattacttgtgcttctgaaggcagctttagtggtggatccagttatggtgtccacaagtggagatactctttcagaatcatctactctctctgtatataggtacaggattcatatttggtttgttttatttgtatttataacatccggttggaatgcttcataaaatttagtgtaatagtgcaacatttgttttgtgcagggatgaattatttgctatggctgatatagtcaccccaaatgtgaaagaagcgtcgagattacttgggggtgtatctttgcgcactgtttctgacatgcgcaatgcagcggagtccatttacaaatttggtccaaagtatgtctgccatattttcatgaatattatgttgctgttcttaagttcttccagttacttattacacatgcacttttctgtgctattacatccatatatctgcccaaacaatgttgttagtatacttgtgattaatttctttttaatttttcatgtatggatatataaatctcttagttccagaataaggagaattaatttgtacctacctttgggcctcagtcttactgttttgcatgagagtgaatgctgcattttatattcttaggcctttattcgataagtgccaaaactatgtgcctaggcgttgctatttgcagtattaatggcatatgcaagaatgcgatatttagattcccattaaattgtgtctagactaatgtattattttctgatgcaaataatttaccatttgcagacatgtacttgtgaaaggtggggatatgctagaatcctcagatgcaactgatgtattttttgatggtacaaattccataattcaatacaatactgtccattatcacatctacatcctgcccttttagcggcctcatataaattctgaactgttttcatcaggtaaggagttcattgagctccatgcgcatcgcataaagacccataacacacatggaactggttgcactttagcttcatgtatagcttccgaattaggaaaggtgcaacgatgctgcatgctgttcaggttagtcttccagtccttttccctgactttaccttcatatagtgaagaaactgtgt

SEQ ID NO: 86882 - DNA, 2298 bp, Oryza sativa
ccatttgcagacatgtacttgtgaaaggtggggatatgctagaatcctcagatgcaactgatgtattttttgatggtacaaattccataattcaatacaatactgtccattatcacatctacatcctgcccttttagcggcctcatataaattctgaactgttttcatcaggtaaggagttcattgagctccatgcgcatcgcataaagacccataacacacatggaactggttgcactttagcttcatgtatagcttccgaattagcgaaaggtgcaacgatgctgcatgctgttcaggttagtcttccagtccttttccctgactttaccttcatatagtgaagaaactgtgtcaaatggtatgtcatgtctgaccgtgtgatcttatcaagcaaattatttagttccacctcccttttgtggcatcactaggaatgtctttgccacaatggtaacatgaaattggttgaaacagttctgataattttattattgtaccttaatactattttgttacaaagctgcaaactaagaaagggtttagcgactctttagtagtaaggtttcgatcatttaagggaaatctgtgttatttaaaagtagcacttgactggtagtaactagaattgtatccactgagatgttggagtgcacatttactgtatgcaacatcttggttacaaaccagccagtgatatattgaaaatgtgtgttttggcttattttctgtcagaactcgttctcttgcaagaacagtggtttgtgcgaaaaaatgtgtatacctgcaaatcccatcatattatcagaacaaagcctgcataagtcatcctgagactttgagtcttaccaaataccaatctaagtttgctaatcagttccggtggacatcggtttcctgaaaatttgtgttatatgtatcttttcatatcctctattcacaacagtaggctcactttgttgtttattgcacatgtgaactatccaggtggctaagaattttgtagaatctgctcttcatcacagtaaagatcttgtcgttggaaatggacctcaaggcccttttgatcaccttttcaagctcaagtgtccgccatacaatgttggctcacagccaagctttaagccagaccaactcttcctgtatgcagtgacagactctgggatgaacaaaaagtggggtcgttcaatcaaagaagctgtgcaagctgccattgaaggtggcgctaccattgtacaactgaggtctgcctattgaaacacaatcatgatcttgcatgtaatgcaatccctccattttatttttctgatgcattttgggtgtttttgatttccagagaaaaagattccgaaacaagagagtttttggaagcagccaaagcatgcatggagatttgcaagtccagtggagtaccactgctgatcaacgaccgggtagacattgccctggcatgcaatgcagatggtgtccatgttggtcaattggacatgtcggcacacgaagtgcgggagctcctagggccgggtaaaatcatcggcgtctcgtgcaagacccctgctcaagcccagcaggcctggaatgatggagcagactacattggctgtggcggtgttttccctacctccacgaaggcgaacaatcctacattggggtttgatggcttgaagacagtttgcctggcatctaagctgcctgtggtcgctattggcggcatcaacgcttcaaatgcaggttcagtgatggagcttggtctcccaaacctcaaaggcgtcgcagtagtctccgctctgtttgaccgtccgagtgtcgtagccgaaacaagaaacatgaaatccatcttgaccaacacctctagaacctagagctactacaatattctttgttcgaaggggatatgtttatcaaaatgaagagatgtttccaactttaataatcagaaggcatttcttgtaataatgcttgatcaaaagcatctgtgatgcaggggaatgaggaatcacaatcttgcatcattgggatgtaaggtacaatgttcagatttcttttacatcttttgagcaaattatccaacaaattttgttgaaagttggtagtacaaaatgaaagggtgaaaggctgtaactttcaacttctttaagctttcaaaatgaatgttgatgctatcatttagctattcgctagttgttttttttttgtcaatcagtgaacattttacaacatatgaaattgccactttactttgcctttactgtacctttgacagtttattttgttttacgtctctctacgtatcatgcg

SEQ ID NO: 86883 - DNA, 518 bp, Oryza sativa
ggccctcatgcttctcaactcgtcctccaaggaagccacctccttccggacgcctctcagcttgccgtactcttcccccatcagcgcggcgagcttggataggagggagttgatcgcaccactggaggcgctcgccatggttacggccaaagatatctttgttgcttagtcagtacgcactcacttggagttggaagaagccgtggatgcagcgccgcgcaggagccgagccgcgcgtcgcctgacggagcaaccggaggtggcctccacggcgactcgccggtgctcaccgggctggtcgattgcaggatgtgaaatccggcgagtggcagtccggcacggaagagacgtgaaatggggaatttcaggtagagcaggtcaaaaaatcagaggggaatttaactgatacgccgttgacttcttaatatgttgaccattcttcttatctattattccctcagtttcgttttatttgacaccgttaattttttagcatatgtttgaccgttcgtcttatt

SEQ ID NO: 86884 - DNA, 564 bp, Oryza sativa
ctaagaattttgtagaatctgctcttcatcacagtaaagatcttgtcgttggaaatggacctcaaggcccttttgatcaccttttcaagctcaagtgtccgccatacaatgttggctcacagccaagctttaagccagaccaactcttcctgtatgcagtgacagactctgggatgaacaaaaagtggggtcgttcaatcaaagaagctgtgcaagctgccattgaaggtggcgctaccattgtacaactgaggtctgcctattgaaacacaatcatgatcttgcatgtaatgcaatccctccattttatttttctgatgcattttgggtgtttttgatttccagagaaaaagattccgaaacaagagagtttttggaagcagccaaagcatgcatggagatttgcaagtccagtggagtaccactgctgatcaacgaccgggtagacattgccctggcatgcaatgcagatggtgtccatgttggtcaattggacatgtcggcacacgaagtgcgggagctcctagggccggtaaatcatcggcgtctcgtgcaagacccctg

SEQ ID NO: 86885 - DNA, 631 bp, Oryza sativa
caatggtcactgacggaaggcttaatcacctttgcgggacgggtctttgtgtcatccttggtcgccactgcttccagtgattttgagcctgcccacgacatcggccatgagggcacccagaagatgttggctcgcctgcgcgccgacttccacattgctcgtgaccacaccaccgtccaggagtttgtgcgtgcctgcatagtttgccaacgcaacaaaacggagcagctacagccggcgggtctgctccagtctcttccggttctgtcggctgtgtgggctgacattgctatggatttcatcgaaggattgccccgagtgcacggcaagacagtcattctcatagttgtggacagattttctaagttcgcccattttattctgttggcacgtccttacacggcaactacggtggtagcatccttctttgctgagatcgtgcgtttgcacaggattccgacgtccattgtgagcgatcgagaccccatcttcaccagcaatttttttggggaactctttcatctctcaggtgttcaactgaatttcacatctgcttttcgtccacaatcagacggacaatcagaagtcaccaacaagattattgccatgtatatcagatgtctttcgggga

SEQ ID NO: 86886 - DNA, 723 bp, Oryza sativa
tcttcctccgcgccggccaccctcggtgaggcatccctcccctcttttccccttcctcccctcctagtaccgcgccgccgcttcaagtcacgcgcggtcgctttcgacagccgctgccgcttcccgtgccgccggtcgctgccgccgtcgaccgcgtgccgtcgccgctagccctggccggccggtcggctttgatgtcgagccgagcccggcggccgcctctatcgccgcccgtccgatcggccccgagggcgatctgggccgtcggtcccgtggaccggcggtggaccacccgcgtggtcccggtccacggtgaaccgcccccccttgagccgctgaccagtggggcccgcctatcggcgccgcgcctcccccgtgctgacgtcagccctggaaaatattgcgcaataaattatttaaggatttttgttatagtaataaacacaatgaatcttctaaaattcataactaattcatccgagctccgtttaagcccattcaagtctcagtaaatcaagaaaaatgtgtagaatccattaaaaatggttttgttctctgtttcagtagtcttatagcctgtttgcaatgtttgccttgtatgtcgctagattccggttcctccgacgctccggtgtacttcgaaatagtcgccgaggttcctccagcagcagagcaaggcaagtcatgcttgtcacttgaatatgttgatcctatattgcaaat

SEQ ID NO: 86887 - DNA, 614 bp, Oryza sativa
cttctcaaatacatcctgttgatagatactacttgtcaaccattaactggatggtacatatatactgaaaactcaattaatgatccaactataccttctggtggattcttcgagctgtagctgggtccctcctgtacattgttccataggccactctaattacttggtccagaggacaaggtgtatcttcaacttttgaagccagaaatatgcacactgttgcaatcgtctgcaataaaaaacaagtaaagctattggctctggaatgacaataagcaaataaaataaacaccaattacttgtaatagtatttagttatagacagcttgcatcacatgcacagctttttttttcttttcttgagcaatgaagaaacatgtcagcaagtaacatctgcaagtgcagataacgagcacaactccagattaattgcagagacaagaatgtgtttctcaattaaataaccgcatgacaggaatacagtgaatgtggtgaggcgaatcaaatctataaaactactgaggatttatacttattagatggtcaagtatagtattttagcttctaataacaggattgtaagctgtaatccttgtggctaatggcaatagtgt

SEQ ID NO: 86888 - DNA, 661 bp, Oryza sativa
ttctacacatttttcttgatttactgagacttgaatgggcttaaacggagctcggatgaattagttatgaattttagaagattcattgtgtttattactataacaaaaatccttaaataatttattgcgcaatattttccagggctgacgtcagcacgggggaggcgcggcgccgataggcgggccccactggtcagcggctcaagggggggcggttcaccgtggaccgggaccacgcgggtggtccaccgccggtccacgggaccgacggcccagatcgccctcggggccgatcggacgggcggcgatagaggcggccgccgggctcggctcgacatcaaagccgaccggccggccagggctagcggcgacggcacgcggccgacggcggcagcgaccggcggcacgggaggcggcggcggcggccgaaggcgacggcgcgtgacttgaagcggcggcgcggtactaggaggggaggaaggggaaaagaggggagggatgcctcaccgagggtggccggcgcggaggaagacgacggcgaacgacgaccacgagccacgggaggacgacggcaaccgacggacgggattcggggtaccctaaagaaggagaagagagagattagaggggggagatgaaccacggcgaccggcattcatgg

SEQ ID NO: 86889 - DNA, 515 bp, Oryza sativa
tatgaggcggtcggtcggtgaagatgttgacgcccaacaacagcagcataataggccaaccgtgtagacggaaacaccagtcggcggcggacgaggcggccggtcggtgaagacgtagacgcccaacaacggcggcataatatgccagctgtgcaggtggaaacaccagtcggcggcggacgaggcggccggtcggtgaagacgtagacgcccaacaacggcggcataatatgccagccgtttaggcggagacaccagtcgacggcggatgaggcggccggtcggtgaagacgtagacgcccaacaacggcggcataataagccacccgttgaggcggtgacaccagtcgccggtggacgagacgaccggtcggtgaagacgttgacaccgaacaacagcggcataataggccagccgtgcaggcggtgacaccagtcggcggcggcgaaagcaagcctgtggtgatgttctgactgatccattcctggatcgtaagagataagcttaaagccat

SEQ ID NO: 86890 - DNA, 534 bp, Oryza sativa
tgttgaaaccccagactggaccgcccctccggctgtcggagggcggtggcggcgccgcagaatagcccttgttggagatccagctcgcggaatcatcagcgcgggaatgcgagtcggccccgaacgccacgctacgctccctccgctccatgggcgcgggggctgccgccctcttggtggagacccagtcatcgacgtcgtcggcacgcgacatcgaagagtccacgccaaaccctcccatgcgctccctcctctcgagcggcttcttgccggcgccccagtcatcggcctcgtcggcgcgcgacgggccgaagtcctgggggccagatccgccgcggcggggctcgtcgtcgccgcgggggccaccggcgccggcgccgccccagcgagccccgaagccgcgcgtggcgttggcgagctcctcggcggtgcgctcgcgggggcctgtggggaggctgaggaggtcgtcttgggtgggcccgcggtaggcgggggcgacgaacttggtgctgttgaactcgccgagcgggacgg

SEQ ID NO: 86891 - DNA, 840 bp, Oryza sativa
  unsure (1)..(840): unsure at all n locations
ctaatccgtactccttaaccatatattttattttctccactcccgacgaattgtaagcntttagtctttnnttttaccgatcctcctcacaccccccccccccccaggganatgagatcaattgcgcacgccgcagncgacncnagaggaaccacacagcagganacccggccccagcacgcgagggggagacaacgcncccgcgcccggaagaccaggaacccacaaagccggaggaggacgggcgagaagacaagaacagcggcccgggagcgccagaaacgaaggccaacaaccagggggccacggaaggaccgcaaaaaccccaggagagccgccaagggagaaacgcgaggaacaggcaaggagaggcacacacggggagccgaaaaagaaacgcccgggcgggggaaagggaggaaccggagggccccagcaaaggcacaaaaaaccggaggagctgccaccggcgcgccaacaggggaagaaagcnnggcccaaggggcaaccggagcggaacaggggacacaaacagcaaagccagcacgctggaggaagaagagaccatactaccgccggggcaagagaaggccagaagcccggcgggggacgaagaagcccaccaaaggaagggaagcaccaagggcccncaaggagaacgaaaaccacatagaggagaagggccactggaggagcttatcaaaggaggcagtgagtgcgaagtcctctacgttgaaccaggaaggacacttatccagaagcacaatggtggacaaacaatgaagtgttgaaactgggtctaaaaaaaacaatggggcaaaagaaaggcctaaacctgtg

SEQ ID NO: 86892 - DNA, 560 bp, Oryza sativa
aacttctccaaaatcgctcgacccatgacacagttgttgaagaaagaggagaaatttgtgtggagcccgcaatgcgagaaggcgttcaaaactctcaaagaaaagctggtttcctcgccagtgttaatcttgccggatactcgcaaggacttcatggtgtattgtgacgcttcgcgccaaggattggggtgcgtgctcatgcaggacggtcatgtggtggcctatgcctcacgccagctacggtctcatgaaggcaactaccctacccatgatttggagttagccgcggtggttcatgctctaaaaatctggcggcactatctcattgggaatcgctgtgaaatatatactgatcataagagtttgaaatacatcttcacccagtcggatctgaattttcggcagaggagatggttagaactcatcaagaattatgatgtgggaattcactatcatcctggtaaggccaacgtggtcgccgacgctctaagtcgaaaaagccattgcaacactcttaacgtccgtggcattccaccccaacttaatcaacagatggaagc

SEQ ID NO: 86893 - DNA, 828 bp, Oryza sativa
  unsure (1)..(828): unsure at all n locations
aggaacaaaggcgaaaagggaaacgggaaaagccatcccggaacggcggatgaggcaacggaaaggaaaagggcaatggacacccccaccccacccnnccggggatgatggccaccccagcaccagccngcggnngacncnagaggagccccaggagcaaaacagcggagcaacnaaccagaaaccnnaaccaacacggaacagcacacccaggccgcacaggcccgaccaaccagaacaaccaaacccggcgggacagaacaaacnccaaaccaggagcgaagcaaaacagcaccagaaacaacaaccacaaacaccgagagaggcgngagaccaaccacgaaaaacaacgcgcaacccgcccaaaaccgcgggcacgggcaaacgaaaaaacaaacccgggccagaggggaaccaccggacccacaagacacagcccccccaaaaggacgaccaggcggcgcgaaaccggaaaggacccgaaaagaggcggggacaaaacccggagcacaacacaacncaccacagggcaccangccgggaacaaaaacaccccccccagaaacaaaaccagaggcagggaccccccagcgacccccacggaccgcncgccgcgacncagaccggagccccgcaaagaaacacgccanacagaagggaaagccgncgcccaagccggcnagaggcaggaaccggaaaagaaccacaacagaagcacgagaaccggncccaaagcggcaagagcacgacccacaaaaccaggngcccacaacccaacaggggcagggnggaggaagcaaagaagagcacaacacgagnaaccagcgc

SEQ ID NO: 86894 - DNA, 616 bp, Oryza sativa
ctgcggccccgggcagcgtggagagagctatggatgatattttggtaacgtcagacctgaccagtcgctacaaaatttcacgcaaaaccctttggtcatggcaaagtgcagacacaatgcctcggggcttcgtatgcccgttcccaccccctgactggcccggcaaccctaaccgctggcgctctgagtcaatcaaagagtgggaggataaaaagaagataaattaactgaagggctctccgatgatctcttcaagatggctctgccaaacgcggagccagtgtttctgatcatcgatatagtcatgaaggttgtaatgcgccataacccccaccatctgatgcccgagcagcttttcaattacgtgcggcgggcaacctaactcagagagatttgtggctatcgtccgcctcatatcatgaagcgaccactctgccatacctgttccattccaaatagaacgggcgtaattggatgccacaggtgaatgaacgggcgaatctttgatcccgccatcaattttacgttgtgaagtcaccaggtgattggtgtttattttcttgaggtgatttctgaccaggttaacggcggcgtctgagagtccccttctaatatg

SEQ ID NO: 86895 - DNA, 1075 bp, Oryza sativa
attgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagttgaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttc

SEQ ID NO: 86896 - DNA, 559 bp, Oryza sativa
caccaaatgttcgggaataacttgaggtatcaccgattgatctggttgcacattatgaaccaaatgctctgggacaacttgatttgcagcgtgctgcctcggctgattgtcgggcgtcctgaacccagccgatgcatttaggaaaccttgctgctgaatcggctgagcaacttgctgcctcggtggcgtctgctgaatcggctgctgttgaactgggtcagcagtaggctgagttggtaaaaacatagctgcaacttgctcttgagttagccgattcacattttgtccactatgctgagactgctctctcaccaacaaccgaggattgattagttgacctggtgccgatgatggtccagcaggtgcaggagccgatactggtgctgttggctgagctgatggcacattgggagcaatcggttgaccagtcggctgattattagtgatcaagggccgatagtttgggaaaatacctcctggcaaataaaccggtcctgtagcctgatactcagctattgagccatcaaccatcgacttcaccatgtttgacaaggtattg

SEQ ID NO: 86897 - DNA, 615 bp, Oryza sativa
ggatgtttccttttcaggcattgacaccccacatgcaaacactggtgaaagatatatcaagtccaaaggctgggagtttgttgggacctgctttgggtgatcagcaacaagggaacttctccattcatctttggaaaactgctttccaagatgccttcagcagaatatgtcctcttcgtgctggtggacatgagtgtggatgcttaccagtgttggcaaaactggtatgtttaatcattgatatttaatttgagaagaataatcatttttgtgaagtttatgcatgagttgttttattattgtcaggtgatggagcactgtgtagctcgtttagacgttgctatgtttaatgcagtcctgcgtgaatctgcaaatgaagtaccatctgatcctatatctgacccgattgtcgactcaagagttctaccgattccagctggtgacttcagctttggatcaggtgcacagctgaagaactcggtatgtgcccaaattgcaaaacaactacgttcttagtttaaaaccacttacgttggaacgtttcctgtaactgcatgaagaacaaaccagaacatgtgttttaaatcatctcttccttgcaaacaaaaccaaatg

SEQ ID NO: 86898 - DNA, 1103 bp, Oryza sativa
cttggatcgagtacccaaaggaaaaattgtcttccaaaccaagtctccaacttgaaacaactttcctttcacccttttgttgtatgccttggccaccctcttcttctctttctctatctcctccaatgccctcaagcgcttgtcgatgacttcatcaagattatctcccatcaacgtcttgtaatcttcacttgacaaatcatcttgcttgatataacgaagagaaccaagatttacctcaaccgataaaacggcttctttaccataaactaactcaaaaggagtgactttagtggcaccatgtttagatatcctatgcgcccacaatgcttcggaaagcacctcatgccacctctttgggtgttcctcaatcttcttttttactagcttcaacaatgtcttattactcgactcggcttgtccattagcctaagcgtagtaaggagaagaactcaacaatttaatactataagattcggtaaaactcttcacttcctaagacataaaagaagccccttggtccgtagttaatgtttgcggaataccgaatctatgaataatatgcttcaaactacagtcaataaccattcatatgatgtcatatacttcaaaggcacagtttctgcccacttagtgaagtaatccgtaacaactagcacgaacttatgcccctttgataatgaaggataaatttgaccaacgaaatctaaagcccaccctcggaatggccatggtttgattatgggattcaacacggcggcgggcgccaattgaacattgccgaaccgtagacaagcctcacatcctctataatatttgaagcaatcatcaatcatcctccgccaatagaatcccgctcttctaagcaaccaattcatcttgtgggccgattgatgagttccacaaattccttcatgtacctcccccatagccactttagattgatcttcatctaagcacttcaacaagacaccatcaagcaatgtgtatttgaacgattgccgccgaattttccgatcaaccttaagtgtgggatccttcaaatattgaatcaaaggaattctccaatcttcttctgtcacctgggcacaaatgtccgaatt

SEQ ID NO: 86899 - DNA, 527 bp, Oryza sativa
cattatggctggcgctgaggtcccagcccgcaagcgaaccagcaggctgctggtctgggccttgggggttgcggccaagtcccacctcagcgccaggtgggctggcgctgagtgtcccacggtcagcgccattatggctggcgctgaggtcccagcccgcaagccatccagaaggcttgctggtctgggccttgggggttgcggccaagtcccacctcagcgccagtccggttggcgctgagtgtcccacggtcagcgccattatggctggcgctgaggtcccagcccgcaagcgaaccagcaggcttgctggtctgggccttgggggttgcggccaagtcccacctcagcgccagtccggttggcgctgaggtagctgccacgtcagctggggatcggcccggccgccacggtggcacaatgtcagcgccagtcccgttggcgctgacacagccaacgtcagcgccaatgtgtttggcgctgaggcgacggcctatttttggttgaagtttttggcagtggttagt

SEQ ID NO: 86900 - DNA, 619 bp, Oryza sativa
ctgaagttctctcttaccattaaaaatttcttctttcttctaaatgtgtgacgtaccgggagcaacctccggtgacccatgtataccatctttcgtgatttcttcagccaccggtttcgtggatgttccttgcaatcggagcatgccttctttccttttatagtttgtccggaaagattaccgagtgcagggtagtcattaatggtgcagaacaatagaactcttagcttgaagttctcctgaccatatgcatcccaagtttccacactttctttccaaagaatctccagatcgtcgataacaggctccaggaatacatcgatatcattgccgggttgccttggaccttagattaacaagcacaacataatatatttctgtttaaagcataaccatagcgggaggttatagttcgcaataagaactggccaaatgctgtgagtactactcatgtcaccgaaaggattcatgccatccgtacaaagacatatcctcatgtttctagggtcggcagcaaagtctttgtgttctcgatctatattcctcattcaatcgaatccgctgggtgtctaagcataccatcacttccttctttccgtggcgtgccaacgtactaact

SEQ ID NO: 86901 - DNA, 1415 bp, Oryza sativa
ttaatgtattggaccagtctccattattcactgaaatgatacaaggaagagcacctcctgttcagtttaccataaatggtacacaatataacatgggatactatttaactgatagaatttatccggagtgggctgcatttgccaaatcaatcaccaggccccgaagtgctaagcacaaattatatgcccaacgtcaagaatcagcaagaaaagatgtggaaagagcctttggggttttgcaaaaacgttgggccatcatacgtcacccggcgcgtatttgggaaagggaagagcttgcagatataatgtatgcctgcattattttgcacaacatgatagttgaggatgagagaggctcatatgatataccggatgacaatacatatgaacaagggcagtattatcctcaaatgacagggcttgaccatggaccaatatatggatttcaagaagttttagagcaaaacaaggctatccatgaccgacaaacacatcggcgtctgaagggagatttgatagagcacgtgtggcagaaatttagtggtcagcaacaataagattagattttaataattccatatcaaccttgtattttactagtttaatttgtctttaccaatttagaatctaaatgtttgcttccaaaagtacttgtatttgtatgtcaaatgtattactttttatcagctacgtattccaatagggactatgtacactagctagttatcttgcaatacctacaaaaatggattgccttttatttctgaagaactatatatatgttctgtatacagctagtagactgaagaaaaaaggagagcaaaactaccaacagagaggcaaaatgtggttcctttttcctgaaaacatttgaacaggaaacaactgtgttgatacatagcaacaaggttacttacaccaacaccaatgcactggtgtcaagtatactcccctgcagctagctgatcgagaatcgagaatcagctagagccctgacaaacatatactccagtagctatatcgaatactattgaagttttcagattaatcaaactccgatgcttacttttgattagtgttgtaagaattaaacataattatatctcatcatcatgtagcttgtatttttgagaaaaaagacagtcggttgctgttaacaggccggcaacatagcaaatagatatattttggatggcaagagagttaaattaaattttctgcaacataatatttagcaagaacataaaaggttagtgctagctacatccgttcgtgatgtagaacagtagaaggttaatgtagctacctgttttaaactgctgtatgcagggctcttatggagtggggaaacctagtgttgtgttctttacttggatagaagcacgaaccataacacagatcaaacggtaaaacaa

SEQ ID NO: 86902 - DNA, 3886 bp, Oryza sativa
ccctctcgccgagataagcattgtggatagtgtcttctcctattaccgcctgtgactgggtcccacactaatactcatcttgataatatacattggtgttgcccttagagaataaaattatagcacctgagtcgtaggctagtggcattccgttttcaaaacggatgacccagatgcctctgagtactgtatagcaattaactatgaaaaataaaatagtacggttctgatcgttggaccatatggtctctagtggaatgaaacgttttgcatttggagggaagacttttttcatattggggcacctctctatgcggcaccacctgagacattgccaataccaatcccctggcatacttgtgatagtcaagacatcgtgcacatgcaatgactcggacacccaacctattaggtaagctaaagtaggacgaaactaccaatttccatcggattcaccctccaagttgtggctcccttgagcaatctcgaaatgacgcgcggctcaagtttgtggttggaggatgtgggaaagactgcatgggggcatccccaaccttgcgaagtacatcttggtactggactgctggaaaagattgttgttgtagattaacttgatcatttatttgtccattattatatttacaggctccatgttgaacaactccattatacaccgttgatgcgatggtatggatattgaaaaaaatatcacgagtaaagtgtacgggcagtccttaaacttgtagtggtgtgtcatctagatccctaaactctcaaaatacatattcaagtcctagaacttatcatagtgtgttatctaagtcccaaatcgccacaaccccttcaggatcctgcgtggcgttgatgtggcatgccacacggaatgatgtggcatcgttttgactgacaaatggattccatttaaaattttttctttttcttttttttcttctctctttttccctttcttctcctttctctatgaccggagcagaagaaaggaaaaaaagaagaatgagaagaaaaagaaaaagaagaaaagaagaaaaaaagaaaatgacatgtcacgtccatgtggcatgccacatcagcgccacgtaggatcctaaaggggttgtgtcgatttaggacctatatgatacactttgacaagttatgagacctgaatatgcattttaagagtttagggacatatatgacacaaccctacaggtttaaagtaccgcaaatgatatcattatacatggcccttttatttattggatcacacaaggaccgagcaagtcttacatcctcaataacagcttggatttgtaactggaaatagttattattcttgttaaaagatggttgaggaagttcaattccaggccttaataaatttatatattcctataaatttctatcattccaaaggatccatcaatgttgcaatttttttcttttactgccatgaacaagccacggcctatttattttaatttctttaataggttgagttctttttattattttctaaaaactttcatagaatatatacatttgtgccaaatataaaaactttaaggtcggacataaatattaaggaattatttgagatattgtgattggttgagaactatacggagaagctaaattagttgagaagataatatatatgaagaaatcatattcaatgctatattttgggtacgtttcggtttcgttggaatggctccaaaatcttcccggtatttcgtcgagcacctgctctgctaccgtcttctccgtcaacatcgcgcgccggcgccgcccacctcagctccaactcctccacaactggccaatgcaacgccgccatcgggggccgcctcgactccggattccccgcggcggccgtatccaccttcgccgcgatgctccgcgccggcgcacgcccggacggctacacgctcccgctcctcaaccgcgccgcagcctccctccccgccagccgcggcgaggccgagctcgtcggcgccgcccacgccgtcggcgtcagggcggagttcgccgccaacgtctacttctgcaacacgctggtggatgcctacgcgcggcgcggggatggtcgcgtgcgccaggaagctgttcgacgaaatgcccacgcgcgacgtggtttcttggacgtcgctggtctcttcgcatgccggtgtctgggacgtccgggaggtgtcccgggtgttgtactacatgcggctggacggctgccagccaagcgccgtgactctcgccgtggtgctccgcgtgtgcacggccaaatagaacgtcggcggcggggggcagctgcactgctacgcggtgaagatcttgacgcacttgtgcaggatggcagcctcggacgacgcggtggcgctgttccagcagtctccgagaagagatgcaatttcttggaacattatgatctcagagtattcttcggaagggaacatttccaaagttgccgaaatgtatcaaaggatgagaagagaggaggtgtgtcctagctgccagaccttaaccacagtagttgctgcattcgccaagtgcaagtgtctccgagaaggtgagaaactgcattctttcgcttttaggagctgtctcagcgatgcaattttggtggagtcctttgttgatttttatgccaaaatgcgacagattagattgatcagttcagtcatttgaagaattcagcgacacaggcagttgcatatggtcagccatgaattggagctttatttgctgttggcagtttatagaagtaatacatttgtttgggcgaatgttaaattctacatttgttccagtgcgttgagctgcaaggattagtcatcagttacagagaacttggtgcactacggctaggtaaagcaactcatgggtacatgataagaaacaattatgaagcacaatctgaaaagagcgccttggtgacatccatcattaaactctatgctaggctgctagctgtgggagcattaatttggcacgaaggtgctttgacagcatccatcagaaagatattgttgcctggagttcaattattgaagcatacacgatccatggctatggtatggaggctctggaaatctggcattgttccacatgatgctagacgaaggaggaaggccaaatggggtgactttcctgagcttgttgtcagcatgtagtcactccgggcttgttaatgaagttcaagagttttttgattgcatgacaagaacgtttggcatcacacctgagcttggccatcacacctgcatggtggatgttcttggacgatcaggcaacctagatgatgctttgcaagttatcagtgatatgaatgttaagccagatgggagaatttggggtgctctccttgcttcatgcaggacatactcgaacagtaagcttgcttcttatgtggctcagaaacttatgaaattggaaccaggtaatgttggctaccatgtggtgttcagcaatacccaagctagtagtgatcagtgggatgaagttgaaagcattagaagctctatggtagagatggacctgcaaaagctgcctgcatggacttgtgttgctgagactggtagcccttgatttgtatattccatctcttcccaaaacttatgttgatttggtcagaaaatgaccaaaagatttgtggaagttgctgtatgactatattggactgaactgtatcaactgttgatctttcagggtgtgagattgaagtttctattgatgggccctgtagccagtgcactgttctttggagccgatcacctcgtgaccgccgctgtcaatgggggttgttcgtggcaggcagagttcagctgcttgctcgagggtcaaatcggtcggattggatgggatgcgaatatctggcattactggccgtgaa

SEQ ID NO: 86903 - DNA, 587 bp, Oryza sativa
cgtcactgtcatatccattccgtacacccttccagaacaaatgtagtccctccaagcaatggttgcttttcaggcttgctccactggcctcttgctgagttgtaacgttttcaagtcgagacacacccggttctacgggctcgctcatgcattgaagttgtgttatctcaaagccaatagaattctcaaccttgaaatttgttagcttctgaagtgaggccatttctcctatgctagcaatggaagaacacactcccttttgggcaagatgccgcaggctgacaagattatttatgtcatcaggtataaggggacttccatatgaaccaatatctagtacttgaagatggtagcacttgctcagagcatggggcaaagcttcgtgggtcactctttctaagagaagatgaaaagctccatgggactctttgttcttaaatcttagatacctgagatgggtagtgttcgccaaactggaaaggaaggaatcaagatcagcataagctgcagtgatatgcagcagtcgcaaatgctgagcctccctgaaagcatcttggaaggatttaaaaaaatgatggttatattgc

SEQ ID NO: 86904 - DNA, 2960 bp, Oryza sativa
gccgcctgcaaatttcgttgacggccgtcgcccgagagcgaacggccgtctgccacgtcattttcgccgccctctgggagggcgatttttaaatatgcctcccagagggcggtaggagaccacttccgtcaattttcaaaatggaaaattatttttgtaaaacttttcataaaaaaaattataaataaaaaaaattccttgcatctccaccaagcatctaggccctgtttggctactgggatagggaaatgattcccacccaccaaaagtcatttttaaatcctaaccatttcattctctttgttacatttaatcatagcccttcattcgtttcccaatcctaatcccactcctcatttgtcattatccaaacacacccctattgcatgagttgtcaacccacagcgtctctttgatcaatagaaggatttgcgtgatggtccaagcccatgtcaatatgaaaagtgtacaagattggtagagatcaatagctagtatggtaggagaagattttaatccttaaggagatgttctctagtgtaacttgttatctcaaggttaatagaaatggttataaaaatctttaaaaaaatttacaatgtagattataaacatctaccatttcaccaaaaaatcatattcaaatttgatctatagaaatgaaaacgacaaattaagacgtaaatagtatcaatactattcatatgttggatttatctctttttttatgtcaatttgtgacttgagtttggacttgatttttatgtagtagtttatgtatatggcatgaatgttgataatttgtttttttttaatttttaacaaccatttgaatggcgtttgaagcgcgcactttcttccctgtatggtggtttgtcaaatataatgcatggctgatcatgcctttaggccatcgttgtgagaaacatgggcaaatgtcacaccatatcagtgatgatcatcactaaaagaagggcattcggacgctacgcgacatcaacatacatgaaatcctcgtcatgtgcatacaagcgctggacagcgtattcgttaaggcaaataatccgactatttgtgagagaatgttttccacggatcacctcctcaaactctttgtctccaccatgaaatttctccagagctggatgtacaatctttgctcttcaacttcgcagtacaggcaccggacatgttctgttggtaataaaatgaaatgaaatcagaaacttcaacaaagatgatgaataagaaaaaaaatactcgaatattagggaaggacctaatatcaaataattagaaggggtgaggctttaaacctaggtcatttagcccaccaccttgtggagctagccggaagacccctgggcatttctcaacaaaggtgatgaattaataagtaaatcaatatatatcataggattgaccatctaaaaaagtaaaattttgacagtgaaaacgtagttgcaatttcaccatttctaatgtgtatgaaaaaggaacaaaaatccatttataacctacactcaagcgtaagattgaaatcaatcttggactacaatttgggacataataattacgtatgcatctggttgtattctcaaaataattcactctaactatatgtggcaggtctggttatagcaagttcttccatcgtatttttttagttttatccatatacattgtaattgaaaatagttatgaatgctgcatttttcaacatatataacagatcaagcagcttaccagcaaatggcaatggcatgtccaccttgcaacacatgatagccggttcaccctcagccttcttattgtcaaactcggcgaaaaagagcaccggggaagatggtgagcaatccgtcttctccgtggccaagaagttgacatgcgtgtatttatactcgcaaggtgcaaaggaaaggtaatcttcctgcttggagcaataatactctggaccgcacaccgaatcgttcgcgccacaaatcacaagaaggctgtacgtaggtttctacaaaataaagttacgataatgagcaaattgcattggcagtatatcataaattgtgtatatatgatgaatagaagcaaaacgaaccccatctcgcagaaagtgttggttcagggtagctttgacattcctagagatcctcctttgtgtggccatggagcgcatcttgccatcggacaccggccatgtggatttcttgcggagatggcttctgctcagctagcaacacgccggcgaggtaccggacatcctccggcgagagaacgcggtctccaccctgctgcagcaacaacatggcagccggtgattcctgcagcttcgctttgcaggaggtgaggaacgccgcttgcgccgtagggttggggtgccacgccgcagtcgccgccgcctcgtaggcttcttgcaagccggcgcacgggctctgttgccccgccttgatcaccatggcttcgtcggcggcgaggggcaggtcgccgcggcaggcaaccaggcactgcacgatctcgtgctcggagaggtgatggtaccggctctgcaggaaggagatgaggccgtacatggatcgactctcaatgcgggtgaggatgtgcgggccgatcatgtcgagcactggtggcggggctgccgccgggaacgcggcgtcgtaccagacagtgttgaggatgatgttggagactgggtccatgggcccgtagcagtgaccggccttgacgatcacttggtggtagcggttgcgcagctcgccggcgggcagccgggccagcgaccgaaggtagaagccgcggaacgcgtggaggagcaccctcatcagagacgacgtgtggtggaggcggtttttctacactaggtgctgcggcacctaggctgcatgccgtccgatggatttagtgattcgtgcggtatgtaaagtgcttttggcagacatattctgtatcttgcactaggatgaaat

SEQ ID NO: 86905 - DNA, 551 bp, Oryza sativa
gattattgactttggttcatatgtcagattattgatgacatgcgcatacatctcagatgcaacaaatgcacatgtaatgttcctgtggtatttctgaaatgctcatgcttggtaatgactgacactgtccagtaatccttccattttcccttataagcgtgcactctccagggacacccatctttttccttaacacaccgaacttcatattgcgaccgattggacttggcaacccaaaactctctatgaagtgacactacaaaatgctttaccgcctccttcatttcttctgctctagtataaatcgctccctgaataacctcattttctttgtattcccatctcacactatcctcttcagagacgaccagaccagaaaaatcctcactagcccattcggctggattaatatccgtctcatcatctgacgaaccaccttcctctacacgctcgttgtcaaaatcctctctctccatttcatccacaatggtaccgacagtctccccctcgttggctactcaaccaggttgaatgcctactggagctactac

SEQ ID NO: 86906 - DNA, 518 bp, Oryza sativa
acttggcttcctcgtctctggcagaggaatagaaccaaatcccgagaagatcaaggcaatcgagaacatgaagtcgcctacaagactcaaggaagtacagaagctaaccggatgcatggcagcactaagcaggttcgtcgctaggatgggagagcgaggacaacctttcttcgctctgctgaaaaagcaagacaaatttgtatggacacaggaggccgaagaggcattcattgcattcaagcgctacctatccaatccacctgtacttgttgccccccaacctaatgaagaattatttctctatattgccgccacgccatattctgttagtactgtcattgttgtcgagagagagaaggtgcaacgactagtctactatgtcagcgaagctctccacgacgcaaagacaagatatccacagatccaaaactgctctacgcagtaatcatgacatcaagaaagctacgccactactttcaagcccacagggttacagttgtctcctccttccctctcgg

SEQ ID NO: 86907 - DNA, 5108 bp, Oryza sativa
ggaggagtacacagggggtgtcctcaaaggaagggtgcctgatcacatcctcaaacaaatcccggctggcgatcatcttgttgcagggttctcctgagctctgcacccatgtttggtcgtagtccgcaagcgagatgcagaagattatggcacggatgtcctccagcatcccgaggcacttgaagcctccagttagccccttggagttcatgcggatcagttgatacctgcagaagtgcagagatgtaacagaaatgcggttcacatccatgaactaccattcagatttgctggacttggttaatgcaatgatcgatcgatcagatagtctgaaaaatcttactttgtttgtatggctggattgccagctttgtcagcgtatgagtcagagaggggacctcggtcatcaagcgagaattcaagtgtagagaggccattccattggtttacaccctctgcatacaagatatctgtctcggttggttcatattcattgctggatatttcaaccacctgcaaacatatgcaaaaaatccagtcagggcagttgactacaatctcctgccttgataaatttgcaactaaagaaataatattgaattgtgagttgcgacagaagagcgttggttagagccgattacagaagcaacaaagaaaattgtgcatgtttattataggaccaaagcatttcttattacaaggctggatgcaacttaagcaattgctccctaatcactaacgataagctcaaaagcagagagaactccattcaagcttatctagcaagaccaaagtcagatgatctgtaatagttagacaccatttacaatcaagaaacatccatataatcataatctgtatgcacatcataaattggagggacgctagatatcttctctttttccttcaatacattaagccaacatgtaatttatatattttagagagcagctagattgtagttaagtaaaaaaagataatgttttatcaggaattatgaataattcagcagaaaatacgttattgttactcaggtcaacaaaacagtttaaacaacatgaatggttaggtggtcaatgaagaaaaagaaaatcagggctatagtttagttggaaaactaaaactaatctggctcttgtgttaggagcacatctatttgtgatagttacaagtagtcgagtgcttacgcaatgaagaatggcatgtgttaaagagacagaaatgtaaattcacacaaagaagatagtaacaaactgttgatatgaacaatgtcagttataaaatgttgagcaccgaaaaagtggacaacagtagcatatcataaaatcaatcttaccctatcaagaaaataactggcgacatcaggaagaaagtgcaactcatttttccttttatatgtggcttgaatagctggatctttccaaacctcttcaacgataggtgcatactcgcgagttgcagcaggaaaaaaggcatcaaggttacccagggcaactatctccagcaaccaattagcaaagtgcatcaatctttgatttagtgaatacaaagatgacgtgctctgcactgccttcggttcccctgttggaagttcacattctgtaacattttctgaatttcaaaaaacatttggcaacatgcacaggaatagaagaacaataatgttgtcactgtttattttattaagtaataaatagccagtacaactaacatggcccactgtttcataaaacaagagcaagttttcatggcctcaaaatctctaacccagtccagcatcagtttacagaaattgatgtgtctagacaatttggtggtccaatatatctaacagggcattacatactagtcaataagtaatgaaaagtttgctgcagtttttcaggtaaatatgccttgaaaagctaataacaatttgaatatcgtgttttttctatagaaatcaaagagtaccctttgtggtaaccggtaaaaacagaaaagtcaaagaaaatggcacttcatagtatattccctgaaaagtcggttcagcatttctgatgtctttcgaattttattaagtgaagaagaattttatgcatgtgatatctgttgcataactaaagaaatgaacatatggcaaaatgaattcacagcaaaactgagccaaatcgttaccatctcccttgtgattactcatgccaagctctttttcttcctccaaagcctcgtcctcaaagcactcccgccattcaagcaatgtgctgaggtatttgtaaacattgctttgtatcatgagcttcaaattaagtatttcttctggggagaattcagttccatacaagaattttgcctacaaaaggaagtacatacacaaagccacatataggattagcccgttcttcatctaagacaagataagacatatttactgtaaatattagttggacgtagaacttgaccactatccattgagaaatttagagatatgcttttggggaagcttacaagtaattctggaattcaaacaatttcattcagatgatggtctcagtactagaaagtcaaacctaaagaaagattgtccattactactaaaagtcccttaaaacttgaggattaatacttctgagcatatgtaaaatccaaaactaccaataacataatgtacttgacaaccaaagctctcacatttgcacattagcaagggaatagacattatcatcatcccatcttaatgctttttgaataaaatttcacataaaaatgctttgttctaagctatgttctctgagcaataatatggcaaaactaatacaattggcaatagacatggtaaatataggcaagtaaaaacaaacacctgcttaaagattgtgctggatccagagccttctagtccaaccaataaaagtttctgaacttttttctgctcaaggtattctggaacaaacctacttgagtacaaagtagtatcttctttcaaaccacgggggattggcagtgagaaaagggtagcaataagacgggttgatgcctggctgaccaaagtaaatgcaacatattactcagctgatttacatacatatctccaaccagaaaatttttcagaaaacagatataccttttgccaaatatttccttttattatgttctggccctcctcctcgtacgagccatcatcatacaaccagaaatgagtatttcgtgggcactgtacattggccaactgaaggaaaagccagtaaaaactctgatcaagatcttgaagaggtgatgaatgatcccctaaaaagttaagttgcccttttagattcaacagcaggaaaaggattaatccgctaagcatacatactaatgtgagatcaaactttaaaactctgtccagtagaagagtagaacataacaatgaaatagatgggtttgtatgcagtacaatttaaaatggaaacaaagtccaatagaaagctgtacgttattttagattcacaatccttatcccaaatgctatatatagtagcatcaatcacccaccaaggcaacaataaaaaatatgctaatatatcaccaagagaaatgtgttatcaggctcctgtatcaacctctcaggggaattcctgagataaaccaaatgcatacagacaaaacttaccaaggaaaatcaaagattaaactattggccaaaaaaaattttgtcgggctaccttcctagtttaaataaaagagtggagcaacctctatgttctcatcaaagctaccgtgtagaatggatcagagagcacatgggcttgactctacccaaatattaccttaagcatcctaagttcggtctttgtgatctcccgcccatttatgaacacctgtgtagtgccattgctagcatctgtttgtagtttcccaccaatgctcagctttgaactaacaatcctatctggcctctcgccttcctgataccagatgttccgttaaatatataaccagatactgctaagttgaacatgaggaagttgcaggacaatgtaaccattcacggagatatgaaggataacaccatatgctagtgaaacattattgctcttaggagcaaacgttgattatttgcttctccattaatggaaacacttgaagacgtcgaacacacctgtctaataaaagaattactaaacaaaacatacatccgttctttcattcttttaaaaaaaagcacagttgagtttctgaattagaataatggctaaagattctgtagtaatgcttggtgtccataacaattatagttgtgactccagattaaaaaaatgtcattgttagatattgtcgtttgacttagtcaaatgtggcagaagaagaaaaccaatataatgcagctaggtagcaagcctccaaagactatctgattatgaacaaaaacaaaccatatacaggagacttttctaaaagagaacaaaaataaacactactttttctattcacaccacattcctacgcttcagcattttccctaaaaattcatgtattcaacatctgattctactaatagattagaatgagaaatgcaaaatgtagctgtagactagagaatgccattgcagccagctcttaccttgccccagagcccagagtccttgtcgtaccagtagcggccggcagcgaggcgctccggcggcacggcgcagccgagcagcagatccagctccccctgcgagaggccgcggccgttgacgaggatctcgcccggccgcacctggttcgcggcgcacccgcgctcggcgcgcatcacctggcgcacctccgccggcgcgagcagccgcgcgagaagccgcgaccccttccccagcctcgcccgccgccgcgcgtccgccacggggcggccgatgcagccgacgcacttgcggccctccggcatggaccccatcgcccggagcacgcacccggcgcagtaccgcgccccgcatgccaggcactcctccctctccccgagtatccccaccccgattccccccttcccgcacctcgcgcacgccccccgccgcttgcttccctggttcaatggcgcctccggcggcggcggaggaggaggaggagcagggggtgacgaggaggagcaacgcggaggggaggacgccggg

SEQ ID NO: 86908 - DNA, 3734 bp, Oryza sativa
gaacacaggagtagggtattacgcttctcagcggcccaaacctgtatacatcgcccgtgtcttgtgctttttccattctcgcgaactttccacagactaggagtttagaatctcacccagggcccccggccgaaccggcaaaggggggcctgcgcggtctcccggtgaggagccccacgctccgtcaactatccacatattgtgagaagtaaaaacaactataacatagttttgtaggtcccatcttgctacccacttgataaacatacattgatgatgcccaagtaagcaatgtgattggagaacttgaaggtagaggatttaaaataaaccaaatttaaatgactataaaagaggtgataattaatatatcatgcatacatgtcttatactatgaaacatggaaaaaaatggttgttccaagttatagtaataatccactcattaatcgttgtatgggcttatgacgatgctactggctcagtcatcgatctcatgactccttgttcgtcggatatatcttcctttagaggatggataatggattgattgttattatatgaaagttctccagaaatcaaactttactaagttttttaccatgcttagagaaaaatatagcaacattaataacaccaaattagtttccttaaatttaacattgaatatattttgatattatatttatcgtatgttaaaaatactggaaagaaattaaagtcaatatttattttatgtaaaaatattgctacgttttttacggaaagaaattaaagtcaaagcgaattatagtacgaaacggagggaatactctattttggaatcggaatctcttactaattccatttgaccgctagaagtaaacaataaaattatatgagaaacaatgcaacagaaaaaccatcacttgcaagggatacatccaaaggatatgtgcaaacaaacggtgcaaataaattgtgaaaaatctgttggagtctaatttactttggttggtcttaccctaacataatcacctatatgctttaacatggaaattaatctactgagctgcttgtgaagctacggaggccggattcgttgatttatgctacgtacttacggtttttcttcttgtttctcttactgttttccttgtgatgttatctgtttgacatagcgaaaaccttcttaatgccagcggcactagctggagatagccacacgaaggtcttccagcgtttaaccgataggacgattaattaaggtttagagttttaatttgacgcaagaattaggcgtcacttttactctacattttctcccatttataaacaataaacacactggtgaggtgaagtgagtgtagcttagacaatctcaagatatatcggccccggtgcttatactggtaggatacgtgtgtataggtgagcgtgttgcaggcgcctatgtttgtacagtgtttcaagaaaaaataaacacactggtgaggatcagggcttaattattgcctattatatttagactcaaaatctgtttctaccaaccacccaaacaaaatttacccctccgttctcttattgatcagaaagaaaaccggtggtttttagctcctgaaaatccgcaacaacagtgggccgatacaatggaccaacaaaatcatcgcttcttccatatagctccgttcaacatcgagaggcactgtgccacatttttttcatgatgtaagtaggaccacatttttttcatgattgatttgacatcactgctgcaatgctatatcatgagttagcctaacgctgattataagccatacaaacatataaaaaaatgtattttatagataaaacttttatatatgtatctttagagatttaaaactgaatattagaaaaaaaaaccacgatgaaaaaaaactaaatatcaatttcaaaatcaagttttaaaatttaattttggtggcttataagctagctatatggtaaatgatgggagcagatgattagtaatgttaattatgaataaacttgcacgcctactgatcctatttaagagccttagctctcgccttaagattgcacatgtagtacttaattgcacgaagaacaccatggcacaacgtgtccaagaagaagatgagcagatgacgagcaccgatgatttgatccaagctgagatcgagctctaccaccactgcttcgccttcatcaagtccacggcacttagggccgccactgacctgtgcatttccgatgccatccaccgcaatggcggcgctgccaccttgtctgacctcgccctcaatatcgggctgcacccgacgaagctctcccacctccggcggctcatgcgcgtgcccactgtctctggcgtattcgccgtcgaagaccacaatggtgaggccatgtacacactcacccgagtatctcgcctcctcctcaacggtgatggcgagagaacacatgccctgtcccatttggtgcgtgtgttagtcaacccgctcactgtggcctctcatttcagcattcatgagtggttcaccatcgagcaagcagccgccatgacacccttcgaggtggcgcacggttgcacgcggtgggagattatagcaaatgatgccaaggatggtagcgtgttcaacaccgccatggttgaggacagccgtgtcgccatggatatcatcttgaaggagagctgtggcgttttccagggcatcagctctctggttgatgttggcggtggccatggtgctgcagctgcagctatagcgacggcattcccaaacatcaagtgtacggttttggatctccctcatatcgtcgccgaggctcccaccacccatagcaacatccagttcgtcggtggtgactttttcgagtttattccagcagctgatgttgtgctacttaaggtatgtacaataattcaagtgacctttgatatgctgtacttttagctgttgagtagcttcttcaataattatgaatattaatatgtgtcagatttgcatgtgatttcagtatattttgcatgcttggcaagatgatgattgtgtcaagattctgcggcggtgcaaagaggcaatcctggcaagggatgctgggggaaaggtgataattattgaggtggttgttgggattggacccaaggaaattgttcccaaggagatgcaaattttgtttgatgttttcatgatgtacgttgatggcatcgagcgagaggagcatgaatggaagaagattttcttagaggctggattcagtgactacaaaatcacaccagtgctaggtgcccgatcgatcatcgaggtttacccttgatgcttctgaaggtgtagatgtgcatctctgcgtggaacctattctagttcagtagccttgaggcatgcgcgtgttcacgtcgaggccatcattttttgtttttctgttgtcatatgtgctatagtatattgtgcgttgtgggatggcacaactcatgcatgtcgtggcttaagtctcgggcatattggtagcctcgatttccatttctatattcatcacaataagaggaagagaaaaccaaaagctacaaggcagtttgtagcgcccaattaatctttatcgctcatactttgttttgtctactcaccaagtgttcatgtgcgttcatctgttctagcgataacaagtggtatcagagtgagcatcgaagatcggtcatggtgatgtctggataggagaaccatttcttgacagggtcgaggtgttgctccc

SEQ ID NO: 86909 - DNA, 1063 bp, Oryza sativa
attcctgcagcccttcagaattttctctgatgaagtccgatccaccaactgctcagtgctgttctcctcgccgacaacctggtgaagctagcgggggtccaaaaatctagccgactgctcaatccagcagccaaaagccaaccgagcaaccaggacccaggaagaggaaaatggtcctgagtgatgatgaggacgatgatattgagaagaccggcaacaaggagacagctgggaagcggccaagacaagctaacccatcgaagaagaaaacatccagccgggcagtacccacgatcagaaagtcatcaaggtatgaatccgttgtgatttctccttcattcttcaaaatgatgtcaatagcatttttgcaacttataggaaatcatccgacatcgatccatttggaaaaaatcctgaaccgactaacaaggaggctgtttcttctgctgctagtgaggccgaaccgactacaaaagaccgtatgactggcgatcagtcggcaactggcaatgtagaagctgataaggagccccgactggaaaccagtcagcgaatgctgaagcccgcgctaaccaggagcctccgactagaaaccagccgagtggtgagcaaaacgaagatatccctgagtcggaggggcaagccagtagttctcccttaaatgatactaacgctgatccggaagttggtgcttttgataaggtagaaggacccgctcgaccaccaccgaaaataataacaggtaacaatcctctaagtaaacttgtatttagaaaaatcttccccaattgcttgacttctcttgtgcctgtataaaggtccgacgattggcgatgaagaagaaattcttcgaatccaatcggctgaagactcccgaccacctatcctagtcaagtggtggaatgacgagatgcagccacatggcattgtaataaacaagcagaaagaagacgagaaggtgtcattgttaaccaggacacttaatcaggccactcgtcttgtgaatgtaagtactctatccgtagtcctttatatcaaattgatagacttaatgaaatgaccg

SEQ ID NO: 86910 - DNA, 756 bp, Oryza sativa
catcgggatcaatcaaagcacttcaagggcattgccacggaaggattggagtccaggaaagggcatttgaatctattaattaggatatttttagagatattttcggtaagagtccgcctaagggactcgttcgtattttaaattgtaatagagatagagtcgtgtccagcaaggacatgttattacttcgggtataaatatggcccgacaccttgtaaacaagggacggcagttcaataatacttcggcgcattgccacccttttctttttttcattgattcgacgagtttttgctttcgagttgggctgcatcgagtttgatctccgacgaagaggtaaagcttgttatggccgtggtttgcattctcagaattagtgcttacatctctatgacactctaatcctgaccgtgtgaattgccgagttatcatatacgatgtacaatctagatcgatctcgtcatctaacctcatcggctagcttctatcatcgaaaacggccgatagatttagataacgacattgagttagattatacagtgtatctaccatcttgaatgagttttcatcgttttgtttagattttacgtttctcttcatacttaatgctgcaccggttaggttcgatctgttaagtaatgtcttgaaccgtattatctagctctttctatgaatactaatagagatagcatcggagtttcagccgatcttacctggtttatttgtcttgttcattatatggtccttgatcttcta

SEQ ID NO: 86911 - DNA, 734 bp, Oryza sativa
tcctgcagccctttcgtgaggagtgctgttgttgcactttgtaaacacagagagaagtaataaagtcgtcatctactttgagagatcttcaatttgtgtttgctcgggttcggcggtccaaccggtgagacaccaccggtcagaccgacggggtaacggcggttagaccaaagcgactacggcggttagaccgacagtttccaggcggttagaccggcgcatctacttcggtcagactgcgattcatcgatttgtgggtaacttttaattccgctaaaagttttggtttttgggtacaccaaccatttaccctctctggttggcttagttcttgctattcgatcctacatctctctcacaaaaaacaaactttgtccaattttctacctcttatcattgggatacaagctgcagattttcaagcaaataaggcttacatacaataatttaatttcaaagcaaatgtctgcctgcaaaaatcgtgtattttcgcaagccttgaagtgcaggcggagtggatggctgcctgaaaaaatcgttttggtccgcttgtaaaatttttttttttctagcagtgcatcaaatcctcctggatcaccttccccagagggctatcctgcaatctgcttggtccctgcaccgtgctcgcttgcggttgattttttatttttctcttcgctgctgctgctactgttcaaagtaagcgaagtggctggagaggtgacgaattctaa

SEQ ID NO: 86912 - DNA, 581 bp, Oryza sativa
aggatttttatataggttcgggcccctgagttgtcaggtaataaccctacatcctattggccgaagccggtattgctcttattcaccataatcacaccaatacaatatgtgggtagcctatctaactgttgtcgacatgtcggtctgaaggtttgactcgtagtcgacaacagggtagtcttactcctcggatccgtgcccggcgagatcagagatagcgctttcgtatctcctgacagtatccggagacaccgtaggggaatagccatgcctatccctgaagtcgatatccggcggcgtgtcttggcgtatgtaggcttgtatgttgtggcttctggtgggcgtgtgttgattgtcatgggtgttttccatggtcctttcccctctcctcctagggggtcttgtatttatacccataggtgtccccttgtccaagtagaactagggaaaccaatatggatacaatccgagtagtccttgtcgtttccatgtagaactctggttgtctttccttatccggaactccctcgaggccaattttcgtataagacatggtatgtggtggatcctgccgagattta

SEQ ID NO: 86913 - DNA, 708 bp, Oryza sativa
acgttctgaaacttagcagccaggtagagcgaaccagcagctatgtattggggcttatactgtaggcacagtgttgttttaagcctacgagcaacagaatgaatacatccagattgatcagttgaatgaatgaagcatcaaaacaataatgtcacaaagtgatatgtcacatctcataccaatcatttacaaagttccaagctacttgtttcacttccttctgagagatcccaagtttttccatagcatcaagtagtggtctgtaaggatgttggatgttgaaatcaaaccgaacagttgtaaggactaatctctccccggtcaaaattagtgctttctgcttctcaaatacatcctgttgatagatactacttgtcaaccattaactggatggtacatatatactgaaaactcaattaatgatccaactataccttctggtggattcttcgagctgtagctgggtccctcctgtacattgttccataggccactctaattacttggtccagaggacaaggtgtatcttcaacttttgaagccagaaatatgcacactgttgcaatcgtctgcaataaaaaacaagtaaagctattggctctggaatgacaataagcaaataaaataaacaccaattacttgtaatagtatttagttatagacagcttgcatcacatgcacagctttttttttcttttcttgagcaat

SEQ ID NO: 86914 - DNA, 6205 bp, Oryza sativa
atttagtaataaaattatcacaaaactacatgttctgcatcatgttaaatacaaaactacaacatttagttttgtgataactctaatattatatctatagttttgtgattggccttaaatctgtagttttgagatacgacgtcttaaatatgtagttttgtgataatttggtcaaagtacctgtagtaaatattatgttaccagcctgccatttttgtttgatggtggtgttcatctctaaaagtctgatttactaatggttttaggtgatatgtcaaaatttctgagcaactaccctgaatatcggaagactcatggaaatgtaacgaagcatgttgctttggtcagtgagatgagcagaattgtggaggaaaggaagattatgctaatttcccagacggagcaagagttagcatgtacaagtggacaagcagctgctttcgaggtattggtataatgaacatgaaatatatcatggtgccgtggacacattgttcttataaaatatcatatatgttcaatatcctcaccaccaaagatattccctcccgaggtttttcattttcaatcaaatttatctgctgctagagttcacttaagttctttatttatgccagtgcaatttccaaaatgggaattacacctataccatagttctttagcttatacacactaaaaaactgtggcacggatgatcttccaaaatatatttacaacttgactcatgcttttttttttattatcaaaagacagtgggggaggcacccacggtatatattataaaagaataaagtatttacagggaagacaaaaagagtggaaagaaaaagactaaagacttaaattacagctgatcaatccatgattgaactaaaggcctgttaatctctttgagtctaattaaatgtagactcaattgactcatgcttttggattgaatatcttattgaatgggctgtgtgcattggaaaatgtgttgttttctacatagcttaagagttatgcagctttctttgctttatttgccaccattagctgcatgaatcaaagcagcacgtccccttacagtttttcatctgtccttacatcacctctcattgtttatctcatctgatttgatgctagtaaaatgtataagtggtctgttccacgtttttggttcacctgttgattttctgcaggctgtcacttccttgctaaacaatgaaagtgtgtctgatattgatcgtttacggttagtattgctctatgctttgaggtatgaaaaggagagtccggttcagttgatgcagcttttcaataaattggcttctcgttctgctaaatacaagtcaggggtatgaacctttaactagtgacagatcatgttcttatctaagcgttcttctattttatatgttgttttgatgttcatcttctttgtaattatttttagtggaaggtttttgctttcacagtttgaaccataaacaattgcagtcttgacatcactgttacgtgccttcagcacatagtaactatctcttttgtgcaaatcatggacttcccttgttgtgaactatgaggtcttctaaaaagcatccttgatttcatttgatgtactgggagcactgattcactgtttgataagtctactgccttggcttgaatattttaaaaattagactacaatttatttggaatcctagtgtttttaaccaggtttagttatcatttttttctttggttactaagtactcccttcatcccaaaatatagcaacttctagcattcaaaatttgtcccagaatataataaacttctccacctactagctcatctgaaccaatcacaaccatctcatttaatttctccacccacttcttctcaaccaatcacccttttccaatttaattctatctacttccttaatacctgtggctaactccagaaattcttatattttttgaccgagggagtattttgctaccagttttgaacaaaataggtaatatattttactaagtttttgagcaggctttccacttggtacactatgtgaattaaacttgtcgtgctagtgtaaaatggacacaggggcctcttcaggtggctgcctgttattatcggagacaaaatacctagccatattgtactgatggtttttgactgatgacttattctaattttgcatgcagctggttcaattcctcctcaaacaggctggtgttgataagagaacaggtgacttatatgggaaccgtgatctattaaatattgctcgcaacatggctcgtggactcaaggttagacaaaaaagtcttccttcgcacttgtggtacatgtaatgtggcttatttcttatgcacttattggttgcagggcgttgagaatgtatacacccaacatcagcctcttctctttcagaccatggaaggaattgtaaaggcacgattacgagatgctgattatccgcttgttggcaatcatttccagcagaacaggttagtcctaggatatgcacgattgtgaaactaaattctttaatcagactttgttttactgaatggacttgaatcctgccaccctgaagtaacattttattttccgttcaattttctgaattctgatccacattcttttgttgtcagcatggtttacttctaaatgtggagtaatttttaggagtactggctgattgatactctcctcacaggcctcaagatgttgtgctgttcattgttggagggacgacttacgaggaagcaagatcagtagccctttacaatgcagcaaatcctggagttcggttctttcttggtggttcagtggttctaaattcaaagaggtatattcattgcaattcttcccatttgcatagagtgggatatgttgcatcagtttttgctgatttgatattgtgcaataactctgaattgatttttaacatctggtttcaccgtcaaattgcagatttcttgatgacttaggagaggcacagagaatatcgaaatcgaggagtctagtatgagcaggctcttagcttctacagcttgaaacttggcagtctgacaattgaaacttgtggtgtttttgcatagagaatcaacttcgtggtaaattttgtaatgcacagctttagattcatagtgcaacacaccatacggaataaaattgttcacagttcacctaaaaacacattttttgtggtttgcaattattgctgcatatagggcgctccgggtgaaattaatatttaacgcagtttagttcaatgtcctgggagaatcaacattcaagtcgcgcattttgttgatattttgtcaaattttagcattttgttgtccagaaccaacttaattatctattactctaatagtcttatgaccagatatatagtggctaatgtggtaaattttagctgtctttagatgtgaaaaaaaattgcctcacttatatagcaacgtatcaggtgaactcagccgtgcacacatgcacacgctagaacaatccaactttcgaaagaagtataaacagtgctcaaaattgaaatttcatcagcgaacagacaaatatcaaaagagtgaaattgtacacgtaatgctgccaattgatagcatgcatgtgccatcttgaatcgtcgatggaatttgacatacctagaaaaggtagtagaagatgatgaggtcctggatggctggatgttcttgttgggaaagacgcagtggctggatggtgagcttccccgaagtggccaagaaaaaaggctggtctctcggccttttacaccccaaccgagtgaggcctcaaagggtacttggataattgacaaacataatagttgaactagcaagcaataatgctcctgcgttgcactgggaaaaaaggttgatggaagagagaaagagagtgcattgtcaataaaagcagagcaaggcagctatgtgaaaagtgaaagataacgaaaacaaaatacgcacagatgaccaagatagaaagtgtgtacggtgacgattgaaaaaatgtatgaatttttaaagtagataatccctcctaatatatgacaccgttggctttttatatatattcgacccttttgttttatttaaaaaatatgtaatttccatttattttgttataaatttatataacgatgtcatatattaaaaccggggagggagtattaaaaccagggagagtatgtttcaatatataagaatatacagggatatggaagagatagatatttaacccttccataccagaagccacgacattactaccaaaacgatttgtttttcctgacggactacaaaaccttgctcaaaaaattaaaatgaaaccctaaacatctagccctgccagtaaaaaccgatttttacagattcttattgacggggtttcaagagcgccacttgtaaaaatagaggtatttttacgagtgacgctctttaagactccacgtaaaaattcggggtttaagccagaaaagaaaatcgtcgaaggcaatgcacaaactatctcaacacccttcctttttttctcacaactcccacctacctctccctcgtactcagatctagctctcctctccaccactccctcaacctctcctccctctctcggttcgacggaaggggtgacggtagcaacaaggggagccgtgggcagagttcctccaacagctagcggcggtggagcttgggtcgcaggcagcggtaccgaagacatagctcgggcggtgggggtcaagccacaggaggtggagttcagtcgcgggctgcgggctgcggggcggcatatctggtgtcggttcggggcgggggcggtggatccgatggcgatggtgacctagggtgcaaatccgatagccaatgccatcgtatatgcatgtatcgtgtataataaggatgggtaaatttcataataggctcatcaattatcctaatccaatacatcaatcaattattccgtatacgcatcaactaaacatcgaatgcaagacttgaagcccatcaagtgtacaaagaaattagctggccgaacgatctattcatcgaggcgattggaaaaggaaggagatggatggaaaacatgataatagtggcacggtttcaattttataaaatttctagtggcacggctacgaatatatgaattgtaatagaaaaaatatataaactaaaattgtaccaaatatataaactttagatgattagggtttagtttttcatgatataagccctttaagaaaacatattcttcacatagattgttcgaaaatagattttttatctacatgctttaacacactaagattttctggaagaattctctcatattgaaatgattctagtgatataacatccattatctacatgactacatgttttcacttgtccatcgtcattttgccatattgactgcgatcgagaagaaaagaaaaggcgagaaagttaattcaagatatagagctagcatggatggtataatggtcgagtaaagcgatggagtaaaagaaaagagggtggtcgctcaatggtgcttggatatcgcgacattccaaaccttaggtagagaggcaagagaggagtagagggccgagtagaacacaatcagaattaaacgtggaaacaacgatgaatcaaatcctacgtgtctcaaattggaatatagttttacatcaaaacttgacatgaactgtgtgtcgcgtgggaacacggtcttgtcgagacaatcaaatctaatcaacccaaactttgacaatagaaggccttaaactgtaagcatgagtttcgagacggtgaagaatgctgcctaatggcatgaggaatggagaccagaacactcgttgcttagagagatactactctacaatgcagagttgctttggatgggacatgatgatttagcattttagccctttgtattttttaaatcagtctataaactttactaaaatatgctcttcctaaataaaaatgcaaaatagctctagcattagaaaaatttacattcatagccttggcccacctctaagccacacaggacattatcccagtctccagctacccttccttccagatgcatgcatcccaacttccccaaatatacaagttcctggttcgaaaaagaaaagaaaaaactaggcccccacaaatcgatgccgcatctctccgtccgctcccagaaatcaacgccaccactgctgacccccccaaccttc

SEQ ID NO: 86915 - DNA, 3041 bp, Oryza sativa
gttccggctccctttccccttcggccacggcccagggggccttggcatgggccttccccggcgagcggcacctcagccacggtgccctccccacgcaccggcggctttccccctcccttctcccacccccaccggcagtgtcgctgctcccgctgccatggctcacggcgccctcgcaacggcgccttccctggcaagcagcgccctacccttggtggttagcgcctcagccgccgcgccctctactcggctagcagagctccttccctggtgggtggcgtcctctcctcagctgcttcaccctcttctccggaagcggcttggtggtagcaccctccttgtggcacatggcggtgcgcccgccaagccgccatggccttagggaagcggtgtgcttggcctctgatgagcagtgacctgggtgatttagttgttttataatttttggggatgatttttgttagaagtacagatatgttagttatagataagagtcaaatacaaatatagagataagatatatcctagagataaaatagagtcctaaagatagaatcctagagataaatctactcttacttgtattgtactccaagcatccttcgtgatgccacccatcatccttcgtgatgccctagcgagatgagatgaatccgtaagctctccttgggcaacacattagctagctatcctctcctatcatctatatattagattatccaccgatctcattagatatattttccattaattagtaatagattagatcaattccttcattagccacgtaaaagccaatatcagtactgtcgtgtcgcccgggagcagcgctggagccttggagatcaacaacaagcagcaacggcaacaccatccaatcagctccgagcatgtacatctactgatctactccaagaccaacgtcatccatcgatcatcaccaagtctacggcaagatcgagccagctgctacatcgataaatgactacgtgatcatcttcgccgatcctacatcactagttatcttcatcaacttgctgccgccgactcgtccacgtagatggacacgtcacctcctctgacagattaatctgcaagacggttcatcgacgacgacatcgaccgcgtcatcgactacggcatcgatcatgttatctacaacgacaacaactgcatcaacatggcatcaccattgtgatgaccgctacacatgtcataaatatgttttttcgccttcggctatatgcggctacacctacaaccacggctactacatgatcagctacatcgacgaatgtctacaacaacaatcattgacggaaactctagtcaaagcgtacgtgtcatcgctatcatctatgacactcccgctataactgcgagagggaatagaggagagtccatcagagatccaatcaatgatggtgagtcgaacaagatgaagaaatagaagatttcaaatccagttgcaattgttcgcttcactccggttacaactgagggggaatgttagaagtatagatatgttagttagagataagagtcaaatacaaatatatagataagatgtatcctagagatagaatcctagagataaatctacttttacttgtattgtactctaagtttctatctcctatgtactcctatatgtattctatgagagggtcgatctaatagatcagaaaacatcagaatacaacaattagaattttcacaaatttgattcattgttgttggatttgtgattttgtgatttagtttctctcgtttccgtgcggagttctcggctcatgtggatcggatttgatctcctgtacggacgggagcgacgtggaggtgaatcagtgatgaatcggctacgaattcgtgggtggtttattggtttttttttttgcaatttctttctatcggtaactaaatcggattgtggtaggacatacatgacgaaaacgcggaaacaaagagaggtgacgaaaggaaagttacaaattttttaattagctaaggttaagactagaaaaaaaagcctatatgttgcaatgggttaaagcatttttaattttagttgtgcacgtgctttggcagataaatagttgaacataacaattccacgaccacgatgatgaaggaagcccaagaaaaaactgtgtacatgaagagtagaaggctatcaaatcgattgagattttcattactaattcgaagcttccattgctacgtaaggcagacgctcatatgtgattttttcttcttcttgtgttgtaacagattttcttatagatcataaaaaaaagccagtttattgtgtagtaagtcatatcatcgttaaatattgttcactaattgtgtccgcgctatggatgactaaggttaataaatacatgttactcaggatatcagaaaattggtaataacaacttctagctagcctccagaatttatctcaaaatataacaatttatacaccaatattctcttattaaccaatcacaaccatccaccattcaatttttccacctaccttcacttctcatccaatcacaattcttcattatttaattctacataccttcttaataactgtatgtaactctaaaaatgcttatattctaggatggaggaagtaccaactatcaactaatatttggattcaaaattttgattgaaaaatatatatgacaccgtacacttttcatataacgtttgatcatttatcttatttaaatattttacgtaaatatgtataaatataaattaaggttagagttgctcgagagtaaaaaaataagtcacaacagaatacaagccgacgatcttgcatggcgattgatatgaacgtgtggcaaggtacgaacctgttgatgaaggcccgtggctgagggatttcagtttaaaaaaagtacaccgaaggtccctcaacctgtcatcgggataaaaaacgttctcgaaccgcaaaaccggatatgcagggtcccttaactatacaaaaccggtcacctgaggtcctttagtggttttgaccatagttttggtcaacg

SEQ ID NO: 86916 - DNA, 671 bp, Oryza sativa
attcctgcagccctggacttctccaacaacaacctgtccgggccggtgccgctgcagctgatcagggaggggctcctggagagcgtcgccggcaacccggggctgtgcgtggcgttccggctgaacctcaccgacccggcgctgccgctgtgccccaagccggcgaggctgcggatgcgggggctcgccgggagcgtgtgggtggtggcggtgtgcgcgctggtgtgcgtggtggcgacgctggcgctggcgaggcggtgggtgctgcgggcgcggcaggacggggagcacgacgggctcccgacgtcgccggcgtcgagctcgtcgtacgacgtgacgagcttccacaagctgagcttcgaccagcacgagatcgtggaggcgctgatcgacaagaacatcgtcggccacggcggctccggcacggtgtacaagatcgagctgagcaacggcgagctggtcgccgtgaagaagctgtgggtgtcgcggcggtccaagcaggagcacggccatggcggcggcggggggtgcctcgaccgcgagctgcggacggaggtggagacgctgggcagcatccggcacaagaacatcgtgaagctctactgctgctactccggcgccgacagcaacctgctggtgtacgagtacatgcccaacggcaacctatggga

SEQ ID NO: 86917 - DNA, 2102 bp, Oryza sativa
  unsure (1)..(2102): unsure at all n locations
gccgcccgtcgcctcgccggtggccggtgggtttcacgcacaaggacgtcctcacggaggcggcgcgcggaccgtgtcgcgtggcgcgtaagctagaagaattttgtcccaagggtagcaatggcggtgctagcccgaaggctacagtaaagcccagggacacgtgtgagtatctcgaggtcgcccatggcggaggtagcccattggctacagtgaagcccagggggatctcgggagcccatccaaggaactcgaggacaccccaatttcctgaagcgaatctctcgctggaagatatttttcctcgtgtttccccttctggatcgcagaattggatctgggtgaggcgtggagcgacacagccaaacctagggtttccagcgcaagcggaagaaatccgatgatttggtggcttagctcgtcggatctggagagttccggagcggaagtgtgatcaccgatcatttgcccaagtcgtcatggagcggcgtccgccgattcggccggactggcaagctaacaagcgtcaggcgatggagcaaggcggaggtgactgggggatccgcgacgtccgggaggaggagggcctccggcgtccactccccaatcaaccaagggtgaatccaaatgtcaagcctcaaggtcgtcaagctgcggagatggagcgtggggctggtacgatgaagatcaagtgcttcaaatgtggccgtgaaggtcaccaccaggcaaactatactaatccccccctctgttactcttgccacaatactggacacattgcttctcattgcccgctgatttctgctaaaagatgtgttaagctctgtggatttgggatcccagggcaagggttctatagtttgcaagtagagatttctgacgcagaggtggctagagctcctgtgagaggtattttgacagtgattcagggggaagcttctgtgagtaaagtgctagctgaactgaaacacttgtttgtaggtttaacttgggattggaaaattaagcagctaaatgctaaagaatttctcaaaaaattcccttcatatgaagttaggagtcagatttcaacttgcaagagctttgactttgagacatcccagattaaagctagtgtggtggagactggtataactgaagaggctgttgatgaattagtggctgtctgggtgaaaatctatgggattccaaaaatggccagatcagaagactatatcaaatctattgtggagctggttggggagtttgaggctgtagaggttgcaagtatcaggagagatggtccagtaagggtgagagttgcctgtaaggatcctagagagctatatttctctattcatctgtacataaacaaggtgggttacatgattcgttgggaacctaaggggtacttaccttatgagaatagacagaatcctccagatgatgatgacaaagatgataaggatgatgaggggctagaggatgatatgaatctagatgacgaattcaagaatcatgacatctctagaggaagacctcttaaaggcgagggaagccaacatgagagtagagcagagctttttctgctccaccacttacaagggcaaagtcagttctgaacagggaggaagtataaaaatgatagcctctaagaaaacctctcttttgaaacaccctgacttatttgagagttgtacttctttagtgatatggggagacaaaacccaagagatgattgcagagcaggaatcncaagagttggaggcacctgaattgtcccaaaatgagactagacccgagttctcaacactgttagagtttgatgaggatcttgagagatgccaaatccctactgattctgacattgagaggctgagagaagaagaagatagggaggaggaggacagtttccaggaggtctctaacaggaagaaggggaaggctaaaaggactgaacctgcagttcttcaagaatgagcttaagacatagagagttagnctgttgttccttattccaaagagagctaagctcctgacccaaaggaaaaatttggagcaaccaggtaataattctaatccctttgcggtttttcaattattagactctgttgaattgaaaa

SEQ ID NO: 86918 - DNA, 3724 bp, Oryza sativa
tggcggaccgggggaggatgaagggggtggagggtggcgagggagggagtggtgccggggaaggggcggaggggagacgggaggcacgggaggagctggagctcgcgctgtcgctggggcggcgagggtggcatttgccggcagcgcggcgcgagccgccgcccccgcccgcggctatgaggtggacgatgcctcctcattcatgggaccacgacgcagccgggagctcgcgggctgcgacacacgtccctccgcttaggtgtcgcgacatttggcacggagacaatgatgcagggggcgctatagagggcgcggaggagggagacgaggaggacgaggagggagatgaggatggagacagggatctgcagagtaaacggcccaaagtgcgcggcttcggcgagtaagttgcttcgaccgttacttttcctattttgctgttttgcatgcttgtttgttgtgttcagagttttagtggagttttattgctgatctcatgtaaactagtagtttgtagttaaaccctatcacgtcgatattgtaatttggagcaactcatggatgccataagtaagttttttgttctgttcagtgttttagcagagttttattgttgatctcatgtaaactagtagtttgtagttaaaccctgtcatgtttatattgtaacttggaacaactcatggatgccataagtagtttgaagtcgcgttgggagttttttatcaaacacgcttattagaatgaaaataggataagtccaatttactccccagaactataagattggataattaaccccctgaactattaaaaatggttcactttactggttatttacatttcttttctttgtttctctctatatcagtcgtattttaagcttaaattttgtagagccatagatgacacctttatcaaagttttaaaattgtcccaaaatttttcttgactatctgcttgaaatttaaaacctctatgtttaaattagtctcagtgcttccaacctatgtaaacagtgattaaaaaattgaaaaaatgttgagagataagttataatgcatatatcaatcccaccaaattttattgcaaaaatgacctatatagagagaaatgaaaaagagaaatgtcgttacggagtaaggtgaaccattttcaatcgttagggggtgggggggtgtaaaatgagccgaaaatttgtttatggggttagatgctcaggtgaaagtttggggggagttaaatggacttttttcatgaaaataatgagggaaacagtatataattgcacttgtagatgttttattctggttattagaaatactgataccccttggattggtaattgactgctctgcctgtggttgatgcacttgttccctattcccttaaattcatgttagtacgtattttctgctgcagagacagcctacataaacttacttgcctaagtatccttctggaagttttgtaagattaatgtggacatctagtattccttcttttcaccattcttcctttctgaactatgacttgcatcccatttacgtccttcagataataatacagtagatcaatattgattgcagccatgctgccagaatgattggcaatcaattttttgtattactgttttacaattgtgaaagaagcaagatgtttgcctcccccctctctcttttgtgaaagaagcaagaagaggtgctacctcataagtaaaccttgcatagattatctgatattttagtattcacattatgtagattattccaggtagttatatcctacatgattttcatactgttgtaggttagggcttatctttctctgtggttggcaatgggtattgataaccttgttttgctgaacagtagtggtattttctttttatgtggacttggtcatgaagtacttctttttgcttaccactcttcatgtacatagtgagtaaacatattcttcctttttgcagagaaagcccacaacattctggtgtaaatgcttccttctttggcttggaatcaacacatttccctggttctgatgaacatggccatttcaagctctcacactgtccagaaaatgaattagattttggtttgtcgcttttcccaaatgatggtgttaatgagaacccaggggatggcaatgttggtgatgtagaaatctcaggtggagaaaattctgaagatgttgaaataagaatggatctatctgatgatctattgcacctggtgtggcgcttgtttcttttgcacttcctctatatgcaaaatgcttggttgaagtatactaatttgttaaatatgctattacagatattctctttcttgggtcagagggatctatgcaaagaaggtgcctcctgtaaacagtggcgctctgcaagtatgcatgaggacttctggaaatgcttgaagtttgagaatactaggatatctctgcaaaactgtatgtcatttggttggctcttttttattctttttaaatactataattcatatgtgaaattatttaaatgttgtatggatttcaatggcatttaggcgtgagacagccagatagggattgttgacagagatttttcaaactattacccaattatcgtattcttttattacttgcttctttggttacaaggaacacaacttctttacctaatgctacagaggcttggatggatctaagagctttgggatcatgttatctagctctccgaatggacttccatctatgttatacttacatgatgttaatgattagacatactttaactttgctgataaaagtacaaatatagaggtgatgatggagtctggtatcaactgctagaaatttgcatttggctgtagtgaaaaccatcaaacaaatacaattttatttggattgaataaaacatgttgattgaaacccattatttgtgatttataacttctatttactaaaatggaattgttctctgctgttaagctacactaagcatatgttctttttctagcatatacactacaactgtttagtcatatccatttcatgtctgattgtatccctctgaattattactcgatattgctgacatgctttatcaccctgttgttgacatttgcagttgttgacatttgccatcgttaccaaaatgtgacatacctaaatctgtctggtgtcccacatgcagaattactggtgatggaagcgataacatgcttaaggttttcttccgattctatttcattaacctttgatgtgataattttgtcctcgtatttatcaaaaatggcacttttctaggcatctcaagacactaataatgggcaaagggcagctgggagaagcattttttcagttgttgtctgagtgcccattactgactactctgacagttagtgatgcatccctcgggagtggcattcaagaagtaactgttaatcacgatggattacgtgaacttcaaattttgaagtgtcgtgcactcagaatatctgtcaggtaacaagcttgttgcaaatacttcattatatataatatgttcatgtgtcttttgatcttttcaatatatgttgtttatcatccagatgttcccagcttcaaatactctcattgaggcgaactggcatggctcatgtatcactcaactgtccccagttggttgaattggattttcagtcctgccataaactttctgataatgccattcgccaagctgctacagcttgtccgctgttag

SEQ ID NO: 86919 - DNA, 1330 bp, Oryza sativa
aggacccagcccaaaatgaaagagatggaatgaagttcagcaggttggttagtgattccaagacgcctctgtacgctggatgcaaagcaaaatacattaagttgtcagttaccttagacctaatgaagctgaaggcaagtagtagatggacggacaagagtttcacagatcttttaggaattttgaaggctatgcttcctgttgagaacacattgcccgagacgacatccgaagcaaagcaggttctgtgtccactggggttagaggtccgtagaattcacgcttgtccaaacgactgcatattgtaccacaagcaatatgcggacttggatgcttgtcctgtatgcaaggcttctcgatacaagcgaaagaaaagtgctgacgaaggaaagaagtcaaagaggggtggtctagcaaaggttgtgtgttatctacctatcattgatcgtttcaagagaatctttgccaaccccaacgaagcgaagttagtacgttggcacgccacggagagaaagaattacgatatgcttagacacctagcggattcgattgaatggaggaatatcgatcgaaaacacaaagactttgctgccgaccctagaaacatgaggatatgtctgtgtacggatggcatgaatcctttcggtgacatgagtagtactcacaacacttggccagttcttattgcgaactataacttcccgccatggttatgctttaaacggaaatatattatgttgtgcttgttaatccaaggtccgaggcaacccggcaatgatatggatgtattcctggagcctgttatcgacgatctggagattctttggaaagaaggtgtggaaacttgggatgcatatggtcaggagaacttcaagctaagagttctattgttgtgcaccattaatgactaccctgcactcggtaatctttccggacaaactataaaaggaaagaaggcatgctccaattgcaaggaacatacacgaagccggtggctgaagaaatcacgaaagatggtatacatgggtcatcggaggtggctcccgctacgtcatgcatttagaagaaagaagaaaatttttaacggtaagagagaacttcagcctgctcccaaagatttgtccggagatgaggtccacaatatggtcaaggacataagcaatgagtttgggaagaaaagaaaacgtagcaagacaaaggagaagggtatgtggaagaaaaaatccatattttggcggctaccttattggaaagatcttgatgttcgtcattgcattgatctcatgcatgtagaaaagaatgtgtgtgagagtttggttggcctgatgtt

SEQ ID NO: 86920 - DNA, 2498 bp, Oryza sativa
  unsure (1)..(2498): unsure at all n locations
aacatggaagacgcaacgacgacgatggttgtggtgatgccgtcgatcaacaacaacgacaaagtcgacgaacaagacgcggtgctgccgccaccggttgcggttgcaggtggcggtccccaacagcagccgctaaccatgcatccccggctgttaatggctgcgcgcaacggcgatcacaaggcgcttatgaggtgcagcggcggccaccacatcacatcatccatatgcacgagggagctcctgcaccacctagcgctcatgtagttgatgaagaaggtcgacaagaagtttcagtggaagacgatgcagatggtcatcagcgttcaaagtgcactgatggagtccctgcagcgccgcaagcatctgcggccgatgttgaagaagactctgttcatcatgaaaacatcagcaagctaatctcaggtatagcattcatctggattaattatctgggctaagagttttcagcaatttatttttcccctgcctctctagtgtacaatacaggtcaaaacaatttgacgaggttaaatatatataggtataacaatttgattcatacctatagctaccaacanaacaattcaaattcaactttatttcacaatccatttggatactatatatatacctagagtcaaaatatgactaaacacatacagatttagttcaaacttgtttgaactagtttgccaagaagttaatgctcgtactttaacatttcatactcatttgaattgagtatatactcaatttcaatcttggtgctcgggcaccatggtgccccagttaattttaatatatatatatatatcctatatatacaagtttttcgtgtacaccaactagcaaatatcacgaaaattctaaaaaaaattcggcatttactcctaatagtattacacatatatacaaggaaaaagtccaaaatacacctctaaactgtagatagaagtccgtatatcactttgaactgtaaaaccgttcatattacccctaaggtggttttgtatatatatagtggttttatctaatttgtatataacttggatgagtttgatcatgtgacatacacattaaacatatatatatataacccttcacttaaatctttctttgtaattacttgttagctctcatttataaataagtaccaacataataaaagcatggtatcattgtataagtataaattaatgacttataattgatgatatgcaaacatgctatattagttatttaaaattgttcgtttaagcttgtaaaatatgcaaaaccactatccaaaacaacccttaggggtaatatgaacgggtttgaaaagtccagcgggttaaatatccagtttaaaggttaagatgctagctgcactttcctccaaagtttatggggggtatttggactttttcattcaaatttattatattttagccaaaaaaatggtgaaaaatctaacggttttaaagataaaaaatgttagaattttgtgtttttttgttatggctaaaatataatgaatctgaagataagatttcacacgttggtgtaatactattagaagtatgtgtccaatttttttttaaaaaaaattctatgatatttgttagttggtgtgtacggaaagcttgtgtacatatgatatattcctatatatacacttacgtttcccaaaactgtataaagtctgaaaacagacgttatgcacgcaggtttcgtacctccggctctgggagcgccaattctagatgaagtgactacctacgatggagactccgcgctgcatgtggtggcagcctgtgctgacaccgaggactatttgaagtgtgcaagaatgatatacaacaaggcgagtcgcctattggatgcgatcaacagcgaaatggacactcctctgcactgtgcggttagagcaagtttaatagtatacccaactattagctccaatttatctatagctaatataatagctcattaatacaatagttacatactacactattaatatttggtcctacttattatacacacactgtgtcttggagtctgtgctacagctggctataaatctgtagcccgctattcttctctctcatcatttaactgcttaaaatatatttacagctggcttatagcttgctattatacatgctcttagggctgggaacattggtatggcttcttgcctcatcgagttggcggcaggcgagcagaattatcatcacggtgcacggtggaaggtcaaggatcttctccgaaggatgaataaacatggggagacggtcttacaccgcggcgatccgcaacggtaataaaatgttattggagaagctgatgtcggagggatccagaactagtatgcgtcccaaggatggcacatcaccactagaccttgccattgcattaaggcgttgggaccttgtgttcgaatcggagttgcttgttgcaagttttaagaagttctcttatttcggcccgtgtggacaaaatgtcttcca

SEQ ID NO: 86921 - DNA, 751 bp, Oryza sativa
gcggcgatccgttccacagctcgtatggtgtcttcccaccaatacttttggatgacgacctgttcaggagataaacagctgtgtgactgccttcccccaaaacatacctggcagccctttggctttgagcatgctccgcgccgacccgaccaccgattggttgcaacgttccacgacgccattttgttgcggcgagtagggcgccgtcgtctcgcgtcggactcccagctcggcgcagtaatccgcgaagtggtggaccaggaactctccccccctatccgtgcgaagagcacgtagcttcttgccgctcttgcgttcagccgcggcttggatgcgcttgatggctgccgccgccccatccttggaggggagcagtgacaaccacatgaaacggctgtaatcatcgacgagaaggagaaagtaccggttgccgctcggagttggtggcgagatcgggccgcagaggtcgccgtggagtagttggagcggctccagggagcgctgttgagcctgctgtgggaacggcgtccgacggtgcttgccggcgaggcaagcctcgcaaagctggtcaacttgcgacacagccggaagaccgcgcactagctgctctctgcccatttgccgcagcgcagtgaagttaatgtggccgaaccttgcatgccacttccatgcttcgtcgccgatgcgtgccgtaaggcagaccgggcgcgcgagctcgacgtcgaggacgtagagacgtccaggattgcgg

SEQ ID NO: 86922 - DNA, 2965 bp, Oryza sativa
ggacagcctggtgtcgctgggcgtgctcccccgcctcgtccacgtgctccgcgagggctccgtgggcgcgcagcaggcggccgcggcggcgatctgcagggtgtcgagctcgtcggagatgaagcgcctggtcggcgagcacgggtgcatgccgctgctggtgcggctgctggaggcgaagtcgaacggcgcgcgcgaggtggcggcgcaggcggtggcgagcctgatgagctgcctggcgaacgccagggacatcaagaaggacgagaagagcgtccccaacctggtgcagctgctggagccgagcccccagaacacggccaagaagtacgccatctcctgcctcctcacgctgtcggcgagcaagcgctgcaagaagctgatgatctcgcacggcgccattggctacctcaagaagctctccgagatggacgtcgccggcgccaagaagctgctcgagaagcttgagcgaggcaagctgcgcaacctcttcagtaggaagtaaaaaccgaagcgaacgaccaccagtagcagtaagctagtagccttcctttttgccgtaaactgtataaaaatcccgtgctgtttttcatagcctctatgaagtgtaagtggggtgcagagagcatcggcgtttatctgatctggacataaacccgttgtaatatcgtcgccgtctaattccgctgtgtatggaactctgaatcattgcagtttccgtgtcagtgctaataatcatttgcaatgttcagacataatcatttgcactgtctttgcagttacatgaccacattgtcagtgttcatagcacagaaacacccaagctcttgtaagcagattgcatggttgaagtactgctactaatcactgtcaatggctgcaggtatcttgttataagcagattgctgggtgattatttcagagtaattggggcatgatttggacaagtctcaagcaggtgaccgcaccgcacgcacgcgccaatgatcagtgtactggagtactggtgaatgggtgatgattgtgcaggtaaacgggcgtaatccgcgagtgttacgcggctggtgatcggtccccttcgccttttgctacaggtgacgggcgatcaagtgatcaacacatgcgttgttgatccgggaaaaggggtttgcttggcccagcgagaagacagatgagcgagtgatggctggtgattgagcaccgctgcgtgcgtcgattccgaatgcttgtctcatctgccacggcagtaaaagccaaaggtaaatatacctcatataataaccagagatgtgatatattagtactatcataaatttgtttttcacaatcccacgtatatcaatataaaaccaaaaagacttagaatattcatactctatcaaaatctcaatgcaattattcatcactttgtatactctcaatacaatgattttctactttcacaaactccgatacaataattactctaaaaataatcttattttggaacaaatgaaatgagcttaaaaataaatttatcatgggacaaggaagtaacatttaggtaatatttttttagatgatttattgaaagaatttttgaaaaggcactattttgtcctaaaaaaggtcaattctaactataaacctgaacatacatgtatccaggttagctaagattggattttttttatagggcggtttggtacactgcaagatgtaaaagaaagatttgcaatgtgatcgagtgtagtaaacgtataaaagaggataatatgatatattccctctgttcttaaaatataacaatttttaatattttaagtttgtcccaaataaaacctcttcactgttccattcttaaccagtcacagttttcacaattaaaattctccatcactcttctctcctcaaccatcataaacttattctatttaatttcacgtattttcttaattaatatttgtatccttacctaaaactccttacattttaagagagaggtgatattatgtacttcctttatttcaaaataaacaaactatataggatatgccatatttttattattattatgaatgtttcagggaccacctatacatttgtcgacaaatttttttctaaaaatttgacagatataattatagtacaatcgtagtgtaattacactgtaacttgcatgtaactacagtgtaacttgtatataagtttcacgtaattttgaatcgttagatctattacaatatttgttctagtgaggaagaaaaaaaatcacaacacacacatatgtgaaaggatttgttcccatgacctccattttaccgaaataacatgttacggagagatttttgatagttacatacaagttacattatagttacagtgtaattacatgcaagttgtaatgtaattatactacgattgtactgtaattacatccgtcaaatttttggaagaaaatttgtcgacaaatatatagcaaaattgtttcacaagaactaccacacgtgccgttccatcgaagcctttttagcatctgaactaacccactacgaaatttcagggcccaaaggccagcaaaccgcggggagatctcgtgggctagaagaccgtagctttatccggcccattccagaaaagccctgcaatacgacgtacgcaggtctccgtgccggtgtctgtcctcccgcgacggcggagacgtccggccgccgccggcgaccgaagcttcaccgttttccatcctaacccaccggtaaatcgatgcccttttcctttttcattctaccacccaggttgcttgcccgtttgaaagggctgaatagatgaatggatgatacattttctgaatttgttacaatattttagagtataaaagcatgaattaatacaagtttaaaaggttatcttagaacaacatattacaaacaatatatatatatatatatatatatatatatatatatatatatatatatatatatat

SEQ ID NO: 86923 - DNA, 1031 bp, Oryza sativa
atcccgccgggcgtcgagagcgccgaggggctcgcgtccatggcggcgttcgtcaccttcaccgacgccgtgtcgctgctgcggccgcagttcgaggcggccgtcgccgccatgtggcctctggcgagcttcatcgtcgccgacgcgttcctgtactgggtcaacgagtcggcggccgtgctcggcgtccccaagatgtccttcttcggcatctcggcgttcgcgcaggtgatgcgtgagctgagaaaccgccatggcctgtgcgccgttatggagcccggcgacgtcgacgacgacggatacccagcgacgctcgcggtgccggagttcccgcacatcagggtcacgcttgaggatctcatggcgacgttcggcgagccgtcggctgtgaggatgatgatggagctcgacggcaagctggggaaggccatcgaggagagccatggcctgatcatcaacacgttccatggcttagaggctccctatatcaagttctggaatgagcatgtcgggcctagggcctggcccatcggcccgctttgccttgcgcaatcggcatctgcgaccgccgatgcccggccctcttggatggagtggcttgacgagaaggcggctgccggccggcccgtgctgtacattgcgcttgggactctcgcggcaatcccggaggtgcaactcaaggaagttgccgatgggttggagcgggctgatgtgaacttcatatgggcttgtagggccaaaaacattgaccttgggctagggttcgaggagcgtatcaaggataggggcctagttgtaagggagtgggtggatcaactggaaatttttcagcatgagagcgtacgagggtttctcagtcattctggatggactcctgtgctagagagtgtcacaactggtgtaccactagctgtttggcctatgatccccgatcaacctttcaacgcgagattttagtcgacgagccggacattgcgattagggttttaccgattgataggaccatgcggggtttagttccaagggaggag

SEQ ID NO: 86924 - DNA, 1448 bp, Oryza sativa
atcttggataatttgtgtgcagtttcctcgggggactcgcgtgttgagaggaaccgtggccggagaggaaccgtggttgaaatgtccaccgctctgaagcatctggaggaggcatttgtcaagtgcagccaagggaagaaatacttcggcggcgacaaaatcggctacctggacatcgctcttgggtcgttcctcggatggattaaggcggtggagaagttcgccggcgtcgagctccttgacgaggcgaaggttccaaacctggctgcttgggcggatcgcttctgcgcgcatccggccgtggtggacgccatgcctgacgccgataaattggtcgagttcgccgttaagcatgccgcttcgatgaaggctttggatgctcccaagtgatcagcgaattaagcattctcctttgtgttgcatgtactgcattacatcatcggatctggttccataatttttagtgcttaagtaggaaggaaaccgtgttgatgggcgggcattttattttttataataaaaaaacactaaaagaagtattatcttatcatattcatcttatatattcaccataagagtaaattattttataatggtaactaaagaagaagaaaaaataactatgccatgaaataaatcgtagtctttgttatactaaatgataagaatgtctctcaaattttaaacaaaaatcacttagtctcgcttggatgtaaatttcagagaattagtagatccattataacctactcattccgttttatattataagtcgtttgactttttttctatttaaactttttgaatttgactaagtttagaggaaaatataatactattttaaacacaaaacaaatatattaccaaaatatatcaaatgttagatttaatataactaattcgatattttaaatattgctagattattctataaacttgatcaaacataataaagtttgcctagggaaaaagtcaaacgatttatagtatgaaacggaggggtacccgttaacattttgttaataatttttttaccactgtttacataagatgaaagcacaaattttgaaactttgataatgatgtcatttaaatggcttttttcttaaaatacgactcatataaagagaaatattattgaggacagtaaagtgaatcttttttaaaattttataagtaaaatgagaaaaaaaaatttagatgttaagtgatccaatgaaatagtcgggagattaaaatggaatttttaaataattaaaaaaaatccccaatgcctgcaaatcgttttcaaataattaattttgtgttcgaccatttgatcccgaattccagccacgaggcttccatcgtcgtctcattttcatgctcattgcttcacctatctaactccaacatttgctccactgttaatttttgttcttaaattgctcgatgttcatgtggtacac

SEQ ID NO: 86925 - DNA, 1374 bp, Oryza sativa
  unsure (1)..(1374): unsure at all n locations
agtagtagtcgagtacaanancncctcatagaagagatctagctaaggtttgcacttcagtgactggaaactaatcccacatatcatttgaatgtgcaggcaacattcacaacaaactatcgagaaacagtaatggataaagaatttaatagagtcaaaaggaccaaaagttgaaaataataccagcaattatattgttttgtttatgtagcaaacatcatccatggttgatgcagattctctactgctcgagcacctcacgtatgcagtgactttaagccctgagagagtgcaaataaccattagatgttattatgatacaataaatcatctattccattgaaaaagatacagtaaatcatctcccaattagtgaacaaggtaacctttggaagattatttgggtgacatattgcattaagatcaaatttgctgtcactaagtagctgtgccaaaatttcagtgagttagcatttatgatgatagatcaggatgtcccccattgtgccaaagacataaataaagatcggcaatcgaactttcttagttgaaattatcatattcatcggctactgatctaatacaggaaagtggcaagtctgctcgcacttgaagctcaacgtctagtggagatggatgaggccttaccgatcatgcaccttgacaaatatcctaagctggagaaacctatcgatggagatcctgtgcttggtggcgtactcatcaagcacacactccttcatggccgcagcggccaccggcggcggcgtagacacacacaactccagtgtgtacttcgcgagcggcctacagaacaagtgaaacactgatgacagcaacacaaaaatgaatcacatagctaaggtcggcggattagggacctgactgcaggcacaatcatcgcaacgcgcgtgctgttgcggatcccggaagttggttgtgttcccctttaatctctctttacatttttgtgaacattgcagctagatttctgctctaaaaaccaaaaactactcatttttgtaaataaaacagagaggatacaatataaatttctaaactactctaaaatttagatgcaaagaaactcaattttcagatgccacattagttgcaaaaaaaacgttgagatgtaaacctgagtgaatgatgtgaatatatgagggtccacaactggttttcaacgaggtggttagtacagggatggaacataggacgttagggtggatagcttacacgatgtcggtgtcaaacgcgtcgactaaccgtgccgttaaggtaggctggcgggcgcgacactggaatgcagatgcagaattctgtgcaaattaaaacctgatgaactactgtacaatctngtagtcgcacgtcact

SEQ ID NO: 86926 - DNA, 748 bp, Oryza sativa
gtgtgtactacatgtacagtagttcatcacattatcggtgatgatccaattggatactccaaacctgtgcacaatgttaatgagaaaatctctagccttgtctgctgtaattgtgacgactggtttggcttcgatccagttggagaatttatcaatagctacaaagagatgagtataaccaccggtgcctttttgaacgggccaaccatatcgagccgccaaaccgcgaacggccaggataatgggatggtttgcaactcctgagctggtagatgagtctgtcgggcaaaaaattgacaaccctcacacgtccgcacaatcttgtcagcatcggatatggcggtaggccagaaaaaaccctgccgataagccttgcaaatgatggttcgcgcagctgcatgattgccgcagatgcccgaatgtatgtccgttagcaattgcctcccttcctccaaagacacgcaacgttgcagaatccctgacggacttttcttgtacagttcagccctatgcatgatgtaaagtttgcttcacctggaaattcgcttggcttcgtctttatcttgagggagttcttgcttagttaaaaatttgatgaagggctctctccagtcggcttcgagcatgttcacttcttgagtgtccgtggcatcggttgtttcttttcttggtacggtcagttcataaagatgttcaacgaacacatcggaaggagctgcttctcgttttgaaccaaagttggctagtt

SEQ ID NO: 86927 - DNA, 7131 bp, Oryza sativa
gaagtttgcgggaggatttccaaacgaatccgagagagagagagagggaaaagtggggggaaagagggagggaatcacggggagtgatttccccctctttatggcgcgcggggacggcgggatgcggcggattcggcggcggcggcggcgctagggcacgggcgggcggcgggagcggcggaaggtaggggatgacgggtgggccccacccgtcagcgagggtggcgggcgggcccgcccgtcagcgacgcgcgcgcgggggaaggccgatgggccgcgggggagaggagagagagggagggagctgggccgagccggcccaagagaggaaggggaaaaaggactttttagagcttttctttttataaaatcattttaactttgtttatttcttaataattattatttgtgctctgaaaattccactaaaatttgagggctccttttagaccaaggagaatttaacaaaaattctccgggccacatttgagtttttcttgtacgtattttagtgtttgccaatttcttttcgaattttaattaattctattattccttttagcgaatgatttttaattcgggatgaatttatcaggacgtgacataaactaagtgcacaagggtgtgagagctcttgaaagggttcaagataatgcaatggagtgccaaaaccttacccttgctgctggggagtgggtatatatacccccaaccaccaaaactagccgttggaaacgaaatccccaactttgtgctctgccggtcagaccgtcgttgtgaggccggtcaaaccggactactttgtaacggctagaaaactagccgttacagggcaatcattgagcccactcaacctggccggtctgaccacagtgtagtggccgatcagaccgtccacggctcggtcagaccgccatcggcttggtggggccggtcagaccggccttaccacgccggtcagaccggcctaaggcccacggtcagaccgcaggtcacttttcagctcaaacgaccattagtaaaacgacgatatctcttaactcgggtctcagaatttggcgttcttggactttatggaaagcttattcaaagggctatccaacccatgaacaatccatccaagaaacacaacttttctcagggagaaagggctcacactccaaaggatactccaccggacataaccacatgaggctacccaaacctataggatttgcccacatctctctttgtttaggacttgagaaaactcaacacacttggctagacaagcccaccaaatacacctatatgcatatgaactaatatggcacaagatcatccacaagctcgcttcatagacccctcttgatagtacggcgtctatctagcaaatccggtctacaccaaacaccaagaccgggaaaagactaagaaaacattcttagctacattatacctttgccttgcgccatccatcttggggtcaagcttgagtcgagatcaacacttgtgaccatttgattcaaccatgtttataccaaggtatttaccatcatttgtcaagactttcttctcatcacaagcttgatttcattcttgccaacatggcgatgtccttggcatggtgaccattaacccatggtgtcatccattagcctcatcatagtgggacctattccttttcacatctcaaaggagaacattagtctcaacaaatcggttgtcatccttcacttgatgaccaaccggttgcatatgaaagatatgtatatgtttgttgagtattcattaacatcacaagtgtcatatactcgtatgcaagctcaagtgcaaagatccgatataaataataggtgaacaacatggatctaaaacatgtacaataaatgtataggatttgctccccctaagtatatgcatacaaagaaatatacaacagagacaagtgtatgcataagtaaagaagaaccaatgggggtttatcctatacacatagagaaggcatatgtagtaatgatgaagataaacaaaaaaacacataccttcatgatctccatgttctcaatgtaaaggagactaaataagataagactcaagtaaacattagtctcacacttatataacaataacatggaaatcatatatatgaacctatcaaaaagtcggagataagaagtgatacatatcgctttatctccatgaatttcatccttgtcatgattaaggtccatcaccaaagaatgcatatctaccacatctcattatcgggaaataaccttgttgaaaacttatgtaaaagagaggttaatcccataaacatcggtttatcatctatcaccaacgtaacaattacacaaattgtttaatccaagatctttcaatcttttctctcttttgtgataaataataatccgatataaacaatacaaagaaatgagatgaaagataatttcaaatcaaggtagagatcttataatgaacaaaatatagaataagctccccctcaagatgtgcatacatatggatatgaaggaatgcatatgcacataatcaatcaagatcaatgagggagctcacactatattttggatccacaagagagacaaagttagaatatgtgaagtttaatacatacctcccatcatttttactttcatatccaaataagactagtcaaagaaagactcataaaaacgttagtctcgtataattagatttgtcattaatcaccgaaaccaaattaaggcacttgaacttacagccttcaaaaccaccgagggaccatatttacccggttttcgtaagttgaaggacggatcatacccggttttgcggtcgagggacgaaaatcagactgagcgacaaataaagggacctaaagtgaacttattccgacacactatgtatatggaccagacatcggaagtacattcggctaagcatttgtagttttgggcttcatctacacctcaccaatgggctcttgttgggctatcaggatgaagtcttcattgtttgctgaaaattccagggcaccttttgtttgctcaaactaaggttaatatagtgtgaagacgtcttctactcttttatactccctccaacctataaaaaaacataacttagaataagatgtgatattttttatgtttagattcattgtaccaaaaaagttacattccatcatagggtagttttttaatgagaccatcagagtacgtgcttgaaaaaagtactactgaagtttcaagttacagtagtgttttttccgaataagacgaatatcttctaagtattccttaagaaacaataaatattaatttacaaatcttagtaatagtacttctacacacagattgtggaagatcgaagaaaaaaaaaacaagcatagaagacggatcctaggcaatccgcatgcctgcatgatgcacatcaggaaaatttcacgactgccgccgcgcatcgggatctgaaaacgcacgactcctcccgtgacaaaacgtccatcccttcgacgccgcacgccgctgttcccgttgaaaatcaccaggacgaggtcggcggcgggcgtgcggcgcacagctgccacggcacggcggcctcgtcgcgcggttggtagagacaggccggcacgtccgtcgtgtgaatcgcgcggatgccgcgcgggtcaccatcgcgatcgaccgataacatcggcgcgacaggagatggatcgccacaacaccaccacagcggatttgatctcacatcacgtgacactacccgtcacccgccatcggattaacgacctctactcgacaccaaactagagctcctgctcccgtccgctcgatcgcgtcgtcctggcgatgtaacggatcggtcgatttgcctccccaacgcgacgctgacatgggaagattccgtgccctaccatatgccgacttcaatttttactcggtctatctttgacacaagcgatctacgaatctcatcatgcacaagtacagaagctagccggtccgtgcatgcatgctgcaatatcactgacgttgcgaagagaggccggaggtgggtactaccgtactagaatcttatcgtgacgtgaatgtggagttttccttcacaatggcttttacctgtgcaggttagacaaagggttgtaccaaaccaggtcgtcggatggtcgctattattttttttcccgtttttcagaaccacttttgtgacagcaactggcagctttgcatgcgttggaggcggtaggccggccgcgagagcgagagaatcccttctccccgacgcagccactacgtgtgcaacgcattggccgcacaactagcttaagccggtcggcccggctgttgcctgttgatggcgccgtgtagactaatcgatctatcagcaaaccacccgttgctgtcattggccagggtcgaaattaggtacagtactccgtacgtccccggcactgctgctcgacgtcacaatgataaatgaccagcgtttcgccgagacattctggtcgtgcgtgcgtgcgaggggcatgggccaccatgcgcctcgtagttatcggcaggaacaggcatgtgacgtgacacggccttgcccggaggaggcagcgctttgatgggtcgaaagatatgggcagcgtccacggacgatgtaacgacgcccttgaccgtgcgtgacgcggtactacaccgtaatagtaccgtaatatcaactatagccgcctcacctgtccggttgattacgccgcgcgacggctgtttcttgccgcgtcggcaggtccgcgcgccgcgactgacgtgatgatccgatattgcaggtgtgtcatttggggtgcgtccttgcattgcatgcaccacatgaccgtgtctagtgagcaagatcaggagtaatcaatggctaggctgtttgtttggaggggctaattcataagtccctctactttagtcccttttagcccctaaaatactaaaaaaggagggactaaaagaggctaaaactacctagttccataagttcctgtgggaggtgctaatagctcacctactattgaatggatgaagcatataagtgccggatgaaatgctcctagataggtcatttaatgatgtttcagtcccttttagtctctccaaacaaagtttaacctctctttcaaaaatataagtccctcccctagagacttatggttttgtgagtttagcccttctctcccaaacaccctctaagtaggactaaagaggacttatgttttagtcttagaactaaattttaaccctaggacttatgtaaacaatcggggcctaaaagttgctgcaactgatagcagctgatctagctttcctttcccatcagactagcgataccacagtatagtctcgttagagaattatgaatttcgcaaaattagttaggagtagtctcgatggttaattcaaaagcttactccaattactaaacgtaccactgtatctgctagtctaacatgaaaattagtttactactgcctctatcccacaatatatgtcgttttaactttttcatgcaacgtttgatcattcgttttatttaaaaaattagtataaatataaaaaaggataagtcatacttaaagtacttttgataatgaagcaaatcacaaagaaaataaataataattctattttttttaaataagacgaatgatcaaacattacaaacaaaaactcaaagcgacaagcaatatgggacggagttagtaagtcccataaaatcaaatctattatacgatatactccctccgtcccaaaatataagaacctaggaccggatgtgacattttctagtactacgaatctctgtcccatccagtcttagattcttatattttgggacgaagagagtagcacattctaagggcatccacaatatagtctaaaactagtccataagcaataaaatattccattcagccacctaacaacattgtggaactagtccatagcaagaaaatagcaaaagccacccataagcatatgggctgaccatatagaataatatatgttatttctctctatttcctctctcctcctaatactagttgctatctatatagattgtgaagataacaatagttatggtccatatgtgtgggtcccatctatatggactatttttgctatatacattgttgttgccctaatactactacatatctaatattagaatatatcacattgaagtaataaatcgtaatagttgattaaccggggctctggctagctcagtcgttggaagctttaatactccctccatctcaaaatgtacggatttttaggattgaaacgggtattaataaagtaggtagaactaaataggtgaagattgtgactggttgagaagtgaaggtaggtgagaaaattgaatggtacggtggaggattgtgattggttgagaagagaatgttggtgaagtggttatattttgggacaaatcttaaagagctaaaagttgttatattttgagatggagggagtagaagatataagtattttgcagataaactaagacatatggcaatgttttttaccctgtgtgttgagtacgaaatactatctctgccgccatcaaaattttgcccttctgtttttttcactgttccgttaatatttgtgtctcttttgacactgtcgttgattaacgaccatggcatttacttctactagtgtacgtgatttgtcacacgtaattcaattctacaatataagtaacttattttgtgaaacatttgagaaccaaatcccatggtgcaatttcaaaaattatccaattgtacaccttttttcccaatctattatctttgaagcggccataatttagttttgttgataactttatggtatttgttagaagtacgtgtcgagtgctgcattatttttgcacgtttacagggtataatggtcttttagaggcaaacgtaatggtgaaacgtctttgaagctgtggtgccctggtttagaaaacgtacgtacggcaaatgaaaaagttacagatgtggaagagagaatacagtcacaacaaatggcaaaaatagaaaaactttcccgctggaaaaataatagagtaaggccctgtttagtttccacgcaaaatttttttatcctgtcacatcgaatgttt

SEQ ID NO: 86928 - DNA, 605 bp, Oryza sativa
cctattatgccgccgttgttgggcatctacgtcttcaccgaccggcttgccttcgccaccgccgactggtgtttccgcctgcacggctggcctttatgccgccgttgttgggcgtctacgtcttcaccgaccggcttgccttcgccgccgccgactggtgtttccgcctgcacggctggcctttatgccgctgttgttgggcgtccacgtcttcaccgaccggcttgccttcgccgccgccaactggtgtttccgcctgcacggctggcctattatgccgccgttgttgggcgtctacgtcttcaccgaccggcttgccttcgccgccgccgactggtgtttccgcctgcacggctggcctattatgccgccgttgttgggcgtctacgtcttcaccgaccggccgcctcgtccgccgccgactggtgtttccgcctgcacggctggcctattatgccgccgttgttgggcgtctacgtcttcaccgaccggcttgccttcgccgccgccgactggtgtttccgcctgcacggctggcttttatgccgccgttgttgggcgtctacgtcttcaccgaccggcttgccttcaccgccgccgactgg

SEQ ID NO: 86929 - DNA, 611 bp, Oryza sativa
cggtgaagtcgtagacgcccaacagcggcggcataatagaccagccgtgtaggcggaggcaccactcggcggcgacggaggcaggccggcggtgaagtcgtagacgcccaacagcggcggcataatagaccagccgtgtaggcggaggcaccactcggcggcgacggaggcaggccggcggtgaagtcgtggacgcccaacagcggcggcataataggccagccgtgtaggcggaggcaccactcggcggcgacggaggcaggccggcggtgaagtcgtggacgcccaacagcggcggcataatagaccagccgtgtaggcagaggcaccaatcggcggcgacggaggcaggccggcggtgaagtcgtagacgcccaacagcggcggcataatagaccagccgtgtaggcggaggcaccactcggcggcgacggaggcaggccggcggtgaagaggatgtcgccatcagcaacggcgacggtgcacaccaaccgtggaggcgtgtaatccaatcggcagcgacgagggcggccggcggtacgtgcgttaaaacaatagatcaaataataattagtgatctgttaattaatctatttcacataagaaaattt

SEQ ID NO: 86930 - DNA, 522 bp, Oryza sativa
cttcaatatgtcatgaccaggaatatgacccatctctcaacagagaatgatgatagatcacgcctattatttttttatttatgcttaggtgttgatatctgaatgatctagtttttcttggttatacaaattatcagttatcaattaaacaaacagaaataagtagagtacaaggatacatactaaaacaaaggaagcgaagatggaagcaaatatgctctcacttagataacctttgtcttgcccaaactcctaaaaacaacggtaataattggctgttacatatgcaaattaatcgatagcaaaaaggataagtgatttacttactggaagggccataaatccaaggtcctgcagaagtggaccaggtcgatgcaagtaatgcactcctcgagcagccagcccatgaatatactaattataggcaaaatattgtatgaatctccaaagtaatccattaatcaactgacaaacacagaagaataagtaatcctatataactaaatgcagaaaaaaaaaaga

SEQ ID NO: 86931 - DNA, 1485 bp, Oryza sativa
gatggattgaatccggcctccagaagtcgcgccacctcctcgcggatgaaggcttgacgttccggggcctgccgccgcactttctgccggaccggccttgcgcccggccgcacggcgagacggtgctcaatcacctccctggggaccccgggcatgtccaccggtctccaggcgaagacgtcggcgtttgcccgcaggaaggagacgagcgcgtcttcctatttgtcgtccagaagaccaccgattcgtgtggtcttggacgggccgtggcccagggcaacctccttgaccgagacctcgtcgcacgtgaccatccgctgccttggggcggccgggacggaggtggcgagcctcttgtcaccacccgcgggcttggacgccgcggcgaggtggtccgcgcgctgctccatacaagcaagcgcgactttgaggtcgccatggacggtaatggggccagcggggcccggcatcttcatctggagataggcgtagtggaccgccgccatgaacttcaccaacgcgggcctccccaggaccgcgttgtagggcagactgaggtccgccacatcgaagtccacccgctccgtgcggaagttggcggaacctccgaaggtgaccgggaggtcgatatgacccagcggccaggtgtgccccggcgtcacaccgatgatcggctgggacggccggagcaccatccccgtggccttgatggcgtcaaaggctgcgggggaaaggatgttgagggctgcacccccgtctatgaggacacgccccaacttcacattgcaaacggtgggggaaaccaccatcgcgatctgtcctccccgggcaacgcacggcgggtggtcagtctggtcgaaggtgagggcaacctccgaccaccgcgcccgccgcgtcgcctcatgggtaggggccgcggccagaagctctcgcttcatggccttgaggctccggcgagaagcgtgagcgcacgctcccccatcgacggtggcgacggtggcctcaggctcctggaaccccaggtcatcgtcgccatcgtcgatgtcctcggcggtggccttctgcttggcctcacctcaccggttgccggcgggagccgccggggtcttgccctcacggcgctcctgcctcttctcctcctcccacttcctcgtccgttcagccaaacttttgaccgcgcggcagtccgcgaggtcgtggagggaggtgttgtgcacggtacaccacttgccggttgggcgctccctgctgggagcgccggcctccttctttttgtcgctcgcaggcctcccctttcggggggcccgcgaagcgccctcgacggcgagaacatgaccctcatcgtcggaacgggccgaccccttcttcctcctcctgtcctgccgccctgaccgagcggcggacccgggggcggccggagctgccactccagaaccggaggagttccaggtccaggcctcctccttgcgagccacacggtccgcg

SEQ ID NO: 86932 - DNA, 705 bp, Oryza sativa
ttctcctcgtgttccgcaacaaaacgatgttgttgaaagaaagaatcgagttttggttgagatggctagaataatattggatgagtatcatactcccagaaaattttaggctgaggcagttaacactgcatgctatatttcaaattgggctttcttgaggtcaaaacttggaaaaacttcttatgaggttcgatttcgacgtcaacccaaagtttcacatttgcgtgtttttgttgcaaatgttttgtcttgaaatctagaaatttggataagtttgaggcacgctctaccgatggaatgtttcttggttacccagcacattcacgtggctattgagtacttattttggagaataacaaaatcgttgggacttgtgaagtttcttttcatgaggctagtctacgtactagaccagaaattgcatgtacattgtcacaggttcagggggaggatagtcgtatttttgaagacgagagcgacgacgacgacaacgaggtcggctcggccagtcagaccgccggtacacctccggtcagaccggctccagacgagcagtcagaccggccaggtttgtcggcttccggttttgttgatgctgatcgagatggtcctccaaaggctacaacttcgaccagtgagggtacagaatgcgaaacaacttcagaagtcgctgctactttgcatattcaacgacaatatccgcga

SEQ ID NO: 86933 - DNA, 616 bp, Oryza sativa
actgctactaaaaaattataaaaataccactcgaactgtcattccagtggtatccttacaaaagtgaagaaaaccgttggcaaatttgcaaatgtccccaattccgaatctgctttgtctacgaataaggaagctaaatgggttggtttgataagacccttttttgctttgttgataaataataaaaaaagagttttttttctataacatgcttgttttattataacaagttctatatgaaaatgcctgctaaagagaaaatctatctgattgtcttttagccaatatccaattttagaattagaaagaaaatgtaagaagtctccccacttcaattagtccccgtgttcttcgaatggatctcttaattgttgagagggttgcccaaatgcggtatataaggcatacccagtaaagcttatgagtaaaccagatatggagatggcgactaaagttgttgtttccatttttatagaatttctagattacaatggatctaaaaaagactgtgtatttacaactacaacagtacccatgtccaggtccatattgaacatccaataccatttcaagtattggaaccacttctgcatctgattcctatatagcgagtgtt

SEQ ID NO: 86934 - DNA, 527 bp, Oryza sativa
cccgactcactagtcaacggcgaaccagttgatgtagtgaggcgaaggaaaagacaaaatatcatataaagaataaaataaatgatgacttagctttgtaatattccctcggtgacagcaaaagtagccgatgtgggaacaagcagtccatcaatggtgacaaaaacaccagtcggcgccagtggaaccaagccaatggtgtagatgatgaagcccattaacagcggcgaagtccgccaatcgtataggcaaaaacaccagtcggcagggcgaaggccagccggtcggcgaagacgtggacacccatgaacggtggtgtgaccaaccaaccgtataggcgaggacaccagtcggcggcgacggaggcaggccggcggtgaagtcgtagacgcccaacatcggcggcataataggctagccgtgtaggcggaggcaccaattggcggcgacggaggcaggccggcggtgaagtcgtagacgcccaacagcggcggcataataggccagccgtgtaggcggaggcacca

SEQ ID NO: 86935 - DNA, 1448 bp, Oryza sativa
ggaagctccatttcttgagccaagcctcatggtacaaactcggggcatgagattcttccaatgcgcaaaccttgatcaggtatgatttattcgttacaagttcaattaactgtactgaatacataaaacactaaccgatttctactccatcataacatcttacgtagacataccgtacattgtgcaactacattgaggtgtagatacggaggacccacaaaacgacggaacacgtccatatgcacgtagtgaattaagattggactaccttagatctctctttcatgcactaatcactaatcactactttcatgcacttacatctatttacacaatttttaaaataggaggaagttaggaaatgtcaattcgtacaatggatcgatacggtcagagttacttccattggtcaaacgataacgcaacctgagacgaccacgcaattcattcaggcatggatggagtacgaacatcaggtacaaattgcaagctttagactggaggaataatccattaggtttacctaaatggtcagagcgtccaaagtgtggttgtacagatcactgccaggtggatacctagtttgcagaacaaacaattggtaggagatactttgtctgccccaatgtagacgacgatttcgttgtacgtataacaaattccaaatttaactagcatctgcttattattactatcatatctgactaactatgtttgtttcttagggcaatccaggaaggtgcgcattcactttatggatcgacaatgtcaatcccacatatgatggccaaaagataactgagtctgaaacactggtagagtaccagcgagagaaggagcattaaaatgcaatacatgttgaacagcgcggaaggggtcggtagatacgctcaggctcgatttgtcaggactgacaaatttgtatcttttatccatgctatcttgtcattataatgtttcattattatggtgtgttgttgtatgcctcacgaattacaaataaatgggctctatcgttccgatttccaaagtttcttttacgccacgatacgttgtatccttaaaatttataagtatctgcttatatttttataacttccaccttcaattgtgtacatgattcaacatacgcgagaattatacataacttacaatttataggtaacaaaccccctcatttccccgcaaaaaaaaaaaccctcattaccctccaatctttatgaaaaattaaattattcaaattttataaaaatgtacttactttgttcgtttcaaaatgatattttacctaattttagctgctaaaagattaggtttatgtaaaacacctatttcgaaaaattttaagtgcaaaataattagatttatgtaatgaataatttgaaactattctccttctatttcgaaacgataatttacgtagtttataaagtaaccattaattattt

SEQ ID NO: 86936 - DNA, 2066 bp, Oryza sativa
attcctgcagcccgtgcgtgaaagaagattgtccgtggcgtgttcatgcatataagggtaaattgaaagaatattggaaaagttaacattgtgaccgagcatcagtgccacttacaaggggtcgagaagtatcaccgcaacatcacatcagcttttgttgcaagtgagatgtacaggagtgttgtcggtaactctggctttgaaccaagagcaattattagccgcattgaagacaaattcaagtacaccataacctatgccaaggcttggagagaaaaacataaggttttagagatgcatttttgaagcatcatatgataatttgcagcgtcggttagccaccattgcctagaggaatagcaatacatactatggcgtgcatacatttccatccactgttgatcctaacaagagtgtgttgcaaagagcctttttctcattgggtgcttgcatgaaggcttttgtgcactgccggcctgtgttatgtatagatggaacatttttgatcggtaaatacagaggtcagctattgacagcgattggagttgatgggaacaatcagctgttacctatggcttttgcatttatagagagtgagaacactgaaagctggtactggttcttggacagagtgcagagaaaagtcgtgtgtatgaggcccaatgtttgccttatacttgatcgtcatgcgggcatgttgcgggctattgactacttgcagaacggttgggatgagaagggaattccagctaagtggcccgatgttcagagtcggtgctgcatgcgtcacatgggtgctaatttctacaagcaattcaagaacaagcatcttatggatccttttaagaggctctgtgcacagaatcaagagaagaaatttaatgagttgtggaataagtcggatgagttgacaaccaacaaactgacgagcaatctcgtcgactacaagctgaaggtgacgagcctccagtacctcttggtgcactacatgatgacgcacccacaatgagaaggaggtcgggatcatctatccaaaagttctctcattagattgagaatgaaccaaaggagaagtggtctctattgttcgacaccgatggttctcgatatggcataatgacaactaatctagccgaggtttacaacttggtaatgcgaggagtgcgaggactaccgttggttggtatagtcgaatttatccttcacggcgcgcaggcctacttcagggatcgatacaagaaaattgatccctcaatggtagataacaagataatatttggcagcgtagtgactaagtacatggaagataaaatagcaaaggcacagaggcatagagttgtggctcaaggaacaaaagttcatcggtatgaaataatgtgtgttgataggagcaggcgtggaatcatgcgcaagcatgccgtgcaggaatgtgtactgaagtctgatggaggatgcagttgcacctatatgaagcctaagcttcgacatctgccttgctctcacatacttgccgtggcaggagactgtggtatatgtcccgatgtgtacgtgtcaccttatttcaggaaggaagcaatctttcatacatggagtgaggagatacatgggttcgggatttcaggatcatacataactcagaggtcccaagtttttttcattcccgatccatcgaagttaagggtgaaaaaggggcggcgttagactagacgcatcaaaaatgacatgaacgagtcggaagctggtgggaggactctacgctgcagcaagtgtgaccatcgcggccatacttacaagaaatgctcgaagactgcacagggtccaagcaccgaggatgttggtccatctggagaggcaagtgatggaagaagatcacctggggaaggaacaacaagctaataggaacaacaggcgtcctcatgcggcaggcgatgcgatggtctaatagtgaaattttgctcacgcgtgcgcgtgttgtcacatcaagtgggccagatgaactctcattaagtccatttatagcactagttgcggccctatataatagacaagctgaatacaacagcttc

SEQ ID NO: 86937 - DNA, 697 bp, Oryza sativa
attcctgcagcccgataacccaccaacaatgagaaggaggtcagggtcgtccatcagaaatttcactcagtggattgagaatgagcctaaggagaagtggtctctattgttcgacaccgatggatctcggtatggtataatgacaaccaatttggcagaggtgtacaactgggtaatgcgaggagttcgggtacttccattggttgctattgttgaattcatccttcacggcacgcaagcgtactttagggatcgatacaagaaaattggtccgtccatggccgataacaacatagtgtttggcaacgtagtgacaaagtacatggaagataaaatcaaaaaggcacggagacatcgagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagtcgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaag

SEQ ID NO: 86938 - DNA, 913 bp, Oryza sativa
gagttcaagaaggaatacaatttaaaattagctgaaattcggaattaaaaataagcaatattgaaacaagaatccatataaaaacccaatacgagattaattaaaatttagaataaaaaataaaataatatccaaaactagaaaactaaaagagagttcaagtagaaatacaaatttcaaacaactgaaattgaaaataaaaaataaaaacatcaaaagaacacaatacggtattaactaatttttttttaaaaattctgaaattaaaaaaaaaagattttaattaggaatacaatttataaataactaaaatttgtgataaaaataaagattattgaaataaaagactatctaaaacatgtgacgagataaattaagtaacatgcctataaaagaagtagagtggtggcggttgatacgacatataaaaattgttaataaaacaccaaatagaatcctaataacgattaaaaggaggaacatcgggcaggccgtgaattaagcgagtaaggcggttgtcgagacttctataaagtaaaaaaaaataaaccacattgatcatcacattcgatttttaaaatctcagtgacaataaaaaggagaagcagcgggcggggtgtataagagtatagttgcagagccgccgaaggttgacgggacttctagaaaataaaaaatgaattccaacgatagttatgtttgatttttagaatcacaatgacaataatgagtaggcggcatacgggctgtagaggggcatagtggcatcgtttgatgggacttctaaaaattataaaaaaataaaattacaactccaatttttaaaggttcggaacttctaaaaagtaaaaagaaccaatgataatcatgttcgattttaaaatctcaaatttcaatgacaataaagaaggga

SEQ ID NO: 86939 - DNA, 648 bp, Oryza sativa
  unsure (1)..(648): unsure at all n locations
tgagaacactgaaagctggtactggttcctagagangtgcacattgcagtggtgcgtatgaggcccaacgtttgccttatacatgatcatcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccactagttgaaggtgacgagcctcccatacctcttggtgcattacatgatgacccaccaacaatgagaaggaggtcagggtcgtccattagaaatttcactcagtggattgagaatgagcctaaggagaagtggtctctattgttcgacaccgatggatctcggtatggcataatgacaaccaatttggcagaggtgtacaactgggtaatgcgaggagttcgggtacttccattggttgctattgttgaattcatccttcacggcacgcaagcgtactttagggatcgatacaagaaa

SEQ ID NO: 86940 - DNA, 648 bp, Oryza sativa
cctgccaccgtcgaccgttcgattgattggcacgtcgtccgcgaggaagagtcatgtaaggtattggtttgtattaatttgttcatttccgattcaattttatttactttgcacgaagtagatggcgattgcccgtatccggtggaccgatatggaggttcgtgtgtttcttaagagctgcttgaaggagatggcagcgttcaccatcacctccaactcccccaagccgcaggcatggcagaacctaatacacaagatgtacaccaagtgcaagaataaggtgaacaaggctcaattggagtacatttgggggcagtgtaaaaagcggtacaacaggtgggtgtggctagaatcgcatgcaagcgggctgggtcgtgatccccatacatcagccattgttgccgatgatgagtggtgggaaagcaagaatgcggtacgtacacttgaccataaatattttgaaccaacaattttgcctacaattggtattatctgaaatttagtacatgcatgcaattatgaatacagttttgtaaggtgtaataatttttttgttcaaattgtgtgtgccaacaaatgactagctgcagtaaaatgcaaggattgtgatcacatatgtttcatagttgttactgtcatgtcgttttt

SEQ ID NO: 86941 - DNA, 692 bp, Oryza sativa
aattcctgcagccctcagatcttacacaacgctgagtgcccaagttttttatattccagatccatctaagttaagggtgaaaaagggtcgacgccaaactagacgcatcagaaatgatatgagagtcagaagcaggtgggaggactttacgttgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctttcgatttaggaaataaaatgctgttgtgatgtaatgagtgttcggactaaatacttctatcgtgtaatttcaattcaatgttgttgtaatgagtacctccgactattgttgtactagtagtattgcgaattattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaaccgtgggattgacaggaaccacc

SEQ ID NO: 86942 - DNA, 702 bp, Oryza sativa
tgcaagtacttcatcattgttgaagaaagaagagaaatttgtgtggagcccgcaatgcgagaaggcgtttaaactctcaaggaaaagctggtttcctcagccgggtgtttaatctgtgcgcggcatacctcgacaagagactttcatgagtggtattgtgaacgcttctcgccaaggattggggtgatgctcatgcaggacggtcatgtagtagcctatgcctcacgtcagctacgacctcatgaaggcaactaccctacacatgacttggagttagccgcggcggttcatgctctaaaaatctggcggcactatctcattgggaatcgctgtgaaatatataccgaccataggagtttgaaatacatcttcacccagtcggatctgaatcttcggcaaaggagatggttagaactcatcaaagactatgatgtgggaattcactatcatcctggtaaggccaacgtggttgccgacgctctaagtcgaaagagccattgcaacactcttaacgtccgtggcattccacccgaacttagtcaacagatggaagccctgaacctaagcatagttagtcgcggattcttggctgcgttagaagccaagcctaccttgctcgatcaaatccgcgaggcttcagaagaatgatccggacatgcatggactcctcaagaatatgaaacagggtaaagccgctggttt

SEQ ID NO: 86943 - DNA, 511 bp, Oryza sativa
attcacttttcccacctacctccagtactcatccaatcataatcctccaccattcacttctacctactttcttaataaccgtggccaactctaaaacgtcttatattttgggacggatggagtagtaaaaatctgagtagatacaattcccccataatatttcttacccaacagctgtgactgatacttacaatgaaaccgttcaaaagatgagctccttttaacatttgatgccgaactttggttgcctgcctgatatactcttctgtatataggtaaccataacaatgtacgactgggacacagtgtgcaagtgcaaagttattggatctgtaactgtagccgttctcggtgaagacgaagcaggagctacttggttcgacctggacagtaaatctggtcaggtaaagtgtaaaattgatgaataagtgatattgtctaacttaccactattgctgtacttcaaatattcaatgaacttttaaggatgtatttacaattaacgaaatat

SEQ ID NO: 86944 - DNA, 1162 bp, Oryza sativa
aaagtgcgacggtgcgggctcattccgacggggagagtgagcggcgagtggcggaaacggaggagcggagctcggggattgattttatagcgacgggagagagagagggcggccggagagaaaggaaaccggccgcggagttctcgggctccattgaagacgccggcgacgattgcgggattcaaatcggacgaatccgagggagagagagagggaaaagagggggaatcgggagagggaatcacggggagtaattcgcccctctttatggcgcgcggggaaggcgggatgcggcggaatcggcggcggcggcggcgctagggcacgggcggcggcgggcgcggcgcggggttggggatgacaggtgggccccacccgtcagcgagggtggcgggcgggcccgcctgtcagcggcgcgcgctcggggaggagccgatgggccggaggggaggagagagagagagggagggagagaagtgggccgagccggcccaagaaggaaaaggggggggaaagaagacttttagggatttttctttttataaaccttttcaactttgtttatttcttttcaattattatttgtgctctgaaaattccactaaaatttatttacgcattttaggcttttaggaaatatacaaaaatcctccaagcctcatttgacttttatctttgcacattttaattgttggaggctttcacatgaattttaattattctttgcacaatttcgaggatgtattttagagtcgatttgggacgtgacaaacctaccccccttaaacggaatctcgaccccgagattcggaagaactggcgaagagatcgggatgggctgccttcagctcgtcttcacgctcccaagtagctttttcttcggcgtgattgctccactggaccttgcaaaaacggattacccggttcctggtcctgcgctccatggtgtccaggattttcactggcctctccacgtaggtcaaatcttcgcgaacttcaatttgctctgagtcggcctgctcggatggcactcgaaggcatttcttgagttgcgacacatggaacacatcatgcacgttgcccaaggaggcgggcagctccaactggtaagcgacttctccgcgtcgagcaatgatacggaaaggacccacataccgaggtg

SEQ ID NO: 86945 - DNA, 795 bp, Oryza sativa
ttgaacgagcgcgtcactccgcatgtaacgcagtgcagcgcgctcgtttatccggtctgtgaccggtcacagaccggtcagatcgtgggttaggtggcaacaggcggtatgacacacgcctcgccccatcccgtcaggataagagcctccaggcacttgtccctagccggagccagcgtgctagctcctggagatgacacgttggtcccggtcagatatatgccaggcttcatcccaaccgttacaagcaagacattgtatgaagaagggtgaacatgcagattgataaactgacgcgtggtggacaagaatgaccgatttgtgaccggtctgacactggtcatgtcgtcggcagacagccatgttcccacgtcgcacctgcttccggcgaaagtagaggtaggtatgggccgtcccatcagaaggtcattcggacggcaaccattacaaatctccgcccatttatgaaggaaaggcgagccaagttttagtgaaaagaggatgggtccccaccaaaaagagaaataggtagaagtggtgcatgtggtatccccttgagatataaaaggaggaccttgcccacttagggaggggatccggaccagaggaccaggggaggagagattggagactcccggaggatccaggagaagatcccacgagaggcaaaaaggaggaaaggggtttctagagtttgagctctctggttctccagctctttgtagcttcttcgtacacagatctaccagaacacaggagtagggtattacgcttctcagcggcccgaacctgtat

SEQ ID NO: 86946 - DNA, 4904 bp, Oryza sativa
gagaacgaggatgatctgtgccatggttcttttgtgtcttagctcgaacaagggctcgtgcccaggtcccagtcctcaaatggctcgggtcggggctagtgcctggggagatccacgtgtcgagactggccaggccgggagcgtggtgaccgagggttatgggtgacccggttgtgggtttttgccgatcccccccggagttaaccacgccccggggcacggctcggttctgggccccttttggcgattttagccgactcgagcccccgagggcaggatcgagcacgagtgacctatttcaagtcaagattcttcaaaaggaaacaacagcacagacacagcctttaggaaatcgaaaatgcttttattgaaatacagatagaagagaaataagaatatgcatgtgtggtagcccccggccaaccctgcacgcccgaggggggtacggggttggcccgagcccgaaacctgacacccgaaccctattaggggtagaagcgacgaaggtgttcgatgttccacgggttaggcagctctgtgccgtcgcccgcggccagccgaacggagcccggccgggggacgctgatcactcgatacggaccctcccacattggtgagagcttgctcaatccagcacgcgtttggacgcggcgtaggacgaggtcgttgacgcagagtgatcgggcccggatgcggcgctgatggtagcgccgtaggctctgctggtagcgcgcggctcggagggccgcgcgccgccttcgctcctccaagtagtcgaggtcatctctgcgaagctgatcttgatcagcctcgcagtacatggtggcccgaggggacctcagggtgagctcggatgggagaaccgcttccgcgccgtagacgaggaagaaaggcgtttccccggttgctcggcttggtgtggttcggttcgcccagagcaccgctggcaactcctcgatccacgaatcgccgtgcttcttgaggatgttgaaggtcttggttttaaggcctctgaggatttccgcattggcgcgctccacttggccattgcttctggggtgggcgggggaggcgaagcagagcttgatgcccatgtcttcgcagtgatcgccgaaaagttcactagtgaattgggtgccattatccgtaataatacggttaggcaccccaaaccgggctgtaatgcccttaatgaacttaagtgcggagtgcttatcgatcttgacgaccggataagcctcgggccacttagtgaacttgtcgatcgcgacatacagatactcaaacccgcccggggcctgcctaaacggtcccaggatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaatagaaaccttgacgaaaggctttgccaaccaaggtgcgcgaggcggagtgggctccgcattcgccttcatggatatcggcaagaagctcgacgccttgttcccgaggaatgcacttcaggaggattccgttagccgcgcgccgatagagggtcccttctaccagcacgtagcgtttggagatgcgctggacgcgttcactcccttcgcggtcctcgggtagagtcttatctgtgaggtatgcttggatctcagcgatccaagcaatcaatctaagggagctgggagcactcccctcgggtcccgaggcctggactccgacgggcctcgggggccggtcaggcgcgtccgtctcccctaaggggtcgggtcgcgccgacggctgggcaagcctttcttcaaaggcgcccggtggggtctgggctcgcgaggaagcgagccgtgagagttcgtcggcaatcgtgttatcccgtctgggcacgtgccgaagctctatcccgtcgaaatggcgctccatacgccgtacttggcgtacgtaagcatccatctgcgggtcagagcaccggtactccatacagacctggttaacaccaggaggcggcggatccccagtccagctgccaccctaagtcccgcaaggagtccctcgtactctgccatattattggtcgcccgaaaatcgaggcgaaccaggtatctgaggatttctccgctcggcgaggtcaacgtgacccccgcaccggcgccctgaagagacagggagccgtcaaattgcatcacctagcgggcggtgtgaggcagctgcgaggggcccgagctggcctcggggagtgagacgggttcgggagccggggtccactctgccacaaaatcggcgagagcctggctcttgatagcgtgacgtggttcaaagtgcaaatcgaactcagaaagttcaattgcccatttcaccacccgtcctgtaccctctcgattatgcaagatttggccgagggggtaagacgtaaccaccgtgacccgatgcgcctggaaataatggcgcagtttcctcgaagccatcagaatagcataaagcatcttctgggcctgagggtatcgggtcttggcgtcccggagggcctcactaacaaagtagacgggccgctgcacctttcggtggggccgatcctcttcgccaggggccgcatccctggggcgctcttcgtccaagcggcctcgcggggcgcactcgtcttctgtgccgacgacctcggggtcggaggacgacaggcgcggccttcccacagtggcctcggtgccgtcctgggggtcgggggctcctggcatcgtcggacaagcgggcaaagggccaactccggtcgtcgggggccttaggccaccgttcggctcgggggcctcttctccctgctctctcccgggtcgagtcggcacagggttaacctcggggtcagagggcgataggtgcggccttcccgcagtggcccccgggccatcctgggggtcgggggcacctggcaccgtctgacaagcgggcagagggccagctccggtcgtcgggggccttgggccaccgttcggctcgggggcctctcctccctgctctctcccgggccaagccagcacagggtggggatgcgcggaatgaggattgtcctcatcgcgctccacaaccaacgccgcactaactacttgcggggtcgccgctaagtagagtagcaagggttcatctggctccggggcgatcaaaactgggggagagctgagatacgccttcaactgagtgagggcacgttcagcttcctccgtccaagtgaacggcccggagcgtttgaggagcttaaataagggtagcgccttctctcccagcctcgatatgaaccgacttagggcggccatgcaaccggtgacgcattgcacatccctaagcttgctgggggcgcatccgctctatagctcgtatcttctcggggttggcctcgatgcctcgggcagagaccaagaacccgagaagcttgcccgcaggtacaccgaacacgcacttatcagggttcagctttatgcgggcggagcggagactctcgaaagtttccgccagatctgaaagtaaagtttcttggtcgcgcgtcttcacaaccaagtcatcgacataagcctcaacattacgtcctatttggctacccaaagaaattcgagtagtacgttgaaaagtaggacctgcattctttaacccgaagggcattgtcgtataacaataagttcctatgggggtaatgaatgtagttttttcctcatcctccctagccatgcgaatctgatggtaaccagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagtttgccattcgccttgggaacgaccaccgggttcgccagccactccggatggatgacctcgcggatgaatccggcctccagaagtcgcgccacctcctcgcggatgaaggcttgacgttccggggcctgccgccgcactttctgccggatcggccttgcgcccggccgtacggcgagacggtgctcaatcacctccctggggaccccgggcatatccgccggtctccatgcgaagacgtcagcgtttgcccgcaggaaggagacgagcgcgtcttcctatttgccatccagaagaccaccgattcgtgtagtcttggacgggccgtcacccagggcaacctccttgaccgggacctcgtcgcatgtgatcatcctctgcctcggggcggcgggaacggaggtgccaagcctctcgtcgccaccctcgggcttggacgcagcggcgaggtgatccgcgcgctgctccatacaagcaagcgcgactttgaggtcgccatggacagagatggggccaccggggcccggcatcttcatctgaaggtaagcgtaatggaccgccgccatgaacttcaccaacgcgggcctccctaggaccgcgttgtagggcagacttaggtccgccacatcgaagtttacccgctccgtgcggaagttgacggatccaccgaaggtgaccggtaggtcgatatgacctaacggccatgtgtgccccggcgtcacaccgataatcggctgggacggccagagcaccatccccggggccttgatggcgtcaaaggccacgggggaaaggatgttgagggctgcccccccccccccccccgtctatgaggacacgccccaacttcacgttgcaaacggtgggggaaaccaccatcgcgatctgtcctccccgggcaacacacggtgggtggtcggtctggtcgaaggtgagggcaacctccgaccaccgcgcccgacgcgtcgcctcatgagtgggggccgcggcca

SEQ ID NO: 86947 - DNA, 588 bp, Oryza sativa
gcctgcctccgtcgccgccgactggtgtccccgcctatacggtcggttggtcacaccaccgttcatgggcgtccacgacttcaccgccggcctgcctccgtcgccgcagactggtgcctccgcctacacggctggcctattatgccgccgctgttgggcgtctacgacttcaccgccggcctgcctccgtcgccgccgactggtgtcctcgcctatacggttggttggtcacaccaccgttcatgggcgtctacgacttcaccgccggctcgcctccgttgccgccgagtggtgcctccgcctacacggctggtctattatgccgccgctgttgggcgtccacgacttcaccgccggcctgcctccgttgccgccgagtggtgcctccgcctacacggctggcctattatgccgccgctgttgggcgtctacgacttcaccgccggcctgcctccgtcgccgccgactggtgtcctggcctatacggttggttggcacaccaccgttcatgggcgtctacgacttcaccgccggctcgcctccgttgccgccgagtggtgcctccgcctacacggctggtctattatg

SEQ ID NO: 86948 - DNA, 617 bp, Oryza sativa
gggcgctccccggcccacccgaaagggaaggcctgcgagcgacaaaaagaaagaggctggtactcccaccagggagcgcccagccggcaagtggtgctccgtccacaacacctccctccacgatctcgcggactgtcgcgcggtcaaaaacttggctgagcgaacgaggaagtgggaggagtacaggaggaaggaacgccgtgagggcaagtcgccggcaactccctccggtaaacggcgaagtgaggccaaacaaaaggcccccgctgttgacatcgatgacggtgatgatgacctaggtttccaagaacctggggccaccattgccactgtcgatgggggagcgtgtgctcatgtctctcgcgggagcctcaaggccatgaagcgagagcttctggccgcggcccctactcatgagacaacgccccgggcccggtggtcggaggttgccctccctttcgaccagaccgaccacccaccgtgtgtcgcccggggagggcagattgtgatggtggtttccccccccatctgcaacgtgaagttggggcgtgtcctcatagatgggggagcggccctcaacatcatttcccccgaggcttttgatgccatcaaggccc

SEQ ID NO: 86949 - DNA, 997 bp, Oryza sativa
  unsure (1)..(997): unsure at all n locations
gtgggnattgannattcgannatcgactaacacatggtacagnagctcatcagaggcgagccggcggtgaagtcgtagacgcccatgaacggtggtgtgaccaaccaaccgtataggccaggacaccagtcggcggcgacggaggcaggccggcggtgaagtcgtagacgcccaacagcggcggcataataggccagccgtgtaggcggaggcaccactcggcggcaacggaggcaggccggcggtgaagtcgtggacgcccaacagcggcggcataatagaccagccgtgtaggcggaggcaccactcggcggcaacggaggcgagccggcggtgaagtcgtagacgcccatgaacggtggtgtgaccaaccaaccgtataggcgaggacaccagtcggcggcgacggaggcaggccggcggtgaagtcgtagacgcccaacagcggcggcataataggccagccgtgtaggcggaggcaccagtctgcggcgacggaggcaggccggcggtgaagtcgtggacgcccatgaacggtggtgtgaccaaccgaccgtataggcggggacaccagtcggcggcgacggaggcaggccggcggtgaagtcgtagacgcccaacagcggcggcataataggccagccgtgtaggcggaggcaccagtctgcggcgacagaggcaggccggcggtgaagtcgtggacgcccatgaacggtggtgtgaccaaccgaccgtataggcggggacaccaatctgcggcgacggaggcaagccggcggtgtatatgacgatgcccatcaacggtggtgtgaccaaccgaccgtatatgcgaagacaccagtcngtcggcgacggaagcaggcccgcggtgtatattaccatgccatcaaccgggtgtgaccaacgaacgtattggcgggacacaattggggtgacagagcagaccgcggggttattaccatcccatcaccgtgtggccaccggaaattttgttctt

SEQ ID NO: 86950 - DNA, 584 bp, Oryza sativa
  unsure (1)..(584): unsure at all n locations
ccacgcgtgactgaatatcgtatnccnnnnnnnnnnnnnnnnnnnnnnnnnnnnnnnnnnnnnnnnnnnnnnnnnnnnnctcgtaaatggggtcttggaaaagctaaagatttgcagtcggagtggtcaaaaaatagatttcctttgtatgcttttggtttatgctgctgcttttatgctcccactcatgcaatgatatgataaaagatcacatggtaatatggtatcgatttgctcagtcgctactttgttgtcctaggtaaattgtatgcatgcttggcgtctgtatgaagtgcatgacaatgcatcgggaagcatcagctgttgccacagctattcttgatacaataagatctgggtactccaagcctaaacagacatttcctgtgttaaggaactttattagttaggtacaattttgacattaacttttgtttcaacagagctgtttcacaacatcttgaagcatatgtcagagggtctatgtgttgtttgcaacttcttgcaaattgatagcgctgcacctgatgtatgtctcatcagttcttatagaaagaaatcaggacattccaactggtttggaa

SEQ ID NO: 86951 - DNA, 680 bp, Oryza sativa
ataaatggaaaccgaacagacatggaggaaaaatagaaaaattaaattgaaagctgaaccgacgtgaggtgcatgaaggaagattgtccgtggcgtgtccatgcatataagggtaaatgtaatgattattggaaagttagcattgtgaccgagcacaagtgctacttacaaggggtggagaagtatcatcgaaacatcacttcagcttttgtggcaagtgagatgtacagcatcgttgttggtaacattggctttgaaccaaaatcaattattaggcacatcgagaacaaattcaagtacaccataagctatgcaaaggcctggagagccaaacaaaagattattgagatgaggtatggcacattcgaagcttcttatgataatttgcctggtttgttagccaccattgcccagaggaataataatacttactatgacctacatacatttacatcggttgatgatcgaacaaagagtgtgctgcaaagagcctttctctcattggatgcttgcatcaatgcttttgtgcattgtcgacctgatctatgcatagatggaacttttatgacaggtaaataccgaggtcagatattgacagcaattgggtgtgatgggaacaaccaaggtctacctatggcttttgcatttgtagagagtgaggccactgaaagctggtcttg

SEQ ID NO: 86952 - DNA, 893 bp, Oryza sativa
  unsure (1)..(893): unsure at all n locations
cggttcccnanggtaggacnnnnnnnnnnnnnnnnnnnnnnnnnnnnnnnnnnnnnnnnnnnnnccgaacgagcagctcagagcgttttgatatcatgctgctaatcgccctgatgcttcaactaacatgttggcttgcgggcgttcatgctcagaaacaagggtgggacaagcacttccaggctaacacagtcagaaattgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagagcttgtcggctcaggcggggcacgctaagcgcgtgcggatcggatcagagatcaggaaaaagacaaaaaaataaaagaaaaagaaaaaaaagggacttcccgcatacgcggagaaaaaaccttttcgcgtgaaaataaagggtgacaaaaaaataaactgcactgaccaagaaaaccgcacgattggcggctgaggcggggcgtgctatgcgcatgcaaataagagcagagaacggaaaaaaaagacaaaaaaaaaaggacttaccctgcgcgggaaaaatcccgttccgcgtgaagaaaaatcggcgacaaaaataatagccggacgaaccaagctaaaaccggatactctttttttttattcgatcatcataggcaaaagccgaggtaggtaaagtagactattccttccccttaagttgacaaaaaaaaaataagtttggccagctttctacagcccaattagatttgccacataaggggggtccacttctcaatctngnnggttgaagcgntgcgtcattccnngcagcgc

SEQ ID NO: 86953 - DNA, 588 bp, Oryza sativa
agaaaagtccctcaggaattatgcaatgttgtgtttctttgcaagaaggaagacaattgctacaggacattcactctggcatttgcggaaatcacgctgccgcacgaacaatggttggcaaggcttatcgacaggattttttctggcccactgcagtatccgatgccgagagagttctgcgaacatgagaaggttgtcaattctttcccatacagattcacttaccaactcaggagttgtaaactatccctctttcctggccgttcgcggtgtgggggcttgatatggttggtcctttcaaaagggctactggtggtttcactcatctttttgtagctgtggacaaattttccaagtggatcgaagctaaaccagtcgtcacaatcactaccgacaaagctcgagattttttcatcaacatcgtgcaccggtttggggtacctaatcgtatcattatagatggtacccaattcactagtgatgtgtttaaagacttctgtgaagactttggtatcaagattgttatgcttctgtagcacattctatgaccaatagacaggtcgaatgcgccaatggtatggtagttca

SEQ ID NO: 86954 - DNA, 2201 bp, Oryza sativa
aaccgggactaaagatatttttccgctatttctaaattctttttaaacccggttagggttaagaaccgggactactgataagcgcactgaatattaatttccattacatatgtgtttctaaaatagaaaataatgcattaaaattatttaaagtcgaaaaattaatgacaattacttcgaaaaattattgttgtctgtagtaaattaagtggataaaacgtaataagcaaatatatgatttaaaattaataaaaattctaataatcatatatacttagcatatgaatgatattaaattgttaaaaattgtaattaacatatgtatatacatacgatatgcatgttttaaaattagtaaaaattctaataatcttatataattagcatatgaatgatattaaattaattgttaaaaactctaattaacatatgtaaatacatacgacatgcatgatttaaaattaataaaaattcgaataatcatatataagtagcatatgaatgatattaaattaattgttaaaaactctaattaacatatgtaaatgccacaagcctgatttaaaacttttaaaaatcctaattatcgcatataactagcatatgcatgatttaaaattgttaaaaactctaagtaacatatgtaaatgccacatgcatgacttaaaacttttaaaaattctaattatcgcatgtaactagcaattacatgatttaaaattgttaaaacctctaataatcgtatgtaattaacatatgccatacaaaaattgatttatatggataattattacatccaaaatagtttacatcgtgtacacaataattacggcaatacatcggcggtgacggttgaccggacgtactttctcctcactattgttccctctttgtgatcgctacgtgagtaaggggtgtcttcatttgataggaggatgctagggtcaatcgtcaccgtgaaagggggttgcccatcaaactgatcgtaatcctcgtcagtcttgccatcaactccgacgatttttcttttgcctgggagaaccacgtgacgcttcggctcgtcaggccctctgcccttctttcctttgctagacatgtccttcacgtaaaagacttgcgttacatcattggtaaggacaaaatgttcgtccgagtatccaaccttgttaaggtcaaccgttgtcatctcactgtcatcaatcattacgcctccaccagtcaacctatcccattggcaccggaacagagggaccttgagaggaccatagtcaagttcccatatgtcctcgatggcaccgtaatacgtgccagttgttccatcgtgtcctatggcatcgatacgaacaacgctgttttggttcgtgctcttcatgtcttgggctctcgtgtagaatgtgtacccattgatctcatatccctggaatgtcgcgatcgacccagatggtcccctcgccaggaaggccagttgttggttgatcatctcgttacccagatggtcccctcgcctggaatgagatgttgtcgtagccacacggggaaagtatcaatgtgatgccgtgtaatccatgcatcggacttaccgatgtttctggcgcgaactagagccaagtgctcctcgatgtaaggagctaccaatgaagattgttgcaaaaccgtgaaatgggctttacggaataaattgttgtctaccgtcattattgctttcctttcaagagttcccttttcccgtatctcccttcatggcgtgattcaggtaccccgattgggcaaaggtcttcaataaattctacgcaaaattcgatgacctcctctgttccataccccttggcgatgcttgcctctggacgagcacggttacgaacatactttttcagaacgcccatgtacctctcgaaaggaaacatcttgtgtaggtacacaggcccgagaatactgatctctttgacaaggtgacaaagcagatgcgtcattatattgaaaaatgaaggtggaaatatcaactcaaaactaacaagacattgcaccacatcattctgaagggcttctaatctatctggatcgatgaccttctgcgaaattgcgttcatgaatgcacatagctttgttattgttgcccggacattgtttggaaggataccccttattacaactggtagcagttgtgtcatcacacacgtgacagtcatgagactttaggtttg

SEQ ID NO: 86955 - DNA, 2973 bp, Oryza sativa
ccgtccacgactgagctcagggagcgcattgctaggtaagcctttgaataatccttttggtctttgattcacaaggttgttttcagttatgcatcattttcatgtaattttgcatccggagctaacctaatccagagtaatgtatagcatttaaccactttatagcaattgtacatctgaaacttgttttattgactcagtattggtgctactgtcacttgatgatctttggatgtcaactagtgtttttagggttaaatctagtgcaacctttttgctaatttgtgtattacgaaggctttatgcattattttcttctactgtctcacatgctgggctaaattgtggctgatgaaatttctttccctggtccgactgaatgtggtccatattgagtgcattttgggtttagtcatcctattatccacgtaagcctcatatgaattcagaaaattgaagctgaaggaagacaacattgcttctaataattttaccaggagtaacatactaaagttgaactgttgaagcaccctatagagaaacttttgctaaaagattcctacggtaaactttattataatcctcaatatgcagacctgctgtctgctttcaaagttgtctttattgcattgaatccaggaactattcggtgtaaacagagaatgctgtcttttgtatttgtttattatacttttggttatgcttgttgcattctgattaactgctgctctgttgacatagctcaagaattttacttatttgtgctgtcaataacccggatttcttgtttatgtaatggaagcataggtttggtttgtacagaacacgatcaaatatactgaaataaatgccatcttgttacacctttgatctttgttcaatactcaactaaactctaaaacttactgccgtctaatattgctgttacaacctctttcggtgttaagctcttctttagtttaattgattgatagttagtatgcaagagttgtatcatttttcctcgctgttaaatcttgtaattaaaatttgaggacacaaataatctctaaatcaggtatttacttcaggtcaaaggaggaaagactgaatgatacaaagcaaggaggaatactggatgataatggtggtgatggtgagatattatcgtgggtgggcaagagtcgtaaacttgatgaaaaaaggcaagctgaaaaagagaaagcattacatcgtgctcgagcattggaggaacaggtgatggtttaaccatgatgtttatgtgtatacattttaaaatatgtacaactaactttcatatatcaaacttgcaggataacattttagctgaaaatgatgaggatgatgacgaggagcaacaggaggataaccgagtgggaggtaattcctgtgcaagtttattttgttatgccttttgtgtagtatatcgtctgagctatagtgttctgtgcactgttatcagaataacgtgtttcactcttttcatcttttgtccagaacacttatctggtgtgaaggttcttcacggacttgataaagttttggaaggtggcgcagttgtcatgaccctaaaagatcagagcatcctggctgatggggatatcaatcaaggtgatgggcttttacatgtttatatgtaccagctcctagggtaactattgtcttacttgagaaaaatatttgtagaggctgatatgcttgagaacattgagattggtgagcagaagcaaaggaacgaagcttacaaggccgcgaagaagaaaggaacatatgatgacaagtaagttcaccatacatatatgtgttactgctaacatgctgtgtttattggattgatgtgatataatgttcatttttctgcctgtctttaggttcaatgatgatcccttgtcaaagaaatctatactctcacaatatgatgacccaatggaagatgaggtaaagtaaaatgcgatgttcaattttgtttgctttgtatccctctgttggtagttatttttattgttgcacttatcagggagtgacacttgatgaaggtggacgcttcagtggtgaagctgaaaagaaactggaagaggtaattcaacttcatccctagaagccatggtactttttagggtccattgcaaatactttggttgcatctttgtgtggactaactatattttgattttgccagctccgcaaaagaattgaaggtggttttgtgcagaaaaagacagaagatcttacttccgcagcaaagatgtcatcagactattatactccagatgaaatgctccagtttaagaaaccaaagaaaaagaaatcccttaggaagaaagaaaagcttgatctggatgcacttgagtctgaagctattgctgctggactggggacaggtgatcttgggtccagaaaagatgcaagacgacaggctgctagggaggaagagcaaaaggctgatgctgaaaagagaaactatgcgtatcaagcagccattgcaaaggctgaagaggcatcaaaagcattgcgcccggagaaaaatatttctggtaaacacgctgaatctgaagaactagtttttggtgaagattacgaagatttgcagaaatctctggagcaagcaaggaaattagctctaaggaaacaggaagagactgctgcatctggtcctctggctgtagcagaactggctactgcaagaataggtcaaaaagatgcagatgctgccgaaggagatgcacaacaaaataaggttgttatcacagagatggaagagtttgtgtggggcctacagttgaatgaaggtgacctcttttttgttttctgtgagtaatttcaaagaaatgcataggcagtgactaattattggcttcttttggtatcttctttcagagactcgcaaaccagaagcagaagatgtttttatggatgaagatgatgacatgatcatgtcacacactgtggcaaaagatgacatgagtgggctgg

SEQ ID NO: 86956 - DNA, 1076 bp, Oryza sativa
ctacacacattcttaacagggttcccagtaaatcagtccctaagacaccttttgaattatggactgggaagaaaccaaccctaaattattttcatgtgtggggttgtcctgctgaagcacaagttttcaatccaaatatgggaaaattagacctcaaaacaatcagttgtcattttatcggttatcctgataagtcaaaggcatatagattctactgcccaaatcagtttacaaagttcattgagacaagacacgctgtgttcttggaaaatgacataatcaaggggagtatgacacccagagaagttgttctggaagagaaacggaattatgttccaatgcctataattgaagaacccgttttctcaacacatactcatgttgcaccttcaatagaaagaaataatgatgcaacacctgctgaagctcctgcaactacttctagtagtgtatcaaatgatgagaataatgaggatgctcagcagccccagattatgatagatgagcaaaataacgaacccgtcagaagatcacaacgagttagaaagtcagcgattccaagtgactatgtcacttacatgaatgaagaggtgaatgaacctatgagtgaagaggtgaatgagcctatacttgataatgatcccatctcatttaaagaagcaatgaagagtgaacattcatctgaatggctaaaagctatgaaagatgaaatgaaatccatgagtacaaataaggtctgggacttagtagaaattcccgaaggagccaaaacagttggctgcaaatgggtctataagactaaacgtgaccccaagggaaatatcgaaaggttcaaatcaaggcttgtagcaaaaggatttacgcaaagagaagggattgattataatgaaacattttctccagtgtctactaaggattcattcagaattattatggcactagttgctcattatgatttggaattacaccaaatggatgttaagacggcattcctaaacggtgatctgtatgaagatgtatacatggcacaaccataaggttttgttatgaaaggaaaagaacatatgggatgtcat

SEQ ID NO: 86957 - DNA, 675 bp, Oryza sativa
ttattgcggaacggattgacaaccactgcatgtattctgaaagatgtagggaagtacatgacatatacaccccttccttctgacaagctggaaataagagaatccatagatcagtttccaaatcaaaacaaccatatatcaagtatgagtgcagtcaaggtttcaaatattggttagtaaaatacaggtaggagtaacttatgcttattctaccatacatttaggagcataaacatggattaattatcacaaataactgctaggaagagcaatcttgggacccagagagcatacaaaagaactagtatttgactctgtaataatagcgcttgaataaatgaactcaaagtacatagaatgtcaataaagaaaagaaatggacaatagtaccatagtattccagagtataaaaataacaatccattgcaaaagctagactggatactgcattacctatttacaaagttctcataaaaggttacctgtggtatagatagaaaaatgaaacggtctgttccaggtatgaacactctgcagttgtcttcatttgcaattcagcaagatcccatccatcttggatacttcgtctttttgcagacttatccactttgcacacacaaccaatttggagaatggcattgagctctggcagaattttcgtctcgtatattccct

SEQ ID NO: 86958 - DNA, 573 bp, Oryza sativa
ttcgaagtcaagcaaaacttaaccgttcgcatgctaagtgggttgaatttattgaatcttttccatatgtcatcaaacataacaagggaaaagaaaatttcattgctgatttgttctttcgtgagattgttcgcttgcatggagtgaccgccctccggcgctgccgcgacggcgcccttggcgacggcctgcacctccttgacatgctccggcagcttgatctccaacccggccgccaccacggcggacgacgacgacgccaccagtggcttcttgctccggtacgccatgtacagcgccatctgcgccacgccgaacaccaagcccagcacgttgggcagcgccacgaacacgtccttcttgagcagcccgtacaagaaccagatcaccgcgctaagcaccaggaagaaggatagcgagaatggcatgaactccacgctcttggtccggatcaccagcctctgcaaaacacaacaatcatcagaaccttgtcatcagctgctggttgatcgatcgagcgattagttagcaagacatcaagattgcattcgtttgctagcttacgatgatgct

SEQ ID NO: 86959 - DNA, 682 bp, Oryza sativa
attctgctttttagtgactatcatcatataaagaggcaaattgagtcagagatgattcaagctggtggggtgacaccttcaaagccttttcttgacctctcaaaaccagagcatttactaaaactgaaggatcgtttgaagaagtactgccaaaaggtgatatattaaaatgcatggattaattaaacctttttggtggcttgcaattactatacttttgtcccaatgcaggcatataaaagagtagttgacaaaccaattacagaagtgaggaacgctggaatatgcatgcgtgaaaattccttctatgtagacacagtacgaaggtccgtctgatgtttattagtatattttagtgtactatgttcattggatagttcatggatatgtaacagtgatttctattttagcttccataatagctcttagtggagcaaagtgcaattttctggttgataaacatagcattgttggctaatgctttcttcaaggtgctctaaaatgtgtactttgtttgaaaattccagctttcgtgatagaaggtatgagtacaaaggtcttaacaaatcatggaaaggaaaactggcagaagcaaaagccaatggaaattctatcaaaattcaggaagcacaggttcacaatgcattattatattatacatcaagaaaattagatcaatacc

SEQ ID NO: 86960 - DNA, 535 bp, Oryza sativa
tccatgcaagtgaacaccatagtgccaaacaccatgcaaaaatccttagtcatttttggagaaccttgtgggctaagttggggacgaaacttttattttctactacttgtcatccccaaactgatggacaaactaaggttgtgaatagaattttatctacaatgcttagagctattttgaaaaagaatattaaaatgtgggaagaatgtttgtctcatgttgagtttgcttataatcgttcgcaacattctactactaagaagtgccattttgagattatttatggccttctaccccgtgctcctattgatcttttgcccctcccaacttcagagagggtgaactttgatgcaaaacaatgtgatgaactgatgttaaaactgcatgagaccactaaggagaacatagagcacatgaatactaggtgtaaacttgctggaagcaaaggaaagaaacatgttccttttgaatctggtgatttagtttggctggctgttgttgcactcggcctcaaagtagggagacaaggtgaaaa

SEQ ID NO: 86961 - DNA, 742 bp, Oryza sativa
atttttctatctataccacaggtaaccttttatgagaactttgtaaataggtaatgcagtatccagtctagcttttgcaatggattgttatttttatactctggaatactatggtactattgtccatttcttttctttattgacattctatgtactttgagttcatttattcaagcgctattattacagagtcaaatactagttcttttgtatgctctctgggtcccaagattgctcttcctagcagttatttgtgataattaatccatgtttatgctcctaaatgtatggtagaataagcataagttactcctacctgtattttactaaccaatatttgaaaccttgactgcactcatacttgatatatggttgttttgatttggaaactgatctatggattctcttatttccagcttgtcagaaggaaggggtgtatatgtcatgtacttccctacatctttcagaatacatgcagtggttgtcaatccgttccgcaataaagagctatcgccatcatttcttgaaaagcaatatcgagatgcttgtcaagctcttggctctttgcatgaaaacatcactttccttgtaagaatgaattatcgtatctgaataaaaaaaaattgcacgtgctggtttagcatgctaacttctgactatttgattccttccataggtggattaccacacatcaattgatgcaggtagcaagcatgggcaaaaaatgttacttgaaaacagg

SEQ ID NO: 86962 - DNA, 797 bp, Oryza sativa
ccgaggaggagagagcagcagccgaccacgccaccttgctttgcgctgctacctccaccaaattaatacccccccccccctccttccacttcactcccactcccatccccatcaccaccttccccctcgtctctctcactctctcctcgccatggcgctccacctcttcctcctcctcctcctcgcggcgagcctcgccctcgccaatgccgccccgccgcccaacgacgagggcgccaccaccatcgtgctcaaggacggcaccacctgcaagctctgcgcctcctgcgacaacccctgcaacccctcctactacccgccacccccgccgccggtcgtcacccccacgccgcagtgcccgccgccaccttcctacccctccggcggaggcggtggcggaggcggaggcaccgtcatgtacacctcgccgccacctccctacagcggcggtggaggcggcagcagcaccggcggtggaggcatctactaccccccgcccaccggtggaggcggcggcggcggtggcggctggcagcagggcggtggaggaggcggcgcctacccgacaccgccgccgcccaacccgttcctcccctacttcccattctactactacagcccgccgccgccgttctactccagcggctcgtctgtcgccggcgtgtcggccatttcgtcggcggcggcggcgacattcacgctgctcctcactgggctcctactgtggtgagaactgagaatgggatagatctgctgagttaaacctatgtctttctttacactaggtgggtaatttg

SEQ ID NO: 86963 - DNA, 714 bp, Oryza sativa
cttatgataatttgcctcgtttgttagccaccattgcccagaggaataataatacttactatgacctacatacatttacatcgggtgatgatcgaacaaagagtgtgctgcaaagagcatttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaaccaagcaaacagatgagcaatctcgcagaccacaagttgaaggtgacgagccctccatacctcttggggcattacatgatgacccaccaacaatgagaaggaggtcagggt

SEQ ID NO: 86964 - DNA, 636 bp, Oryza sativa
catcaatagcaatataaacaccagccgtgaaggcagctgaggcaactagcggtgaagatgaaaacgcgcatcgacggtggtgtgaccatccaaccataaagacgaaggatccaatcgacggcaatgaaggcagtcgtcagggaaagtgaagacgcccatcaacggcggtggaatccgccaaccgtataggtggaaacaccagtcgtcggtgatgacgacagccgacagtgagacgttgatgcccaacaatggtgatgtgaccatcaaaccgtatagacgaggacaccagtcggctgcgatgaaagcaggccggcggtgaagatgtagatgcccaacaacggtggtgtgaccatccaaccgtataggcaaagataccagtcagcagcggacaaggcggccggtcggtgaagatgatgacgcacatcaacggtgatgtgaccatccaaccgtgtaggcgagggcaccagtcggcatcagcgaaggcgagccggtggtgaaaacgtagaccaaccagccatgtaggcgaggtcactagtcggcagtggtgaaggcaagccggcggtgaagacatcgacgcccaacaacgatggtgtgaccaaccaaccgtgtagtcagagacaccagtcggtggcggac

SEQ ID NO: 86965 - DNA, 738 bp, Oryza sativa
atgcctgcagtcgactctagaggatccccggcttcctgcttgttgatcaagttgcactcatgacagacttccttgatcttcttcccttggtttttcttctcttccttctcctcatcaacatcctcaacctttccctctttagcttcctcgttctcactagtaatctcctttgaatctgagagaggtttctgcttgttcgaggaatgccactcatgagagacttcattgatcttctcccctttcttttccttctcctcatcaacagttgcatcaaagccatagatattatcacctgccaaatagcatcaccaaacaatacatagtctttaaaacagggaaataaagtaacaataatcagtgaagtatatgaactatggccatcatcgttctgaatacgagtaactgaacaagccatttttatatgaaaaaaacgtaattatgtaaatgctactaaattgatgtattgtctgcacccaaaaagggaaaaacagacaaaaaaaaaacagctagcagtggctgcatccaaacgctgcaaaagtagcagctttggaacatcaaccaaggttacccgtgaaacaaagcgacgaaaacaggacagtgatcaagagctgatcagatcacaagggctgcaacatttgtactgttgttcttctctactccctctgtcccaaaaagaccgaaattcttcgattttcgtgtctaacgtttgatcgtccgtcttatataaattttttttat

SEQ ID NO: 86966 - DNA, 1296 bp, Oryza sativa
cagcgattacggggagctcggatgccgggagctacgagtacgacgacgaggccgaggaggactacgaggaggagctggagcaccacctccgcgtccaccaccacgagcacgccgttggggagggtcgtggcgagggagagcgagatggggagggggctgagggaagcgagttcgaggaggaggggttcgacgaggagtatgatgaggaggaagtcgagccagagctagaccccgcggagtacgaggacgatgaggcttatgcacgagctctgcaggatgccgaggagcgcgaagtagccgcgcgacttatggctctcgcggggatcagcgattgtgagtagaaaaggagtgctgtttcttcagttcatttcacatgtttcagttattgctgtcgataatttcaatttgatattgctttgtagggagacctgtggagcctgtagaggagcatgcgaatgatccacaggtaatggtctatttttcttgttagttggacaaattgtgtttgttctgatatgtggaaatcctagagttggatgaaatgatcttggagtaataacataaatgatgatatagtctccttaattcgttgttgttgcaataaaatttacacctacattatgtatgacaaccgaaatcatatggaatttacacttgaagtgatgaatgtgccttgcaactttccttgtttccacgcactgttgataaacgataagactgcccccaaattcattttttgggtaccttccagcatccaaaatccatcttattttcagttgaacctggaattctttttcttgctcaccttcagtttcatatttgagtgataaactcatgagcatccaaggtttttatgtactttttatcacatttacagatcatgacttctataagaagtgttggttgtttacatcaggtggatttttaatcgtttatactttagtagagcttgtactgtccattagttgagcaatagtaagaccagaggtggtatgtggttcatgctgtggcttgtcaaatttgcatgctgtcctgtttactccatggattttggcatgctatattatctccaatggaagctgcatacttgaacttgggaaaatgtcttttcattttttccttactccattactcattgataatcagcttttatgaactggaaaaacgtcatttaacacgttgatatatttttaccaaaacccaggatgcgtggcaagaggttgacccagatgagtattcttatgaggcaagtttcattgttatatgttagccttctggcacctggcactgcatcag

SEQ ID NO: 86967 - DNA, 1760 bp, Oryza sativa
acccggccttggccgagttggcgccgacgcggcgcctacgtggctgccacgcgggccggcgggaggtagacgacgacgccgaccggaacggacggcggacgacagcggcgagcggcggagcgaaccacggcgatacaggcgaaagcgagcacaccgggtggttgcacgagacgaggggagacgagccaacggctcggattcgccggagggagcttgacggcggcgaatcgcggcggcggcaaccggcggcgggagaaggggaaaacggcgacgaggtcatgaggggccgattcccggcggcgagagcacctacgcggctacgggaatccgatgctagcgttggattaggaggaaacgcatcgggggaggccggcgacgagaggcgcttccgagctcgggcggcgacggcggcgagcacatggcgagcggcggcaacggtcggggcggcgccggctagctacggggaggctactcatgctactacccgagtctaaggggaggagatggagcgaggagggagaacggggagatgcactaccgtgcgggcgaggcgcagtgacgagaggctgacggcgcgggagtaatctctccggcctcgggccggggaagaggaaggagagggcgcgcccggagtccccttccgcgtccttgctcgtgccggctcctccgacacgcgcaacgacgaacggcgacggcgaacagagcacgggaggcggcggcaatggcgtggaggcgaatgggagaggaaaggaaagggggaggcttgggtttataggatggcaatgtcggtttgggaaccgacttagggcgggcaaaggagagggctagcgctcggcggtcgcggccaaagcggcgacagggaggagggaggaggatgacgccggcgggaggaaaaaggggaaaagagggagaggaaagagggcttgtcccttgcctcttcgggaaaaggacgagggagcggaggcgacgcggcagagggaggaggagctctgcctctgtcctttggcagcttgcgcgcggagtggcggggccgaggcgatgacgacggcgatgacggcgggacggtgtggagcggagcggcgacacgggcgacaggcgcgggcaggcgcggcagaggctgacggcggcggcgaccaggcggtcggccaccacggcacgcgcgcgcgggaagcaacgggcggcgctgcggtttgagcggcgtggcttgggcacgcgcgctggcttgcggggccgagcggctgcgcggctgcagacgcggcagggcagcggggccgggtgacgcggacggtgcaggcgcggcacgggcggctaccacgcgggcgcgcgcgctgaacaacggcgcgcgggggccgacttcgcgggcggggagctcgccagggatggagacggggagagggagagcgagggggaggcgctcggcgcggcgcagctcacgcgcacgcgcgcgcggcgcgcgggcggaccggaagagggagggacagagagagagagatagccggggagggagggggagatgggccgagagagattcggcccatcgaacccgggggaggcaaaatagacttttgcggaggaattgatttgggaagggtttggattcgggattgaactcgacgatagatcggggatttgagatctgagatggcacggacactagacaacaagcaaagaaacaaatttcgcaattagggtttttaagagataattttcctgctaggcgccccgacggaacgggcgctacagaccaacccccctaacaa

SEQ ID NO: 86968 - DNA, 726 bp, Oryza sativa
cttgggccggccggcccatttagctcggctgagccgccccttttctctcgggccgcgccctagccgcccgaggaaaagtctaatttccctccccctcttcttttctttttcaaaaaggatttaattaaattcttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttgtcccgtttcgagtgtagtttcggagcccgaagacccgcagtgcgaggatttcgaggatcaagcccaagatctcgagcaaggcaagccacctttgaacttaattatgttgcttgaaaaatattatgcattgataggatcgcacttaatctgtttgtcccgtctgcaaggcagattggcagacctacctagtttgttgcatttgatccttcctttgttaattgttataccatgttcccttgtaaccatctagttgcgcctcgatattcgtgcactctgtgcgagtatcgacggtcgccttcaaacttaaaatttgaaaaacaacttgggtaaaacttgggttttacaaaagacttggaaaacccgacacctgggtcggtgcttgcgaactaaatgaatttccaaaaccgcggaccggggaacgtaccggg

SEQ ID NO: 86969 - DNA, 716 bp, Oryza sativa
ttcctgcagcccgaatctctgacacattcttgggtgggttccaagcaagtacagcttcaaccttgctgggatctacttggacaccgttggaggagatcacgtgtccaagaaatgctactcggtctaaccagaattcgcatttcgagaatttagcgaatagttgatgatccctgagcttttccattatcagcctcaggtgttcagcatgttcttccttattcttggagtatatcaggatatcgtcgatgaacaccacgacaaactggtccaggtattccatgaagattttgttcattaagttcatgaagaatgctggagcattggtgagtccgaaggacatcactgtgaactcatatagaccataacgcgttgagaaagcggtcttcgggatatcttcagatctgattttcagttggtggtaacctgatctcaagtcaatttttgagaaaactcttgctcctttaagttgatcgaacaaatcgtcaatctgtggcaacgggtacttgttctttatagttacttcattcagggctctatagtcgattaccattctctcagagccatcctttttcttaaccagaagcactagggctccccaaggggatgagctaggtcgcacataactcttactctccaattcttcgatttgtcttttaacttctgctaactcattagctgccattcggtagggtctttttgcaattggtgcggtgcct

SEQ ID NO: 86970 - DNA, 1257 bp, Oryza sativa
agtgctttcaggcacatgagctacacggaaagccgtagcaaactcatcccaagcaatgttagtgggttcagggtgtgcattgcagtaattctcccaccaatctgcagcaggtcctcttagctggtgagaggcgtagagcgtcttctcaacaggagtacactgcactaagttgagttttctatcaacatctttcagccaatcgtcagcctcgacgggctcgacggtctgagagaactctggcggacgagacctcagaaaatctgtcagcttggatctattgttgctcatgtgagggtggccatttccatgcgcattatgctgaaaaccggctacggctgcggctaacccttgcaagatttgtgtctaaactgccattaagtgctgcatgttgttttccacatgaggtggggaagggaggcgttcttctccagaattgtgactagcagtgcggtgagagcggtgagactgttccatttctgcattacgggaagctgtgtgatgcgagcggttactgcgacggggttgctcaacttctgcgttgcgggaagcagtacggtgcgaacggttgctgtggtgagactgctcattagctgactcatgatttgcttctggctcaactctaccatcctcaaaaccaaagcgggctggtgcacgagcagcacggcgggggcggctaaccatctaaactcccagaagagggcggggtaagagtcagataagcacttaggagggcaaggagcaaagtaaatagcaactcagatagcacacactaggcataaactggatttttcatatcataaaaacacctagtacaacgggtgtagacaagtcacagagctacgccgagcttgactgtgcgcacaccacctaggagaaccagactaccaaacaatacccacaacaaacacacgcacgcactacctcgccacgactccaaaagagttggcggcggaacaaaagggcctaacacacggacggctgctgaagactgcctcctctactcctcgtctgcctggctgcttcctgtagtcggctcctcagtcgaagaaacgtcgatcggctgacgcgaagggaccggcggaacctgtcgagggccggcagcagcacgggccgctggcggtgggggagctgggtagtcgaaacggaacacggtggaagaaccaacaacacgcttccgcgcagtgcggataaagcgtgggcctcggcgggaggaagcaactggggtgtgtccgggggtgtaggaagggctaactgggt

SEQ ID NO: 86971 - DNA, 1578 bp, Oryza sativa
acattggctttgaaccaaaatcaattattaggcacatcgataacaaattcaagtacaccataagctatgcaaaggcctggagagccaaacaaaagattattgagatgaggtatggcacatttgaagcttcttatgataatttgcctcgtttgttagccaccattgcccagaggaataataatacttactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttgtacctatggcttttgcatttgtagagagtaagaacattgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagtaattcaagaacaagcatcttatggagctctttaagaggttctgtgcacagaaccaagagaagaaatttaatgagttgtgggacaagttggatgagttgacaacgaagcaaacagatgagcaatctcgcagaccacaagttgaaggtgacgagcctcccatacctcttggcgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtgtacaactgggtaatgcgaggagttcggatacttccattggttgctattgttgaattcattcttcacggcacgcaagcgtactttagggatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatgagtgaggagatatatgggttcgggatctcaggatcttacacaacactgagtgcccaagttttttacattccagatccatctaagttaagggtgaaaaagggtcgacgccaaactagacgcatcagaaatgatatggatgagtcagaagcaggtgggaggactttacgctg

SEQ ID NO: 86972 - DNA, 1667 bp, Oryza sativa
gacaacgcctgcaggaccatcggccgcttcatcgccgagaggtccatgaacgccgacgtcttcgccatgtcctacgagcccaagaagaacgagaggatcgaggggaagcttggcatcgtcatcgacaccattaaggagcacggcattatatttgtttaggcaagttcagcttacaacgttgattaaaatgtaagtaggatttttttttgtgctattgccttcttaatgtcggtcttgtgatgttattctgcttgtagaattgcttgtttttcttacgattttgctcatgggttggtggtttacagcgaatgcaattgttttatctattgcttccactaaaaagtatagaaatcagacatacttatttcaaaaatatacttatgtttcaaataaatacagaaactcttcctttcaaaaataattcatgccttttttagttctgaagttggaaacacaccaaaattgtcctgtcaaatgtgtaaaaagactgctgtgatgttaatgctaatggaatatgtgagaatggcaggggtagggccttggaacccgttgatcatctcagttcaggtttactgagttgaattttgccagctagctgtgatcttaaaatatacataaatacgttgagatgataattcaggggatggatctcatcattcaaccaaacatcttagtaataaactgcattttggtggaataactattactaagttctattacattattattattatttatttggacaaaggaagtataacttccgggatctgcaccaactaaggatacacacaatcatatttgtggatggagtcatgtgttccaccaccacacaaatggtgcttcccataacatgatgttgatcattggtattgttcacgtaagaaatgtgtgggtttgtaaggaatgtagagcatgagtccctactgattgtcgaattttcgtacatcatgtatcagtaggatagccttgatctcttgttgattatcaggtatctgatgaatgacttccaagcgctgtattgttcatgttcttcaaataataactgtatgtttccaccagatgttgcgaggtttattgcatggtagctatgttcatctgttgggtagctgaagtctgttgtcccaccatgttcatcaaaaattatgtctggaagaaagtgggtgattaaacaattggataaatcaatttagcacagctacatattaaaagcaaaggtaagacctcagatttgcactgcctatggtgaatggtcctgcacttaagaaagaggatagtaaaatgaggctcacattctttactggttctcaaactatgctcctttcctaagttcaatattatcttgtcatgcttgcagtgcacagaaaccatcctgatatggatcttccctgcatgaatacacaaatgaaagtgttttttttttcgcattcatcttgtatccctggaaaatgaagtaatctaattgaatgtggcatgtcattgatgagttaattgggcattataccatcaggtgttcgaataggaagtcggacatctttctggttactcatgagattctcaaaggcataattgcttattgccctgttccgcatcttaaaggcattagctccttttaagcctgcagcaaaagaaccaagtttcatgcaagtaacttagtatacaatatatag

SEQ ID NO: 86973 - DNA, 637 bp, Oryza sativa
ttaggatgagatctcttaactccttcttggccggtacacagatgcgtggaccgcaccaaactgtgccttgatcgtctatggagaaatcggtgtctttcttctcttgtattctttttattaattcttttatcccttcgtcatctttctgagcctcccggatttgcgattctagggttggctgcaccgtcaagctggcagggacacctgactgtaccacggtcagcctcaacttctccaattctctgcacaggcggtcttggtcaggccgtatttgagctacattactgtaggccttgcgacttagcgcatcaccgaccacattagctttaccggggtggtcatgaattccaagatcgtaatccttgattagttccaaccatcttctttgcctcatatttaactcggtctgagtgaagatgtacttaagacttttgtgatcggtgtatacttcacatctgttcccgattaaatagtgcctctagatcttaagagcatgaaccacggctgccaactcgagatcatgggtgggataattgacttcatgaggcctgagctgcctggatgcataggccacaacctttcgttcttgcattaggacacatcctaagccttgtcttgatgcatcacagaagatctc

SEQ ID NO: 86974 - DNA, 659 bp, Oryza sativa
atgcaagacgataggaaaatcacttaaccctgcagcctggccatcaaggtgccatgctctccaatcatcaacaatggaaaagtttaatgatcttatccatgcctgcgtgcctgagaatggcacaatagggtcgtggtctccgctgcacccacataagtttttttttttttacagagcattaagcgtaagcgatcaggaagattcaaaacaatatgtaaataagaaatgagcctgctgaaaatattgattatgctaattgaacctgtacacaagagcacggtaacccctggtggtgacgttgaaatggcattctatgctgcttggaagatcacgtgtgtaaggaagacccgtagggcaccttatccattccgtcaccgttccctatttggaaggtgatttattattgacttgtagattaattagcccctccgttttaaattatttatcgctttaattttgttctaagttaaacatttctaattttgactatcaatttataaaaaatcaataatagtttagcaacatatgaactatatattctgaaaacatttctcatggtgaatctggaaacatagtattatgttgttaaactatataaatttttaaaaattgctagtcaaagttagtaatttttgacaaagatagaatagtaaaaggct

SEQ ID NO: 86975 - DNA, 657 bp, Oryza sativa
tggttgtagagagtgtaagttcaatgataaagcatgacaggaagctaagattacttgttacagcttgatttcattctctctaagttcaacaactctgacgctttagtgtttttgcttgttctcccggatacaagcgtgtttttttgggcagagtttggagtatatgtagtttattatttttgtagtatatgtattgttacgattgttatttgtaccgcccgtgtttgtaaaatatggaccacaaatcatgtaacccagtagactactagaaagacaccaggtttccccctcgaactgtgcccttttgatctggcgtggtgagattggtgattggtacattacatttgtaccatcagtttgtcaggtcaagacaaattaacatggcatggactggtacctttgttttcggttgctaaatgaaatagtacaagtactttggttcgttcttttttcccatcctggtaaatccaaggtctcagttattcagatgttgcagtttatatatttattactaacatttgtctgctctgcagggctttttaccctttaattcctttacagagatatattcattattggggcctcgggggtcccaggtccatcgataccactaccgtgctaataataagtgtactgagctttattcatggtcacacc

SEQ ID NO: 86976 - DNA, 1592 bp, Oryza sativa
ggtctaaagtccatatcgatatccaataaactaaatagaaattcagaattaaaaaataagaaaaaaaataaatgtagaggttagaatccatctagaaatccattttagaaataaagaaattcaaaattaaaaaatatattggatgaagaatatagagtccataaagaaatagaatttaaaaataattaaaattccgaattaaaaaatattgaaagataagtttagaatccatatatagaaatacaatttagaaataatataaattaggaattaaaataaggaatattggaagaagagtatagaatccatattagaatcttaaaattcagaataaaactaataaaattaaagtagaatttagagtacatatagaaatacaatttacaaataactaaaattagaaattaaaaaaggaatattagaagttcgctctcatgagacacgcaaaattatgttgtcattttaatatatttgaataatacattgagaaaacatatatgttattataagagagaaactataatgatgctagctgcgcaatctgcgcgggccaccatgcttgtttgatttattgttaaatatacttttatgtatacatatagttttacatatttcataaaaatttttaaataagacgaacggtcaaacatgtttaaaaaagtcaacggcgtcaaacatttagggatggggggagtagtttattcatagtcattttacatacacgtaaaacaacttcaatctgctaggtaaataagttcaagctggactagcttacaatggtcttgtactccatctagtgtaaaattaatattagtgaacgctaattgctagattcaaatacttcgctcatagcctagcaagcaactactatctagttgagttattccatccacatcctcctcctctgagatcgcagtcaactcggaggagtaaaggcaaattgaatccatcacaggcacaggaggaggcggcgtgctatctccatcgcagaaaaatggcctcggaggcacttgcaacgcatcaacatccccttcgagcatctctatgacctcactcattgttggccgatcatatgatttcatctggatgcaccaaaacacaacaagccacagcttcctctctttctcatgcatgtcaatagcactagatatctcatcaacttgttgatctactataagctggtcatacacccatgctgggtagtatgccctactcgaatttgagtttgcatttgggtctgcgttctttctacctccagccatctcaagcagcagcattccaaagctataaacatcggatttgctggatatgacgccaaaactacgacatgccatctctggagccatatacccaaatgttcctcgtaaagccctatctgacacaaagctcttctcccttgggtacaattttgcaaggccgaaatcagcgacctttggaataaagttgtcatccagaaggatgttgtctggcttgatgtcaaagtgtagaatctgcatctcgcacccttggtgcaggtagttgatccctctagcaatgcccagagcaatctcattgagcttgtcccacgagaagcttgagtattctatagtgtc

SEQ ID NO: 86977 - DNA, 629 bp, Oryza sativa
agaagttatgctatgattgccccatatgacgtagatggtaaccgtattacgtacccttctcttgggggacgaaactacaactctactacccctgttaaatttacaaaactagcaaaaccacttaaagtcggggatacagaggtttttgtagaagatgttagtctatggaacggacaggcaccgcaagactaccaacgtagtattatcatgtggggttataaaaactcgttcggctatacttatcccgatggaacgtatagtcagctaatgcagatgaggacatatgatattggtgcagttgacaccacagctaacaagattacgttaaacaagccatgggcagttgcaaacccaaatagttcagatgggattttcccagtagggcatacacttagcccaacttctgacggctccacatatttgtatttgaatggtcacgtaaatatacaagtacctactacgtacaccaagtacagccatttgattagtggctcttctgagtttgctaatacaacgattatcccagtagaaacaggttttattcaacttggattcttgttgaaccgtgatacaacaggtgaaaaatcttggctaaatgggttacgtctacgtgactatacagatacgta

SEQ ID NO: 86978 - DNA, 689 bp, Oryza sativa
aaggagagagactccgatatatccaaaaaacaagaagaaagtgaattgcatctctacaaaatgtaaagagaaaccattagtgttgtagtgtaaaactaaaccattagttttctagaggactaggagtcattcaaaatatgttaaaagaaatgttaagcacctgctaattcattagcaaataggcccaaaagaccaagataaagagctgaatctccgaccttcaagataaatcataatatggtatcaatgaacttgtgggaaaaaaatcaggacaacacaacaaaaacagtttgatgaaattttacacaaccgagggactaaatttataggtattatcatgtaatgtgtacttaccgatggatacgatttcaatattgcgacaattgctgtgtaaatgaaggcaaggaagcatggacgatgcttcagacggattgccaatggtaataccataaaaacaatgttcatattgaagactataaggaagaagcttctgaaaaagtcaaagacttcagcaaagaagtacctgcacaacccctttaatgagacaaatggaatatcattgagttagttacataatttgatcaaaactcaccataatacaccaatatttggcgataggtccttaacggtaaggataaaaccatatgtcctgcagaaacacagcacaagtcaataggtaatggcaaata

SEQ ID NO: 86979 - DNA, 2224 bp, Oryza sativa
atactccgcgtgtcgaggtccgccgtgctcagcttcggcttcttcatgggggtcctcgtcgtggactcgtggtgctcaacatcgccgtggtgctcatccctcctcttcttcctcctcccctctcccctctcttcatctctctcccctctcctctccccatctcccctctcttcacctcccgccggcggagcttgcatgagcagcaccagcagtcgtaggagcaagacgggatcctcaagtacatgctcaagatgatggaggtgtgcaacgcgcaggggttcgtgtacggcatcatcccggagaagggcaagccggtgagcagcgcctccgacaacctccgctcctggtggaaggagaaggtccgcttcgaccgcaacggcccggccgccatcgtcaagtaccaggctgacaatttgttggcgacaatgccgtgccggggtgcgacggcaacgtcggcggcgccgcgccggcagggccgcacttcctgcacgagctgcaggacaccacgctgggttcgttgctctcggcgctcatgcagcactgcgacccgccgcagcgccgctttctgcttgagaagggcgtgccgccgccgtggtggccggaggggacaggcgtggtggcccgaatccgtcgtgccctcaccatcgcggcccccgcccccgtttccaccgtcctccacgccgccctccgacctcgacggcatcctcgccatgggcggcgacggcatcctctcccgtcggcgccggcgcgcgccgctccctctccgtcacgcctgagagagagagaggagagacaggaagagaggggagatagggaaagaggaggaagaagaggatgggtgagaatgacacctggggcccacatgggccccaccatttttattaatttatgtgtgaaactgacatgtgggtcccacgaggtttattgtttttcttagatcaaattgccacgtaaacgccacgtcagtgtcacatcaaatggagaccgagtcagattagccacgtaggcgtcacgtcagctaaaaccgctgaggaaccttatctgcactggttttgacagttgagggactgttgtatctgatttttcggttggaggacgaaaatcggattcgttgacaagttaagagacttcagatgaacttattccttcataattccacgtctctcggaagaagaatgttaggcctgcttcattcgtgcaaacggcagacaccgatcgcaaacggcagaacgtgtacgtcctgaggacgggccggcccagatgtaggaaaagattttttttgaaaataaaaaggagaaaagattagagcgcacacagacacactgagacgagtatcctcaggttcatcagaattttcagattagttggaattgcctttcatttgggggtttgcgttttcataaaactgctaattacgggctctctttgcactctgcaatgctgcaagcctgtcgatccctcaccttctctgagccccctctaagcttatggtcccctgtcccaaatctttttttttcgaggggacagacagggagctcctgcaattcactatagaagaagagagttgatccagtttataagggaaaccggacccaaaaaccttacaacaacacggttattaaaggaaaaccagcaaaaaccccgacattgacaaaccgaacctaagtacagccgtccaacaagagataaactcctaaaacgaagcctttaagaaggttacgccgacaacgacgacatcgtccgatcctaacgaatctaggttttcacccggagaaaactcttgaagtggagttgaacgagggctccagtagcaacgccttcaagaaggtgaacggcgtccaagggtgtcgccgttgctagcaccgagagcggagcaagactttcgccttggagcacccatcaaccatagcatccacgacaggagccaccaaatgtcacctgcacaccgaggatacctgcgatattcacaccacctgcacgacgaccggactccaaccaccccgttcccacccgaggacgcgccggatctgggcaaggagccagatccggctgtcttcctctccaccaacgccggccgacgcctagaggggcgccggaggacgccagtggcagccgcggggtgcctgcgtgctctggccaccaccggccggcgccggatccgggtgcgccaccgccggatccgcgggctgcaccattgccaccccaacgccgtcaccatccccgc

SEQ ID NO: 86980 - DNA, 1284 bp, Oryza sativa
gggcgggagtgactacgttagggagatggaggtcacggtgcgcgtcgtgcagaccgcctgcaccctctgccagcgcgtgcagagctcgctcctcctccccgcctccgcctccgcctccgtcagagtccactccaagatcgaccgctcccccgtcaccgtcgcaggttggtcttgttgccttcactcctgagcgagctcgtagcactggtcagttcgtcgccgcaatttagtatgcctccaaaatccatagcgagagattagtcaaactggagctccatcatattagaatattcagattgatactgattcattgttcttaattcagtccgaattcctaaatggaatggttgcttaattagttattgttgttgactttgaaattgagcgaccgtgtgcgtagtggtcttatactcttatgttctgtgatttcctaaggaagagaattgaatacttgcacttgacttgttggcctgttagaacactactaaataataatggtccactaccaggttcagtatgagtacaatggtagtgggtagctcatgctccatgttgccaacataccagataccagatagctcataataccacatggtcatatgtcaaatcaaatctgatctgatgcaatgttatttggcccacaaatttaagaagatctttgtgttaaatgccatcaagaattgtgactttgtggttggtatcttttggatgcaataaatttatgcttttgtggtaattggttaccagtagtaatctttccttcaaacgttattccagattggggcgtccaagcgatagtaagctggctactctcggattgctttcaagatgaaaacatatctatagtagccgaagaagatgatgagacgctatctagtagcgatggtgcagctttgcttgaatctgtcgttgctgctgtcaatggttgcttgattgaagctccgaagtatgggctgaggtccccagagaaagagctcaaagctcatgatattcttcaagctattaggaggtgcagctctatcggaggtccaaaaggaaggttttgggtgcttgatcctgtggatggcacgcttgggtttgtacgtggggaccaatacgctgttgctctcgcgctaattgaagatggggaagttgtattgggagttcttgggtgcccaaattatccaatgaagaaggagtggctcaactaccaccaacgatattacaggttgatgtctaaggtttctcctcccacatcaggatcctggcataagggttgtgtgatgtatgctcaccgaggatgtg

SEQ ID NO: 86981 - DNA, 610 bp, Oryza sativa
cttgcgcaacgtttactgcccacgccgcatagttagccccagcgaatacaggattggtcccagtaacggttttaagttctgacaattcaggatgctctaatgccgtttgatgaaattcttctaggtattgtttagctttttcctcagatactgttttattgggactttcgctcattttatttttgatagggccatgctctttcaaagactctatctttgtcttagttttatcccttatgacatcccaatcaagatttatgcatgacaatgagctacctactgatcgtcagacacgatttcctgcacaggcttgagccatatactcatacatcgcatcttggccacgttttccacgggtttcaaaattaatctcaagttctacgcttaacgctttcgcctgttcccagttattaatataatcaacgctagaactcccctcagcgaagggaaggctgagcactacacgcgaagcaccatcaccgaaccttttgataaactcttccgttccgacttgctccatcaacggttcagtgagacttaaacctaactctttcttaatagtttcggcattatccacttttagtgcgagaaccttcgtcagtcctggata

SEQ ID NO: 86982 - DNA, 655 bp, Oryza sativa
cgctaaggggttttgttttaggaacagacggcggtgttttgctgacgcctcgaatcgacgcttttgttgcgacatgctaagttttcccccctattgctagtaggttgatgggtcgcacgcccggcacacatgttttggccttgcttgtgtgtccataactcaaaataggtgacctaacggccgccgcccgactaaacataccaatagtcaccaaattcatatgggctactgaggagtaggcaatgatcttcttaagatcgatctgtcttaaagtggtcaaggaagtatatattatagcaatcgcgcttagagtataaatgaaaggagtgaaacaaagtgtcgcttcgggaaacatgggtattgaaaatcttaaaaacccgtaggttcccaattttaaagaattcctgccaagatgacggatccagccgtaggtgcctctacatgggcttcgggtaaccaaatatgaactggtaccataggcacttgacggcaaaagaggcgaaaaaagcaatccatagaaggatttggcgccgctcactaaattctgtggttaataaaatttgtaaatcggtggttcctgtttggagaagaatcaacagaatagctaatagcataaaaacggatcccagtaaagtatataggaaaaactgatatg

SEQ ID NO: 86983 - DNA, 623 bp, Oryza sativa
gaaacctatgatggcaagttatcaaaaaccaatatgactagcccaaaagtattaccacagaaaagaatacgaaggaatcataaccacactggaacaaatgcacagaaaaataactctactctaaacttgtagttgcagaacaaggactaagtctatctaagattgccacccatgcacacatgagcatcccatgtacacatcaattacaagtcatgatgtgctactaaaagttctctttcatctcacatatgtagcaaccaaatggttctagaaaacatgaaaaacactatatttcagaaagaaaaactttactattttttttcgacagcgtcaaataaattactgtacattacataaatgcaaacacacaaacctgaacgttaagataatcacagatagcatctaatatgaactgtatctcatcctcatgtggttcaggaagcattgttattgctgtactagagtcggatgtaccagctactgtcctttctaaccatggcagcataaatacaactctaccatccttggttttagggacaattagcccaatcccatcaggggaataataatcaggaagtacaatgtgcactccactgcttggactgatcatgggcactacgtaa

SEQ ID NO: 86984 - DNA, 1042 bp, Oryza sativa
ttctttgtgttctttgatgaccctttcaccttctgaaggtctcatactctcgtgtcaccatacaggtcctcactattgatggaggaatggtaatgtaaaaaggcttgagcggtcactggcaatcttcccggcagctgtagtagtaaaatcatcatgtaatgaacatcttttttgtgaagtattatttactgttgagatacccttacctataagagacttgtttcttgtgtagtttataatggtattggaatagctctaactctgttcgtctttgattcgagatcaattgtagagcacatagaaattttggacattggtttcctttttgcgaacaataatgatgtataatgatctcctagtttatcttcgcgttcgataataaacggattatatgatctgccatgctcgtaccatagtagcatcctgctaccatttctcctttcatctgactatttgaaccctgcaagctgttccaaactgatagtttgtttaaccgctctacaaatttcataacgacaaccaccatgcaaaagcaccacattcagttcagcacaccacataattcgtattaaccaagttaaccgaagacgacgatatgagattagatatatcaatgttagcatgcaagtactcaaacccccgtcacattgtacttgaccacaaggcatgtccatacatgataacatcaaaattcaaggaactcgagggcagataaattgactgagtgatgtgctaaacataacattctctcatgttccctgacctacgccttgatggcatacttcctcatggggaaatacttctcgcgcttcttttccctctccgtcttcagcgaaagctgtgatatggcaaccatggaaaatgtcagaagacggatgcaagtataacataactagattcattacaagacactagaaaattgaacataagtttaggatgacaaatgacttcatgtttctataagaattgaaaaaggtgagccttcatttttcaaagaatgcagcaaacaagtcctttatctacccttctctcttaatatctt

SEQ ID NO: 86985 - DNA, 705 bp, Oryza sativa
ttattggcagggggaccttttaacttactcaccaggccacacagcaaatttgcaagtgcacaaagatcccaaaggatggcataatataggttcatttgcaaaagcagcatttagcaaaacttttaaaagaagtaaaaacagtggagtgattaatcagaaattttaatcaacactgaacagcacacccatgctgcacaggcccaaccatcctgaacaaccatacccggctgtacagattaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccacaagacacagccccacatcatgtcaccatgtgcctcagtaccaccacggtacctcggaaaggagctgtgacattacccctcgcacaacacaatccaccacagtgcaccattcctggatcataatcacccccctcaaaaaccagaggcatggactccccagcgactcccgtgggcttatctccgccacttctcagtctggtgctctgcaatgaaccatgctatacgaaaggtaaagccgttgcccacgctggcttgtggttggcacggttaatgtttcacaataatacctcgcgaacccgtcctt

SEQ ID NO: 86986 - DNA, 1657 bp, Oryza sativa
ttcaggcttctgctcatagagactttcatttggctggaacaaatggcaaaagttgttagtacagaatttcaatttacttgaggagaaaaggatggacactttgtaattgaaattcactgggtatttgggtatatttcattgttggcaacgcaattcaaatcagggctatggtttgttaagaagatgaagctctaactcaatcggatatgcagagagcatacctttgacgtaagtttccgtgcaccaagtccaccggtcttatttccaggcttcttcgcaacaattggcttcttgaaagaatgagttggagcccttggtgaacgaataacctcaggctcagtcttctcatttgcaacttctttagatgcctctgccagcttaagatctggaattgcatcagcttgatttgtaggttgtgaagctgcaactggggaggacggccaactgttgttcccatcttcagtggaatttttagcaacatccttagcgagcaactgccggtataagtcagcagctcttgaagtatactttgcttcaatttttccaccatctgtccaaccatgctgcttgaagaaagcttgtgcacggttgttacctccataaaccatcattttcaattgttctggggtccacgaatccaaatttgttgacctgcagattgcagcagtcaactcaacgggtttccagcaaaaaagaaggccacaactaaacaagaagttcttatattgtttagcatgtaaattctgtagtcaaatggtaagaacatatctaacgaagcgttgtagttacgtcgatctctaaaccaaatttgacagagcttaaaatttaattactcataagtagaaatggtgtgattgtgtagttgatggcaaacagaattacaacacagacaaaataacttcaagcgcaccacccatgaaatcttcagccaatttactacaagatactattgtgccagtttaattgagtgacctaaaaaggaacagtgttatattggcatcccaaaaatatatcgcccctagtagattgaaaaagaaaaggaacagcaccatgaaaatatctagctttgaagaaattatcatgagaatctagaacttccaggagaatgtagattgcagaagtacaaagagaatatgatgcaaaccgacactgcaggccatattggattttcttttagatgtaagaatatattggattatcagataccaagtaaatatctctgtacagtttaatagatatgacataaagatgataagtttgcacacggctgcgaatcataacagaatgtgataaattgcaaaggaaaacataaccggcaggccgaaattcagaatttagtagagagaaaaaaatacatgattagctcaaggcacctcagtaaatgatatgaattgtaaggcaggcagacatagaaggagtgcgggggtgtatgagggggaacctgacgaaggagacgtgaacgccgaggctacggtggacggcagagcagtcgatgcagaggaagacgccgtaggtgacggaggcccaggtcgggttcttggcgttgcagtcgaagcacatctgcaaattaggcatacgcacatataaatatagtcgactcgtaagagaaaaaaaatcacacgaattacagaagaacacagtctctctcacacacaca

SEQ ID NO: 86987 - DNA, 736 bp, Oryza sativa
tcctgcagcccttggtgtatgggataaaaaggaaactgatttttaaccaatccaatctactatatctttccaaaacaaacttgactactttcaaaatcaaaatttggaattcaactttcttcttttcggccccaacacaggcccggccaaaacaaacacacacaaggatcggcaaccttaatgcaactaaaaaactccaaaactaaccgacagaaacttctgaaaactacaaaaataaaaccgtggcagcgagccgattccgttttcgtaggtcccgacaacaacagagacacggtggcagcgacgactgtggtacaaaacgtgaccagaactcgaaactctaaacgaactagacgctaagaccagcaacacgacgtgacgatgcaacacaaaattcaacaaagcaaaaactgaaaagaacaatgcaatggcacaatatggctaggtaaatgatacgaatttttttgttggctattttctggttataggaagataaaaactcaccgagcaacgaaagctctgataccacctgatgaaccctgagttcctctcgacactcaaggctgttgttggcccgatcttttggtgagttgtgataactacgatttgggagaaacgttgacgatccgactacaaccgtacgagacgttgtgttgcgccttagcgatcgatacacctctccatgggttgctgatcttgccggtgcagatcaaccctatttctgcaagcaaatcga

SEQ ID NO: 86988 - DNA, 634 bp, Oryza sativa
tccgccgcttcgactgcccccaggtgtacaagcacttcatcggcaggtgggtcttcgggcccgacccccaccaggaggacaacggcaacgacctccgccccggccgcctccgcgaggtcagcgtcatctccggcctccccgccagcaccagcaccgagcgcctcgacctcctcgacgacgcccaccgcgtcttcggcttcaccatcaccggcggcgagcaccgcctccgcaactaccgatccgtcaccaccgtctcccagctcgacgagatctgcaccctcgtcctcgagtcctacatcgtcgacgtccccgacggcaacaccgaggacgacacccgcctcttcgccgacaccgtcatcaggctcaacctccagaagctcaagtccgtctccgaggccaacgccaacgccgctgccgccgccgccgctcctcctcctcctccaccggcggcggcggaatagcctttttcttttctttttggacctctctgcaatttcacttctattcagggaggtgcttcgaatttgctccatgtctcatgaagttggaggaggaagggtcagcttctaatacatctcattcctggtggtgctgcctgtaataatctcttcatcttcttttttcctctcctcct

SEQ ID NO: 86989 - DNA, 708 bp, Oryza sativa
atcaggaagtgagacacacacacaaaggtaagtaaaaattccaagcaaaagaaatccaggaagagaagaggaggaggagaggaaaaaagaagatgaagagattattacaggcagcaccaccaggaatgagatgtattagaagctgacccttcctcctccaacttcatgagacatggagcaaattcgaagcacctccctgaatagaagtgaaattgcagagaggtccaaaaagaaaagaaaaaggctattccgccgccgccggtggaggaggaggaggagcggcggcggcggcagcggcgttggcgttggcctcggagacggacttgagcttctggaggttgagcctgatgacggtgtcggcgaagaggcgggtgtcgtcctcggtgttgccgtcggggacgtcgacgatgtaggactcgaggacgagggtgcagatctcgtcgagctgggagacggtggtgacggatcggtagttgcggaggcggtgctcgccgccggtgatggtgaagccgaagacgcggtgggcgtcgtcgaggaggtcgaggcgctcggtgctggtgctggcggggaggccggagatgacgctgacctcgcggaggcggccggggcggaggtcgctgccgttgtcgtcgtggtgggggtcgggccggaggacgcagctgcggatgaagtgcttgtacacctgggggcagtcgaagcggcggacga

SEQ ID NO: 86990 - DNA, 1217 bp, Oryza sativa
ttatagactcattggatgaggaaggtttgcataatctagataatgcaatggaagctatggaagtagatttgggaacaggaaaaaggaaaagatacggagagggttctgtaaaaaatgaaggagaaagagaaagaccagccagggcagcaggaagatggcctccagaaaaagaagaatattcatatcattatatcccaggacagtataggcacatgggcactaaaagaagagattttgagaaaccaataaaatttcaaaatcaaaaaagtgatggggctatactaaatctagcagcacatgatcccatagactggccaaatatcattagtatttggaaggggttaatagttcaaaaatacatacaaaatcagcataatatagggaataaggtggaggatatgataacttatttagaaacatttttgggtgaatctgctaaagtcctatgggaacaatgggttgaaaagaatcctaataactatgaagagctaaaaagagcaggaagtaatcctcacaactttgaaaatatagtatctaatattatcatagctgaagacccagaattaggatatacaaccctgcaaaatgaaagattaaaagaaatagaaaaattaactttaacaagctggaaaggtataaaggaattttctcaacattatctatataatgcaacaactgctaagcaaggatacaataagggaatagttgagcgatattttaataaactacctgacccattaggtagtatgatttttgaggaatataaaaaggaaactgaaggagctgaaattaatatttcccaagccataaccttcgtgttcaaacaattaagaaaaatatgcacaggaatacaagcccaaaggtcaatgaaacattctgattataatttttgcaataaaataatacaaatacctttatcatatggagaagataggcctagaaataaaagaaaccatagatatcaaagtagaaatagcaataatataaagacaaagaaaaggtacttcttaagaagatcagataatagagcacctttcttacataaacgaaatgtaagaagatataacccaaagaaaacttatgataagacatgcagtgtttcatatgtaattcaccagatcatttaagtagaacttgcccaaataaagatcaaaaaagatattctagtacatatgaagaacaagagagagttttaattatagatagcgtaaatgaaa

SEQ ID NO: 86991 - DNA, 1762 bp, Oryza sativa
tgagtacagtggatagtactcagtcttgctctattttttccccaaccccagagtgcgagtatgtgtccgatggcgggttctccgaggagtaggcttcgtccgtgccgtcgagggtgcctctggagtggtattcccgctgcagttcaagtccaggcttagccccagttatcttttgtttttccgctgcatttatgtaagacttttatgatgtttgtaagacatggatctgaatgtcaacattgtcatttgtgtacccggccggtcctggacggggattttaatgcacattctgcttggaattctattcaggaatttctgggcatgacagacccacttctcctcctcctgctccccaatctccccgtctcctcatcctccccaatctagtgaaatagcggagggatccatgcggcccgcgtcggggctagcgttgccgttgaaagtcctttcggacatcgagcactcatcgatccaacgaaggtcccctcgccgccatcctccgagcactcatcaatcctggggaaaactctgcatgggatccttgtttgcccatgcccaccacccacctcggtccgccgtagcaacgaatggggcaacccagctattgagtgaaaacacggcggtctagaagatctgcttaactccaatgcaggtcctactcgagtgtgtcaagggcaggctaggccggctaatttgatcatgcaataagcaataaagataaaagcatagttagtcagccgataggccgatagagtatagttggtgatctcagctgatgtagtagaccaaataggctatggactggatagattagtgaataacaaaccctaaacatgcctcaccgacgataatactgcctattaggtttgataaagaagcataaagacaatattatgaaaatagccaatggaacaatatttagagcagaatctatagataacgataaagtactagctaataatttagtacgaacttatataaacaaatcaatctatataaacatttgaaatcatgatcagttactaattcaaatagcccagccgatactgatctagcttgatataattatataggatgatctgtctaaataagtggcaaatatacataaaaccagtaaagaagcatgtatattagggtggcgatgcgctgaagttgtattggattctctctcgtattacagtggtatggggttcatatttatactccgagtacagacttagtccattatggacacgattcaaacctttctaaagataaatacaaacaagaccatagacggcggtctcttgccaaatctaacacaaaccgactgaaatatcctaattaatagatacaattgtattattcgagctctatctctaattgataatgacgggtatcccgatctagacccaaaccgagcccaagttataccatatcggctgtatcggccatcaacttcatcaaccttgatcaacccatattctatttttagccgatacgatatctagccaatgcgtagtctgactccaaatccaactcgattcaacaccaaatccgcttcgatcttcttccttcttctccgaatctaatgcaaaattccgttgttaacaccagccaccggcagcatgtgtcgctcgctcacgcctcctaggactcgtatcacagaagctggaagctgggagcttgggactcgtagttccccttcgctcggatccaatagcggttgggaattgcggcaacgagagcgacgggctcaactggccgggcccctaccacgtac

SEQ ID NO: 86992 - DNA, 6707 bp, Oryza sativa
ttcagcaaccaagcccaactagaaaaaaaggagtcgtttatacaaacttctactttatacgaatggaaattagttaggttaagtagtgaactcaccagttcctgatagacgacggcatcacttttgttctcaaatgtgacagagccgtccgggttgaccttaccccttgcccgcgcccagttgcgagctctttgtttagggatgtctgaaaacggagcagggacattcgctgctgcagcggctgcatcttcttgggcccatattgcctccttgccgatgtaccctacggtgcccagccgatgtgggtgctcattccgctgttgcagtaggcgatgtgcctcgcttgattccctaaactcttgggtgttcttgagagagcagaattcctcccacaccgtctcggttatttgagggtattcatcgaacggcgtatgattgccgggcgggttgacaaactcggtgaagagcttcgacttccgattcttccaagctttacccatcttctggaatgccttccgcttgagcctatcctttgcttcagccggaaatgtgaaccatttctccattgccgtccaagctcgctctttctcggcttctgtgaccttgccgatatctttatggaggatcccgaagttctcacgtgccgccagcccgcagcagttagaccatcttccaatgacagtcctgggcgccgtgggcctaccactagcgtcaacttctcttataacttgcactatggtcggccatatattttgtgaccggggatttctactcgacctacttgcacttgtcccgcccgacatcgatgtatgttgttcctgcggcaattctgcagcacaaacaaaagggaacatttgctaaggggtgctagctaaaatttagtggtcatgtggtgaaaatttgtcctattaattaccatgaatttcgggttgttcgaccgccgttgtcgagggatgaccttaggcaagtgtctccgtggctgggtttgcttcttcctggatcctcgcaggtgttggggagggtggatttgcgccgggcgttgtcatggtctaattttcgcgaaaaagcttataaatttcctaccattatactaaatagcattaaatccaatgtaatacggggtatactatgaaagatatggcctcagttttgctcagaaatatgcatcaattaccatcatttgcatgaagggaaaaaaagaggaaatcacaacatcaaaatctgttcttatgcataaaaaaaagaacaagtgtatatagtctcctcttatcaaactagaaaaaagaacaagtgcagaaaatatgttcttatgcataaaaaaagaacgtagatactctgttcttatccataaagaacaagtgtagaggtatataaccactgaatcaatcatgcaaatttaaaaaacagcagcagcaagggtacagatagaatgttattgacataaaacagcagcagcaggagtatatatgccacaggggcagcaacagcagggggaaattcacataaaacagcagggtgaacaagtagccacagtaagaccaatagcagggcaaagatagtccacaggggcagcaacaacaggggcaaattaactaaaacaacatgtctagatagtctcctcttatcaatccagaaaaaagaagaatagataaaaaaaagaacaagtgtagataatctgttcttattgagcaattcatcactggccatttaacaaggaacacattgggcagcagcagcaggggcaaagatagtccacaggggcagcaacaacaggggcaaattaactaaaacaacatgtctagatagtctcctcatatcaatccagaaaaaagaacaagtatagataaaaaaaatgaacaagtatagataatctgttcttattgagcaattcatcactggccatttaacaaggaacacagcagcagcagtagcaattgtagattaaaaaaaatgaacaagtagcactaaatcatgtatataaatcatgtatgtggcaacagcagcaagggtatataagtcatgtgtataaacaacaattcatgcaattcacctattcatagacaacaagggtatataaatcaacaagtgtagataatctgcggccaatctatcaattctttcatttgaactaaatttcaaaccctaaacctaataaagttccttaattatcaaaaaatgacagaaaacaaaatgcatggagaattttggtgtctaggtcggttccgtccatggactacactgaccaatccaccaaaattccccatgcattttgtattatgtgatggtttgataacctcggaactacattaaatctgcggccaatcaattaattcttccatttgaactaaatttcaaaccctgtatatgctttatttataggaaaagggaacataacccctaactagctagctagacaaactatttctagctagctaccctacctagctagaaacactgttgccaatctatcaatccatcctttttcagctaaatgtaaacattatccccaaaattcaatagttctagcaaaagggaacaaaacaacatataaagcagtatacactccatgaatggttacatgtcaaaatggcacttaaatccacattcaagtttcaaactagctacacattcaagttttaaataacagttgcaacaatctgaacagaatgataaaaaaagagcacaattatacatatgcattttcaattcacatagaaaagagcacaattatacatatgcattttcaattcaaaaagagcacaattatccccaaaattcatcgttcatccaaagttcatcattcattcatccattccattgcatcatttattcatccatccactgcaccattccattcatccgtatcagagagagaggggtacctggagaggagacgacgagcagaggaggcggcgcacggcggcgatgacgagtcccggccggcgcacgacgcacggcttctcggcacggcggcgcggcggcggcttcttggcacggcggcactgaggaggagaagagggggttaatcggcgaacaatagtaaataaggggaggcggggggagtgggctcactgtggaggtcccggtcgagagaaggaggcggcggagaggagatcccggtggcggcgacgacggtcctggcgtggagactgagaggaggtcccggcggccgtcgagagagttagtgaggcggcagcggtggagagggcagcagcgaggagggcggtggagaggtcgaggcggcggtggagagggcggcgtaaagggcggagatggcgacagagagggcggtggagatggcggcggagaggtcgaggcggcgacggtggagatggcggtggagatggacggcggcggtcgagagagtgagtgagacggcgccggtggagagggcggtggagaggtcgaggcggcggtggagagggcggcgtatagggcggagatggaggcagagagggcggcggagatggcggagagggcggcggatttggcggcggctagggcggtggtggagaggtcaaggcggcggtggagaggagggcgtagagggcggcggagaggtcgagagaggcgagtcggcggtcgagacagtgagtgagtgagagtgggtgccggatctggattgatctagaagatgtccaaccctaggtcaaccctagtcaaactcacatgtgacgggcgccaactatggggccgtcacaggtggcctcacctgtgacgggcgccaactgtggagccgtcacaggtgaggctacctgtgacaggcccaacactctgggccgtcacagatgatgtcacctgtgacggccccacagttagaacccgtcacaggtgagtttgcctacagcaattttattttattttatttcacttagttcttttatttttcttaacatatttccacatacactatatatttttgttatacttaattattttatttcactaacagtagtaattgcacttcattattttactaattgtattattttatttcaatggttatactaatttaattattttatttcacttctagtgggtgcttcacttaattattttatttgactatttcattagcaatatactattgatcattgcgaacatattagagtcatacagataacagacatgtagacataaactacgtacataaattacaaaaataatccttcctcatggtcgacgcgtgcatattgaacgtcatcttcttcttcctcctcttctagaggtatttcttgacctatgccatggacgtgctggttgtaatcatcctcgtctgcaatattgtccaatccaacaattctccttttcccttcacgaacaacatgtagtttcttgttacacgggtcaactatgtagaacacttgaacaacttatttggcgagaacgaacggttcatccttgtacgcgttgttagccaagttgacagtggtgaaaccttcattgtcaacttttacattgcgaacatcgacccatcaacaacgaaacaacgggactttgaacttcaagtaatctagctccaatatttgctcaactctaccatagtattgatcacgacgaccaccgtcactagcagcctcgatgcgtaacccactgttctgcactgtgcatttgctgtcttgctttaccgtgtgaaaggtgtatccatttatgtcatatccttgccaggtggtggcactccattcaggaccctatgacaaccactaaagtgtttcactagacaagttctgcaacctggcaattcggttcttcagccactcattgaaagaagacatgtgcttatttctgacccaactctcttatcggcctgggttctcctgtcggagaactgtaaggtgttcgtcaacgtaccacaccacatcagtcatatgctgcagtaccgtgaaatgagctttatcgtacaccttccgatccaacctaacagtctttcttccaacagtaccaacaccatcaagcctcccttcgtgatgagatcgtggtaatccaattgaagaagtttctgacctatagtccacacaaaaatcgatgacctcttcggtggtgtaactctcgatgatactcccctcggggtgtgaacggttccgtacataacccttaaggatccccaggtacctttcgcaaggatacatctgcgtcataaatgctggaccacagcactttgtttgcctcacaaggtgcacgggaagatgttccattatgtcaaagaaagttggaggaaagtacatctcaagatgacatagggttctcacaagttctgcctgtagttcatctagtccctcgggatcaatgatcttctggccgattgcatggaagaaggaacacaaccgctggatcgtgtgtcgcaccttaggaggcaaaatattccttagtgcaacgggcaacagctgtctgataagaacgtggcaatcatgcgacttcattcctaccaacttaagatcttgcagtgaaacgagcctactgattcttgatgagtaaccagatggaacctttataccactcaaacatgttagcaaatcaatcttctcttctttcgagagagtgtagcaggctggaggaaggtaaaccctgccggattccgtggttatgggatgtagttccgagcgaacacccatttcttccagatctcgtcgggcgttgagaccatcctttttagtacctgggttaagcagtaatcccattaaactctcgcatacattcttctcgacatgcatcaaatctatgtagtggcgaacttcaagatccttccagtatggtagtctccaaaatattgacttctttttccacatgctcctctcttttgtcttttgtttttccacatgctcctctattttttccttcgacgtgctcttctcttttgtctttccaactttcctttttttttccaaactcgttggttattcccatcaccaagttgtgcacctctgtccctgttagctctgccgagggtccggctgtatctctgtgtccattgaaattctttttcatattcctatacgggtgataccttgggagaaatctcctgtgacccatgtagaccgtcttgtgtgaatgcttcaaccatttgcttcttgtttccttcatacactccgaacatgtccatttccctttcacagtttgccagaaaggttgccaagggccggataatcgttgatggtacaaaacaacatcgcatggaggttgaaatactcttgtgcatatgcgtcccatgtccgtgtgccctcattccatagcctttcaaagtcatcgattatcggttcaaggaacacatcgatatcgttgccaggttgtctcggtccttgaatgagcatggcaagcataatatactttcttttgaagcacaaccagggaggaaggttatagttaacaagcagaactggccatatactgtgacgactgctcaaatcaccaaatggattaatgccgtccatacacattgcgaaacgcatgtttcttgggtcatttgaaaattcctggtaaatcctatcgattgtcctccactgtactgaatctgctgggtgcgtcagcatactatcgactttccgttcttcggcatgccagcacactagcttagcttgttccttattcgcaaacattctcttcatgcgctccgcaattgggagataccacaccacctttgttgggcctcccctctttgacttacttccttcaccttcactctttgctcgtttgtatcttgatgccccaca

SEQ ID NO: 86993 - DNA, 9135 bp, Oryza sativa
caaatggagttctaagatcagatatcagttagatggatcagttattcagttgagacttgagttcgtaaatggattcaaatagctgcacaacgtggactattgcgacacctttagtccggttctcaaacctgctacactgaccctaatgttgtctctagcagcagtttcactgggctgatctttattccaactaggaaggtagcccgcgcagttgcgcgggcactttgtttgatgttgcttaaatttttattacgaactttttataattgtttgtttaagggttctttttttctgaaatgttttttttccaaatccattattgtttaataaacatgttctatttgcacaataaagctcgtgccctctaattagttagctttttgttacatacttattgcagtctaatcatctaagaactaaaaaataatgcaatgcttatgctaatgggtaaacatctaattagttagctttatatgtcaacatttttataaatatgaatcaacttttgtgtaaacatctaatactaaaataggttcctgttgtttatttattcatggattgaggggattcaaaactatgttaaatacatattcttgtagagtccaattctattgtgcagtgtaggagacaacccataagtgtgcgaagctagcgagaacacaattattggatggttaaatattactacaaacatatcattatctggaatgagcttttatatgattgttcccataatttcattttttaataaaatttttagttaaatattaggaattatgtaatcgaaagtaaccaacccacaaatattttgtttagctagcttgcattgggcatgaattagtaacaattagattttataatcgtttatctgaagcctataatgtctatccacttgtcataattatcacatattctatgaagttctaaaagaccctagaaaatatgtgtttcaaatatcagataaattatttgaaagctttttgcatttgtagcatggaatttgtttggtcactatacaatccacttgcaccttctactcaatatgccctatggtgacaaaaagtaaggcctagctggactcaatagcactcctcttatcctctattgatgcactattattatctcattaaaactggtctactcagtgtctccctgctttgcttgctgtctcattctagtttgcgcaagaaaatttttgggttccaaagtctaaacaatacattgtaaattttttctgtctagtagatgacaattgtttggtgataatggttttcttgcacctccaagtcatcatgttgcatggttgtaaaacttgtatatatgctgagacacggaggttaccatacgattcattgtagtagtgtttacagtttcgatcatgtttagttaatctttcttttcatgtctcggtgtatcgtaacacataaatggattcaaaatttaattcttcaagtgaatatgtgcatggtgacatgtttatagaaagttaatgtccatatatatggatgataagatctttttaaaggtttgtgcacagagaaaacatacttttttttcatacccgtaaggtatggaatataagcacatagccaccggcaagtatatatatgtaccatatactaaaatgctattaaataccgtctaataaagtaatttaaatgttacatagaatatattctagagcacttatgtagaagatcgtttggcactcttggattatttgagcacattttagagaattcatgaattcgattgtttcctctaactggcaaaactacatttttcgatcaatcacaaataaagatataaaattataattgttatggtagctagagtcaaaagccgaccttaaccaaatatgtcattctggatatgtattggcagtgaaaacataaagtaaacatcgattgtaccaatatagcccgaggggcattgtatgtatgtacatacgtgcaccatcgcccaacatccacccctctgccctcattcatgccctctccccatgtattgtctctcatgttttcatcatatattaatcatgaaccctaatttattataatcttttaaaataaataactattttttatcgaggacccatattaactatatttgaacttctaaaataaatattgtattttttgttatattctgacttttttcatatcatttaaataattattaaaaatatgaaaaaaccaatgatatataccttacctgttgaaaatatttttggtgaattttctttgcatctatgtataatttaggatttattacaattaaaataccaaccaaataattttgaaaaattccaaatgatttgagaatgttaatcttacacaaattaaaatttaaattggatctacttaaaaacacaactaaattacatggtttgcatttttacatagttcaaactaccgttatatatttgttaagtaatatttgatgccataaagtatatagtttgatgtgattacttttgaaaaattgttgtggagttaattaatacatgtggatgtcatctgccacaatgtattttgtgctaaaatatagcgaatataagacatccatgtaaaatcataataaaataaatgataattacgtatttttattagtaagatgaataatcaaacacatgctcaaaagtcaatagcggaaaaaagtaatataaaaatatttaggggtatcctaggttaaaaaataacagtagggtgaatgggaagaaaaaaaaaggggatgagtacgtactacctgcctacatacatacgtgtgagggagggtggaatatgtacgtcagtacgtgtactgagggagggagggaagagtagatgtacgtgcagggacagaagaggaagggataaactattggttttaatctaatctaatggtgtaaaataatggatccaccagtttaaatgaaaattgagggttagatgtttctcgtctattaaaacgccatgtggcggcttaggagcatttatagggggtgccacgtggcggtttaggagcgtttataggaagtttaatggacttttagtatataataactaggaaggtagcccgcgcgattgcgcggatatgcgtcgtacgttaagactgagatatttataagagcgaaatattaaccggtgaacatctatcacgatttctccataaatttttttcgtcgacattaatttcctttataattttctaacctattagctttctattatatcatatttaagtaatatctataagcaattatttataatcttcttcatcatttgaaaagaaggtagacttttttcttaagaaaacatgtcaatgaaaagtaagtgtaaagtaaaactaaggtatttttctttttttaattgcatatatattatcatgatttattcgaggattaattgggtgggacgtgaagctccactaaatatatgggtttatatagcctaatatgattgatataatttgagagccgatccatctatgaacatttcatgtagagtgggtcagaagctccatgcacaataatattttttaaatgtgatgtaccatgtatagacatatgtttttcttatataagatagatctaactgttaaatataatgattccacatgcttaaaaggcattggagtattccagaaatatagcttaaaaattatggttgttttaatatctaacattattgtgaagtgaacttagctcaactggttatgtttgttgtgatggaatttgcccacttgggttcatgtcctagacttggacaaattctttcagtaataggtaacatacccatcgacagcgagaagtacatagtgacttcgtcaatctcaaaatatgtcatcctagtctctcggaagtactcataggggtatgtgcatgtgtgagttcatagaggtgagtgtgcgtgttgtgagcgcccgcgtttgtattttattttaaaaaaatatcaaacattatttattgtttctcttttaatttaatagataaaacaatagggaggggacgacagtgttgtgtagatgtgagagtgaggaggaggtggagattttgtttttccaatttttataatttttctaaatgatttaagtgaaatcctatgacggggtgtttcattttttctaagaatttttaaggtttatcccttttttaatagggcgtgccccatggtaacttaaaatttttctaaaaaaatagatcaaatagttaaaaataatggatacgtcaatttaattgaattaatttaatctagcacctcgtatgtccagccacgtgtccctcggtgattcgcagtcagtgttagttatgttctttttgtttcttttcgtgggaaaaaaaggttggtggttactccctatgtcaaaataattagagataaatatggacaaattcacatttatccatatcttaactacttaaaaattagtaactttctaatcgtcgtcacaataattttctgtccgtcaatccgaccaagcggcaccctccatccacatacacgcaattacatcccttacgatgcccaaagaaaaaaatggagtttgattcaaaataagctaacatttctcacctattttgaccggaaattataaaatatttcctccggtgtcctatagccaattacacaattttcgtagtgtccatcagccatgtcacgtttttacggtgtctcccaaccaaatacacgttttttgggtgtcctgtatgaaattttgcctttttcttataattataggacatattatatggtgatttatgagcgctctagtgggctttaattgatttttgttacatatagtgatttagcataacataatacatatgttcgattaatttttcttatttagttgccatccaaacgatagggtctaccatcaaatgatgtattttaactttttatagtaaaatatagctaatgttatcttgatttatttatttaattataaataaaataatagttatattatgttagttaaaaaaataagaggacataattgaattggagaggagatgatgggtgagccagaggtatacgtaaggtaggaggaagggaggagattattgtttttaacatagattgaatgggtcctagttttgagttatctatttttataaacacatataatcttagatctattagaaaatactttgtgtgttgtactttttaattaaacaacttaaattgtttaaagttgttctaatttaagtgtatgttattaatcataaggtttaaaaatctatatatttttcttaaaaatgtatggatcagtgaaaaacaatagttattagaataatatgacccagagtaatgatttttttaataatatagttaacttggatcttcaattttatgttttatagtaaataatctaatggtgtgcaccaataaaaagctagctatatgatttagataatataattgtctaaaattgtttatcctaaaatattttttccatctaacagaaagtggaaaataggatagaaaggaaataggtggagaggtacgtacacacaatgagtccaccgtatattagtgaaaatcgacagccggatgttttgtttattctcgtaatttttgtgatttttttaatttattaaaataccacgtggtggtgtaggagcgtttggtggtgtaggagcatttgtagaagtactacgttgtgttttaatagcgtttatatgatatttaatggacaaagctctaaatatgcttcaatgtgataatttttaaattaaaatatagttaatatcaaatgtagtcgtaatattttcccacatacatctatttattatttagataaatttattagaggacgggtgaatgttgatattatgtataaagatttgaggagtgaaggacggtgcgtagtttgtacaaacttgggagaatattttttctcaatccagtgaacagtagtacgtattttacatttgagattttttttcacttttttgggtgaaccgtacatatgtacgtgtcactcgtaacaattaggtgggaccgtggcagggctaaaccttatttttttcaattgtaattacagttttttttttctttttttcagtgagtagcaaagtacagaagtacgtatatatacgtgtaactattcacgtgattttttattcgagcaggttacgtgggatgtattttaaataaatctaatctaatagtttaaaaatagtgggtccaccaataaaaatgattggatgtttttttctcacaatttacaaggttttctctaatttattagaacaccacgtggtggcgtagaagcattcgtaggagtgctacacgactatttagaagcgtttgtatcaagtttaataggtctctaatgttacctattgcatgtcgacccgatgtgtcatgatgtatttagtaccacaacattacttttatacaccgatactatatataattaaaagaatacaatcgatcataaattgggcatataattaaaaataatttaaaagataatgtttagagaccgttcatatgatatttgatatttatattatagatcatatacttccgtatattatgtagtattatattttatattatacaaaatactattttagaccgtcattttttccaacagtactaactacacatttttttttggctttatcattttttatcgtacacagatgtttttattcttccgcctaaccgtaggaagctttatttgtttttttcaattatacttgcgtatggacattttctttccttttcccagccaccagttgcatattttttttaagaaaaactatcaatttttttaataatagatctaatctaatggtctaaattaacgggttcaccaatttaagtgaaaatcaacggtgagattagatagtgccacgtggcggcctaggagtgtttgtaggagcgccacgtggaggtttaggagcgtttgtagaaagtttaatggacttttagtatataatagatagatagatagatagatttgatgtaaaattttctatgcacggtgaacttcatctagatttaaatatgcaaaagagaacctcatgtgttctttgatcctgctcactcaatacgtatctggaagctagataaggtgttgtatggaattaaccaagcgccacgtgtgtggtactatgaagtatgaactatataaactgagtattaagttgcaggagttggggtttacagtttacaccattcaaaagtgatatttttcaatttatcttccatcaatctggtgtcatcatttacatctttgtctatgtggatgatgctactattgctagttcagctgcaaaatctgacactggaggactgattcagtaaattacagccaagtttgcaatcaaggtcacaggggagctgtcatattttctgggtattgaagcaaataagcaacctggagatggagtgaatctgacacgacagaatcaatttcaatttgccaaaccgaatgctaatcctactatcctatgtcatgttcagacaaattagctctgcattgcggaccttttggcttctgactttcaggagctgagatgagatgttaaaatactctgaaatactcggttaataaagtgcttcagaattcacaagttcatactgtggtcagctgtaaaactgattttgccgatctcagagattacagcgttctctgaaatttaagcccagtagtgtgacttggacccaacatgatttcctgttgtcccacaaaaaccgaacagtcccacgatcgaatacagtctgattataaatgcttgacgaatgcagaaaaaagaactggttttgtctgaaagtaaaatatggacacttttttttttctgaaatgaactatgggcacaaacacagtcggtagttttgggcatattccttttcgattcttctcctgcaaagcatttttgcaactgtttttcattttgtacttttcagctgataccttaacaatgtgcaactacaacattttggtgattggtttgcagccaccgccttaatattgtcctgtgttttagctgctattttattggcttatgtgaggcactaaaattcagatgtttgacacccagcatctgcttgggccgaaccttgcaaacagcagcaaatatccagcccaccagcccatgagcccatctccctcgttagctccttcccccaatttcgcctggatttttttagattggtaatttcgcctggattttttttagaccggtaatttcgcctggattagcgggagtagttttcggatcagaaactttttgaagttttgaaatttgaaatccaccgcctaatttccatttcccacgaggaagcaactacttatgcggttatgccgagaaatccgcgggggacgccacgatcagttgatcaccatttccaccgatcaccaccagagcgaggaggagacgatggagccgaatcggcggcggcgcaagacggaggaggcggagatctccgccgccgaccgcttcgccgcgctgccggacggcgtcctcgcccggatcgtctccatgctcccttactgggacgtcatccagctctccgcggtgtgcgcctcgtggcgccgcctccgcctccaccgcgccgcgcccgtcgtcaacatcgacctccgcgagttcgtgctgttcggcgccttcctccccgggtacgtcgtgctcggccaccgcgccgcgctccaccggatgcgccgccccgtggacaagctcaggctgacctacttcgccgccgaccgctgcatgaacgaggaggccaacgccatcatcagggccgtcgccgcgcgcgagatccgcatcaccatctgccacggccccggcggcgctcgcgctgcccgcgcgcgccgcctggacgagtgggacgtcgacgtgccctcgacggcgacggatctagacgtccgcgggtctggctaccgcgcgccggccgtctacgccgactgccttcgggtgctcaccctctatcacctggagctccacgacgcgccgcgcctcccgtccctccgttcgctgacgctccagagcgtcctcgtcgccgcggccgtgccgttcgccccgggcaagtggtgcccgcagctggagagcctggagatggagagctgcacggtggagtaccggcaggtggacatccgcctccagctgctcaagctgctcgtcatggacgacgtcagcgtcgg

SEQ ID NO: 86994 - DNA, 588 bp, Oryza sativa
agctccgctcgttctgcgcgcagggcctccacttgggtgttgaacccatccagcactgcggtgtttgcggcggccagggcctgcagaaggggctcggcgctcagcggggcgacagaagatgaggagaagagccgccttggagaaaaggcgacgcggcttggccccccggaggatgcgctgggctcggggatgtcccccgggcccgtttgatcctgggcgtcgcccggtgaggtaggcccaggcgatgcgcccgcggcctcgtcgcgagccgcctcggaggatgtcgcctgagggccgcccgagggagtgggcccaagtgacgcgccagcagcggctgacgcctcagcctggcgagcccgggcggcctcctcccgggcagcttcttcggcttggcgagcccgggcggcctcctcccgagcagcttcctccgcttggcgaacccgggcggcctcccgggcggcctcttcagcttcccgaaggcgggctgcggcttcacgccggtcagactctcgcctccgctcctctgcggccgctggatcttcggcctcggactggccggacttggggtggcgggaggaatgcgacggg

SEQ ID NO: 86995 - DNA, 518 bp, Oryza sativa
cacgagcgggattatcttcttcctcggcgagtgcctcgttagctggcagtcggtcaagcagcaggtggtggccctgtccagctgcgaggccgagtacatggcggcctccgccgcttcgacccaggcgctctggcttgctcgactgcttagtgatctcctcggcagagacactggagcggtggagcttagggtagatagcaagtccgccctggccatggcaaagaacatcgtttttcacgaacggagcaaccacatccgggtgaggtaccacttcatccgaggctacttggaagggagcatcaaggcgagctacatcaacaccaaggaccagcttgcggacttgctcaccaagcctcttgggaggatcaagttcctcgagctctactccaggatcgggatggcccaacttccccacaagacgacgcacaagacttagggggagaatgatggataagtctttgtggtccttggtcgtgggtacttccttttcttttgagtagtttcaccttttcaggaca

SEQ ID NO: 86996 - DNA, 664 bp, Oryza sativa
  unsure (1)..(664): unsure at all n locations
caacttacccgttcgcctcgcggttgccgaacacaccgtcgctgacatgcagcgcgcgctggattcttccatcggggaggccgaggccctccgcttggcgggcgagatggggcccgacatgctttgggactcggtctcccgcatggatcgcgccggtcggcaagcgggcctctggaaaggccagacgaggacgcgcccttgcaacctggaaggcctcgctccgcacctcaacaggatggcctgggtcctcgaacgactccccgaggagctcgagaagaccatcaagtcatcctcgagggacctcgcccggggggcggtcgaactcgtgctagcgagttaccaggcccgggaccccgatttctctccctgatggcgctggaggagttccctcccgggaccgaggacgacgcgcgcgcgcgggtcggggatgctgccgaccacatcgtcaacggcttcgaggggtcggcccctcggctcgcgttcgtctccagctccgacgaggagggcgacgcnncagccgggtgaggaattgacgggtggcgacgaggccggctacccgggcgcatcggaatgagcccccgagcccccgcccatccttacctttttttctttttctttcttctaaggccttcatgcctcgggtaccgagctcgaattcgcctat

SEQ ID NO: 86997 - DNA, 8958 bp, Oryza sativa
ctcgtgaaaaacggctttgaaatcgggaaagccgattcaaccctctttactaaaagacatgataataatatttttgtgtgccaaatatatgtcgatgacattatatttggttctactaacaagtcttttagtgaagagtttagtaggatgatgaccaaacgttttgagatgtccatgatgggtgaattgaagttcttcctcggccttcaaatcaagcaactcaaggaaggaaccttcatttgccaaacaaagtatttgaaggacatgctcaagaagtttgggatggagaacgccaagccaattcacactcccatgccatcaaatggccacctcgacctcagcgagcaaggtaacaacgtcgatcaaaaggtatactgttccatcattggctcacttctttacctttgtgcatctaggcccaatattatgcttagtgtgtgcatgtgtgcaagatttcaagccgctccgaaggagtgtcaccttgtggccgtgaagagaattcttagatatttagtgcacacccctaaccttggtctttggtatcctaagggagcgaggtttgatctcattggctatgccgatgcggattatgccgggtgcaaagtggataggaaaagcacattgggtacttgccaattcttgggtaggtcccttgtttcttggtcttccaagaagcaaaactccgtcgccctatccaccgccgaagcggaatatgtttcggtggggagttgttgtgctcaacttctttggatgaagcaaaccttgagagactatggcctcaatgtatccaaaatcccactcctatgtgacaatgagagcgccattaagatagccaacaaccccgttcaacactcccgaaccaaacatatcgatattcgccaccatttcttgagagatcattccacaagaggcgacatagacatccaacatgtgagaaccgacaaacaattggcggatatatttaccaagcctctagataaagctaggttttgtgagttgaggagtgaactaaatattttggattctcggaatgtggcttgatctattgcatgcatgtttgcttggtagaataggtttgcataccactttgtgacaaaatggtcattcaattcatggatggacactagtcattttttttgtggagattttgaatctatgtgtatggggatctcatttttcaatgaattttggtcctagcacaacttgaaatagattcacacattccctctctcgagggtgaattatcttgtctcatggtaattccccctcttttgatcccttagatcgtccatttgacttgtggctattgttttgtgtgattgattgtgtgctagtcacaagttcaaatggagcctctagtgctcgaccatcccttcctttctatatcctatcaaaaatccttgtaaaaattgttttttgtcaaaattcctttaaaatgtttgaaaaatagtttcatcaaaattcccggcgaaatctcattgcaaagctgtgttttccaagaatttttggactttccgaaaaattttcggacattccgaaaatctctatcctgtcgctctttcaattgctgcaatcccaggatttttcggactttccgaaaatttttcggacatatccgaaaatcatcagaaccgtgcgccactcttctgtatcctttcggacatatctgaaaattttcggaaatatccgaaaaatttcggggtcttcatatatcaccccgtggactcccttctctctcctttccacttcttttccccacgggttgcctccctcctccctccccaccggtgactccccggcgacctcctcctctccggcgacctcccgcgacacccctcctctccaacctcgagggagcacgtttggggcacttcttgggccctacattgtcgatcttcaccgtgttcttcccgtgttcttcacgttcttgaggtatttgcccttcaatcaaatccctagattcctcaagatttctcttgcgatttcctttggtggagatgttcccctagtgccttaggccctgcagattcaatttcacaagtttttgttggcggatttgtgcggcatctgagttatagagttcggcaaaatttttcggacttgtccgaaaattttcggatatatccgaaaattcctggccgacccctatcacttcagatttgcatgtttcttgctctcaatcacttgtttcttgtctccttggcttccatatctgactccttgtatctctattgtttgaaggatgcctctccacaagcaaacctcccacaagtccaagcgcccgagggatcgctctcccactccatcttctcatgatgattcggacagtgattggtccggtggagaggatgcggttcctcaggttgcgcgggtggctcgacggtctactcatgctcatgatggtggtggtgatggtgagggctcctctcgtcaaccgcaaacgccgccgcaccaacccaatgtccccattgggcctctccgcattcatacccccgagagggatccggcggtgattcgccaagtgtatgattggcggcgcaagtctgaggttgttgctcctcgtcgggatgaggatccgcgctcccttcgccgcaccgacacggatccgcggttttggactctctttcaacaagacttttatgagtctgtaattaaggtccaaagctcatcccactgttcccatgcaatggatcaattgggaggagctgcaggcacataatgatctggtgatcaactctgtgattgccaattgtgatctcatggatatccgctccttcatgacgttgcagcaaaattggtgcaacgagatcattgctcagttttacgccaccgtatactggatgactcaggggtcctggtactctgtttcttatcagcagttgtctgagatctggggcttccgtcttcgttctttgctaaaccttgatgaccttcataatcttcaaattcctgccaacacagacttgcttcccctttacactcaaaatgatccaaatgtggtgttgggcaaggtcgacggcctcaagctgtactttgcctacttgaaccggatgtttcaccggtcttttgtgcctaaggatggtgatgctagcagcattaaccatctctctaggaccgtgcttctccggtttgatccccctcctcatcgcttccatgtctatcactttgtgtgggaggagatccgcatggcttcaattcagtacaagaaggggttggtctatgcccctcacattatgcggatgatcgagactgtgactcagctccagtttcgccatgatgtgactcattctcagcttcacttgcgccttcttaaggccccctgctcctcagctgctcgggacataccctcctcttctacccagccgcctcctgctcctgagcgccctgcctctgtggctcgtcgtgagccgtctcccttattccgcattttgcggagtctttttggtctttgctccgaggaggccaaaaagaaccgctgattgcggaattcggcgaagaagacggctcgtgatgtcaagttcctaaaggcacggtattatgaggaccaccacattgatatccctccttctcctccgggtttcgaggccgagcccgatgagccggaggatgaagagattgaggatccttttgccgggttgccttccgacttcgacttctttggatatggccatggctatggctatcctcctccaccacctcccgaggatcctcctcaggcgcccttcgcttgagtcgtcagctcatcgtcctctctttttggtgtcttgctgccaaagggggagaatatctatcatagctttagtttatctatcttatccttagcgtcgagcacggttggtttttatctgtatgatattttttgtgttttttatgttaagtttaaagctttgtaagtctattgtttaattatgaatgcttgtgatgtaatggatcctattatctttaatgtggtgcaatatcttatcctctttatatggtgcttgtgatgagatgtaattattcatttgcatgtgatgtgttggatgtgatgagcatatgtgatatatttattctcttgtgagcttcaatgtggatgcaataatttagggggagctctccacttgcttttatgcacactcttagggggagcttccactaaaactttgcaccaaaaaccttaaattatattcattctctcttgtgttctaatcgtattgtcatcaatcaccaaaaagggtgagattgaaagtgcatctaggcccctaatgattttggtgattaattacaatgcgattagagaggactaacatttttatttaagcaaatgtgaaggttgtcatgtcctcaaagagttagcgtaatgcatatcccgtggaatacgttgatgtgatgtgatgcggcaaatgagaaaatgatattttgtacgttttcgtttccttgagttaataggaaagccgcactattaagaggaatgatgcattgacatacgaggagtgatcaaagtgctcaaaatctatttttaaaaggtgtttctcctcagtttggtgtgttctggattttttcggagttttccgaaactcaatttcggactttccgaaaacacacagaaccaaattgtcgcttctggaaattttcggatatgtccgaaagtgattttcggacttttcgaaaaaaactgcgaaggcaaaagtggttctgtatattttcggacttgtccgaaactgattttcggattttccgaaaatcatcagtagagtcaattttgcatctgtatattttcggacttgtccgaaagttattttcggacttttccgagaacatccagaacgatgttgttggtactagaaattttcggacttgtccgaaaagttttcggaatgtccgaaaaatccttcgttgactttgctgttggtgctgagctggaattttcggacatgtccgaaaatctttcggaatatccgaaaatctcaattattgtgcataacgggcagaatctgggctgtggctataaatagccccctcccctcacttgtgagggctgctggttccattccaatcatttgtgcccttggcttgctctctctctttagtacttttgagccttgctttcttgtttcccctcttacccgtgttcgatttggatttggtgtgtgtgtgtgtgagagttgtggattcgagtttgtgtgagtgcttcttgttgacttcgtgaagatttgtgagcacttgcatcatctccgggagttctttacttcatttgttactcttggaggttgaggactcctaggcggctaggtgtcgctcccgagccaccgatctacttgtggttggccgggggaagtttgtgaaggtcggatctcacctccgaaagggaagagatagccttagtggaaagaggagtgcttagtgcaacctcttgaggaaagggttagccaagacccggctcttagtgagctcctcaacggagagtagaatcccctcaaggattcgaacttcgggaacaacctcgtgagcttcatctttggtgactttacttcctccctctcctctagctttgcttgtttgagccgctataggtctagttgctgtttgtgctagcatattcttgttgtaggcaactagatctaggatttactttcctgtttgtgctgactctgaaaattttcggatatatccgaaaatttcggaaatatccgaaaattactgcttccgcttttagttgatttttgaattagcctattcacccccctctaggcctaattgacactttcaatcggagtacgaacgaagtcccagggattgaaacgacgtgggccgttagatctccttttagtctttttatatataaaaaaaagaaaaaagaaaaggaaaaaggagagcgctacagccagccatagccaccacacgcctgcgctcttgccactgccgccctcgtcctggttgccgccgccgtctttgcgccgccaccacggccatagccggaggccacggacgtcgtcatctatcgccaccggtggtttcttttcgttttgcttatttgtggtgagttcgtgctgctgctcttcttctttcgtttccctgctgtagccgatctgatggcttgttgttgctgctgccatgatctgctgctggctgctgctgccgcgatatgctttttgctgctgctagggctgctgctggctgctgctgcgtgtggagattatggataccccatacctacacggcatgtataaccgactgggtatggggtgccatgtatagatagaatatctttaaagggactcgggttaaatattaaacttgtatgtcaaggaaatatccagggttctagtcggttaagattgtattttatctgtaactacctattccgttagggatatggtctgtactttgtaatatggactcctctcctatataaggaggggtccgggtgcctctaggggcacgattttttctcccagatcatacaatcaataatatactcggcagatcaatccccagacaggagtagggtattacttcttgaataagaaggcctgaacctgtataaaattccttgtctctgaacacatctacttttccagcttgatagccacccccttttagtatgccgaaatcttgtttcgccagttggcgcgccaggtaggggtagcgtcaagttcttcgccgactagtacgatgggttccgtctccggcatcgacgacttcgtcttccctcccgggtaggcatttcgattcggcggcctcgacttcatcaccaacgacttcggcaagatttctctcctcgactcggattcgaaccagtcgggaagaggccagatctctgccccgttcggtatcccgaactcggccgaggtctactccaagatcatctctcccgagttggcttcaaaccactcggacgagatccaatctactccaacacgaccagatcaagatgatgggtcctatcccccaatcctaatgagacttcccgacgatctggctgctgtcttcatgaccaaggcgtctcccatccgaagacctagacgggattcggctttagcccagatccaatctagctctaaggaggtcggcgttatactccaacctctcgggacggtctcgactgaagaattggatggctacctcagctctcccggcgtcagttcctgaccaacggagatcctcgagtacgacgacttcggctaccactacgactacggcaacttcaacggcttcgacgatggctatgaggacgactacacgcctctctttttcggcgtatttatggccgacaacgagacggcagaacaacgccgagcccgagaagcggaagaagagcgcacgcgacaagaagccgaacgtcgccgactggaggaagaacgacaacaacaagagcgagaacgactacagcgtgaacaacaagatcgcgaacgggttgcgaaggaggttgaggatcgacgacagcgcgccttggaatccgggcgacgagcacgagatctcatcgggcaacaagacgtcgacgggacagcggttttccgcacaccccagcaaaacgcggttgcagtgatcaccctcctcgacaccctcctcaaggaagatgcgctcaatcaggccgatcatgtcgtcaacatcttgaatcagacgaagaccatgatcgccgcctcgatcccggctaactccgcaagcacccgcacgccgactggcagccgagtcctccctctccgatctcaagactatcaccaaccaagcctcagcgtcgttggcgccggatccaatcgcaggagcaggggtcacgacgagcgatctgtccattcacctcccgaacgacacagggagcgccgagttgaacgacctcgcaggcaccccatcgatcttcacgataccatcaaccagcgccgcgcggcaagaggctacgctccccaccgttcaccagactgctacgatgacgacgtggatggtgtagctaccttcacggccgacctgcgtcgagtggattggccagccggcttcaaaccgactggaatcgagaagtaggacggcaccactaacccggagtcctggctcaccgtctacggtctcgcgatccgcgctgcaggaggagatagcaaagccatggcgaattatctgcctgtggccctagcggattctgcccggtcctagcttcacgggttaccccgtggcacaattggatcttgggtggaacttcgcgaacacttcatcgccaatttccagggcaccttcgaacgccctggcactcagtttgatctttccaacgttgtccagaagtccagagaatccctgcgagattatatccgacgtttctctgaacaacgcaataagatctccgacatcaccgatgacgtcatcatcgccgccttcaccaagggcattcaccacgaagatctagtcggcaagttcgggcgtaagcctcccaggacagtcaagcagatgtttgaaaaagctaatgagtatgccaaagccgaagatgctatttccacgtccaagcagtcgagcaccacttggaagccgaagaaagatacgccgactactggggggagtggaagtactcatcacaaggatcgcaagcgtaagcccgaggaacttgtggcaactactgcgccaacctcccgacaacgttcgcgcgtcaacaccttcgacaagatcatgaactcccaatgtccgcaccatccaaattctaaccacgcagccaaagattgcttcgtctacaaacaatttgcagagcagtacgccaagaatacacgcaaaggcactgacggagatcaaagtacgtcaaagaagaaggatgacgaagatgttgccccgactgattttcaagaccatcgcaaggaattcaaccacatctttggcggacccctggcttatgaatccaagagaaaacaaaatttgactgaacgagagatcaatgctgtccagcccgacatgccccaatatcttcggtggtcagaaacgacaatcaagtttgaccgctcggatcat
